United States Patent 9,254,311 (MODIFIED POLYNUCLEOTIDES FOR THE PRODUCTION OF PROTEINS) - sequence listing, part 20

SEQ ID NO: 42123 - DNA, 1104 bp, Artificial Sequence
  Description of Artificial Sequence: Synthetic coding sequence
atgtatgccatgaagtacatgaacaagcagaagtgcatcgagagagatgaggtgagaaatgtgttccgggagctgcagatcatgcagggcctggagcaccccttcctggtgaacctgtggtacagcttccaggatgaggaggacatgttcatggtggtggacctgctgctgggcggggacctgcgctaccacctgcagcagaatgtgcacttcacagagggcaccgtgaagctgtacatctgtgagctggccctggccctggagtacctgcagcgctaccacatcatccaccgggacatcaagccagacaacatcctgctggatgagcacggccacgtgcacatcacagacttcaacatcgccaccgtggtgaagggagctgagcgggccagctccatggccggcaccaagccctacatggcccctgaggtgttccaggtgtacatggaccggggccctggctacagctaccctgtggactggtggagcctgggcatcacagcctatgagctgctgcggggctggaggccctatgagatccacagcgtgacccccattgatgagatcctgaacatgttcaaggtggagcgggtgcactacagcagcacctggtgcaagggcatggtggccctgctgaggaagctgctgaccaaggaccctgagagccgggtgagcagcctgcatgacatccagagcgtgccctacctggccgacatgaactgggatgctgtgttcaagaaggccctgatgcctggctttgtgcccaacaagggccgcctgaactgtgaccccacctttgagctggaggagatgatcctggagagcaagcccctgcacaagaagaagaagaggctggccaagaacagaagcagagatggcaccaaggacagctgccccctgaatggccacctgcagcactgcctggagaccgtgcgggaggagttcatcatcttcaaccgggagaagctgcggcggcagcagggccagggcagccagctgctggacacagacagccggggcggcggccaggcccagagcaagctgcaggacggctgcaacaacaacctgctgacccacacctgcacccggggctgcagcagctag

SEQ ID NO: 42124 - DNA, 1461 bp, Artificial Sequence
  Description of Artificial Sequence: Synthetic coding sequence
atgaggtctggagctgagcggcggggcagcagcgctgctgccagccctggcagccccccacctggccgggcccggcctgctggcagtgatgcccccagcgccctgcccccacctgctgctggccagccccgggcccgggacagcggagatgtgcgcagccagccccggcccctcttccagtggagcaagtggaagaagaggatgggcagctccatgtctgctgccacagcccggcggcctgtgtttgatgacaaggaggatgtgaactttgaccacttccagatcctgcgggccatcggcaagggcagctttgggaaggtgtgcatcgtgcagaagagggacacagagaagatgtatgccatgaagtacatgaacaagcagcagtgcatcgagagagatgaggtgagaaatgtgttccgggagctggagatcctgcaggagattgagcacgtgttcctggtgaacctgtggtacagcttccaggatgaggaggacatgttcatggtggtggacctgctgctgggcggggacctgcgctaccacctgcagcagaatgtgcagttcagcgaggacacagtgcggctgtacatctgtgagatggccctggccctggactacctgcggggccagcacatcatccacagagatgtgaagccagacaacatcctgctggatgagcggggccacgcccacctgacagacttcaacatcgccaccatcatcaaggatggagagcgggccacagccctggccggcaccaagccctacatggcccctgagatcttccacagctttgtgaatggaggcaccggctacagctttgaggtggactggtggagcgtgggcgtgatggcctatgagctgctgcggggctggaggccctatgacatccacagcagcaatgctgtggagagcctggtgcagctgttcagcacagtgtctgtgcagtatgtgcccacctggagcaaggagatggtggccctgctgaggaagctgctgactgtgaaccctgagcaccggctgagcagcctgcaggatgtgcaggccgccccagccctggccggcgtgctgtgggaccacctgtctgagaagagggtggagcccggctttgtgcccaacaagggccgcctgcactgtgaccccacctttgagctggaggagatgatcctggagagccggcccctgcacaagaagaagaagaggctggccaagaacaagagccgggacaacagccgggacagcagccagagtgaaaatgactacctgcaggactgcctggatgccatccagcaggactttgtgatcttcaaccgggagaagctgaagaggagccaggacctgccccgggagcccctgcctgcccctgagagcagagatgctgctgagcctgtggaggatgaggccgagaggtctgccctgcccatgtgtggccccatctgccccagcgctggcagcggctag

SEQ ID NO: 42125 - DNA, 537 bp, Artificial Sequence
  Description of Artificial Sequence: Synthetic coding sequence
tgaggactggagggcgtggtggtggatggccaggtggagacagcccgggtgtggaggggggacaggcctggaacagagggcaaggaggagagcggcatgctgtctgctgtgtggggcgctgggggccctggagctggaggagctgcccggggccagcccagcaggaaggagctgctgctgcggcaccacctgtggagcggcccccgctgcctgtccttccccctgggcagcctgcctgccagcctgctgggcctgcccggggccaccagccacaggagctgcctgagccccaacctggccagcggcctggccgcccggggcacccagacccagagcgtgctgtttggagaggtgcggctgcccctggatggaggagtgcggggggccaggaagaggagcctgctgcgggcccaccccaggacaggcatcctgcccggccgctgtggcatggtgtggaaggacaagaagctgcagcccagcggctgccacgagaaggccggcggcgtcttctgtggccccagccggggcggcgtgtag

SEQ ID NO: 42126 - DNA, 834 bp, Artificial Sequence
  Description of Artificial Sequence: Synthetic coding sequence
cccttcttccgggcccggggcctggagggcgtggtggtggatggccaggtggagacagcccgggtgtggaggggggaccggcccggcacagagggcaaggaggagagcggcatgctgtctgctgtgtggggcgccggcggccctggggccggcggggccgcccggggccagcccagcaggaaggagctgctgctgcggcaccacctgtggagcggcccccgctgcctgtccttccccctgggcagcctgcctgccagcctgctgggcctgcccggggccaccagccacaggagctgcctgagccccaacctggccagcggcctggccgcccggggcacccagacccagagcgtgctgtttggagaggtgcggctgcccctggatggcggcgtgcggggggccaggaagaggatgaactttgaccacttccagatcctgcgggccatcggcaagggcagctttgggaaggtgagcccccgggtgccccggcggccccaggccagctgcaggacagccctgtgccccccaggagtgcactgtgccgaggccggccatggagaagatgtgagacatgaggtgcatgagcaggccgctgtgcaccgggcccggcggggcccccagaggctgcccggggccggggaccctgctggggaccgggcccggctgcctggagagcccctggtgctgctgcccggccggggcggccacgtgcacggccggggccctgccaccggccggggccctgccctgcccccagctgctgagagagctgtgctgcggggccacggggaggccgtgcacctgagagatggcaccggcagcggcctgccctag

SEQ ID NO: 42127 - DNA, 1110 bp, Artificial Sequence
  Description of Artificial Sequence: Synthetic coding sequence
atgtatgccatgaagtacatgaacaagcagcagtgcatcgagagagatgaggtgagaaatgtgttccgggagctggagatcctgcaggagattgaacatgtgttcctggtgaacctgtggtacagcttccaggatgaggaggacatgttcatggtggtggacctgctgctgggcggggacctgcgctaccacctgcagcagaatgtgcagttctctgaagatactgtgcggctgtacatctgtgagatggccctggccctggactacctgcggggccagcacatcatccacagagatgtgaagccagacaacatcctgctggatgagcggggccacgcccacctgacagacttcaacatcgccaccatcatcaaggatggagagcgggccacagccctggccggcaccaagccctacatggcccctgagatcttccacagctttgtgaatggaggcaccggctacagctttgaggtggactggtggagcgtgggcgtgatggcctatgagctgctgcggggctggaggccctatgacatccacagcagcaatgctgtggagagcctggtgcagctgttcagcacagtgtctgtgcagtatgtgcccacctggagcaaggagatggtggccctgctgaggaagctgctgactgtgaaccctgagcaccggctgagcagcctgcaggatgtgcaggccgccccagccctggccggcgtgctgtgggaccacctgtctgagaagagggtggagcccggctttgtgcccaacaagggccgcctgcactgtgaccccacctttgagctggaggagatgatcctggagagccggcccctgcacaagaagaagaagaggctggccaagaacaagagccgggacaacagccgggacagcagccagagtgaaaatgactacctgcaggactgcctggatgccatccagcaggactttgtgatcttcaaccgggagaagctgaagaggagccaggacctgccccgggagcccctgcctgcccctgagagcagagatgctgctgagcctgtggaggatgaagctgagaggtctgccctgcccatgtgtggccccatctgccccagcgctggcagcggctag

SEQ ID NO: 42128 - DNA, 1500 bp, Artificial Sequence
  Description of Artificial Sequence: Synthetic coding sequence
atgctgtctgctgtgtggggcgctgggggccctggagctggaggagctgcccggggccagcccagcaggaaggagctgctgctgcggcaccacctgtggagcggcccccgctgcctgtccttccccctgggcagcctgcctgccagcctgctgggcctgcccggggccaccagccacaggagctgcctgagccccaacctggccagcggcctggccgcccggggcacccagacccagagcgtgctgtttggagaggtgcggctgcccctggatggaggagtgcggggggccaggaagaggatgaactttgaccacttccagatcctgcgggccatcggcaagggcagctttgggaaggtgtgcatcgtgcagaagagggacacagagaagatgtatgccatgaagtacatgaacaagcagcagtgcatcgagagagatgaggtgagaaatgtgttccgggagctggagatcctgcaggagattgaacatgtgttcctggtgaacctgtggtacagcttccaggatgaggaggacatgttcatggtggtggacctgctgctgggcggggacctgcgctaccacctgcagcagaatgtgcagttctctgaagatactgtgcggctgtacatctgtgagatggccctggccctggactacctgcggggccagcacatcatccacagagatgtgaagccagacaacatcctgctggatgagcggggccacgcccacctgacagacttcaacatcgccaccatcatcaaggatggagagcgggccacagccctggccggcaccaagccctacatggcccctgagatcttccacagctttgtgaatggaggcaccggctacagctttgaggtggactggtggagcgtgggcgtgatggcctatgagctgctgcggggctggaggccctatgacatccacagcagcaatgctgtggagagcctggtgcagctgttcagcacagtgtctgtgcagtatgtgcccacctggagcaaggagatggtggccctgctgaggaagctgctgactgtgaaccctgagcaccggctgagcagcctgcaggatgtgcaggccgccccagccctggccggcgtgctgtgggaccacctgtctgagaagagggtggagcccggctttgtgcccaacaagggccgcctgcactgtgaccccacctttgagctggaggagatgatcctggagagccggcccctgcacaagaagaagaagaggctggccaagaacaagagccgggacaacagccgggacagcagccagagtgaaaatgactacctgcaggactgcctggatgccatccagcaggactttgtgatcttcaaccgggagaagctgaagaggagccaggacctgccccgggagcccctgcctgcccctgagagcagagatgctgctgagcctgtggaggatgaagctgagaggtctgccctgcccatgtgtggccccatctgccccagcgctggcagcggctag

SEQ ID NO: 42129 - DNA, 411 bp, Artificial Sequence
  Description of Artificial Sequence: Synthetic coding sequence
tgagcccggggcctggagggcgtggtggtggatggccaggtggagacagcccgggtgtggaggggggacaggcctggaacagagggcaaggaggagagcggcatgctgtctgctgtgtggggcgctgggggccctggagctggaggagctgcccggggccagcccagcaggaaggagctgctgctgcggcaccacctgtggagcggcccccgctgcctgtccttccccctgggcagcctgcctgccagcctgctgggcctgcccggggccaccagccacaggagctgcctgagccccaacctggccagcggcctggccgcccggggcacccagacccagagcgtgctgtttggagaggtgcggctgcccctggatggaggagtgcggggggccaggaagaggaggagctag

SEQ ID NO: 42130 - DNA, 942 bp, Artificial Sequence
  Description of Artificial Sequence: Synthetic coding sequence
atgcctggcctgctgctgtgtgagcccacagagctgtacaacatcctgaaccaggccaccaagctgagccggctgacagaccccaactacctgtgcctgctggatgtgcgcagcaagtgggagtatgatgagagccacgtgatcacagccctgcgggtgaagaagaagaacaatgagtacctgctgcctgagagcgtggacctggagtgtgtgaagtactgtgtggtgtatgacaacaacagcagcaccctggagatcctgctgaaggatgatgatgatgacagcgacagtgatggagatggcaaggacctggtgccccaggccgccatcgagtatggccgcatcctgacccggctgacccaccaccctgtgtacatcctgaagggcggctatgagcgcttcagcggcacctaccacttcctgcggacccagaagatcatctggatgccccaggagctggatgccttccagccctaccccattgaaattgtgcctgggaaggtgtttgtgggcaacttcagccaggcctgtgaccccaagatccagaaggacctgaagatcaaggcccacgtgaatgtgtccatggacaccggccccttctttgctggagatgctgacaagctgctgcacatcagaattgaggacagccctgaggcccagatcctgcccttcctgcggcacatgtgccacttcatcgagatccaccaccacctgggcagcgtcatcctgatcttcagcacccagggcatcagccgcagctgtgccgccatcatcgcctacctgatgcacagcaatgagcagaccctgcagaggtcctgggcctacgtgaagaagtgcaagaacaacatgtgccccaacagaggcctggtgtcccagctgctggagtgggagaagaccatcctgggggacagcatcaccaacatcatggaccccctgtactag

SEQ ID NO: 42131 - DNA, 654 bp, Artificial Sequence
  Description of Artificial Sequence: Synthetic coding sequence
atgcctggcctgctgctgtgtgagcccacagagctgtacaacatcctgaaccaggccaccaagctgagccggctgacagaccccaactacctgtgcctgctggatgtgcgcagcaagtgggagtatgatgagagccacgtgatcacagccctgcgggtgaagaaggagctggatgccttccagccctaccccattgaaattgtgcctgggaaggtgtttgtgggcaacttcagccaggcctgtgaccccaagatccagaaggacctgaagatcaaggcccacgtgaatgtgtccatggacaccggccccttctttgctggagatgctgacaagctgctgcacatcagaattgaggacagccctgaggcccagatcctgcccttcctgcggcacatgtgccacttcatcgagatccaccaccacctgggcagcgtcatcctgatcttcagcacccagggcatcagccgcagctgtgccgccatcatcgcctacctgatgcacagcaatgagcagaccctgcagaggtcctgggcctacgtgaagaagtgcaagaacaacatgtgccccaacagaggcctggtgtcccagctgctggagtgggagaagaccatcctgggggacagcatcaccaacatcatggaccccctgtactag

SEQ ID NO: 42132 - DNA, 942 bp, Artificial Sequence; identical to SEQ ID NO: 42130
  Description of Artificial Sequence: Synthetic coding sequence

SEQ ID NO: 42133 - DNA, 339 bp, Artificial Sequence
  Description of Artificial Sequence: Synthetic coding sequence
atgcctggcctgctgctgtgtgagcccacagagctgtacaacatcctgaaccaggccaccaagctgagccggctgacagaccccaactacctgtgcctgctggatgtgcgcagcaagtgggagtatgatgagagccacgtgatcacagccctgcgggtgaagaagaagaacaatgagtacctgctgcctgagagcgtggacctggagtgtgtgaagtactgtgtggtgtatgacaacaacagcagcaccctggagatcctgctgaaggatgatgatgatgacagcgacagtgatggagatggcaagggcaccggctgcatcagcgccatcccccactag

SEQ ID NO: 42134 - DNA, 957 bp, Artificial Sequence
  Description of Artificial Sequence: Synthetic coding sequence
atgcctggcctgctgctgtgtgagcccacagagctgtacaacatcctgaaccaggccaccaagctgagccggctgacagaccccaactacctgtgcctgctggatgtgcgcagcaagtgggagtatgatgagagccacgtgatcacagccctgcgggtgaagaagaagaacaatgagtacctgctgcctgagagcgtggacctggagtgtgtgaagtactgtgtggtgtatgacaacaacagcagcaccctggagatcctgctgaaggatgatgatgatgacagcgacagtgatggagatggcaaggacctggtgccccaggccgccatcgagtatggccgcatcctgacccggctgacccaccaccctgtgtacatcctgaagggcggctatgagcgcttcagcggcacctaccacttcctgcggacccagaagatcatctggatgccccaggagctggatgccttccagccctaccccattgaaattgtgcctgggaaggtgtttgtgggcaacttcagccaggcctgtgaccccaagatccagaaggacctgaagatcaaggcccacgtgaatgtgtccatggacaccggccccttctttgctggagatgctgacaagctgctgcacatcagaattgaggacagccctgaggcccagatcctgcccttcctgcggcacatgtgccacttcatcgaggtgctgggcctgtgccaggaggtgcagaagcagcacgtgtccaagtctggaattggagagcctgctgctggcatgggagaggactacccctggaggttccaccacaagcaccacggcagcgccctgctgatcttcagcgaggcccacagaagagtgctgaagagcctgacctggggccactttgtgggcggcggcccagaatgtgtgtacccaggcctgtctggaagaagaagacccctgctgcctgagagcctgtag

SEQ ID NO: 42135 - DNA, 942 bp, Artificial Sequence; identical to SEQ ID NO: 42130
  Description of Artificial Sequence: Synthetic coding sequence

SEQ ID NO: 42136 - DNA, 942 bp, Artificial Sequence; identical to SEQ ID NO: 42130
  Description of Artificial Sequence: Synthetic coding sequence

SEQ ID NO: 42137 - DNA, 1311 bp, Artificial Sequence
  Description of Artificial Sequence: Synthetic coding sequence
atgacagctgtgtacatgaatggaggcggcctggtgaacccccactacgcccgctgggacagaagagacagcgtggagagcggctgccagacagagagcagcaaggagggggaggagggccagccccggcagctgaccccatttgagaagctgacccaggacatgagccaggatgagaaggtggtgcgggagatcaccctgggcaagagaattggcttctaccgcatccggggggagatcggcagcggcaacttcagccaggtgaagctgggcatccacagcctgaccaaggagaaggtggccatcaagatcctggacaagaccaagctggaccagaagacccagaggctgctgagccgggagatcagctccatggagaagctgcaccaccccaacatcatccggctgtatgaggtggtggagaccctgagcaagctgcacctggtgatggagtatgccggcggcggggagctgtttgggaagatcagcacagagggcaagctgtctgagcctgagagcaagctgatcttcagccagatcgtgtctgctgtgaagcacatgcatgagaaccagatcatccaccgggacctgaaggccgagaatgtgttctacaccagcaacacctgtgtgaaggtgggggactttggcttcagcacagtgtccaagaagggggagatgctgaacaccttctgtggcagccccccctatgctgcccctgagctgttcagagatgagcactacatcggcatctacgtggacatctgggccctgggcgtgctgctgtacttcatggtgacaggcaccatgcccttccgggcagagaccgtggccaagctgaagaagagcatcctggagggcacctacagcgtgccccctcatgtgtctgagccctgccacaggctcatccggggcgtgctgcagcagatccccacagaaagatatggcatcgactgcatcatgaatgatgagtggatgcagggcgtgccctaccccacccccctggagcccttccagctggaccccaagcacctgtctgagaccagcaccctgaaggaggaggagaatgaggtgaagagcaccctggagcacctgggcatcacagaggagcacatccggaacaaccagggcagagatgcccggagcagcatcaccggggtgtaccgcatcatcctgcaccgggtgcagaggaagaaggccctggagagcgtgcctgtgatgatgctgcctgaccccaaggagcgggacctgaagaagggcagccgggtgtaccggggcatccgccacaccagcaagttctgcagcatcctgtag

SEQ ID NO: 42138 - DNA, 1311 bp, Artificial Sequence; identical to SEQ ID NO: 42137
  Description of Artificial Sequence: Synthetic coding sequence

SEQ ID NO: 42139 - DNA, 1140 bp, Artificial Sequence
  Description of Artificial Sequence: Synthetic coding sequence
atggagcagctgagcagcgccaacaccaggtttgccctggacctcttcctggccctgtctgagaacaacccagctggcaacatcttcatcagccccttcagcatcagcagcgccatggccatggtgttcctgggcacccggggcaacacagctgcccagctgagcaagaccttccacttcaacacagtggaggaggtgcacagccgcttccagagcctgaatgctgacatcaacaagagaggagccagctacatcctgaagctggccaaccggctgtatggagagaagacctacaacttcctgcctgagttcctggtgtccacccagaagacctacggggctgacctggcctctgtggacttccagcacgcctctgaagatgccaggaagaccatcaaccagtgggtgaagggccagacagagggcaagatccctgagctgctggccagcggcatggtggacaacatgaccaagctggtgctggtgaatgccatctacttcaagggcaactggaaggacaagttcatgaaggaggccaccaccaatgcccccttccggctgaacaagaaggacaggaagacagtgaagatgatgtaccagaagaagaagtttgcctacggctacatcgaggacctgaagtgccgggtgctggagctgccctaccagggcgaggagctgtccatggtgatcctgctgcctgatgacattgaagatgagagcacaggcctgaagaagattgaggagcagctgaccctggagaagctgcacgagtggaccaagccagagaacctggacttcatcgaggtgaatgtgtccctgccccgcttcaagctggaggagagctacaccctgaacagcgacctggcccggctgggcgtgcaggacctcttcaacagcagcaaggctgacctgagcggcatgtctggggcccgggacatcttcatcagcaagatcgtgcacaagagctttgtggaggtgaatgaggagggcacagaagctgctgctgccacagctggcatcgccaccttctgcatgctgatgcctgaggagaacttcaccgctgaccaccccttcctgttcttcatccgccacaacagcagcggcagcatcctcttcctgggccgcttcagcagcccctag

SEQ ID NO: 42140 - DNA, 687 bp, Artificial Sequence
  Description of Artificial Sequence: Synthetic coding sequence
atggtggacaacatgaccaagctggtgctggtgaatgccatctacttcaagggcaactggaaggacaagttcatgaaggaggccaccaccaatgcccccttccggctgaacaagaaggacaggaagacagtgaagatgatgtaccagaagaagaagtttgcctacggctacatcgaggacctgaagtgccgggtgctggagctgccctaccagggcgaggagctgtccatggtgatcctgctgcctgatgacattgaagatgagagcacaggcctgaagaagattgaggagcagctgaccctggagaagctgcacgagtggaccaagccagagaacctggacttcatcgaggtgaatgtgtccctgccccgcttcaagctggaggagagctacaccctgaacagcgacctggcccggctgggcgtgcaggacctcttcaacagcagcaaggctgacctgagcggcatgtctggggcccgggacatcttcatcagcaagatcgtgcacaagagctttgtggaggtgaatgaggagggcacagaggccgccgccgccacagctggcatcgccaccttctgcatgctgatgcctgaggagaacttcaccgctgaccaccccttcctgttcttcatccgccacaacagcagcggcagcatcctcttcctgggccgcttcagcagcccctag

SEQ ID NO: 42141 - DNA, 1026 bp, Artificial Sequence
  Description of Artificial Sequence: Synthetic coding sequence
atggccatggtgttcctgggcacccggggcaacacagctgcccagctgagcaagaccttccacttcaacacagtggaggaggtgcacagccgcttccagagcctgaatgctgacatcaacaagagaggagccagctacatcctgaagctggccaaccggctgtatggagagaagacctacaacttcctgcctgagttcctggtgtccacccagaagacctacggggctgacctggcctctgtggacttccagcacgcctctgaagatgccaggaagaccatcaaccagtgggtgaagggccagacagagggcaagatccctgagctgctggccagcggcatggtggacaacatgaccaagctggtgctggtgaatgccatctacttcaagggcaactggaaggacaagttcatgaaggaggccaccaccaatgcccccttccggctgaacaagaaggacaggaagacagtgaagatgatgtaccagaagaagaagtttgcctacggctacatcgaggacctgaagtgccgggtgctggagctgccctaccagggcgaggagctgtccatggtgatcctgctgcctgatgacattgaagatgagagcacaggcctgaagaagattgaggagcagctgaccctggagaagctgcacgagtggaccaagccagagaacctggacttcatcgaggtgaatgtgtccctgccccgcttcaagctggaggagagctacaccctgaacagcgacctggcccggctgggcgtgcaggacctcttcaacagcagcaaggctgacctgagcggcatgtctggggcccgggacatcttcatcagcaagatcgtgcacaagagctttgtggaggtgaatgaggagggcacagaagctgctgctgccacagctggcatcgccaccttctgcatgctgatgcctgaggagaacttcaccgctgaccaccccttcctgttcttcatccgccacaacagcagcggcagcatcctcttcctgggccgcttcagcagcccctag

SEQ ID NO: 42142 - DNA, 654 bp, Artificial Sequence
  Description of Artificial Sequence: Synthetic coding sequence
atggtgctggtgaatgccatctacttcaagggccagtggcagaacaagttccaggtgcgggagaccgtgaagagccccttccagctgtctgagggcaagaatgtgacagtggagatgatgtaccagatcggcaccttcaagctggcctttgtgaaggagccccagatgcaggtgctggagctgccctacgtgaacaacaagctgtccatgatcatcctgctgcctgtgggcatcgccaacctgaagcagatcgagaagcagctgaacagcggcaccttccacgagtggaccagcagcagcaacatgatggagcgggaggtggaggtgcacctgccccgcttcaagctggagaccaagtatgagctgaacagcctgctgaagagcctgggcgtgacagacctcttcaaccaggtgaaggctgacctgagcggcatgagccccaccaagggcctgtacctgagcaaggccatccacaagagctacctggatgtgtctgaggagggcacagaagctgctgctgccactggagacagcattgctgtgaagagcctgcccatgagggcccagttcaaggccaaccaccccttcctgttcttcatccgccacacccacaccaacaccatcctcttctgtgggaagctggccagcccctag

SEQ ID NO: 42143 - DNA, 573 bp, Artificial Sequence
  Description of Artificial Sequence: Synthetic coding sequence
atgggcagcctgagcacagccaacgtggagttctgcctggatgtgttcaaggagctgaacagcaacaacatcggggacaacatcttcttcagcagcctgagcctgctgtatgccctgtccatggtgctgctgggcgcccggggggagacagaggagcagctggagaagattgagaagcagctgaacagcggcaccttccacgagtggaccagcagcagcaacatgatggagcgggaggtggaggtgcacctgccccgcttcaagctggagaccaagtatgagctgaacagcctgctgaagagcctgggcgtgacagacctcttcaaccaggtgaaggctgacctgagcggcatgagccccaccaagggcctgtacctgagcaaggccatccacaagagctacctggatgtgtctgaggagggcacagaggccgccgccgccaccggggacagcattgctgtgaagagcctgcccatgagggcccagttcaaggccaaccaccccttcctgttcttcatccgccacacccacaccaacaccatcctcttctgtgggaagctggccagcccctag

SEQ ID NO: 42144 - DNA, 1179 bp, Artificial Sequence
  Description of Artificial Sequence: Synthetic coding sequence
atgggcagcctgagcacagccaacgtggagttctgcctggatgtgttcaaggagctgaacagcaacaacatcggggacaacatcttcttcagcagcctgagcctgctgtatgccctgtccatggtgctgctgggcgcccggggggagacagaggagcagctggagaaggtgctgcacttcagccacacagtggacagcctgaagccaggcttcaaggacagccccaagtgcagccaggccggccgcatccacagcgagtttggagtggagttcagccagatcaaccagcctgacagcaactgcaccctgagcatcgccaaccggctgtatggcaccaagaccatggccttccaccagcagtacctgagctgcagcgagaagtggtaccaggcccggctgcagacagtggactttgagcagagcacagaggagaccaggaagaccatcaatgcctgggtggagaacaagaccaacgggaaggtggccaacctgtttgggaagagcaccatcgaccccagctctgtgatggtgctggtgaatgccatctacttcaagggccagtggcagaacaagttccaggtgcgggagaccgtgaagagccccttccagctgtctgagggcaagaatgtgacagtggagatgatgtaccagatcggcaccttcaagctggcctttgtgaaggagccccagatgcaggtgctggagctgccctacgtgaacaacaagctgtccatgatcatcctgctgcctgtgggcatcgccaacctgaagcagatcgagaagcagctgaacagcggcaccttccacgagtggaccagcagcagcaacatgatggagcgggaggtggaggtgcacctgccccgcttcaagctggagaccaagtatgagctgaacagcctgctgaagagcctgggcgtgacagacctcttcaaccaggtgaaggctgacctgagcggcatgagccccaccaagggcctgtacctgagcaaggccatccacaagagctacctggatgtgtctgaggagggcacagaggccgccgccgccaccggggacagcattgctgtgaagagcctgcccatgagggcccagttcaaggccaaccaccccttcctgttcttcatccgccacacccacaccaacaccatcctcttctgtgggaagctggccagcccctag

SEQ ID NO: 42145 - DNA, 1071 bp, Artificial Sequence
  Description of Artificial Sequence: Synthetic coding sequence
atgaccctggtgctgtccatgaaccgcttctgtgagcccatcgtgtctgagggcgctgctgagattgctggctaccagaccctgtgggaggccgacagctatggaggccccagccccccaggccctgcccaggcccccctgcagggcgacagaggagctggcccccccctggccggcagccactaccggggcatcagcaaccccatcaccaccagcaagatcacctacttcaagaggaaatatgtggaggaggaggacttccacccccccctgagcagctgcagccacaagaccatcagcatctttgaggagcgggcccacatcctgtacatgagcctggagaagctgaagttcattgatgatcctgaggtgtacctgcggcgctctgtgctgatcaacaacctgatgaagaggatccacggggagatcatcatgcagaacaactggtgcttccctgcctgcagcttcaacggcaccagcgcccaggagtggttcatggcccaggactgcccctacaggaagaggcccaggatggccaaggaggagtgtgagaagttccacgcctgctgcttctaccaggagtgtggcggccactacctgaacctgcccctgtctgtgaatgccaacgtgggcagcgccagcacagctgccagcagccccagcgccagcagcagcagcagcagcagcagcagcagcccccccctgcccctgcccagctgcagccggcaggtggactttgatgtgggcagcgccagcatctacaagagtgatggccagatcccagccaatgagatctttgtgaccaacgtgcgcagcctgggcgtgcaggagaaggccaagctgaatgatgagaaggccaatgatgacaccaacagagatggcggccccctgagccatgagcctgtgggcaatgacctggcctttgaatgtaaaggccagttctatgactactttgagaccggctacaatgaaagaaataatgtgaatgaatcctggaagaagagcctgaggaagaaggaggccagcccccccagcaacaagctgtgctgcagcaagggcagcaagatctag

SEQ ID NO: 42146 - DNA, 447 bp, Artificial Sequence
  Description of Artificial Sequence: Synthetic coding sequence
atgcaggaggtgggcgtgggcctgtaccccagcatcagcctgctgaaccacagctgtgaccccaactgcagcatcgtgttcaacggcccccacctgctgctgcgggctgtgcgggacatcgaggtgggggaggagctgaccatctgctacctggacatgctgatgaccagcgaggagaggaggaagcagctgcgggaccagtactgctttgaatgtgactgcttccgctgccagacccaggacaaggatgctgacatgctgactggagatgagcaggtgtggaaggaggtgcaggagagcctgaagaagattgaggagctgaaggcccactggaagtgggagcaggtgctggccatgtgccaggccatcatcagcagcaacagcgagcggctgcctgacatcaacatctaccagctgaaggtgctggactgtgccatggatgcctag

SEQ ID NO: 42147 - DNA, 396 bp, Artificial Sequence
  Description of Artificial Sequence: Synthetic coding sequence
atgcgctgcagccagtgccgggtggccaagtactgcagcgccaagtgccagaagaaggcctggccagaccacaagcgggagtgcaagtgcctgaagagctgcaagccccgctaccccccagacagcgtgcggctgctgggccgggtggtgttcaagctgatggatggagcccccagcgagagcgagaagctgtacagcttctatgacctggagagcaacatcaacaagctgacagaggacaagaaggagggcctgcggcagctggtgatgaccttccagcacttcatgagggaggagatccaggatgccagccagctgcccccagcctttgacctgtttgaggcctttgccaaggtgatctgcaacagcttcaccatctgcaatgctgagatgtag

SEQ ID NO: 42148 - DNA, 225 bp, Artificial Sequence
  Description of Artificial Sequence: Synthetic coding sequence
atgcgctgcagccagtgccgggtggccaagtactgcagcgccaagtgccagaagaaggcctggccagaccacaagcgggagtgcaagtgcctgaagagctgcaagccccgctaccccccagacagcgtgcggctgctgggccgggtggtgttcaagctgatggatggagcccccagcgagagcgagaagctgtacagcttctatgacctggagagcaacatctag

SEQ ID NO: 42149 - DNA, 1110 bp, Artificial Sequence
  Description of Artificial Sequence: Synthetic coding sequence
atgcgctgcagccagtgccgggtggccaagtactgcagcgccaagtgccagaagaaggcctggccagaccacaagcgggagtgcaagtgcctgaagagctgcaagccccgctaccccccagacagcgtgcggctgctgggccgggtggtgttcaagctgatggatggagcccccagcgagagcgagaagctgtacagcttctatgacctggagagcaacatcaacaagctgacagaggacaagaaggagggcctgcggcagctggtgatgaccttccagcacttcatgagggaggagatccaggatgccagccagctgcccccagcctttgacctgtttgaggcctttgccaaggtgatctgcaacagcttcaccatctgcaatgctgagatgcaggaggtgggcgtgggcctgtaccccagcatcagcctgctgaaccacagctgtgaccccaactgcagcatcgtgttcaacggcccccacctgctgctgcgggctgtgcgggacatcgaggtgggggaggagctgaccatctgctacctggacatgctgatgaccagcgaggagaggaggaagcagctgcgggaccagtactgctttgaatgtgactgcttccgctgccagacccaggacaaggatgctgacatgctgactggagatgagcaggtgtggaaggaggtgcaggagagcctgaagaagattgaggagctgaaggcccactggaagtgggagcaggtgctggccatgtgccaggccatcatcagcagcaacagcgagcggctgcctgacatcaacatctaccagctgaaggtgctggactgtgccatggatgcctgcatcaacctgggcctgctggaggaggccctcttctacggcaccaggaccatggagccctaccgcatcttcttccctggcagccaccctgtgcggggcgtgcaggtgatgaaggtgggcaagctgcagctgcaccagggcatgttcccccaggccatgaagaacctgcggctggcctttgacatcatgagggtgacccacggccgggagcacagcctgattgaagatctcatcctgctgctggaggagtgtgatgccaacatccgggccagctag

SEQ ID NO: 42150 - DNA, 1110 bp, Artificial Sequence; identical to SEQ ID NO: 42149
  Description of Artificial Sequence: Synthetic coding sequence

SEQ ID NO: 42151 - DNA, 777 bp, Artificial Sequence
  Description of Artificial Sequence: Synthetic coding sequence
atggaggaggaccgggacaaggtgatctgcaacagcttcaccatctgcaatgctgagatgcaggaggtgggcgtgggcctgtaccccagcatcagcctgctgaaccacagctgtgaccccaactgcagcatcgtgttcaacggcccccacctgctgctgcgggctgtgcgggacatcgaggtgggggaggagctgaccatctgctacctggacatgctgatgaccagcgaggagaggaggaagcagctgcgggaccagtactgctttgaatgtgactgcttccgctgccagacccaggacaaggatgctgacatgctgactggagatgagcaggtgtggaaggaggtgcaggagagcctgaagaagattgaggagctgaaggcccactggaagtgggagcaggtgctggccatgtgccaggccatcatcagcagcaacagcgagcggctgcctgacatcaacatctaccagctgaaggtgctggactgtgccatggatgcctgcatcaacctgggcctgctggaggaggccctcttctacggcaccaggaccatggagccctaccgcatcttcttccctggcagccaccctgtgcggggcgtgcaggtgatgaaggtgggcaagctgcagctgcaccagggcatgttcccccaggccatgaagaacctgcggctggcctttgacatcatgagggtgacccacggccgggagcacagcctgattgaggacctgatcctgctgctggaggagtgtgatgccaacatccgggccagctag

SEQ ID NO: 42152 - DNA, 2415 bp, Artificial Sequence
  Description of Artificial Sequence: Synthetic coding sequence
atggacctgcctgtggatgagtggaagagctacctgctgcagaagtgggccagcctgcccacctctgtgcaggtgaccatcagcacagctgagaccctgcgggacatcttcctgcacagcagcagcctgctgcagccagaagatgagctgttcctgaagaggctgagcaagggctacctggtgggcaaggacagtgatgcccccctcttctaccgggaggagggcaacaagaagttccaggagaaggactacacaggagctgctgtgctgtacagcaaaggagtgagccacagccggcccaacacagaggacatgagcctgtgccacgccaacagatctgctgccctcttccacctgggccagtatgagacctgcctgaaggacatcaacagagcccagacccacggctacccagagcggctgcagcccaagatcatgctgaggaaggcagaatgtctggtggccctgggccgcctgcaggaggccagccagaccatcagtgacctggagaggaacttcaccgccaccccagccctggctgatgtgctgccccagaccctgcagaggaacctgcaccggctgaagatgaagatgcaggagaaggacagcctgacagagagcttccctgctgccctggccaagaccctggaggatgctgccctgcgggaggagaatgagcagctgagcaatgccagcagcagcatcggcctgtgtgtggaccccctgaagggccgctgcctggtggccaccaaggacatcctgcctggagagctgctggtgcaggaggatgcctttgtgtctgtgctgaaccctggagagctgcccccaccccaccacggcctggacagcaagtgggacaccagggtgaccaatggagacctgtactgccaccgctgcctgaagcacaccctggccaccgtgccctgtgatggctgcagctatgccaagtactgcagccaggagtgcctgcagcaggcctgggagctgtaccacaggacagagtgccccctgggcggcctgctgctgaccctgggcgtcttctgccacatcgccctgcggctgaccctgctggtgggctttgaagatgtgaggaagatcatcaccaagctgtgtgacaagatcagcaacaaggacatctgcctgcctgagagcaacaaccaggtgaagaccctgaactacggcctgggggagagcgagaagaatggaaacatcgtggagacccccatccctggctgtgacatcaatggcaagtatgagaacaactacaatgctgtgttcaacctgctgccccacacagagaaccacagccctgagcacaagttcctgtgtgccctgtgtgtgtctgccctgtgccggcagctggaggccgccagcctgcaggccatccccacagaaagaattgtgaacagcagccagctgaaggctgctgtgaccccagagctgtgcccagatgtgaccatctggggcgtggccatgctgcggcacatgctgcagctgcagtgcaatgcccaggccatgaccaccatccagcacacaggccccaagggcagcatcgtgacagacagccggcaggtgcggctggccaccggcatcttccctgtgatcagcctgctgaaccacagctgcagccccaacacctctgtgtccttcatcagcacagtggccaccatccgggccagccagaggatcaggaagggccaggagatcctgcactgctacggcccccacaagagcaggatgggcgtggccgagcggcagcagaagctgcggagccagtacttctttgactgtgcctgcccagcctgccagacagaggcccacaggatggctgctggcccccgctgggaggccttctgctgcaacagctgtggggcccccatgcagggagatgatgtgctgcgctgtggcagccgcagctgtgccgagagcgctgtgtcccgggaccacctggtgtcccggctgcaggacctgcagcagcaggtgcgggtggcccagaagctgctgagagatggagagctggagagagctgtgcagaggctgagcggctgccagagagatgctgagagcttcctgtgggccgagcacgctgtggtgggggagattgctgatggcctggcccgggcctgtgccgccctgggggactggcagaagagcgccacccacctgcagaggagcctgtatgtggtggaggtgagacatggccccagctctgtggagatgggccacgagctgttcaagctggcccagatcttcttcaatggatttgctgtgcctgaggccctgagcaccatccagaaggccgaggaggtgctgagcctgcactgcggcccctgggatgatgagatccaggagctgcagaagatgaagagctgcctgctggacctgccccccacccctgtgggccctgccctgtag

SEQ ID NO: 42153 - DNA, 1059 bp, Artificial Sequence
  Description of Artificial Sequence: Synthetic coding sequence
atggcccggggcaggaagatgagcaagcccagggctgtggaggccgctgctgctgctgctgctgtggccgccacagcccctggccctgagatggtggagcggcggggccctggccggcccaggacagatggagaaaatgtgttcaccggccagagcaagatctacagctacatgagccccaacaagtgcagcggcatgaggttccccctgcaggaggagaacagcgtgacccaccacgaggtgaagtgccagggcaagcccctggccggcatctacaggaagcgggaggagaagagaaatgctggaaatgctgtgcgcagcgccatgaagtctgaggagcagaagatcaaggatgccaggaagggccccctggtgcccttccccaaccagaagtctgaggccgctgagccccccaagaccccacccagcagctgtgacagcaccaatgctgccatcgccaagcaggccctgaagaagcccatcaagggcaagcaggcccccaggaagaaggcccagggcaagacccagcagaacaggaagctgacagacttctaccctgtgcggcgcagcagcaggaagagcaaggccgagctgcagagcgaggagaggaagagaattgatgagctgattgagagcggcaaggaggagggcatgaagattgacctgattgatggcaagggccggggcgtgattgccaccaagcagttcagcagaggagactttgtggtggagtaccacggggacctgattgagatcacagatgccaagaagcgggaggccctgtatgcccaggaccccagcacaggctgctacatgtactacttccagtacctgagcaagacctactgtgtggatgccacccgggagaccaaccggctgggccgcctcatcaaccacagcaaatgtggcaactgccagaccaagctgcatgacattgatggagtgccccacctgatcctgattgccagccgggacattgctgctggggaggagctgctgtatgactatggagacaggagcaaggccagcattgaggcccacccctggctgaagcactag

SEQ ID NO: 42154 - DNA, 1059 bp, Artificial Sequence; identical to SEQ ID NO: 42153
  Description of Artificial Sequence: Synthetic coding sequence

SEQ ID NO: 42155 - DNA, 1323 bp, Artificial Sequence
  Description of Artificial Sequence: Synthetic coding sequence
atgcagaagggcaaaggaagaaccagccgcatcagaagaaggaagctgtgtggcagcagcgagagccggggcgtgaatgaaagccacaagtctgagttcatcgagctgaggaagtggctgaaggccaggaagttccaggacagcaacctggccccagcctgcttccctggcaccggccggggcctgatgagccagaccagcctgcaggagggccagatgatcatcagcctgcctgagagctgcctgctgaccacagacaccgtcatccgcagctacctgggcgcctacatcaccaagtggaagcccccacccagccccctgctggccctgtgcaccttcctggtgtctgagaagcacgccggccacaggagcctgtggaagccctacctggagatcctgcccaaggcctacacctgccctgtgtgcctggagcctgaggtggtgaacctgctgcccaagagcctgaaggccaaggccgaggagcagagggcccacgtgcaggagttctttgccagcagccgggacttcttcagcagcctgcagcccctgtttgctgaggccgtggacagcatcttctcctacagcgccctgctgtgggcctggtgcaccgtgaacaccagggctgtgtacctgcggccccggcagagagaatgtctgtctgctgagccagacacctgtgccctggccccctacctggacctgctgaaccacagcccccacgtgcaggtgaaggccgccttcaatgaggagacccacagctatgagatccgcaccaccagccgctggaggaagcatgaggaggtgttcatctgctacggcccccatgacaaccagaggctcttcctggagtatggctttgtgtctgtgcacaacccccacgcctgtgtgtatgtgtcccgggagatcctggtgaagtacctgcccagcacagacaagcagatggacaagaagatcagcatcctgaaggaccacggctacatcgagaacctgaccttcggctgggatggccccagctggaggctgctgacagccctgaagctgctgtgcctggaggccgagaagttcacctgctggaagaaggtgctgctgggggaggtgatcagtgacaccaatgagaagaccagcctggacatcgcccagaagatctgctactacttcatcgaggagaccaatgctgtgctgcagaaggtgagccacatgaaggatgagaaggaggccctgatcaaccagctgaccctggtggagagcctgtggacagaggagctgaagatcctgcgggccagcgctgagaccctgcacagcctgcagacagccttcacctag

SEQ ID NO: 42156 - DNA, 852 bp, Artificial Sequence
  Description of Artificial Sequence: Synthetic coding sequence
atgaatgaaagccacaagtctgagttcatcgagctgaggaagtggctgaaggccaggaagttccaggacagcaacctggccccagcctgcttccctggcaccggccggggcctgatgagccagaccagcctgcaggagggccagatgatcatcagcctgcctgagagctgcctgctgaccacagacaccgtcatccgcagctacctgggcgcctacatcaccaagtggaagcccccacccagccccctgctggccctgtgcaccttcctggtgtctgagaagcacgccggccacaggagcctgtggaagccctacctggagatcctgcccaaggcctacacctgccctgtgtgcctggagcctgaggtggtgaacctgctgcccaagagcctgaaggccaaggccgaggagcagagggcccacgtgcaggagttctttgccagcagccgggacttcttcagcagcctgcagcccctgtttgctgaggccgtggacagcatcttctcctacagcgccctgctgtgggcctggtgcaccgtgaacaccagggctgtgtacctgcggccccggcagagagaatgtctgtctgctgagccagacacctgtgccctggccccctacctggacctgctgaaccacagcccccacgtgcaggtgaaggccgccttcaatgaggagacccacagctatgagatccgcaccaccagccgctggaggaagcatgaggaggtgttcatctgctacggcccccatgacaaccagaggctcttcctggagtatggctttgtgtctgtgcacaacccccacgcctgtgtgtatgtgtcccggggctggaaccagctgtgcagctag

SEQ ID NO: 42157 - DNA, 852 bp, Artificial Sequence; identical to SEQ ID NO: 42156
  Description of Artificial Sequence: Synthetic coding sequence

SEQ ID NO: 42158 - DNA, 924 bp, Artificial Sequence
  Description of Artificial Sequence: Synthetic coding sequence
atgcagaagggcaaaggaagaaccagccgcatcagaagaaggaagctgtgtggcagcagcgagagccggggcgtgaatgaaagccacaagtctgagttcatcgagctgaggaagtggctgaaggccaggaagttccaggacagcaacctggccccagcctgcttccctggcaccggccggggcctgatgagccagaccagcctgcaggagggccagatgatcatcagcctgcctgagagctgcctgctgaccacagacaccgtcatccgcagctacctgggcgcctacatcaccaagtggaagcccccacccagccccctgctggccctgtgcaccttcctggtgtctgagaagcacgccggccacaggagcctgtggaagccctacctggagatcctgcccaaggcctacacctgccctgtgtgcctggagcctgaggtggtgaacctgctgcccaagagcctgaaggccaaggccgaggagcagagggcccacgtgcaggagttctttgccagcagccgggacttcttcagcagcctgcagcccctgtttgctgaggccgtggacagcatcttctcctacagcgccctgctgtgggcctggtgcaccgtgaacaccagggctgtgtacctgcggccccggcagagagaatgtctgtctgctgagccagacacctgtgccctggccccctacctggacctgctgaaccacagcccccacgtgcaggtgaaggccgccttcaatgaggagacccacagctatgagatccgcaccaccagccgctggaggaagcatgaggaggtgttcatctgctacggcccccatgacaaccagaggctcttcctggagtatggctttgtgtctgtgcacaacccccacgcctgtgtgtatgtgtcccggggctggaaccagctgtgcagctag

SEQ ID NO: 42159 - DNA, 924 bp, Artificial Sequence; identical to SEQ ID NO: 42158
  Description of Artificial Sequence: Synthetic coding sequence

SEQ ID NO: 42160 - DNA, 1251 bp, Artificial Sequence
  Description of Artificial Sequence: Synthetic coding sequence
atgaatgaaagccacaagtctgagttcatcgagctgaggaagtggctgaaggccaggaagttccaggacagcaacctggccccagcctgcttccctggcaccggccggggcctgatgagccagaccagcctgcaggagggccagatgatcatcagcctgcctgagagctgcctgctgaccacagacaccgtcatccgcagctacctgggcgcctacatcaccaagtggaagcccccacccagccccctgctggccctgtgcaccttcctggtgtctgagaagcacgccggccacaggagcctgtggaagccctacctggagatcctgcccaaggcctacacctgccctgtgtgcctggagcctgaggtggtgaacctgctgcccaagagcctgaaggccaaggccgaggagcagagggcccacgtgcaggagttctttgccagcagccgggacttcttcagcagcctgcagcccctgtttgctgaggccgtggacagcatcttctcctacagcgccctgctgtgggcctggtgcaccgtgaacaccagggctgtgtacctgcggccccggcagagagaatgtctgtctgctgagccagacacctgtgccctggccccctacctggacctgctgaaccacagcccccacgtgcaggtgaaggccgccttcaatgaggagacccacagctatgagatccgcaccaccagccgctggaggaagcatgaggaggtgttcatctgctacggcccccatgacaaccagaggctcttcctggagtatggctttgtgtctgtgcacaacccccacgcctgtgtgtatgtgtcccgggagatcctggtgaagtacctgcccagcacagacaagcagatggacaagaagatcagcatcctgaaggaccacggctacatcgagaacctgaccttcggctgggatggccccagctggaggctgctgacagccctgaagctgctgtgcctggaggccgagaagttcacctgctggaagaaggtgctgctgggggaggtgatcagtgacaccaatgagaagaccagcctggacatcgcccagaagatctgctactacttcatcgaggagaccaatgctgtgctgcagaaggtgagccacatgaaggatgagaaggaggccctgatcaaccagctgaccctggtggagagcctgtggacagaggagctgaagatcctgcgggccagcgctgagaccctgcacagcctgcagacagccttcacctag

SEQ ID NO: 42161 - DNA, 1323 bp, Artificial Sequence; identical to SEQ ID NO: 42155
  Description of Artificial Sequence: Synthetic coding sequence

SEQ ID NO: 42162 - DNA, 696 bp, Artificial Sequence
  Description of Artificial Sequence: Synthetic coding sequence
atgcagaagggcaaaggaagaaccagccgcatcagaagaaggaagctgtgtggcagcagcgagagccggggcgtgaatgaaagccacaagtctgagttcatcgagctgaggaagtggctgaaggccaggaagttccaggacagcaacctggccccagcctgcttccctggcaccggccggggcctgatgagccagaccagcctgcaggagggccagatgatcatcagcctgcctgagagctgcctgctgaccacagacaccgtcatccgcagctacctgggcgcctacatcaccaagtggaagcccccacccagccccctgctggccctgtgcaccttcctggtgtctgagaagcacgccggccacaggagcctgtggaagccctacctggagatcctgcccaaggcctacacctgccctgtgtgcctggagcctgaggtggtgaacctgctgcccaagagcctgaaggccaaggccgaggagcagagggcccacgtgcaggagttctttgccagcagccgggacttcttcagcagcctgcagcccctgtttgctgaggccgtggacagcatcttctcctacagcgccctgctgtgggcctggtgcaccgtgaacaccagggctgtgtacctgcggccccggcagagagaatgtctgtctgctgagccagacacctgtgccctggccccctactag

SEQ ID NO: 42163 - DNA, 678 bp, Artificial Sequence
  Description of Artificial Sequence: Synthetic coding sequence
atgcagaagggcaaaggaagaaccagccgcatcagaagaaggaagctgtgtggcagcagcgagagccggggcgtgaatgaaagccacaagtctgagttcatcgagctgaggaagtggctgaaggccaggaagttccaggacagcaacctggccccagcctgcttccctggcaccggccggggcctgatgagccagaccagcctgcaggagggccagatgatcatcagcctgcctgagagctgcctgctgaccacagacaccgtcatccgcagctacctgggcgcctacatcaccaagtggaagcccccacccagccccctgctggccctgtgcaccttcctggtgtctgagaagcacgccggccacaggagcctgtggaagccctacctggagatcctgcccaaggcctacacctgccctgtgtgcctggagcctgaggtggtgaacctgctgcccaagagcctgaaggccaaggccgaggagcagagggcccacgtgcaggagttctttgccagcagccgggacttcttcagcagcctgcagcccctgtttgctgaggccgtggacagcatcttctcctacagcgccctgctgtgggcctggtgcaccgtgaacaccagggctgtgtacctgcggccccggcagagagaatgtctgtctgctgagccagacacctag

SEQ ID NO: 42164 - DNA, 213 bp, Artificial Sequence
  Description of Artificial Sequence: Synthetic coding sequence
atgaatgaaagccacaagtctgagttcatcgagctgaggaagtggctgaaggccaggaagttccaggacagcaacctggccccagcctgcttccctggcaccggccggggcctgatgagccagaccagcctgcaggagggccagatgatcatcagcctgcctgagagctgcctgctgaccacagacaccgtcatccgcagctacctgggctag

SEQ ID NO: 42165 - DNA, 204 bp, Artificial Sequence
  Description of Artificial Sequence: Synthetic coding sequence
atgcagaagggcaaaggaagaaccagccgcatcagaagaaggaagctgtgtggcagcagcgagagccggggcgtgaatgaaagccacaagtctgagttcatcgagctgaggaagtggctgaaggccaggaagttccaggacagcaacctggccccagcctgcttccctggcaccggccggggcctgatgagccagaccagctag

SEQ ID NO: 42166 - DNA, 375 bp, Artificial Sequence
  Description of Artificial Sequence: Synthetic coding sequence
atgaatgaaagccacaagtctgagttcatcgagctgaggaagtggctgaaggccaggaagttccaggacagcaacctggccccagcctgcttccctggcaccggccggggcctgatgagccagaccagcctgcaggagggccagatgatcatcagcctgcctgagagctgcctgctgaccacagacaccgtcatccgcagctacctgggcgcctacatcaccaagtggaagcccccacccagccccctgctggccctgtgcaccttcctggtgtctgagaagcacgccggccacaggagcctgtggaagccctacctggagatcctgcccaaggcctacacctgccctgtgtgcctggagcctgaggtggtgtag

SEQ ID NO: 42167 - DNA, 4035 bp, Artificial Sequence
  Description of Artificial Sequence: Synthetic coding sequence
atgagccggggcaaggtgatccggctgcacaggaggaagcaggacaacatcagcggcggggacagcagcgccacagagagctgggatgaggagctgagccccagcacagtgctgtacacagccacccagcacacccccaccagcatcaccctgactgtgcggaggaccaagcccaagaagaggaagaagagccctgagaagggccgggccgcccccaagaccaagaagatcaaggccttccgggagggcagcaggaagagcctgaggatgaagaacagccccagcgaggcccagaacctggatgagaacaccacagagggctgggagaaccgcatccggctgtggacagaccagtatgaggaggccttcaccaaccagtacagcgcagatgtgcagaatgccctggagcagcacctgcacagcagcaaggagtttgtgggcaagcccaccatcctggacaccatcaacaagacagagctggcctgcaacaacacagtgattggcagccagatgcagctgcagctgggccgggtgaccagggtgcagaagcacaggaagatcctgcgggccgcccgggacctggccctggacaccctcatcatcgagtaccggggcaaggtgatgctgcggcagcagtttgaggtgaatggccacttcttcaagaagccctacccctttgtgctcttctacagcaagttcaacggggtggagatgtgtgtggatgcccggacctttggaaatgatgcccgcttcatcagaagaagctgcaccccaaatgctgaggtgcgccacatgattgctgatggcatgatccacctgtgcatctatgctgtgtctgccatcaccaaggatgctgaggtgaccatcgcctttgattatgagtacagcaactgcaactacaaggtggactgtgcctgccacaagggcaacagaaactgccccatccagaagaggaaccccaatgccacagagctgcccctgctgcccccaccacccagcctgcccaccatcggggctgagaccaggaggaggaaggcccggaggaaggagctggagatggagcagcagaatgaggccagcgaggagaacaatgaccagcagagccaggaggtgcctgagaaggtgacagtgtccagtgaccacgaggaggtggacaaccctgaggagaagccagaggaggagaaggaggaggtgattgatgaccaggagaacctggcccacagcaggaggacccgggaggacaggaaggtggaggccatcatgcacgcctttgagaacctggagaagaggaagaagagaagagaccagcccctggagcagagcaacagtgatgtggagatcaccaccaccaccagcgagacccctgtgggggaggagaccaagacagaggcccctgagagcgaggtgagcaacagcgtgtccaatgtgaccatccccagcaccccccagagcgtgggcgtgaacacccggcgcagcagccaggccggggacattgctgctgagaagctggtgcccaagcccccaccagccaagcccagccggccccggcccaagagccgcatcagccgctaccgcaccagcagcgcccagaggctgaagaggcagaagcaggccaatgcccagcaggccgagctgagccaggccgccctggaggagggcggcagcaacagcctggtgacccccacagaggccggcagcctggacagcagcggggagaaccggcccctgactggaagtgaccccaccgtggtgtccatcaccggcagccacgtgaacagagctgccagcaagtaccccaagaccaagaagtacctggtgacagagtggctgaatgacaaggccgagaagcaggagtgccctgtggagtgccccctgcgcatcaccacagaccccaccgtgctggccaccaccctgaacatgctgcccggcctcatccacagccccctcatctgcaccacccccaagcactacatccgcttcggcagccccttcatccctgagaggagaagaagacccctgctgcctgatggcaccttcagcagctgcaagaagcgctggatcaagcaggccctggaggagggcatgacccagaccagctctgtgccccaggagaccaggacccagcacctgtaccagagcaatgaaaacagcagcagcagcagcatctgcaaggacaatgctgacctgctgagccccctgaagaagtggaagagccgctacctgatggagcagaatgtgaccaagctgctgcggcccctgagccctgtgaccccacctccacccaacagcggcagcaagagcccccagctggccaccccaggcagcagccaccctggagaggaggagtgcagaaatggctacagcctgatgttcagccctgtgaccagcctgaccacagccagccgctgcaacacccccctgcagtttgagctgtgccacaggaaggacctggacctggccaaggtgggctacctggacagcaacaccaacagctgtgccgaccggcccagcctgctgaacagcggccacagcgacctggccccccaccccagcctgggccccaccagcgagaccggcttccccagccgctctggagatggccaccagaccctggtgaggaacagcgaccaggccttcagaacagagttcaacctgatgtatgcctacagccccctgaatgccatgcccagggcagatggcctgtaccggggcagccccctggtgggggacaggaagcccctgcacctggatggcggctactgcagccctgctgagggcttcagcagccgctatgaacatggcctgatgaaggacctgagccggggcagcctgagccctggaggagagcgggcctgtgagggcgtgcccagcgccccccagaaccccccccagaggaagaaggtgtccctgctggagtacaggaagaggaagcaggaggccaaggagaacagcgctgggggcggcggggacagcgcccagagcaagagcaagtctgctggagctggccagggcagcagcaacagcgtgtctgacaccggggcccatggagtgcagggcagcagcgcccggacccccagcagcccccacaagaagttcagccccagccacagctccatgagccacctggaggccgtgagccccagcgacagccggggcaccagcagcagccactgccggccccaggagaacatcagcagccgctggatggtgcccacctctgtggagcggctgcgggagggcggcagcatccccaaggtgctgcggagctctgtgcgggtggcccagaagggggagcccagccccacctgggagagcaacatcacagagaaggacagcgaccctgcagatggagagggccctgagaccctgagcagcgccctgagcaaaggagccaccgtgtacagccccagccgctacagctaccagctgctgcagtgtgacagccccaggacagagagccagagcctgctgcagcagagcagcagccccttccggggccaccccacccagagccctggctacagctaccgcaccacagccctgcggcccggcaacccccccagccacggcagcagcgagagcagcctgagcagcaccagctacagcagccctgcccaccctgtgtccacagacagcctggcccccttcaccggcaccccaggctacttcagcagccagccccacagcggcaacagcacaggcagcaacctgcccaggaggagctgccccagcagcgctgccagccccaccctgcagggccccagcgacagccccaccagtgacagcgtgtcccagagcagcacaggcaccctgagcagcaccagcttcccccagaacagccgcagcagcctgcccagcgacctgcggaccatcagcctgcccagcgctggccagagcgctgtgtaccaggccagccgggtgtctgctgtgagcaacagccagcactacccccaccggggcagcggaggagtgcaccagtaccgcctgcagcccctgcagggcagcggcgtgaagacccagacaggcctgtcctag

SEQ ID NO: 42168 - DNA, 4329 bp, Artificial Sequence
  Description of Artificial Sequence: Synthetic coding sequence
atgagcatcgccatccccctgggcgtgaccaccagtgacaccagctacagcgacatggctgctggcagtgaccctgagagcgtggaggccagccctgctgtgaatgagaagtctgtgtacagcacccacaactacggcaccacccagagacatggctgccggggcctgccctatgccaccatcatccccaggagtgacctgaatggcctgcccagccctgtggaggagcgctgtggggacagccccaacagcgagggggagaccgtgcccacctggtgcccctgtggcctgagccaggacggcttcctgctgaactgtgacaagtgccggggcatgagccggggcaaggtgatccggctgcacaggaggaagcaggacaacatctctggaggagacagcagcgccacagagagctgggatgaggagctgagccccagcacagtgctgtacacagccacccagcacacccccaccagcatcaccctgactgtgcggaggaccaagcccaagaagaggaagaagagccctgagaagggccgggccgcccccaagaccaagaagatcaagaacagccccagcgaggcccagaacctggatgagaacaccacagagggctgggagaaccgcatccggctgtggacagaccagtatgaggaggccttcaccaaccagtacagcgcagatgtgcagaatgccctggagcagcacctgcacagcagcaaggagtttgtgggcaagcccaccatcctggacaccatcaacaagacagagctggcctgcaacaacacagtgattggcagccagatgcagctgcagctgggccgggtgaccagggtgcagaagcacaggaagatcctgcgggccgcccgggacctggccctggacaccctcatcatcgagtaccggggcaaggtgatgctgcggcagcagtttgaggtgaatggccacttcttcaagaagccctacccctttgtgctcttctacagcaagttcaacggggtggagatgtgtgtggatgcccggacctttggaaatgatgcccgcttcatcagaagaagctgcaccccaaatgctgaggtgcgccacatgattgctgatggcatgatccacctgtgcatctatgctgtgtctgccatcaccaaggatgctgaggtgaccatcgcctttgattatgagtacagcaactgcaactacaaggtggactgtgcctgccacaagggcaacagaaactgccccatccagaagaggaaccccaatgccacagagctgcccctgctgcccccaccacccagcctgcccaccatcggggctgagaccaggaggaggaaggcccggaggaaggagctggagatggagcagcagaatgaggccagcgaggagaacaatgaccagcagagccaggaggtgcctgagaaggtgacagtgtccagtgaccacgaggaggtggacaaccctgaggagaagccagaggaggagaaggaggaggtgattgatgaccaggagaacctggcccacagcaggaggacccgggaggacaggaaggtggaggccatcatgcacgcctttgagaacctggagaagaggaagaagagaagagaccagcccctggagcagagcaacagtgatgtggagatcaccaccaccaccagcgagacccctgtgggggaggagaccaagacagaggcccctgagagcgaggtgagcaacagcgtgtccaatgtgaccatccccagcaccccccagagcgtgggcgtgaacacccggcgcagcagccaggccggggacattgctgctgagaagctggtgcccaagcccccaccagccaagcccagccggccccggcccaagagccgcatcagccgctaccgcaccagcagcgcccagaggctgaagaggcagaagcaggccaatgcccagcaggccgagctgagccaggccgccctggaggagggcggcagcaacagcctggtgacccccacagaggccggcagcctggacagcagcggggagaaccggcccctgactggaagtgaccccaccgtggtgtccatcaccggcagccacgtgaacagagctgccagcaagtaccccaagaccaagaagtacctggtgacagagtggctgaatgacaaggccgagaagcaggagtgccctgtggagtgccccctgcgcatcaccacagaccccaccgtgctggccaccaccctgaacatgctgcccggcctcatccacagccccctcatctgcaccacccccaagcactacatccgcttcggcagccccttcatccctgagaggagaagaagacccctgctgcctgatggcaccttcagcagctgcaagaagcgctggatcaagcaggccctggaggagggcatgacccagaccagctctgtgccccaggagaccaggacccagcacctgtaccagagcaatgaaaacagcagcagcagcagcatctgcaaggacaatgctgacctgctgagccccctgaagaagtggaagagccgctacctgatggagcagaatgtgaccaagctgctgcggcccctgagccctgtgaccccacctccacccaacagcggcagcaagagcccccagctggccaccccaggcagcagccaccctggagaggaggagtgcagaaatggctacagcctgatgttcagccctgtgaccagcctgaccacagccagccgctgcaacacccccctgcagtttgagctgtgccacaggaaggacctggacctggccaaggtgggctacctggacagcaacaccaacagctgtgccgaccggcccagcctgctgaacagcggccacagcgacctggccccccaccccagcctgggccccaccagcgagaccggcttccccagccgctctggagatggccaccagaccctggtgaggaacagcgaccaggccttcagaacagagttcaacctgatgtatgcctacagccccctgaatgccatgcccagggcagatggcctgtaccggggcagccccctggtgggggacaggaagcccctgcacctggatggcggctactgcagccctgctgagggcttcagcagccgctatgaacatggcctgatgaaggacctgagccggggcagcctgagccctggaggagagcgggcctgtgagggcgtgcccagcgccccccagaaccccccccagaggaagaaggtgtccctgctggagtacaggaagaggaagcaggaggccaaggagaacagcgctgggggcggcggggacagcgcccagagcaagagcaagtctgctggagctggccagggcagcagcaacagcgtgtctgacaccggggcccatggagtgcagggcagcagcgcccggacccccagcagcccccacaagaagttcagccccagccacagctccatgagccacctggaggccgtgagccccagcgacagccggggcaccagcagcagccactgccggccccaggagaacatcagcagccgctggatggtgcccacctctgtggagcggctgcgggagggcggcagcatccccaaggtgctgcggagctctgtgcgggtggcccagaagggggagcccagccccacctgggagagcaacatcacagagaaggacagcgaccctgcagatggagagggccctgagaccctgagcagcgccctgagcaaaggagccaccgtgtacagccccagccgctacagctaccagctgctgcagtgtgacagccccaggacagagagccagagcctgctgcagcagagcagcagccccttccggggccaccccacccagagccctggctacagctaccgcaccacagccctgcggcccggcaacccccccagccacggcagcagcgagagcagcctgagcagcaccagctacagcagccctgcccaccctgtgtccacagacagcctggcccccttcaccggcaccccaggctacttcagcagccagccccacagcggcaacagcacaggcagcaacctgcccaggaggagctgccccagcagcgctgccagccccaccctgcagggccccagcgacagccccaccagtgacagcgtgtcccagagcagcacaggcaccctgagcagcaccagcttcccccagaacagccgcagcagcctgcccagcgacctgcggaccatcagcctgcccagcgctggccagagcgctgtgtaccaggccagccgggtgtctgctgtgagcaacagccagcactacccccaccggggcagcggaggagtgcaccagtaccgcctgcagcccctgcagggcagcggcgtgaagacccagacaggcctgtcctag

SEQ ID NO: 42169 - DNA, 4035 bp, Artificial Sequence; identical to SEQ ID NO: 42167
  Description of Artificial Sequence: Synthetic coding sequence

SEQ ID NO: 42170 - DNA, 4329 bp, Artificial Sequence; identical to SEQ ID NO: 42168
  Description of Artificial Sequence: Synthetic coding sequence

SEQ ID NO: 42171 - DNA, 489 bp, Artificial Sequence
  Description of Artificial Sequence: Synthetic coding sequence
atgagcatcgccatccccctgggcgtgaccaccagtgacaccagctacagcgacatggctgctggcagtgaccctgagagcgtggaggccagccctgctgtgaatgagaagtctgtgtacagcacccacaactacggcaccacccagagacatggctgccggggcctgccctatgccaccatcatccccaggagtgacctgaatggcctgcccagccctgtggaggagcgctgtggggacagccccaacagcgagggggagaccgtgcccacctggtgcccctgtggcctgagccaggacggcttcctgctgaactgtgacaagtgccggggcatgagccggggcaaggtgatccggctgcacaggaggaagcaggacaacatctctggaggagacagcagcgccacagagagctgggatgaggagctgagccccagcacagtgctgtacacagccacccagcacacccccaccagcatcaccctgtag

SEQ ID NO: 42172 - DNA, 1731 bp, Artificial Sequence
  Description of Artificial Sequence: Synthetic coding sequence
atgcaggtgccccaggatggagaggacctggccggccagccctggtaccacggcctgctgagccggcagaaggccgaggccctgctgcagcagaatggagacttcctggtgcgggccagcggcagccggggcggcaaccctgtgatcagctgccgctggaggggcagcgccctgcactttgaggtgttccgggtggccctgcggcccaggcctggccggcccacagccctcttccagctggaggatgagcagttccccagcatcccagccctggtgcacagctacatgactggaagaagacccctgagccaggccaccggggctgtggtgtccaggcctgtgacctggcagggccccctgcggcgctccttcagcgaggacaccctgatggatggccctgcccgcatcgagcccctgcgggccaggaagtggagcaacagccagcctgctgacctggcccacatgggccgcagccgggaggaccctgctggcatggaggccagcaccatgcccatcagcgccctgcccaggaccagcagtgaccctgtgctgctgaaggccccagcccccctgggcaccgtggccgacagcctgcgggccagtgatggccagctgcaggccaaggcccccaccaagccacccaggacccccagctttgagctgcctgatgccagcgagcggccccccacctactgtgagctggtgccccgggtgcccagcgtgcagggcaccagccccagccagagctgcccagagcctgaggccccctggtgggaggccgaggaggatgaggaggaggagaaccgctgcttcacccggccccaggccgagatctccttctgcccccatgatgcccccagctgcctgctgggcccccagaaccggcccctggagccccaggtgctgcacaccctgcggggcctcttcctggagcaccaccctggcagcacagccctgcacctgctgctggtggactgccaggccaccggcctgctgggcgtgacccgggaccagaggggcaacatgggcgtgagcagcggcctggagctgctgaccctgccccacggccaccacctgcggctggagctgctggagcggcaccagaccctggccctggccggggccctggccgtgctgggctgcagcggccccctggaggagagagctgctgccctgcggggcctggtggagctggccctggccctgcggcctggagctgctggggacctgcccggcctggccgctgtgatgggcgccctgctgatgccccaggtgtcccggctggagcacacctggaggcagctgcggcgcagccacacagaggccgccctggcctttgagcaggagctgaagcccctgatgagggccctggatgagggcgccggcccctgtgaccccggggaggtggccctgccccacgtggcccccatggtgcggctgctggagggggaggaggtggccggccccctggatgagagctgtgagcggctgctgcggaccctgcacggggcccggcacatggtgagagatgcccccaagttcaggaaggtggccgcccagaggctgcggggcttccggcccaaccctgagctgcgggaggccctgaccactggatttgtgcggcggctgctgtggggcagcagaggagctggggcccccagggctgagagatttgagaagttccagagggtgctgggcgtgctgagccagaggctggagccagacagatag

SEQ ID NO: 42173 - DNA, 1452 bp, Artificial Sequence
  Description of Artificial Sequence: Synthetic coding sequence
atggagaagaccctgctggccaacctgggcaccacagccagctgcccagcccgggccaggaagtggagcaacagccagcctgctgacctggcccacatgggccgcagccgggaggaccctgctggcatggaggccagcaccatgcccatcagcgccctgcccaggaccagcagtgaccctgtgctgctgaaggccccagcccccctgggcaccgtggccgacagcctgcgggccagtgatggccagctgcaggccaaggcccccaccaagccacccaggacccccagctttgagctgcctgatgccagcgagcggccccccacctactgtgagctggtgccccgggtgcccagcgtgcagggcaccagccccagccagagctgcccagagcctgaggccccctggtgggaggccgaggaggatgaggaggaggagaaccgctgcttcacccggccccaggccgagatctccttctgcccccatgatgcccccagctgcctgctgggcccccagaaccggcccctggagccccaggtgctgcacaccctgcggggcctcttcctggagcaccaccctggcagcacagccctgcacctgctgctggtggactgccaggccaccggcctgctgggcgtgacccgggaccagaggggcaacatgggcgtgagcagcggcctggagctgctgaccctgccccacggccaccacctgcggctggagctgctggagcggcaccagaccctggccctggccggggccctggccgtgctgggctgcagcggccccctggaggagagagctgctgccctgcggggcctggtggagctggccctggccctgcggcctggagctgctggggacctgcccggcctggccgctgtgatgggcgccctgctgatgccccaggtgcggggggagcagggcctggaggaggccggcgtgcgggtgacaggcaagacaggagaggaggcctgcagcgacctcttcagccaggtgtcccggctggagcacacctggaggcagctgcggcgcagccacacagaagctgccctggcctttgagcaggagctgaagcccctgatgagggccctggatgaaggagctggcccctgtgaccctggagaggtggccctgccccacgtggcccccatggtgcggctgctggagggggaggaggtggccggccccctggatgagagctgtgagcggctgctgcggaccctgcatggagcccggcacatggtgagagatgcccccaagttcaggaaggtggccgcccagaggctgcggggcttccggcccaaccctgagctgcgggaggccctgaccaccggctttgtgcggcggctgctgtggggcagcagaggagctggggcccccagggctgagagatttgagaagttccagagggtgctgggcgtgctgagccagaggctggagccagacagatag

SEQ ID NO: 42174 - DNA, 930 bp, Artificial Sequence
  Description of Artificial Sequence: Synthetic coding sequence
atgctgcctgaggacagcggcggcagcccagatgctgctgccagtgacaagcacatccagtggctgctgggcgcagatggagaggtgtgggtgtggatcatgggagagggccctggggacaagccctatgaggagatcagcgaggagctgattgctgagcgggcccggctgcaggcccagcgggaggccgaggagctgtggaggcagaaggaggccgagatcaccaagaagttcagagatgccctggccaatgagaaggcccgcatcctggccgagaagtggaaggtggagatggaggacaggaaggccgccaaggtgctggaggagcgcatccacgaggagttcaagaggaaggaggaggaggagaggaagagaggagaggagcagatccggctgcaggaggagcagagggccaaggagctgtactggaccctgaagcaggcccagctgcactgccaggccagcgagaaggaggagcgggagtgggaggagcagctgcggcgcagcaaggccgcagatgaggagaggagccggcgggcccagagggccagagatgagtaccgccaccacagcctgcgggccatccagaagggcaccgtggccggcctgagctccatgttccgggagctgggccagagccatgagcaggaggcccggctgtaccaccacctgcctgaccccggcctgccccagcccctggccctgcctgtgtccaggacctgggagcggcccctgcggcctgtgtccagagatgtgattgtgcgctggttcaaggaggagcagctgccccggcgggccggctttgagaggaacaccaagttcatcgccccctggttccacggcggcaactaccactgcttcagaagaagagtgaccagcggcaccctgaggacagagggccagcccacccggctgcccagcgtggtgtag

SEQ ID NO: 42175 - DNA, 1074 bp, Artificial Sequence
  Description of Artificial Sequence: Synthetic coding sequence
atgctgcagcagatcctgcatgacatgtacattgatcctgagctgctggccgagctgagtgatgtgcagaagcacatcctcttctacaagatgagggaggagcagctgcggcgctggaaggagcgggagacctgggaggccctggcccaggatgagggcctgcggccccccaagaccaagagagctgccagtgacaagcacatccagtggctgctgggcgcagatggagaggtgtgggtgtggatcatgggagagggccctggggacaagccctatgaggagatcagcgaggagctgattgctgagcgggcccggctgcaggcccagcgggaggccgaggagctgtggaggcagaaggaggccgagatcaccaagaagttcagagatgccctggccaatgagaaggcccgcatcctggccgagaagtggaaggtggagatggaggacaggaaggccgccaaggtgctggaggagcgcatccacgaggagttcaagaggaaggaggaggaggagaggaagagaggagaggagcagatccggctgcaggaggagcagagggccaaggagctgtactggaccctgaagcaggcccagctgcactgccaggccagcgagaaggaggagcgggagtgggaggagcagctgcggcgcagcaaggctgctgatgaggagaggagcagaagagcccagagggccagagatgagtaccgccaccacagcctgcgggccatccagaagggcaccgtggccggcctgagctccatgttccgggagctgggccagagccatgagcaggaggcccggctgtaccaccacctgcctgaccccggcctgccccagcccctggccctgcctgtgaggacctgggagcggcccctgcggcctgtgtccagagatgtgattgtgcgctggttcaaggaggagcagctgccccggcgggccggctttgagaggaacaccaagttcatcgccccctggttccacggcggcaactaccactgcttcagaagaagagtgaccagcggcaccctgaggacagagggccagcccacccggctgcccagcgtggtgtag

SEQ ID NO: 42176 - DNA, 648 bp, Artificial Sequence
  Description of Artificial Sequence: Synthetic coding sequence
atgctgcagcagatcctgcatgacatgtacattgatcctgagctgctggccgagctgagtgatgtgcagaagcacatcctcttctacaagatgagggaggagcagctgcggcgctggaaggagcgggagacctgggaggccctggcccaggatgagggcctgcggccccccaagaccaagagggccagtgacaagcacatccagtggctgctgggcgcagatggagaggtgtgggtgtggatcatgggagagggccctggggacaagccctatgaggagatcagcgaggagctgattgctgagcgggcccggctgcaggcccagcgggaggccgaggagctgtggaggcagaaggaggccgagatcaccaagaagttcagagatgccctggccaatgagaaggcccgcatcctggccgagaagtggaaggtggagatggaggacaggaaggccgccaaggtgctggaggagcgcatccacgaggagttcaagaggaaggaggaggaggagaggaagagaggagaggagcagatccggctgcaggaggagcagagggccaaggagctgtactggaccctgaagcaggcccagctgcactgccaggccagcgagaaggaggagcgggagtgggaggagcagtgtgagtag

SEQ ID NO: 42177 - DNA, 1296 bp, Artificial Sequence
  Description of Artificial Sequence: Synthetic coding sequence
atgctgcagcagatcctgcatgacatgtacattgatcctgagctgctggccgagctgagtgatgtgcagaagcacatcctcttctacaagatgagggaggagcagctgcggcgctggaaggagcgggagacctgggaggccctggcccaggatgagggcctgcggccccccaagaccaagagggccagtgacaagcacatccagtggctgctgggcgcagatggagaggtgtgggtgtggatcatgggagagggccctggggacaagccctatgaggagatcagcgaggagctgattgctgagcgggcccggctgcaggcccagcgggaggccgaggagctgtggaggcagaaggaggccgagatcaccaagaagttcagagatgccctggccaatgagaaggcccgcatcctggccgagaagtggaaggtggagatggaggacaggaaggccgccaaggtgctggaggagcgcatccacgaggagttcaagaggaaggaggaggaggagaggaagagaggagaggagcagatccggctgcaggaggagcagagggccaaggagctgtactggaccctgaagcaggcccagctgcactgccaggccagcgagaaggaggagcgggagtgggaggagcagctgcggcgcagcaaggccgcagatgaggagaggagccggcgggcccagagggccagagatgagtaccgccaccacagcctgcgggccatccagaagggcaccgtggccggcctgagctccatgttccgggagctgggccagagccatgagcaggaggcccggctgtaccaccacctgcctgaccccggcctgccccagcccctggccctgcctgtgaggacctgggagcggcccctgcggcctgtgtccagagatgtgattgtgcgctggttcaaggaggagcagctgcccaggagagctggctttgaaagaaacaccaagttcatcgccccctggttccacggcatcatcagcagagaagatgctgaggccctgctggagaacatgacagaaggagccttcctggtgcgggtgtctgagaagatctggggctacaccctgagctaccgcctgcagaagggcttcaagcacttcctggtggatgccagcggggacttctacagcttcctgggcgtggaccccaacagacatgccaccctgacagacctggtggacttccacaaggaggagatcatcaccgtgtctggaggagagctgctgcaggagccctgtggccagagggacagccccccagactaccacctgctgtttgaatag

SEQ ID NO: 42178 - DNA, 1020 bp, Artificial Sequence
  Description of Artificial Sequence: Synthetic coding sequence
atggcccacgccctgcggcgcatcctgtacagcacctggtgcccagctgactgccagtttgccttcatggccaggaaccccaggagccctgccagcaagctgttctgccacctgtttgtgggcagccagcccggggaggtgcagatcctgcacctgctgctgtgccgctccttccagctggcctacctgctgcagcaccctgaggagcgggcccagcctgagccctgccccggccccaccggggaggtgcccctgaagcccctgagcagcagcggcggcctggtgcgggagcccttcggccgggaccagctgagccagaatgtgcacgccctggtgtccttccggcggctgcctgctgagggcctggtgggcagcggcaaggagctgcctgagagcgagggccgggcccggcatgcccggctgggcaacccctactgcagccccaccctggtgaggaagaaggccatccgcagcaaggtgatccgcagcggggcctaccggggctgcacctatgagacccagctgcagctgagcgcccgggaggccttccctgctgcctgggaggcctggccccggggccctgggggccacagctgcctggtggagagcgagggcagcctgacagagaacatctgggcctttgctggcatcagccggccctgtgccctggccctgctgcggagagatgtgctgggcgccttcctgctgtggccagagctgggcgccagcggccagtggtgcctgtctgtgaggacccagtgtggggtggtgccccaccaggtgttcaggaaccacctgggccgctactgcctggagcacctgcctgctgagttccccagcctggaggccctggtggagaaccacgctgtgacagagaggagcctcttctgccccctggacatgggccgcctgaaccccacctatgaggagcaggactgtggccccccaggccggccccccaggaccctgcggcccctgagccacgccaagtctgaggccgagctgcagggcctgggctag

SEQ ID NO: 42179 - DNA, 1272 bp, Artificial Sequence
  Description of Artificial Sequence: Synthetic coding sequence
atgcagaaggccggggccggcggcagaagagccagtgactgtggcctggccccccaccggccccgctgcatcaccaagtttgcccagtatgtgggcagcttccctgtggatgacctggacacccaggagagcgtgtggctggtgcagcagcagctgtgggccctgaaggactgccccaggagaagagctgtgatcctgaagttcagcctgcagggcctgaagatctacagcggggagggggaggtgctgctgatggcccacgccctgcggcgcatcctgtacagcacctggtgcccagctgactgccagtttgccttcatggccaggaaccccaggagccctgccagcaagctgttctgccacctgtttgtgggcagccagcccggggaggtgcagatcctgcacctgctgctgtgccgctccttccagctggcctacctgctgcagcaccctgaggagcgggcccagcctgagccctgccccggccccaccggggaggtgcccctgaagcccctgagcagcagcggcggcctggtgcgggagcccttcggccgggaccagctgagccagaatgtgcacgccctggtgtccttccggcggctgcctgctgagggcctggtgggcagcggcaaggagctgcctgagagcgagggccgggcccggcatgcccggctgggcaacccctactgcagccccaccctggtgaggaagaaggccatccgcagcaaggtgatccgcagcggggcctaccggggctgcacctatgagacccagctgcagctgagcgcccgggaggccttccctgctgcctgggaggcctggccccggggccctgggggccacagctgcctggtggagagcgagggcagcctgacagagaacatctgggcctttgctggcatcagccggccctgtgccctggccctgctgcggagagatgtgctgggcgccttcctgctgtggccagagctgggcgccagcggccagtggtgcctgtctgtgaggacccagtgtggggtggtgccccaccaggtgttcaggaaccacctgggccgctactgcctggagcacctgcctgctgagttccccagcctggaggccctggtggagaaccacgctgtgacagagaggagcctcttctgccccctggacatgggccgcctgaaccccacctatgaggagcaggactgtggccccccaggccggccccccaggaccctgcggcccctgagccacgccaagtctgaggccgagctgcagggcctgggctag

SEQ ID NO: 42180 - DNA, 381 bp, Artificial Sequence
  Description of Artificial Sequence: Synthetic coding sequence
atgcagaaggccggggccggcggcagaagagccagtgactgtggcctggccccccaccggccccgctgcatcaccaagtttgcccagtatgtgggcagcttccctgtggatgacctggacacccaggagagcgtgtggctggtgcagcagcagctgtgggccctgaaggactgccccaggagaagagctgtgatcctgaagttcagcctgcagggcctgaagatctacagcggggagggggaggtgctgctgatggcccacgccctgcggcgcatcctgtacagcacctggtgcccagctgactgccagtttgccttcatggccaggaaccccaggagccctgccagcaagctgttctgccacctgtttgtgggcagctag

SEQ ID NO: 42181 - DNA, 396 bp, Artificial Sequence
  Description of Artificial Sequence: Synthetic coding sequence
atgcagaaggccggggccggcggcagaagagccagtgactgtggcctggccccccaccggccccgctgcatcaccaagtttgcccagtatgtgggcagcttccctgtggatgacctggacacccaggagagcgtgtggctggtgcagcagcagctgtgggccctgaaggactgccccaggagaagagctgtgatcctgaagttcagcctgcagggcctgaagatctacagcggggagggggaggtgctgctgatggcccacgccctgcggcgcatcctgtacagcacctggtgcccagctgactgccagtttgccttcatggccaggaaccccaggagccctgccagcaagctgttctgccacctgtttgtgggcagccagcccggggaggtgtag

SEQ ID NO: 42182 - DNA, 213 bp, Artificial Sequence
  Description of Artificial Sequence: Synthetic coding sequence
atgcagaaggccggggccggcggcagaagagccagtgactgtggcctggccccccaccggccccgctgcatcaccaagtttgcccagtatgtgggcagcttccctgtggatgacctggacacccaggagagcgtgtggctggtgcagcagcagctgtgggccctgaaggactgccccaggagaagagctgtgatcctgaagttcagcctgtag

SEQ ID NO: 42183 - DNA, 528 bp, Artificial Sequence
  Description of Artificial Sequence: Synthetic coding sequence
atgtatgccagcagctacccacctccaccccagctgagccccaggagccacctgtgccccccaccaccccaccccaccccaccccagctgaacaacctgctgctgctggagggcaggaagagcagcctgcccagcgtggcccccactggaagtgccagcgctgctgaggacagcgacctgctgacccagccctggtacagcggcaactgtgacagatatgctgtggagagcgccctgctgcacctgcagaaggatggagcctacacagtgcggcccagcagcggcccccacggcagccagcccttcaccctggccgtgctgctgcggggccgggtcttcaacatccccatccggcggctggatggcggccgccactacgccctgggccgggagggcaggaaccgggaggagctgttcagctctgtggccgccatggtgcagcacttcatgtggcaccccctgcccctggtggacagacattctggcagccgggagctgacctgcctgctcttccccaccaagccctag

SEQ ID NO: 42184 - DNA, 432 bp, Artificial Sequence
  Description of Artificial Sequence: Synthetic coding sequence
atgcccagcggccccctgcccaggacctctgtggtgccccggcccaccacagccccccaggagaccagaaatggaacagcagatgctgccagcaaggagggcaggaagagcagcctgcccagcgtggcccccactggaagtgccagcgctgctgaagatggagcctacacagtgcggcccagcagcggcccccacggcagccagcccttcaccctggccgtgctgctgcggggccgggtcttcaacatccccatccggcggctggatggcggccgccactacgccctgggccgggagggcaggaaccgggaggagctgttcagctctgtggccgccatggtgcagcacttcatgtggcaccccctgcccctggtggacagacattctggcagccgggagctgacctgcctgctcttccccaccaagccctag

SEQ ID NO: 42185 - DNA, 1896 bp, Artificial Sequence
  Description of Artificial Sequence: Synthetic coding sequence
atgaatggagctggccctggccctgctgctgctgcccctgtgcctgtgcctgtgcctgtgcctgactggaggcagttctgtgagctgcacgcccaggccgctgctgtggactttgcccacaagttctgccgcttcctgcgggacaacccagcctatgacaccccagatgctggggccagcttcagccgccactttgctgccaacttcctggatgtgtttggagaggaggtgcggcgggtgctggtggccggccccaccaccagaggagctgctgtgtctgctgaggccatggagcctgagctggccgacaccagcgccctgaaggccgccccctacggccacagccgcagcagtgaagatgtgtccacccatgctgccaccaaggcccgggtgaggaagggcttcagcctgaggaacatgagcctgtgtgtggtggatggagtgcgggacatgtggcaccggcgggccagccctgagccagatgctgctgctgcccccaggacagctgagccccgggacaagtggacccggcggctgcggctgagcaggaccctggccgccaaggtggagctggtggacatccagcgggagggcgccctgcgcttcatggtggctgatgatgctgctgctggcagcggcggcagcgcccagtggcagaagtgccgcctgctgctgcggcgggctgtggccgaggagcgcttccggctggagttctttgtgccccccaaggccagccggcccaaggtgtccatccccctgagcgccatcatcgaggtgaggaccaccatgcccctggagatgcctgagaaggacaacacctttgtgctgaaggtggagaatggagctgagtacatcctggagaccatcgacagcctgcagaagcacagctgggtggccgacatccagggctgtgtggaccccggccctggccctggggacctggagggctcctggaccaggagctgcctgcaccccaagagggccagcgagcactgggagctgggcagagatggcagcgagagccccaagggctggggccctggagctgtggcccacatctgtgaccccaacaccctgggcggccctgctgtggagaccggcttccaccacgtgggccaggccggcctggagctgcagaccagcagtgacccccccaacagcgccagccgcagcgccaccagcggggagcagggcgctgagacagatcctgaggccgagcctgagctggagctgagtgactacccctggttccacggcaccctgagccgggtgaaggccgcccagctggtgctggccggcggccccaggaaccacggcctgtttgtgatccggcagagcgagaccaggcctggagaatatgtgctgaccttcaacttccagggcaaggccaagcacctgcggctgagcctgaatggacatggccagtgccacgtgcagcacctgtggttccagagcgtgctggacatgctgcggcacttccacacccaccccatccccctggagagcggcggcagcgctgacatcaccctgcggagctatgtgcgggcccaggaccccccacctgagcccggccccaccccacctgctgccccagccagccctgcctgctggagcgacagccctggccagcactacttcagcagcctggccgccgccgcctgccccccagccagccccagtgatgctgctggggccagcagcagcagcgccagcagcagcagcgctgccagcggccctgccccacccaggcctgtggagggccagctgagcgcccggagccgcagcaacagcgctgagcggctgctggaggccgtggccgccacagctgctgaggagcccccagaggccgcccctggccgggcccgggctgtggagaaccagtacagcttctactag

SEQ ID NO: 42186 - DNA, 714 bp, Artificial Sequence
  Description of Artificial Sequence: Synthetic coding sequence
tgagagcagggcgctgagacagatcctgaggccgagcctgagctggagctgagtgactacccctggttccacggcaccctgagccgggtgaaggccgcccagctggtgctggccggcggccccaggaaccacggcctgtttgtgatccggcagagcgagaccaggcctggagaatatgtgctgaccttcaacttccagggcaaggccaagcacctgcggctgagcctgaatggacatggccagtgccacgtgcagcacctgtggttccagagcgtgctggacatgctgcggcacttccacacccaccccatccccctggagagcggcggcagcgctgacatcaccctgcggagctatgtgcgggcccaggaccccccacctgagcccggccccaccccacctgctgccccagccagccctgcctgctggagcgacagccctggccagcactacttcagcagcctggccgccgccgcctgccccccagccagccccagtgatgctgctggggccagcagcagcagcgccagcagcagcagcgctgccagcggccctgccccacccaggcctgtggagggccagctgagcgcccggagccgcagcaacagcgctgagcggctgctggaggccgtggccgccacagctgctgaggagcccccagaggccgcccctggccgggcccgggctgtggagaaccagtacagcttctactag

SEQ ID NO: 42187 - DNA, 927 bp, Artificial Sequence
  Description of Artificial Sequence: Synthetic coding sequence
atgaatggagctggccctggccctgctgctgctgcccctgtgcctgtgcctgtgcctgtgcctgactggaggcagttctgtgagctgcacgcccaggccgctgctgtggactttgcccacaagttctgccgcttcctgcgggacaacccagcctatgacaccccagatgctggggccagcttcagccgccactttgctgccaacttcctggatgtgtttggagaggaggtgcggcgggtgctggtggccggccccaccaccagaggagctgctgtgtctgctgaggccatggagcctgagctggccgacaccagcgccctgaaggccgccccctacggccacagccgcagcagtgaagatgtgtccacccatgctgccaccaaggcccgggtgaggaagggcttcagcctgaggaacatgagcctgtgtgtggtggatggagtgcgggacatgtggcaccggcgggccagccctgagccagatgctgctgctgcccccaggacagctgagccccgggacaagtggacccggcggctgcggctgagcaggaccctggccgccaaggtggagctggtggacatccagcgggagggcgccctgcgcttcatggtggctgatgatgctgctgctggcagcggcggcagcgcccagtggcagaagtgccgcctgctgctgcggcgggctgtggccgaggagcgcttccggctggagttctttgtgccccccaaggccagccggcccaaggtgtccatccccctgagcgccatcatcgaggtgaggaccaccatgcccctggagatgcctgagaaggacaacacctttgtgctgaaggtggagaatggagctgagtacatcctggagaccatcgacagcctgcagaagcacagctgggtggccgacatccagggctgtgtggaccctggatag

SEQ ID NO: 42188 - DNA, 2016 bp, Artificial Sequence
  Description of Artificial Sequence: Synthetic coding sequence
atggaccccagctactgcccagcccacggcttccccagccaggatgccctgtggcccctgagcagccagcagtggagcagcgcccactacagcgagcctgctgctgggggctgtgatggaacagaggccatgaatggagctggccctggccctgctgctgctgcccctgtgcctgtgcctgtgcctgtgcctgactggaggcagttctgtgagctgcacgcccaggccgctgctgtggactttgcccacaagttctgccgcttcctgcgggacaacccagcctatgacaccccagatgctggggccagcttcagccgccactttgctgccaacttcctggatgtgtttggagaggaggtgagaagagtgctggtggccggccccaccaccagaggagctgctgtgtctgctgaggccatggagcctgagctggccgacaccagcgccctgaaggccgccccctacggccacagccgcagcagtgaagatgtgtccacccacgccgccaccaaggcccgggtgaggaagggcttcagcctgaggaacatgagcctgtgtgtggtggatggagtgcgggacatgtggcacagaagagccagccctgagccagatgctgctgctgcccccaggacagctgagccccgggacaagtggacccggcggctgcggctgagcaggaccctggccgccaaggtggagctggtggacatccagcgggagggcgccctgcgcttcatggtggctgatgatgctgctgctggcagcggcggcagcgcccagtggcagaagtgccgcctgctgctgcggcgggctgtggccgaggagcgcttccggctggagttctttgtgccccccaaggccagccggcccaaggtgtccatccccctgagcgccatcatcgaggtgaggaccaccatgcccctggagatgcctgagaaggacaacacctttgtgctgaaggtggagaatggagctgagtacatcctggagaccatcgacagcctgcagaagcacagctgggtggccgacatccagggctgtgtggaccccggcctgtggccaggggacctggagggctcctggaccaggagctgcctgcaccccaagagggccagcgagcactgggagctgggcagagatggcagcgagagccccaagggctggggccctggagctgtggcccacatctgctggagcaggaccccagacctgaagaggcacctgagcagccacatctacctgtttgtgcccctgagccccagcccccacgtgccccacacagtcatccccaccagcggggagcagggcgctgagacagatcctgaggccgagcctgagctggagctgagtgactacccctggttccacggcaccctgagccgggtgaaggccgcccagctggtgctggccggcggccccaggaaccacggcctgtttgtgatccggcagagcgagaccaggcctggagaatatgtgctgaccttcaacttccagggcaaggccaaggccagccacctgcggctgagcctgaatggacatggccagtgccacgtgcagcacctgtggttccagagcgtgctggacatgctgcggcacttccacacccaccccatccccctggagagcggcggcagcgctgacatcaccctgcggagctatgtgcgggcccaggaccccccacctgagcccggccccaccccacctgctgccccagccagccctgcctgctggagcgacagccctggccagcactacttcagcagcctggccgccgccgcctgccccccagccagccccagtgatgctgctggggccagcagcagcagcgccagcagcagcagcgctgccagcggccctgccccacccaggcctgtggagggccagctgagcgcccggagccgcagcaacagcgctgagcggctgctggaggccgtggccgccacagctgctgaggagcccccagaggccgcccctggccgggcccgggctgtggagaaccagtacagcttctactag

SEQ ID NO: 42189 - DNA, 1899 bp, Artificial Sequence
  Description of Artificial Sequence: Synthetic coding sequence
atgaatggagctggccctggccctgctgctgctgcccctgtgcctgtgcctgtgcctgtgcctgactggaggcagttctgtgagctgcacgcccaggccgctgctgtggactttgcccacaagttctgccgcttcctgcgggacaacccagcctatgacaccccagatgctggggccagcttcagccgccactttgctgccaacttcctggatgtgtttggagaggaggtgcggcgggtgctggtggccggccccaccaccagaggagctgctgtgtctgctgaggccatggagcctgagctggccgacaccagcgccctgaaggccgccccctacggccacagccgcagcagtgaagatgtgtccacccatgctgccaccaaggcccgggtgaggaagggcttcagcctgaggaacatgagcctgtgtgtggtggatggagtgcgggacatgtggcaccggcgggccagccctgagccagatgctgctgctgcccccaggacagctgagccccgggacaagtggacccggcggctgcggctgagcaggaccctggccgccaaggtggagctggtggacatccagcgggagggcgccctgcgcttcatggtggctgatgatgctgctgctggcagcggcggcagcgcccagtggcagaagtgccgcctgctgctgcggcgggctgtggccgaggagcgcttccggctggagttctttgtgccccccaaggccagccggcccaaggtgtccatccccctgagcgccatcatcgaggtgaggaccaccatgcccctggagatgcctgagaaggacaacacctttgtgctgaaggtggagaatggagctgagtacatcctggagaccatcgacagcctgcagaagcacagctgggtggccgacatccagggctgtgtggaccccggggacagcgaggaggacacagagctgagctgcacccggggcggctgcctggccagccgggtggccagctgcagctgtgagctgctgacagatgctgtggacctgcccaggcctcctgagaccacagctgtgggcgctgtggtgacagccccccacagccggggcagagatgctgtgcgggagagcctcatccacgtgcccctggagaccttcctgcagaccctggagagccctgggggcagcggcagtgacagcaacaacacaggagagcagggcgctgagacagatcctgaggccgagcctgagctggagctgagtgactacccctggttccacggcaccctgagccgggtgaaggccgcccagctggtgctggccggcggccccagaaatcatggcctcttcgtcatccggcagagcgagaccaggcctggagaatatgtgctgaccttcaacttccagggcaaggccaagcacctgcggctgagcctgaatggccacggccagtgccacgtgcagcacctgtggttccagagcgtgctggacatgctgcggcacttccacacccaccccatccccctggagagcggcggcagcgctgacatcaccctgcggagctatgtgcgggcccaggaccccccacctgagcccggccccaccccacctgctgccccagccagccctgcctgctggagcgacagccctggccagcactacttcagcagcctggccgctgctgcctgccccccagccagccccagtgatgctgctggggccagcagcagcagcgccagcagcagcagcgctgccagcggccctgccccacccaggcctgtggagggccagctgagcgcccggagccgcagcaacagcgctgagcggctgctggaggccgtggccgccacagctgctgaggagcccccagaggccgcccctggccgggcccgggctgtggagaaccagtacagcttctactag

SEQ ID NO: 42190 - DNA, 1236 bp, Artificial Sequence
  Description of Artificial Sequence: Synthetic coding sequence
atgacagagatgtctgagaaggaaaatgaaccagatgatgctgccacccacagccccccaggcaccgtgtctgccctgcaggagaccaagctgcagcgcttcaagaggagcctgagcctgaagaccatcctgcggagcaagagcctggagaacttcttcctgcggagcggcagcgagctgaagtgccccacagaggtgctgctgaccccacccacccccctgcccccacccagccccccacccacagccagtgaccggggcctggccacccccagccccagcccctgccctgtgccccggcccctggccgccctgaagcctgtgcggctgcacagcttccaggagcacgtgttcaagagggccagcccctgtgagctgtgccaccagctgattgtgggcaacagcaagcagggcctgcgctgcaagatgtgcaaggtgtctgtgcacctgtggtgcagcgaggagatcagccaccagcagtgccctgggaagaccagcaccagcttcagaagaaacttcagcagccccctgctggtgcatgagcccccacctgtgtgtgccaccagcaaggagagccccccaactggagacagcggcaaggtggaccctgtgtatgagaccctgcgctatggcaccagcctggccctgatgaacagaagcagcttcagcagcaccagcgagagccccaccaggagcctgtctgaaagagatgagctgacagaagatggagagggcagcatccgcagcagcgaggagggccctggggacagcgccagccctgtgttcaccgccccagctgagagcgagggccctggccctgaggagaagagccctggccagcagctgcccaaggccaccctgaggaaggatgtgggccccatgtacagctatgtggccctgtacaagttcctgccccaggagaacaatgacctggccctgcagcccggggaccgcatcatgctggtggatgacagcaatgaagactggtggaagggcaagatcggggacagagtgggcttcttccctgccaactttgtgcagagggtgcggcctggagaaaatgtgtggcgctgctgccagcccttcagcggcaacaaggagcagggctacatgagcctgaaggagaaccagatctgtgtgggcgtgggccgcagcaaggatgctgatggcttcatccgggtgagcagcggcaagaagaggggcctggtgcctgtggatgccctgacagagatctag

SEQ ID NO: 42191 - DNA, 1095 bp, Artificial Sequence
  Description of Artificial Sequence: Synthetic coding sequence
atgacagagaaggaggtgctggagagccccaagcccagcttccctgctgagacccggcagagcggcctgcagaggctgaagcagctgctgaggaagggcagcacaggcaccaaggagatggagctgcccccagagccccaggccaatggagaggccgtgggcgccggcggcggccccatctactacatctatgaggaggaggaggaggaggaggaggaggaggaggagcccccacctgagccccccaagctggtgaatgacaagccccacaagttcaaggaccacttcttcaagaagcccaagttctgtgatgtgtgtgccaggatgattgtgctgaacaacaagtttggcctgcgctgcaagaactgcaagaccaacatccacgagcactgccagagctatgtggagatgcagcgctgcttcggcaagatccccccaggcttccaccgggcctacagcagccccctgtacagcaaccagcagtatgcctgtgtgaaggacctgtctgctgccaacagaaatgaccctgtgtttgagaccctgaggactggagtcatcatggccaacaaggagaggaagaagggccaggccgacaagaagaaccctgtggccgccatgatggaggaggagcctgagagcgcccggcctgaggagggcaagccccaggacggcaaccctgagggggacaagaaggccgagaagaagaccccagatgacaagcacaagcagcccggcttccagcagagccactactttgtggccctgtaccgcttcaaggccctggagaaggatgacctggacttccccccaggagagaagatcaccgtgattgatgacagcaatgaggagtggtggaggggcaagattggagagaaggtgggcttcttcccccccaacttcatcatccgggtgcgggccggggagcgggtgcaccgggtgaccaggagctttgtgggcaaccgggagatcggccagatcaccctgaagaaggaccagatcgtggtgcagaagggagatgaagctgggggctacgtgaaggtgtacacaggcaggaaggtgggcctcttccccacagacttcctggaggagatctag

SEQ ID NO: 42192 - DNA, 507 bp, Artificial Sequence
  Description of Artificial Sequence: Synthetic coding sequence
atgacagagaaggaggtgctggagagccccaagcccagcttccctgctgagacccggcagagcggcctgcagaggctgaagcagctgctgaggaagggcagcacaggcaccaaggagatggagctgcccccagagccccaggccaatggagaggccgtgggcgccggcggcggccccatctactacatctatgaggaggaggaggaggaggaggaggaggaggaggagcccccacctgagccccccaagctggtgaatgacaagccccacaagttcaaggaccacttcttcaagaagcccaagttctgtgatgtgtgtgccaggatgattgtgctgaacaacaagtttggcctgcgctgcaagaactgcaagaccaacatccacgagcactgccagagctatgtggagatgcagcgctgcttcggcaagatccccccaggcttccaccgggcctacagcagccccctgtacagcaaccagcagtatgcctgtgtgaaggacctgtag

SEQ ID NO: 42193 - DNA, 978 bp, Artificial Sequence
  Description of Artificial Sequence: Synthetic coding sequence
atggagctgcccccagagccccaggccaacggggaggccgtgggcgctgggggcggccccatctactacatctatgaggaggaggaggaggaggaggaggaggaggaggagcccccacctgagccccccaagctggtgaatgacaagccccacaagttcaaggaccacttcttcaagaagcccaagttctgtgatgtgtgtgccaggatgattgtgctgaacaacaagtttggcctgcgctgcaagaactgcaagaccaacatccacgagcactgccagagctatgtggagatgcagcgctgcttcggcaagatccccccaggcttccaccgggcctacagcagccccctgtacagcaaccagcagtatgcctgtgtgaaggacctgtctgctgccaacagaaatgaccctgtgtttgagaccctgaggactggagtcatcatggccaacaaggagaggaagaagggccaggccgacaagaagaaccctgtggccgccatgatggaggaggagcctgagagcgcccggcctgaggagggcaagccccaggacggcaaccctgagggggacaagaaggccgagaagaagaccccagatgacaagcacaagcagcccggcttccagcagagccactactttgtggccctgtaccgcttcaaggccctggagaaggatgacctggacttccccccaggagagaagatcaccgtgattgatgacagcaatgaggagtggtggaggggcaagatcggggagaaggtgggcttcttcccccccaacttcatcatccgggtgcgggccggggagcgggtgcaccgggtgaccaggagctttgtgggcaaccgggagatcggccagatcaccctgaagaaggaccagatcgtggtgcagaagggagatgaggccggcggctacgtgaaggtgtacacaggcaggaaggtgggcctcttccccacagacttcctggaggagatctag

SEQ ID NO: 42194 - DNA, 4194 bp, Artificial Sequence
  Description of Artificial Sequence: Synthetic coding sequence
atgcccagcaagccagagggcgccgccaagaccatcggcagctatgtgcccggccccaggagccgcagccccagcctgaaccggctgggcggggccggggaggatggcaagaggccccagcccctgtggcacgtgggcagcccctttgccctgggcgccaacaaggacagcctgagcgcctttgagtacccaggccccaagaggaagctgtacagcgctgtgcccggccgcctgtttgtggccgtgaagccctaccagccccaggtggatggagagatccccctgcacagaggagacagagtgaaggtgctgagcatcggggagggcggcttctgggagggcagcgcccggggccacatcggctggttcccagcagaatgtgtggaggaggtgcagtgcaagccccgggacagccaggccgagaccagggctgacaggagcaagaagctgttccgccactacacagtgggcagctatgacagctttgacaccagcagtgactgcatcatcgaggagaagacagtggtgctgcagaagaaggacaatgaaggatttggatttgtgctgcggggggccaaggctgacacccccatcgaggagttcacccccaccccagccttccctgccctgcagtacctggagagcgtggatgaaggaggagtggcctggcaggccggcctgaggactggagacttcctgattgaggtgaacaatgaaaatgtggtgaaggtgggccaccggcaggtggtgaacatgatccggcagggcggcaaccacctggtgctgaaggtggtgacagtgaccaggaacctggaccctgatgacacagccaggaagaaggcccctcctccacccaagagggcccccaccacagccctgaccctgcggagcaagtccatgaccagcgagctggaggagctggtggacaaggcctctgtgaggaagaagaaggacaagccagaggagatcgtgcctgccagcaagcccagcagagctgctgagaacatggctgtggagccccgggtggccaccatcaagcagaggcccagcagccgctgcttccctgctggcagtgacatgaacagcgtgtatgaaaggcagggcattgctgtgatgacccccaccgtgcccggcagccccaaggcccccttcctgggcatcccccggggcaccatgaggcggcagaagagcattgacagccgcatcttcctgagcggcatcacagaggaggagcggcagttcctggccccacccatgctgaagttcaccaggagcctgtccatgccagacaccagcgaggacatccccccaccaccccagagcgtgccccccagccccccaccacccagccccaccacctacaactgccccaagagccccaccccccgggtgtatggcaccatcaagccagccttcaaccagaacagcgctgccaaggtgtccccagccaccaggagtgacacagtggccaccatgatgagggagaagggcatgtacttcagaagagagctggaccgctacagcctggacagcgaggacctgtacagcagaaatgccggcccccaggccaacttcaggaacaagaggggccagatgcctgagaacccctacagcgaggtgggcaagatcgccagcaaggctgtgtatgtgcctgccaagccagcccggaggaagggcatgctggtgaagcagagcaatgtggaggacagccctgagaagacctgcagcatccccatccccaccatcatcgtgaaggagcccagcaccagcagcagcggcaagagcagccagggcagctccatggagattgacccccaggcccctgagccccccagccagctgcggccagatgagagcctgactgtgagcagcccctttgctgctgccatcgccggggctgtgcgggaccgggagaagaggctggaggcccggaggaacagccctgccttcctgagcacagacctgggagatgaagatgtgggcctgggccccccagcccccaggacccggcccagcatgtttcctgaggagggggactttgctgatgaagattctgctgagcagctgagcagccccatgcccagcgccaccccccgggagcctgagaaccactttgtgggcggcgctgaggccagcgcccctggagaggccggccggcccctgaacagcaccagcaaggcccagggccctgagagcagccctgctgtgcccagcgccagcagcggcacagctggccctggcaactacgtgcaccccctgaccggccgcctgctggaccccagcagccccctggccctggccctgagcgcccgggaccgggccatgaaggagagccagcagggccccaagggggaggcccccaaggctgacctgaacaagcccctgtacatcgacaccaagatgaggcccagcctggatgctggcttccccaccgtgacccggcagaacacccggggccccctgcggcggcaggagacagagaacaagtatgaaacagacctgggccgggacagaaaaggagatgacaagaagaacatgctgattgacatcatggacaccagccagcagaagtctgctggcctgctgatggtgcacacagtggatgccaccaagctggacaatgccctgcaggaggaggatgagaaggccgaggtggagatgaagccagacagcagccccagcgaggtgcctgagggcgtgtctgaaacagaaggagccctgcagatctctgctgcccctgagcccaccaccgtgcccggccgcaccatcgtggccgtgggctccatggaggaggccgtcatcctgcccttccgcatccccccaccacccctggcctctgtggacctggatgaggacttcatcttcacagagcccctgcccccacccctggagtttgccaacagctttgacatcccagatgaccgggccgcctctgtgcctgccctgagtgacctggtgaagcagaagaagagtgacaccccccagagccccagcctgaacagcagccagcccaccaacagcgctgacagcaagaagccagccagcctgagcaactgcctgcctgccagcttcctgcccccacctgagagctttgatgctgtggccgacagcggcatcgaggaggtggacagccgcagcagcagtgaccaccacctggagaccaccagcaccatcagcacagtgagcagcatcagcaccctgagcagcgagggcggagaaaatgtggacacctgcaccgtgtatgcagatggccaggccttcatggtggacaagccccctgtgccccccaagcccaagatgaagcccatcatccacaagagcaatgccctgtaccaggatgccctggtggaggaggatgtggacagctttgtgatccccccaccagcccctcctcctcctcctggcagcgcccagcccggcatggccaaggtgctgcagcccaggaccagcaagctgtggggagatgtgacagagatcaagagccccatcctgagcggccccaaggccaacgtcatcagcgagctgaacagcatcctgcagcagatgaaccgggagaagctggccaagccaggagagggcctggacagccccatgggcgccaagagcgccagcctggcccccaggagccctgagatcatgagcaccatcagcggcaccaggagcaccaccgtgaccttcaccgtgcggcccggcaccagccagcccatcaccctgcagagccggcccccagactatgagagcaggaccagcggcacccggcgggcccccagccctgtggtgagccccacagagatgaacaaggagaccctgcctgcccccctgtctgctgccacagccagccccagccctgccctgagtgatgtgttcagcctgcccagccagcccccatctggggacctgtttggcctgaacccagctggccgcagccgcagccccagccccagcatcctgcagcagcccatcagcaacaagcccttcaccaccaagcctgtgcacctgtggaccaagccagatgtggccgactggctggagagcctgaacctgggggagcacaaggaggccttcatggacaatgaaattgatggcagccacctgcccaacctgcagaaggaggacctgattgacctgggcgtgaccagggtgggccacaggatgaacatcgagcgggccctgaagcagctgctggacagatag

SEQ ID NO: 42195 - DNA, 4011 bp, Artificial Sequence
  Description of Artificial Sequence: Synthetic coding sequence
atggagaacctgcctgctgtgaccacagaggagcccacccccatgggccggggccctgtgggccccagcggcggcggcagcacccgggaccaggtgaggacagtggtgatgaggcccagcgtgtcctgggagaaggccggccctgaggaggccaaggcccctgtgagaggagatgaggcccccccagcccgggtggccggccctgctgctggcaccccaccctgccagatgggcgtgtaccccacagacctgaccctgcagctgctggccgtgcggaggaagagccggctgcgggaccccggcctgcagcagaccctgcggggccagctgcggctgctggagaatgacagccgggagatggcccgggtgctgggggagctgagcgcccggctgctgagcatccacagcgaccaggacagaattgtggtgaccttcaagacctttgaggagatctggaagttcagcacctaccacgccctgggcttcacccaccactgcctggccaacctgctgatggaccaggccttctggctgctgctgcccagcgaggaggaggagacagccatccaggtgcacgtggatgaaaatgccctgcggctgacccatgagagcctgctgatccaggagggccccttctttgtgctgtgcccagaccaccacgtgcgggtgatgacaggccccagagatgctggaaatggcccccaggccctgcggcaggccagcggggccccccagggcgaggccgcccctgagacagacagcagcccccccagccccagcgtgtcctctgaggaggtggccgtggccgccgcccctgagcccctcatccccttccaccagtgggccctgcgcatcccccaggaccccattgatgatgccatgggcggccctgtgatgcctggcaaccccctgatggctgtgggcctggccagcgccctggccgacttccagggcagcggccctgaggagatgaccttccggggcggggacctgattgagatcctgggcgcccaggtgcccagcctgccctggtgtgtgggcagacatgctgccagcggccgggtgggctttgtgcgcagcagcctcatctccatgcagggccctgtgtctgagctggagagcgccatcttcctgaatgaggaggagaagagcttcttcagcgagggctgcttcagcgaggaggatgcccggcagctgctgcggaggatgagcggcacagatgtgtgcagcgtgtacagcctggacagcgtggaggaggccgagacagagcagccccaggagaaggagatccccccaccctgcctgagcctggagccccaggagaccctgcagaaggtgaagaatgtgctggagcagtgcaagacctgccccggctgcccccaggagcccgcctcctggggcctgtgtgccgccagcagtgatgtgtccctgcaggaccctgaggagcccagcttctgcctggaggccgaggatgactgggaggaccctgaggccctgagcagcctgctgctcttcctgaatgcccctggctacaaggccagcttccggggcctgtatgatgtggccctgccctggctgagcagcgtcttccgctccttcagtgatgaggaggagctgaccggccgcctggcccaggcccggggagctgccaagaaggccggcctgctgatggccctggcccggctgtgcttcctgctgggccgcctgtgcagccggcggctgaagctgagccaggcccgggtgtactttgaggaggccctgggcgccctggagggcagctttggagacctcttcctggtggtggccgtgtatgccaacctggccagcatctacaggaagcagaagaaccgggagaagtgtgcccaggtggtgcccaaggccatggccctgctgctgggcaccccagaccacatctgcagcacagaagctgagggggagctgctgcagctggccctgcggcgggctgtgggcggccagagcctgcaggccgaggcccgggcctgcttcctgctggcccggcaccacgtgcacctgaagcagcctgaggaggccctgcccttcctggagcggctgctgctgctgcaccgggacagcggggcccctgaggccgcctggctgagtgactgctacctgctgctggccgacatctacagcaggaagtgcctgccccacctggtgctgagctgtgtgaaggtggccagcctgcggacccggggcagcctggccggcagcctgcggtctgtgaacctggtgctgcagaatgccccccagccccacagcctgcctgcccagaccagccactacctgcggcaggccctggccagcctgaccccaggcaccggccaggccctgcggggccccctgtacaccagcctggcccagctgtacagccaccacggctgccacggccctgccatcaccttcatgacccaggccgtggaggccagcgccatcgccggcgtgcgggccatcgtggaccacctggtggccctggcctggctgcacgtgctgcacggccagagccctgtggccctggacatcctgcagagcgtgagagatgctgtggtggccagcgaggaccaggagggcgtgattgccaacatggtggccgtggccctgaagaggacaggccgcacccggcaggccgctgagagctactaccgggccctgcgggtggcccgggacctgggccagcagaggaaccaggccgtgggcctggccaactttggagccctgtgcctgcacgccggggccagccggctggcccagcactacctgctggaggccgtgcggctcttcagccggctgcccctgggggagtgtggccgggacttcacccacgtgctgctgcagctgggccacctgtgcacccggcagggccctgcccagcagggcaagggctactatgagtgggccctgctggtggccgtggagatgggccacgtggagagccagctgcgggctgtgcagaggctgtgccacttctacagcgctgtgatgcccagcgaggcccagtgtgtgatctaccacgagctgcagctgagcctggcctgcaaggtggccgacaaggtgctggagggccagctgctggagaccatcagccagctgtacctgagcctgggcacagagcgggcctacaagagcgccctggactacaccaagaggagcctgggcatcttcatcgacctgcagaagaaggagaaggaggcccacgcctggctgcaggccggcaagatctactacatcctgcggcagagcgagctggtggacctgtacatccaggtggcccagaatgtggccctgtacacaggagaccccaacctgggcctggagctgtttgaagctgctggggacatcttctttgatggagcctgggagcgggagaaggctgtgtccttctacagagaccgggccctgcccctggccgtgaccactggaaacaggaaggccgagctgcggctgtgcaacaagctggtggccctgctggccaccctggaggagccccaggagggcctggagtttgcccacatggccctggccctgagcatcaccctgggggaccggctgaatgaaagagtggcctaccaccggctggccgccctgcagcaccggctgggccatggagagctggccgagcacttctacctgaaggccctgagcctgtgcaacagccccctggagtttgatgaggagaccctgtactacgtgaaggtgtacctggtgctgggggacatcatcttctatgacctgaaggacccctttgatgctgctggctactaccagctggccctggccgctgctgtggacctgggcaacaagaaggcccagctgaagatctacacccggctggccaccatctaccacaacttcctgctggaccgggagaagagcctcttcttctaccagaaggcccggacctttgccacagagctgaatgtgcggcgggtgaacctgccccccctgcccctgtgtggctgggccccctggctggcccccagccaccccaggtag

SEQ ID NO: 42196 - DNA, 2469 bp, Artificial Sequence
  Description of Artificial Sequence: Synthetic coding sequence
cccacccgggccagcagcagcaagaagcagaggcctcccagcagcggcagccgctgggccctgcgcatcccccaggaccccattgatgatgccatgggcggccctgtgatgcctggcaaccccctgatggctgtgggcctggccagcgccctggccgacttccagggcagcggccctgaggagatgaccttccggggcggggacctgattgagatcctgggcgcccaggtgcccagcctgccctggtgtgtgggcagacatgctgccagcggccgggtgggctttgtgcgcagcagcctcatctccatgcagggccctgtgtctgagctggagagcgccatcttcctgaatgaggaggagaagagcttcttcagcgagggctgcttcagcgaggaggatgcccggcagctgctgcggaggatgagcggcacagatgtgtgcagcgtgtacagcctggacagcgtggaggaggccgagacagagcagccccaggagaaggagatccccccaccctgcctgagcctggagccccaggagaccctgcagaaggtgaagaatgtgctggagcagtgcaagacctgccccggctgcccccaggagcccgcctcctggggcctgtgtgccgccagcagtgatgtgtccctgcaggaccctgaggagcccagcttctgcctggaggccgaggatgactgggaggaccctgaggccctgagcagcctgctgctcttcctgaatgcccctggctacaaggccagcttccggggcctgtatgatgtggccctgccctggctgagcagcgtcttccgctccttcagtgatgaggaggagctgaccggccgcctggcccaggcccggggagctgccaagaaggccggcctgctgatggccctggcccggctgtgcttcctgctgggccgcctgtgcagccggcggctgaagctgagccaggcccgggtgtactttgaggaggccctgggcgccctggagggcagctttggagacctcttcctggtggtggccgtgtatgccaacctggccagcatctacaggaagcagaagaaccgggagaagtgtgcccaggtggtgcccaaggccatggccctgctgctgggcaccccagaccacatctgcagcacagaagctgagggggagctgctgcagctggccctgcggcgggctgtgggcggccagagcctgcaggccgaggcccgggcctgcttcctgctggcccggcaccacgtgcacctgaagcagcctgaggaggccctgcccttcctggagcggctgctgctgctgcaccgggacagcggggcccctgaggccgcctggctgagtgactgctacctgctgctggccgacatctacagcaggaagtgcctgccccacctggtgctgagctgtgtgaaggtggccagcctgcggacccggggcagcctggccggcagcctgcggtctgtgaacctggtgctgcagaatgccccccagccccacagcctgcctgcccagaccagccactacctgcggcaggccctggccagcctgaccccaggcaccggccaggccctgcggggccccctgtacaccagcctggcccagctgtacagccaccacggctgccacggccctgccatcaccttcatgacccaggccgtggaggccagcgccatcgccggcgtgcgggccatcgtggaccacctggtggccctggcctggctgcacgtgctgcacggccagagccctgtggccctggacatcctgcagagcgtgagagatgctgtggtggccagcgaggaccaggagggcgtgattgccaacatggtggccgtggccctgaagaggacaggccgcacccggcaggccgctgagagctactaccgggccctgcgggtggcccgggacctgggccagcagaggaaccaggccgtgggcctggccaactttggagccctgtgcctgcacgccggggccagccggctggcccagcactacctgctggaggccgtgcggctcttcagccggctgcccctgggggagtgtggccgggacttcacccacgtgctgctgcagctgggccacctgtgcacccggcagggccctgcccagcagggcaagggctactatgagtgggccctgctggtggccgtggagatgggccacgtggagagccagctgcgggctgtgcagaggctgtgccacttctacagcgctgtgatgcccagcgaggcccagtgtgtgatctaccacgagctgcagctgagcctggcctgcaaggtggccgacaaggtgctggagggccagctgctggagaccatcagccagctgtacctgagcctgggcacagagaggagcagccagccccagcagaagcagctgcacgccttctgggccgtgctgcccacctggtggctgctgagcagtgacctgtgcctgcccagggtcttcaccccaggcctgcacctgagcccctag

SEQ ID NO: 42197 - DNA, 285 bp, Artificial Sequence
  Description of Artificial Sequence: Synthetic coding sequence
atggagaacctgcctgctgtgaccacagaggagcccacccccatgggccggggccctgtgggccccagcggcggcggcagcacccgggaccaggtgaggacagtggtgatgaggcccagcgtgtcctgggagaaggccggccctgaggaggccaaggcccctgtgagaggagatgaggcccccccagcccgggtggccggccctgctgctggcaccccaccctgccagatgggcgtgtaccccacagacctgaccctgcagctgctggccgtgcggaggaagtag

SEQ ID NO: 42198 - DNA, 3195 bp, Artificial Sequence
  Description of Artificial Sequence: Synthetic coding sequence
atggaccaggccttctggctgctgctgcccagcgaggaggaggagacagccatccaggtgcacgtggatgaaaatgccctgcggctgacccatgagagcctgctgatccaggagggccccttctttgtgctgtgcccagaccaccacgtgcgggtgatgacaggccccagagatgctggaaatggcccccaggccctgcggcaggccagcggggccccccagggcgaggccgcccctgagacagacagcagcccccccagccccagcgtgagcagcgaggaggtggccgtggccgccgcccctgagcccctcatccccttccaccagtgggccctgcgcatcccccaggaccccattgatgatgccatgggcggccctgtgatgcctggcaaccccctgatggctgtgggcctggccagcgccctggccgacttccagggcagcggccctgaggagatgaccttccggggcggggacctgattgagatcctgggcgcccaggtgcccagcctgccctggtgtgtgggcagacatgctgccagcggccgggtgggctttgtgcgcagcagcctcatctccatgcagggccctgtgtctgagctggagagcgccatcttcctgaatgaggaggagaagagcttcttcagcgagggctgcttctctgaagaagatgcccggcagctgctgcggaggatgtctggaacagatgtgtgcagcgtgtacagcctggacagcgtggaggaggccgagacagagcagccccaggagaaggagatccccccaccctgcctgagcctggagccccaggagaccctgcagaaggtgaagaatgtgctggagcagtgcaagacctgccccggctgcccccaggagcccgcctcctggggcctgtgtgccgccagcagtgatgtgtccctgcaggaccctgaggagcccagcttctgcctggaggctgaagatgactgggaggaccctgaggccctgagcagcctgctgctcttcctgaatgcccctggctacaaggccagcttccggggcctgtatgatgtggccctgccctggctgagctctgtgttccgctccttcagtgatgaggaggagctgaccggccgcctggcccaggcccggggggccgccaagaaggccggcctgctgatggccctggcccggctgtgcttcctgctgggccgcctgtgcagccggcggctgaagctgagccaggcccgggtgtactttgaggaggccctgggcgccctggagggcagctttggagacctcttcctggtggtggccgtgtatgccaacctggccagcatctacaggaagcagaagaaccgggagaagtgtgcccaggtggtgcccaaggccatggccctgctgctgggcaccccagaccacatctgcagcacagaggccgagggggagctgctgcagctggccctgcggcgggctgtgggcggccagagcctgcaggccgaggcccgggcctgcttcctgctggcccggcaccacgtgcacctgaagcagcctgaggaggccctgcccttcctggagcggctgctgctgctgcaccgggacagcggggcccctgaggccgcctggctgagtgactgctacctgctgctggccgacatctacagcaggaagtgcctgccccacctggtgctgagctgtgtgaaggtggccagcctgcggacccggggcagcctggccggcagcctgcggtctgtgaacctggtgctgcagaatgccccccagccccacagcctgcctgcccagaccagccactacctgcggcaggccctggccagcctgaccccaggcaccggccaggccctgcggggccccctgtacaccagcctggcccagctgtacagccaccacggctgccacggccctgccatcaccttcatgacccaggccgtggaggccagcgccatcgccggcgtgcgggccatcgtggaccacctggtggccctggcctggctgcacgtgctgcacggccagagccctgtggccctggacatcctgcagagcgtgagagatgctgtggtggccagcgaggaccaggagggcgtcatcgccaacatggtggccgtggccctgaagaggactggaagaacccggcaggccgctgagagctactaccgggccctgcgggtggcccgggacctgggccagcagaggaaccaggccgtgggcctggccaactttggagccctgtgcctgcatgctggggccagccggctggcccagcactacctgctggaggccgtgcggctcttcagccggctgcccctgggagaatgtggccgggacttcacccacgtgctgctgcagctgggccacctgtgcacccggcagggccctgcccagcagggcaagggctactatgagtgggccctgctggtggccgtggagatgggccacgtggagagccagctgcgggctgtgcagaggctgtgccacttctacagcgctgtgatgcccagcgaggcccagtgtgtgatctaccacgagctgcagctgagcctggcctgcaaggtggccgacaaggtgctggagggccagctgctggagaccatcagccagctgtacctgagcctgggcacagagcgggcctacaagagcgccctggactacaccaagaggagcctgggcatcttcatcgacctgcagaagaaggagaaggaggcccacgcctggctgcaggccggcaagatctactacatcctgcggcagagcgagctggtggacctgtacatccaggtggcccagaatgtggccctgtacaccggggaccccaacctgggcctggagctgtttgaggccgccggggacatcttctttgatggagcctgggagcgggagaaggctgtgtccttctacagagaccgggccctgcccctggccgtgaccaccggcaacaggaaggccgagctgcggctgtgcaacaagctggtggccctgctggccaccctggaggagccccaggagggcctggagtttgcccacatggccctggccctgagcatcaccctgggggaccggctgaatgaaagagtggcctaccaccggctggccgccctgcagcaccggctgggccacggggagctggccgagcacttctacctgaaggccctgagcctgtgcaacagccccctggagtttgatgaggagaccctgtacacctag

SEQ ID NO: 42199 - DNA, 3783 bp, Artificial Sequence
  Description of Artificial Sequence: Synthetic coding sequence
atgggcgtgtaccccacagacctgaccctgcagctgctggccgtgcggaggaagagccggctgcgggaccccggcctgcagcagaccctgcggggccagctgcggctgctggagaatgacagccgggagatggcccgggtgctgggggagctgagcgcccggctgctgagcatccacagcgaccaggacagaattgtggtgaccttcaagacctttgaggagatctggaagttcagcacctaccacgccctgggcttcacccaccactgcctggccaacctgctgatggaccaggccttctggctgctgctgcccagcgaggaggaggagacagccatccaggtgcacgtggatgaaaatgccctgcggctgacccatgagagcctgctgatccaggagggccccttctttgtgctgtgcccagaccaccacgtgcgggtgatgacaggccccagagatgctggaaatggcccccaggccctgcggcaggccagcggggccccccagggcgaggccgcccctgagacagacagcagcccccccagccccagcgtgtcctctgaggaggtggccgtggccgccgcccctgagcccctcatccccttccaccagtgggccctgcgcatcccccaggaccccattgatgatgccatgggcggccctgtgatgcctggcaaccccctgatggctgtgggcctggccagcgccctggccgacttccagggcagcggccctgaggagatgaccttccggggcggggacctgattgagatcctgggcgcccaggtgcccagcctgccctggtgtgtgggcagacatgctgccagcggccgggtgggctttgtgcgcagcagcctcatctccatgcagggccctgtgtctgagctggagagcgccatcttcctgaatgaggaggagaagagcttcttcagcgagggctgcttcagcgaggaggatgcccggcagctgctgcggaggatgagcggcacagatgtgtgcagcgtgtacagcctggacagcgtggaggaggccgagacagagcagccccaggagaaggagatccccccaccctgcctgagcctggagccccaggagaccctgcagaaggtgaagaatgtgctggagcagtgcaagacctgccccggctgcccccaggagcccgcctcctggggcctgtgtgccgccagcagtgatgtgtccctgcaggaccctgaggagcccagcttctgcctggaggccgaggatgactgggaggaccctgaggccctgagcagcctgctgctcttcctgaatgcccctggctacaaggccagcttccggggcctgtatgatgtggccctgccctggctgagcagcgtcttccgctccttcagtgatgaggaggagctgaccggccgcctggcccaggcccggggagctgccaagaaggccggcctgctgatggccctggcccggctgtgcttcctgctgggccgcctgtgcagccggcggctgaagctgagccaggcccgggtgtactttgaggaggccctgggcgccctggagggcagctttggagacctcttcctggtggtggccgtgtatgccaacctggccagcatctacaggaagcagaagaaccgggagaagtgtgcccaggtggtgcccaaggccatggccctgctgctgggcaccccagaccacatctgcagcacagaagctgagggggagctgctgcagctggccctgcggcgggctgtgggcggccagagcctgcaggccgaggcccgggcctgcttcctgctggcccggcaccacgtgcacctgaagcagcctgaggaggccctgcccttcctggagcggctgctgctgctgcaccgggacagcggggcccctgaggccgcctggctgagtgactgctacctgctgctggccgacatctacagcaggaagtgcctgccccacctggtgctgagctgtgtgaaggtggccagcctgcggacccggggcagcctggccggcagcctgcggtctgtgaacctggtgctgcagaatgccccccagccccacagcctgcctgcccagaccagccactacctgcggcaggccctggccagcctgaccccaggcaccggccaggccctgcggggccccctgtacaccagcctggcccagctgtacagccaccacggctgccacggccctgccatcaccttcatgacccaggccgtggaggccagcgccatcgccggcgtgcgggccatcgtggaccacctggtggccctggcctggctgcacgtgctgcacggccagagccctgtggccctggacatcctgcagagcgtgagagatgctgtggtggccagcgaggaccaggagggcgtgattgccaacatggtggccgtggccctgaagaggacaggccgcacccggcaggccgctgagagctactaccgggccctgcgggtggcccgggacctgggccagcagaggaaccaggccgtgggcctggccaactttggagccctgtgcctgcacgccggggccagccggctggcccagcactacctgctggaggccgtgcggctcttcagccggctgcccctgggggagtgtggccgggacttcacccacgtgctgctgcagctgggccacctgtgcacccggcagggccctgcccagcagggcaagggctactatgagtgggccctgctggtggccgtggagatgggccacgtggagagccagctgcgggctgtgcagaggctgtgccacttctacagcgctgtgatgcccagcgaggcccagtgtgtgatctaccacgagctgcagctgagcctggcctgcaaggtggccgacaaggtgctggagggccagctgctggagaccatcagccagctgtacctgagcctgggcacagagcgggcctacaagagcgccctggactacaccaagaggagcctgggcatcttcatcgacctgcagaagaaggagaaggaggcccacgcctggctgcaggccggcaagatctactacatcctgcggcagagcgagctggtggacctgtacatccaggtggcccagaatgtggccctgtacacaggagaccccaacctgggcctggagctgtttgaagctgctggggacatcttctttgatggagcctgggagcgggagaaggctgtgtccttctacagagaccgggccctgcccctggccgtgaccactggaaacaggaaggccgagctgcggctgtgcaacaagctggtggccctgctggccaccctggaggagccccaggagggcctggagtttgcccacatggccctggccctgagcatcaccctgggggaccggctgaatgaaagagtggcctaccaccggctggccgccctgcagcaccggctgggccatggagagctggccgagcacttctacctgaaggccctgagcctgtgcaacagccccctggagtttgatgaggagaccctgtactacgtgaaggtgtacctggtgctgggggacatcatcttctatgacctgaaggacccctttgatgctgctggctactaccagctggccctggccgctgctgtggacctgggcaacaagaaggcccagctgaagatctacacccggctggccaccatctaccacaacttcctgctggaccgggagaagagcctcttcttctaccagaaggcccggacctttgccacagagctgaatgtgcggcgggtgaacctgccccccctgcccctgtgtggctgggccccctggctggcccccagccaccccaggtag

SEQ ID NO: 42200 - DNA, 1209 bp, Artificial Sequence
  Description of Artificial Sequence: Synthetic coding sequence
atgccagacaagacagccaccccagagcggcccccagccccagaaaatgcccccagcagcaagaagatcccagccccagacaaggtgcccagccctgagaagaccctgaccctgggggacaaggccagcatccctggcaacagcaccagcggcaagatcccagccccagacaaggtgcccaccccagagaagatggtgaccccagaggacaaggccagcatccctgagaacagcatcatccctgaggagaccctgactgtggacaagcccagcaccccagagagggtcttctctgtggaggagagccctgccctggaggccccacccatggacaaggtgcccaaccccaagatggcccccctgggagatgaggcccccaccctggagaaggtgctgaccccagagctgtctgaggaggaggtgtccaccagagatgacatccagttccaccacttcagcagcgaggaggccctgcagaaggtgaagtactttgtggccaaggaggaccccagcagccaggaggaggcccacaccccagaggcccccccaccccagccccccagcagcgagcgctgcctgggggagatgaagtgcaccctggtgcggggggacagcagcccccggcaggccgagctgaagagcggccctgccagcaggcctgccctggagaagccccacccccatgaggaggccaccaccctgcctgaggaggcccccagcaatgatgagaggaccccagaggaggaggcccccccaaatgagcagaggcccctgcgggaggaggtgctgcccaaggagggcgtggccagcaaggaggaggtgaccctgaaggaggagctgccccccaaggaggaggtggcccccaaggaggaggtgccccccatcgagcgggcctttgcccagaagacccggcccatcaagcccccaccagacagccaggagaccctggccctgcccagcctggtgccccagaactacacagagaacaagaatgaaggagtggatgtgaccagcctgcggggggaggtggagagcctgcggcgggccctggagctgatggaggtgcagctggagaggaagctgacagacatctgggaggagctgaagtctgagaaggagcagaggcggcggctggaggtgcaggtgatgcagggcacccagaagagccagacccccagggtcatccacacccagacccagacctactag

SEQ ID NO: 42201 - DNA, 1923 bp, Artificial Sequence
  Description of Artificial Sequence: Synthetic coding sequence
atggtgcagagcgagctgcagctgcagccccgggccggcggccgggcagaggccgcctcctggggagacagaggaaatgacaagggcggcctgggcaacccagacatgcccagcgtgtccccaggcccccagaggcctcccaagctgagcagcctggcctatgacagccccccagactacctgcagacagtgagccaccctgaggtgtacagagtgctgtttgactaccagcctgaggccccagatgagctggccctgcggagaggagatgtggtgaaggtgctgagcaagaccacagaggacaagggctggtgggagggggagtgccagggccggcggggcgtcttcccagacaactttgtgctgcccccaccacccatcaagaagctggtgcccaggaaggtggtgtcccgggagagcgcccccatcaaggagcccaagaagctgatgcccaagaccagcctgcccaccgtgaagaagctggccacagccaccaccggccccagcaaggccaagaccagcaggacccccagccgggacagccagaagctgaccagccgggacagcggccccaacggcggcttccagagcggcggcagctaccaccctggcaggaagaggagcaagacccagaccccccagcagaggtctgtgagcagccaggaggaggagcacagcagccctgtgaaggcccccagcgtgaagaggacccccatgccagacaagacagccaccccagagcggcccccagccccagaaaatgcccccagcagcaagaagatcccagccccagacaaggtgcccagccctgagaagaccctgaccctgggggacaaggccagcatccctggcaacagcaccagcggcaagatcccagccccagacaaggtgcccaccccagagaagatggtgaccccagaggacaaggccagcatccctgagaacagcatcatccctgaggagaccctgactgtggacaagcccagcaccccagagagggtcttctctgtggaggagagccctgccctggaggccccacccatggacaaggtgcccaaccccaagatggcccccctgggagatgaggcccccaccctggagaaggtgctgaccccagagctgtctgaggaggaggtgtccaccagagatgacatccagttccaccacttcagcagcgaggaggccctgcagaaggtgaagtactttgtggccaaggaggaccccagcagccaggaggaggcccacaccccagaggcccccccaccccagccccccagcagcgagcgctgcctgggggagatgaagtgcaccctggtgcggggggacagcagcccccggcaggccgagctgaagagcggccctgccagcaggcctgccctggagaagccccacccccatgaggaggccaccaccctgcctgaggaggcccccagcaatgatgagaggaccccagaggaggaggcccccccaaatgagcagaggcccctgcgggaggaggtgctgcccaaggagggcgtggccagcaaggaggaggtgaccctgaaggaggagctgccccccaaggaggaggtggcccccaaggaggaggtgccccccatcgagcgggcctttgcccagaagacccggcccatcaagcccccaccagacagccaggagaccctggccctgcccagcctggtgccccagaactacacagagaacaagaatgaaggagtggatgtgaccagcctgcggggggaggtggagagcctgcggcgggccctggagctgatggaggtgcagctggagaggaagctgacagacatctgggaggagctgaagtctgagaaggagcagaggcggcggctggaggtgcaggtgatgcagggcacccagaagagccagacccccagggtcatccacacccagacccagacctactag

SEQ ID NO: 42202 - DNA, 2271 bp, Artificial Sequence
  Description of Artificial Sequence: Synthetic coding sequence
atggaggtgctggtgctggccggctaccgggcccagaaggaggatgagctgagcctggcccctggagatgtggtgcggcaggtgcgctgggtgcctgcccggggctggctgcggggggagtttggaggccgctatggcctcttccctgagcggctggtgcaggagatccctgagaccctgcggggcagcggggaggcccggcggccccgctgtgcccggcggcggggccacccagccaagcacccccggccccagcgctggtgcaaggtgaacttctcctacagccctgagcaggctgatgagctgaagctgcaggccggggagatcgtggagatgatcaaggagattgaagatggctggtggctgggcaagaagaatggccagctgggcgccttccccagcaactttgtggagctgctggacagcggcccccccagcctgggcaacccagacatgcccagcgtgtccccaggcccccagaggcctcccaagctgagcagcctggcctatgacagccccccagactacctgcagacagtgagccaccctgaggtgtacagagtgctgtttgactaccagcctgaggccccagatgagctggccctgcggagaggagatgtggtgaaggtgctgagcaagaccacagaggacaagggctggtgggagggggagtgccagggccggcggggcgtcttcccagacaactttgtgctgcccccaccacccatcaagaagctggtgcccaggaaggtggtgtcccgggagagcgcccccatcaaggagcccaagaagctgatgcccaagaccagcctgcccaccgtgaagaagctggccacagccaccaccggccccagcaaggccaagaccagcaggacccccagccgggacagccagaagctgaccagccgggacagcggccccaacggcggcttccagagcggcggcagctaccaccctggcaggaagaggagcaagacccagaccccccagcagaggtctgtgagcagccaggaggaggagcacagcagccctgtgaaggcccccagcgtgaagaggacccccatgccagacaagacagccaccccagagcggcccccagccccagaaaatgcccccagcagcaagaagatcccagccccagacaaggtgcccagccctgagaagaccctgaccctgggggacaaggccagcatccctggcaacagcaccagcggcaagatcccagccccagacaaggtgcccaccccagagaagatggtgaccccagaggacaaggccagcatccctgagaacagcatcatccctgaggagaccctgactgtggacaagcccagcaccccagagagggtcttctctgtggaggagagccctgccctggaggccccacccatggacaaggtgcccaaccccaagatggcccccctgggagatgaggcccccaccctggagaaggtgctgaccccagagctgtctgaggaggaggtgtccaccagagatgacatccagttccaccacttcagcagcgaggaggccctgcagaaggtgaagtactttgtggccaaggaggaccccagcagccaggaggaggcccacaccccagaggcccccccaccccagccccccagcagcgagcgctgcctgggggagatgaagtgcaccctggtgcggggggacagcagcccccggcaggccgagctgaagagcggccctgccagcaggcctgccctggagaagccccacccccatgaggaggccaccaccctgcctgaggaggcccccagcaatgatgagaggaccccagaggaggaggcccccccaaatgagcagaggcccctgcgggaggaggtgctgcccaaggagggcgtggccagcaaggaggaggtgaccctgaaggaggagctgccccccaaggaggaggtggcccccaaggaggaggtgccccccatcgagcgggcctttgcccagaagacccggcccatcaagcccccaccagacagccaggagaccctggccctgcccagcctggtgccccagaactacacagagaacaagaatgaaggagtggatgtgaccagcctgcggggggaggtggagagcctgcggcgggccctggagctgatggaggtgcagctggagaggaagctgacagacatctgggaggagctgaagtctgagaaggagcagaggcggcggctggaggtgcaggtgatgcagggcacccagaagagccagacccccagggtcatccacacccagacccagacctactag

SEQ ID NO: 42203 - DNA, 1938 bp, Artificial Sequence
  Description of Artificial Sequence: Synthetic coding sequence
atgatcaaggagattgaagatggctggtggctgggcaagaagaatggccagctgggcgccttccccagcaactttgtggagctgctggacagcggcccccccagcctgggcaacccagacatgcccagcgtgtccccaggcccccagaggcctcccaagctgagcagcctggcctatgacagccccccagactacctgcagacagtgagccaccctgaggtgtacagagtgctgtttgactaccagcctgaggccccagatgagctggccctgcggagaggagatgtggtgaaggtgctgagcaagaccacagaagataaaggctggtgggagggggagtgccagggcagaagaggagtcttcccagacaactttgtgctgcccccaccacccatcaagaagctggtgcccaggaaggtggtgtcccgggagagcgcccccatcaaggagcccaagaagctgatgcccaagaccagcctgcccaccgtgaagaagctggccacagccaccaccggccccagcaaggccaagaccagcaggacccccagccgggacagccagaagctgaccagccgggacagcggccccaatggaggcttccagagcggcggcagctaccaccctggcaggaagaggagcaagacccagaccccccagcagaggtctgtgagcagccaggaggaggagcacagcagccctgtgaaggcccccagcgtgaagaggacccccatgccagacaagacagccaccccagagcggcccccagccccagaaaatgcccccagcagcaagaagatcccagccccagacaaggtgcccagccctgagaagaccctgaccctgggggacaaggccagcatccctggcaacagcaccagcggcaagatcccagccccagacaaggtgcccaccccagagaagatggtgaccccagaggacaaggccagcatcccagaaaattccatcatccctgaggagaccctgactgtggacaagcccagcaccccagagagggtcttctctgtggaggagagccctgccctggaggccccacccatggacaaggtgcccaaccccaagatggcccccctgggagatgaggcccccaccctggagaaggtgctgaccccagagctgtctgaggaggaggtgtccaccagagatgacatccagttccaccacttcagcagcgaggaggccctgcagaaggtgaagtactttgtggccaaggaggaccccagcagccaggaggaggcccacaccccagaggcccccccaccccagccccccagcagcgagcgctgcctgggggagatgaagtgcaccctggtgcggggggacagcagcccccggcaggccgagctgaagagcggccctgccagcaggcctgccctggagaagccccacccccatgaggaggccaccaccctgcctgaggaggcccccagcaatgatgagaggaccccagaggaggaggcccccccaaatgagcagaggcccctgcgggaggaggtgctgcccaaggagggcgtggccagcaaggaggaggtgaccctgaaggaggagctgccccccaaggaggaggtggcccccaaggaggaggtgccccccatcgagcgggcctttgcccagaagacccggcccatcaagcccccaccagacagccaggagaccctggccctgcccagcctggtgccccagaactacacagagaacaagaatgaaggagtggatgtgaccagcctgcggggggaggtggagagcctgcggcgggccctggagctgatggaggtgcagctggagaggaagctgacagacatctgggaggagctgaagtctgagaaggagcagaggcggcggctggaggtgcaggtgatgcagggcacccagaagagccagacccccagggtcatccacacccagacccagacctactag

SEQ ID NO: 42204 - DNA, 2649 bp, Artificial Sequence
  Description of Artificial Sequence: Synthetic coding sequence
atgctgctgggcgcctcctggctgtgtgccagcaaggctgctgctgctgctgcccagagtgaaggagatgaggacaggcctggagagaggagaagaagaagagctgctgccacagctgctggggccggggaggacatggatgagagcagcctgctggacctgctggagtgcagcgtgtgcctggagcggctggacaccacagccaaggtgctgccctgccagcacaccttctgccgccgctgcctggagagcatcgtgtgcagcagacatgagctgcgctgcccagagtgccgcatcctggtgggctgcggcgtggatgagctgcctgccaacatcctgctggtgcggctgctggatggcatccggcagaggcccagggctggcaccagccctgggggcagccccccagcccggcccatccctggccagagcgctgcccccaccctggccggcggcggcggcggcgctgctggcagcaccccaggcagccctgtgttcctgtctgctgctgctggcagcacagctggcagcctgcgggagctggccaccagcaggacagccccagctgccaagaacccctgcctgctgccctacggcaaggccctgtacagctatgagggcaaggagcccggggacctgaagttcaacaagggggacatcatcgtgctgcggaggaaggtggatgagcagtggtaccatggagagctgcacggcacccagggcttcctgcctgccagctacatccagtgcatccagcccctgccccacgccccaccccagggcaaggccctgtatgactttgagatgaaggacaaggaccaggacaaggactgcctgaccttcaccaaggatgagatcctgactgtgctgcggcgggtggatgagaactgggccgagggcatgctgggggacaagattggcatcttccccctgctgtatgtggagctgaatgattctgccaagcagctgattgagatggacaagccctgcccagctgctgccagcagctgcaatgccagcctgcccagcgacagcggggctgtggcctctgtggcccccagccccaccctgagcagcagcggggctgtgtctgccttccagaggagagtggatggcaagaagaacaccaagaagaggcacagcttcaccgccctgtctgtgacccacaggagcagccaggccgccagccaccgccacagcatggagatcagcgcccctgtgctgatcagcagcagtgaccccagggctgctgcccgcatcggggacctggcccacctgagctgtgccgcccccacccaggatgtgagcagcagcgctggcagcacccccacagctgtgcccagggctgcctctgtgtctggagagcagggcaccccacccaaggtgcagctgcccctgaatgtgtacctggccctgtatgcctacaagccccagaagagtgatgagctggagctgcacaagggggagatgtacagagtgctggagaagtgccaggacggctggttcaagggggccagcctgaggactggagtgtctggagtcttccctggcaactacgtgacccctgtgtcccgggtgcctgctgggggcgccggccccccaagaaataatgtggtgggcggcagccccctggccaagggcatcaccaccaccatgcaccctggcagcggcagcctgagcagcctggccacagccaccaggcctgccctgcccatcaccaccccccaggcccacgcccagcaccccacagccagcccccccaccggcagctgcctgcggcacagcgcccagcccacagccagccaggcccggagcaccatcagcacagctgcccacagcgctgcccaggcccaggaccggcccacagccaccgtgagccccctgcggacccagaacagccccagccggctgcctgccaccagcctgcggccccacagcgtggtgagcccccagcacagccaccagccccctgtgcagatgtgccccaggcctgccatccccctgaccagcgctgccagcgccatcaccccaccaaatgtgtctgctgccaacctgaatggagaggccggcggcggccccatcggcgtgctgagcaccagcagccccaccaacacaggctgcaagctggatgagaagaagtctgagaagaaggagaagaagagcggcctgctgaagctgctggccggggccagcaccaagaagaagagccgcagccccccatctgtgagccccacccatgacccccaggtggccgtggatgccctgctgcagggcgctgtgggccctgaggtgagcagcctgagcatccacggccgggccggcagctgccccatcgagagcgagatgcagggcgccatgggcatggagcccctgcacaggaaggccggcagcctggacctgaacttcaccagccccagccggcaggcccccctgtccatggccgccatccggcctgagcccaagctgctgccccgggagcgctacagagtggtggtgtcctacccaccccagagcgaggccgagattgagctgaaggagggggacatcgtgtttgtgcacaagaagagagaagatggctggtacaagggcaccctgcagagaaatggccgcacaggcctcttccctggcagctttgtggagagcttctag

SEQ ID NO: 42205 - DNA, 2151 bp, Artificial Sequence
  Description of Artificial Sequence: Synthetic coding sequence
atgctgctgggcgcctcctggctgtgtgccagcaaggctgctgctgctgctgcccagagtgaaggagatgaggacaggcctggagagaggagaagaagaagagctgctgccacagctgctggggccggggaggacatggatgagagcagcctgctggacctgctggagtgcagcgtgtgcctggagcggctggacaccacagccaaggtgctgccctgccagcacaccttctgccgccgctgcctggagagcatcgtgtgcagcagacatgagctgcgctgcccagagtgccgcatcctggtgggctgcggcgtggatgagctgcctgccaacatcctgctggtgcggctgctggatggcatccggcagaggcccagggctggcaccagccctgggggcagccccccagcccggcccatccctggccagagcgctgcccccaccctggccggcggcggcggcggcgctgctggcagcaccccaggcagccctgtgttcctgtctgctgctgctggcagcacagctggcagcctgcgggagctggccaccagcaggacagccccagctgccaagaacccctgcctgctgccctacggcaaggccctgtacagctatgagggcaaggagcccggggacctgaagttcaacaagggggacatcatcgtgctgcggaggaaggtggatgagcagtggtaccatggagagctgcacggcacccagggcttcctgcctgccagctacatccagtgcatccagcccctgccccacgccccaccccagggcaaggccctgtatgactttgagatgaaggacaaggaccaggacaaggactgcctgaccttcaccaaggatgagatcctgactgtgctgcggcgggtggatgagaactgggccgagggcatgctgggggacaagattggcatcttccccctgctgtatgtggagctgaatgattctgccaagcagctgattgagatggacaagccctgcccagctgctgccagcagctgcaatgccagcctgcccagcgacagcggggctgtggcctctgtggcccccagccccaccctgagcagcagcggggctgtgtctgccttccagaggagagtggatggcaagaagaacaccaagaagaggcacagcttcaccgccctgtctgtgacccacaggagcagccaggccgccagccaccgccacagcatggagatcagcgcccctgtgctgatcagcagcagtgaccccagggctgctgcccgcatcggggacctggcccacctgagctgtgccgcccccacccaggatgtgagcagcagcgctggcagcacccccacagctgtgcccagggctgcctctgtgtctggagagcagggcaccccacccaaggtgcagctgcccctgaatgtgtacctggccctgtatgcctacaagccccagaagagtgatgagctggagctgcacaagggggagatgtacagagtgctggagaagtgccaggacggctggttcaagggggccagcctgaggactggagtgtctggagtcttccctggcaactacgtgacccctgtgtcccgggtgcctgctgggggcgccggccccccaagaaataatgtggtgggcggcagccccctggccaagggcatcaccaccaccatgcaccctggcagcggcagcctgagcagcctggccacagccaccaggcctgccctgcccatcaccaccccccaggcccacgcccagcaccccacagccagcccccccaccggcagctgcctgcggcacagcgcccagcccacagccagccaggcccggagcaccatcagcacagctgcccacagcgctgcccaggcccaggaccggcccacagccaccgtgagccccctgcggacccagaacagccccagccggctgcctgccaccagcctgcggccccacagcgtggtgagcccccagcacagccaccagccccctgtgcagatgtgccccaggcctgccatccccctgaccagcgctgccagcgccatcaccccaccaaatgtgtctgctgccaacctgaatggagaggccggcggcggccccatcggcgtgctgagcaccagcagccccaccaacacaggctgcaagctggatgagaagaagtctgagaagtag

SEQ ID NO: 42206 - DNA, 171 bp, Artificial Sequence
  Description of Artificial Sequence: Synthetic coding sequence
tgatacagagtggtggtgtcctacccaccccagagcgaggccgagattgagctgaaggagggggacatcgtgtttgtgcacaagaagagagaagatggctggtacaagggcaccctgcagagaaatggccgcacaggcctcttccctggcagctttgtggagagcttctag

SEQ ID NO: 42207 - DNA, 1029 bp, Artificial Sequence
  Description of Artificial Sequence: Synthetic coding sequence
atgaacaaccccatccccagcaacctgaagtctgaggccaagaaggccgccaagatcctgcgggagttcacagagatcaccagcagaaatggaccagacaagatcatcccagcccacgtgattgccaaggccaagggcctggccatcctgagcgtcatcaaggccggcttcctggtgacagcccggggcggcagcggcatcgtggtggcccggctgcctgatggcaagtggagcgcccccagcgccatcggcattgctggcctgggcggcggctttgagatcggcatcgaggtgtctgacctggtgatcatcctgaactatgacagagctgtggaggcctttgccaagggcggcaacctgaccctgggcggcaacctgactgtggccgtgggccccctgggcaggaacctggagggcaatgtggccctgcggagcagcgctgctgtgttcacctactgcaagagccggggcctgtttgctggggtgtccctggagggcagctgcctgattgaaaggaaggagaccaacaggaagttctactgccaggacatccgggcctatgacatcctgtttggagacacccccaggcctgcccaggccgaggacctgtatgagatcctggacagcttcacagagaagtatgaaaatgaaggccagaggatcaatgccaggaaggccgcccgggagcagaggaagagcagcgccaaggagctgccccccaagcccctgagccggccccagcagagcagcgcccctgtgcagctgaacagcggcagccagagcaacagaaatgagtacaagctgtacccaggcctgagcagctaccacgagcgggtgggcaacctgaaccagcccatcgaggtgacagccctgtacagctttgagggccagcagcccggggacctgaacttccaggccggggaccgcatcaccgtcatcagcaagacagacagccactttgactggtgggagggcaagctgcggggccagacaggcatcttccctgccaactacgtgaccatgaactag

SEQ ID NO: 42208 - DNA, 684 bp, Artificial Sequence
  Description of Artificial Sequence: Synthetic coding sequence
atggtgtctgacctggtgatcatcctgaactatgacagagctgtggaggcctttgccaagggcggcaacctgaccctgggcggcaacctgactgtggccgtgggccccctgggcaggaacctggagggcaatgtggccctgcggagcagcgctgctgtgttcacctactgcaagagccggggcctgtttgctggggtgtccctggagggcagctgcctgattgaaaggaaggagaccaacaggaagttctactgccaggacatccgggcctatgacatcctgtttggagacacccccaggcctgcccaggccgaggacctgtatgagatcctggacagcttcacagagaagtatgaaaatgaaggccagaggatcaatgccaggaaggccgcccgggagcagaggaagagcagcgccaaggagctgccccccaagcccctgagccggccccagcagagcagcgcccctgtgcagctgaacagcggcagccagagcaacctgaaccagcccatcgaggtgacagccctgtacagctttgagggccagcagcccggggacctgaacttccaggccggggaccgcatcaccgtcatcagcaagacagacagccactttgactggtgggagggcaagctgcggggccagacaggcatcttccctgccaactacgtgaccatgaactag

SEQ ID NO: 42209 - DNA, 684 bp, Artificial Sequence; identical to SEQ ID NO: 42208
  Description of Artificial Sequence: Synthetic coding sequence

SEQ ID NO: 42210 - DNA, 972 bp, Artificial Sequence
  Description of Artificial Sequence: Synthetic coding sequence
atgaacaaccccatccccagcaacctgaagtctgaggccaagaaggccgccaagatcctgcgggagttcacagagatcaccagcagaaatggaccagacaagatcatcccagcccacgtgattgccaaggccaagggcctggccatcctgagcgtcatcaaggccggcttcctggtgacagcccggggcggcagcggcatcgtggtggcccggctgcctgatggcaagtggagcgcccccagcgccatcggcattgctggcctgggcggcggctttgagatcggcatcgaggtgtctgacctggtgatcatcctgaactatgacagagctgtggaggcctttgccaagggcggcaacctgaccctgggcggcaacctgactgtggccgtgggccccctgggcaggaacctggagggcaatgtggccctgcggagcagcgctgctgtgttcacctactgcaagagccggggcctgtttgctggggtgtccctggagggcagctgcctgattgaaaggaaggagaccaacaggaagttctactgccaggacatccgggcctatgacatcctgtttggagacacccccaggcctgcccaggccgaggacctgtatgagatcctggacagcttcacagagaagtatgaaaatgaaggccagaggatcaatgccaggaaggccgcccgggagcagaggaagagcagcgccaaggagctgccccccaagcccctgagccggccccagcagagcagcgcccctgtgcagctgaacagcggcagccagagcaacctgaaccagcccatcgaggtgacagccctgtacagctttgagggccagcagcccggggacctgaacttccaggccggggaccgcatcaccgtcatcagcaagacagacagccactttgactggtgggagggcaagctgcggggccagacaggcatcttccctgccaactacgtgaccatgaactag

SEQ ID NO: 42211 - DNA, 1029 bp, Artificial Sequence; identical to SEQ ID NO: 42207
  Description of Artificial Sequence: Synthetic coding sequence

SEQ ID NO: 42212 - DNA, 741 bp, Artificial Sequence
  Description of Artificial Sequence: Synthetic coding sequence
atggtgtctgacctggtgatcatcctgaactatgacagagctgtggaggcctttgccaagggcggcaacctgaccctgggcggcaacctgactgtggccgtgggccccctgggcaggaacctggagggcaatgtggccctgcggagcagcgctgctgtgttcacctactgcaagagccggggcctgtttgctggggtgtccctggagggcagctgcctgattgaaaggaaggagaccaacaggaagttctactgccaggacatccgggcctatgacatcctgtttggagacacccccaggcctgcccaggccgaggacctgtatgagatcctggacagcttcacagagaagtatgaaaatgaaggccagaggatcaatgccaggaaggccgcccgggagcagaggaagagcagcgccaaggagctgccccccaagcccctgagccggccccagcagagcagcgcccctgtgcagctgaacagcggcagccagagcaacagaaatgagtacaagctgtacccaggcctgagcagctaccacgagcgggtgggcaacctgaaccagcccatcgaggtgacagccctgtacagctttgagggccagcagcccggggacctgaacttccaggccggggaccgcatcaccgtcatcagcaagacagacagccactttgactggtgggagggcaagctgcggggccagacaggcatcttccctgccaactacgtgaccatgaactag

SEQ ID NO: 42213 - DNA, 156 bp, Artificial Sequence
  Description of Artificial Sequence: Synthetic coding sequence
atgaacaaccccatccccagcaacctgaagtctgaggccaagaaggccgccaagatcctgcgggagttcacagagatcaccagcagaaatggaccagacaagatcatcccagcccacgtgattgccaaggccaagggcctggccatcctgtcctag

SEQ ID NO: 42214 - DNA, 1047 bp, Artificial Sequence
  Description of Artificial Sequence: Synthetic coding sequence
atgcctgggaagcagagcgaggagggccctgctgaggccggggcctctgaagattctgaggaggagggcctgggcggcctgaccctggaggagctgcagcagggccaggaggccgcccgggccctggaggacatgatgaccctgagcgcccagaccctggtgcgggcagaggtggatgagctgtatgaggaggtgcggcccctgggccagggctgctacggccgggtgctgctggtgacccaccggcagaagggcacccccctggccctgaagcagctgcccaagcccaggaccagcctgcggggcttcctgtatgagttctgtgtgggcctgagcctgggcgcccacagcgccatcgtgacagcctatggaattggaattgaaagtgcccacagctacagcttcctgacagagcctgtgctgcacggggacctgatggccttcatccagcccaaggtgggcctgccccagcctgctgtgcaccgctgtgccgcccagctggccagcgccctggagtacatccacgcccggggcctggtgtacagagacctgaagccagaaaatgtgctggtgtgtgaccctgcctgccgccgcttcaagctgacagactttggccacacccggccccggggcaccctgctgcggctggccggcccccccatcccctacacagcccctgagctgtgtgcccccccacccctgcctgagggcctgcccatccagcctgccctggatgcctgggccctgggcgtgctgctcttctgcctgctgaccggctacttcccctgggaccggcccctggccgaggccgaccccttctatgaggacttcctgatctggcaggccagcggccagccccgggaccggccccagccctggtttggcctggccgctgctgctgatgccctgctgcggggcctgctggacccccacccccggcggcgctctgctgtgattgccatccgggagcacctgggccggccctggaggcagcgggagggggaggccgaggccgtgggcgctgtggaggaggaggccggccagtag

SEQ ID NO: 42215 - DNA, 1047 bp, Artificial Sequence; identical to SEQ ID NO: 42214
  Description of Artificial Sequence: Synthetic coding sequence

SEQ ID NO: 42216 - DNA, 1182 bp, Artificial Sequence
  Description of Artificial Sequence: Synthetic coding sequence
atggccgagctgcggcaggtgcctgggggccgggagaccccccagggcgagctgcggcctgaggtggtggaggatgaggtgcccaggagccctgtggccgaggagcccggcggcggcggcagcagcagcagcgaggccaagctgagcccccgggaggaggaggagctggacccccgcatccaggaggagctggagcacctgaaccaggccagcgaggagatcaaccaggtggagctgcagctggatgaggcccggaccacctaccgccgcatcctgcaggagagcgccaggaagctgaacacccagggcagccacctgggcagctgcatcgagaaggcccggccctactatgaggcccggcggctggccaaggaggcccagcaggagacccagaaggccgccctgcgctatgaaagagctgtgtccatgcacaatgctgcccgggagatggtgtttgtggccgagcagggcgtgatggctgacaagaaccggctggaccccacctggcaggagatgctgaaccacgccacctgcaaggtgaatgaagctgaggaggagcggctgcggggggagcgggagcaccagagggtgacccggctgtgccagcaggccgaggcccgggtgcaggccctgcagaagaccctgcggcgggccatcggcaagagccggccctactttgagctgaaggcccagttcagccagatcctggaggagcacaaggccaaggtgacagagctggagcagcaggtggcccaggccaagacccgctacagcgtggccctgaggaacctggagcagatcagcgagcagatccacgccaggagaagaggaggcctgcccccccaccccctgggccccaggaggagcagccctgtgggcgctgaggccggccctgaggacatggaggatggagacagcggcatcgagggcgctgagggcgccggcctggaggagggcagcagcctgggccctggccctgccccagacacagacaccctgagcctgctgagcctgaggacagtggccagtgacctgcagaagtgtgacagcgtggagcacctgcggggcctgagtgaccacgtgtccctggatggccaggagctgggcaccaggtctgggggcagaagaggaagtgatggaggagcccggggcggccgccaccagaggtctgtgtccctgtag

SEQ ID NO: 42217 - DNA, 1086 bp, Artificial Sequence
  Description of Artificial Sequence: Synthetic coding sequence
atgtaccaggtgcctgaccggcaggagagcttctggcagagcccctacctgctgtccttccctgagtgcctgaccagcttcccctgggaggagctggagcacctgaaccaggccagcgaggagatcaaccaggtggagctgcagctggatgaggcccggaccacctaccgccgcatcctgcaggagagcgccaggaagctgaacacccagggcagccacctgggcagctgcatcgagaaggcccggccctactatgaggcccggcggctggccaaggaggcccagcaggagacccagaaggccgccctgcgctatgaaagagctgtgtccatgcacaatgctgcccgggagatggtgtttgtggccgagcagggcgtgatggctgacaagaaccggctggaccccacctggcaggagatgctgaaccacgccacctgcaaggtgaatgaagctgaggaggagcggctgcggggggagcgggagcaccagagggtgacccggctgtgccagcaggccgaggcccgggtgcaggccctgcagaagaccctgcggcgggccatcggcaagagccggccctactttgagctgaaggcccagttcagccagatcctggaggagcacaaggccaaggtgacagagctggagcagcaggtggcccaggccaagacccgctacagcgtggccctgaggaacctggagcagatcagcgagcagatccacgccaggagaagaggaggcctgcccccccaccccctgggccccaggaggagcagccctgtgggcgctgaggccggccctgaggacatggaggatggagacagcggcatcgagggcgctgagggcgccggcctggaggagggcagcagcctgggccctggccctgccccagacacagacaccctgagcctgctgagcctgaggacagtggccagtgacctgcagaagtgtgacagcgtggagcacctgcggggcctgagtgaccacgtgtccctggatggccaggagctgggcaccaggtctgggggcagaagaggaagtgatggaggagcccggggcggccgccaccagaggtctgtgtccctgtag

SEQ ID NO: 42218 - DNA, 2169 bp, Artificial Sequence
  Description of Artificial Sequence: Synthetic coding sequence
atgaggccccaggaccctgccctgtacccccaggccccccaccccctggccctgggccgggccagccaccccagccagagcaggaacaccccacctggccggcccagggctgctgcccgctgtggcccccggcgggcccccatcggccagagcggccggggccgggagaagtggcccacagctgccagcgccctgggcctgctgcggcgctggaggaggagcaaggcctctgtgcctgctgacagcttccgcaccatcagcccagaccggcggggggagaagagcgccagcgctgtgtctggggacacagctgctgccaccaccctgaagggcacagccatccctgtgcgctctgtggtggccagccccaggcctgtgaagggcaaggccggccgggagacagcccggctgcggctgcagaggctgcctgctgcccaggccgaggacaccggggaggccgctgctgctgctgctgaggagcccctgctgcctgtgcctgaagatgaggaggaggcccagcccctgccccctgtgtgtgtgtccaggatgaggggcatgtggagagatgagaaggtgtccctgtactgtgatgaggtgctgcaggactgcaaggccgaggatgctgatgaggtgatgggcaagtacctgtctgagaagctgaagctgaaggacaagtggctgggcgtgtggaagaccaaccccagcgtcttctttgtgaagtatgaggaggccagcatcccctttgtgggcatcctggtggaggtgacctgtgagccctaccaggacagcagcagccgcttcaaggtgacagtgtctgtggccgagcccttcagcagcaacatcgccaacatcccccgggacctggtggatgagatcctggaggagctggagcacagcgtgcccctgctggaggtgtaccctgtggagggccaggacacagacatccacgtgattgccctggccctggaggtggtgcgcttcttctatgacttcctgtggagggactgggatgatgaggagagctgtgagaactacacagccctgattgaggagcgcatcaacctgtggtgtgacatccaggacggcaccatccctggccccatcgcccagcgcttcaagaagaccctggagaagtacaagaacaagagggtggagctgattgagtaccagagcaacatcaaggaggaccccagcgctgctgaggccgtggagtgctggaagaagtactatgagatcgtgatgctgtgtggcctgctgaagatgtgggaggacctgcggctgcgggtgcacggccccttcttcccccgcatcctgcggcggaggaagggcaagcgggagtttgggaagaccatcacccacatcgtggccaagatgatgaccacagagatgatcaaggacctgagcagtgacaccctgctgcagcagcacggggacctggacctggccctggacaactgctacagcggggacaccgtcatcatcttccctggagagtaccaggccgccaacctggccctgctgacagatgacatcatcatcaagggcgtgggcaagcgggaggagatcatgatcaccagcgagcccagccgggacagctttgtggtgtccaaggctgacaacgtgaagctgatgcacctgagcctcatccagcagggcaccgtggatggcatcgtggtggtggagagcggccacatgaccctggagaactgcatcctgaagtgtgagggcactggagtgtgtgtgctgactggagctgccctgaccatcacagacagcgagatcactggagcccagggcgctggggtggagctgtacccaggcagcatcgccatcctggagagaaatgagatccaccactgcaacaacctgcggaccagcaacagcagcaagagcaccctgggcggcgtgaacatgaaggtgctgcctgcccccaagctgaagatgaccaacaaccacatctacagcaacaagggctatggagtgtccatcctgcagcccatggagcagttcttcatcgtggccgaggaggccctgaacaagagggccagcagcggggacaagaaggatgacaagatgctgttcaaggtgatgcagaacctgaacctggagatgaacaacaacaagattgaggccaacgtgaagggggacatcagaattgtgaccagctag

SEQ ID NO: 42219 - DNA, 1962 bp, Artificial Sequence
  Description of Artificial Sequence: Synthetic coding sequence
atggccagcggcagcaaggcctctgtgcctgctgacagcttccgcaccatcagcccagacagaagaggagagaagagcgccagcgctgtgtctggggacacagctgctgccaccaccctgaagggcacagccatccctgtgcgctctgtggtggccagccccaggcctgtgaagggcaaggccggccgggagacagcccggctgcggctgcagaggctgcctgctgcccaggctgaagatactggagaggccgctgctgctgctgctgaggagcccctgctgcctgtgcctgaagatgaggaggaggcccagcccctgccccctgtgtgtgtgtccaggatgaggggcatgtggagagatgagaaggtgtccctgtactgtgatgaggtgctgcaggactgcaaggcagaagatgctgatgaggtgatgggcaagtacctgtctgagaagctgaagctgaaggacaagtggctgggcgtgtggaagaccaaccccagcgtcttctttgtgaagtatgaggaggccagcatcccctttgtgggcatcctggtggaggtgacctgtgagccctaccaggacagcagcagccgcttcaaggtgacagtgtctgtggccgagcccttcagcagcaacatcgccaacatcccccgggacctggtggatgagatcctggaggagctggagcacagcgtgcccctgctggaggtgtaccctgtggagggccaggacacagacatccacgtgattgccctggccctggaggtggtgcgcttcttctatgacttcctgtggagggactgggatgatgaggagagctgtgagaactacacagccctgattgaggagcgcatcaacctgtggtgtgacatccaggacggcaccatccctggccccatcgcccagcgcttcaagaagaccctggagaagtacaagaacaagagggtggagctgattgagtaccagagcaacatcaaggaggaccccagcgctgctgaggccgtggagtgctggaagaagtactatgaaattgtgatgctgtgtggcctgctgaagatgtgggaggacctgcggctgcgggtgcacggccccttcttcccccgcatcctgcggcggaggaagggcaagcgggagtttgggaagaccatcacccacatcgtggccaagatgatgaccacagagatgatcaaggacctgagcagtgacaccctgctgcagcagcacggggacctggacctggccctggacaactgctacagcggggacaccgtcatcatcttccctggagagtaccaggccgccaacctggccctgctgacagatgacatcatcatcaagggcgtgggcaagcgggaggagatcatgatcaccagcgagcccagccgggacagctttgtggtgtccaaggctgacaacgtgaagctgatgcacctgagcctcatccagcagggcaccgtggatggcatcgtggtggtggagagcggccacatgaccctggagaactgcatcctgaagtgtgagggcaccggggtgtgtgtgctgaccggggccgccctgaccatcacagattctgagatcaccggggcccagggcgccggcgtggagctgtacccaggcagcatcgccatcctggagagaaatgagatccaccactgcaacaacctgcggaccagcaacagcagcaagagcaccctgggcggcgtgaacatgaaggtgctgcctgcccccaagctgaagatgaccaacaaccacatctacagcaacaagggctacggcgtgtccatcctgcagcccatggagcagttcttcatcgtggccgaggaggccctgaacaagagggccagcagcggggacaagaaggatgacaagatgctgttcaaggtgatgcagaacctgaacctggagatgaacaacaacaagattgaggccaacgtgaagggggacatccgcatcgtgaccagctag

SEQ ID NO: 42220 - DNA, 1605 bp, Artificial Sequence
  Description of Artificial Sequence: Synthetic coding sequence
atgggcttcctgcagctggtgcggctggacagcaacagccggccccaggccgaggatgctgatgaggtgatgggcaagtacctgtctgagaagctgaagctgaaggacaagtggctgggcgtgtggaagaccaaccccagcgtcttctttgtgaagtatgaggaggccagcatcccctttgtgggcatcctggtggaggtgacctgtgagccctaccaggacagcagcagccgcttcaaggtgacagtgtctgtggccgagcccttcagcagcaacatcgccaacatcccccgggacctggtggatgagatcctggaggagctggagcacagcgtgcccctgctggaggtgtaccctgtggagggccaggacacagacatccacgtgattgccctggccctggaggtggtgcgcttcttctatgacttcctgtggagggactgggatgatgaggagagctgtgagaactacacagccctgattgaggagcgcatcaacctgtggtgtgacatccaggacggcaccatccctggccccatcgcccagcgcttcaagaagaccctggagaagtacaagaacaagagggtggagctgattgagtaccagagcaacatcaaggaggaccccagcgctgctgaggccgtggagtgctggaagaagtactatgagatcgtgatgctgtgtggcctgctgaagatgtgggaggacctgcggctgcgggtgcacggccccttcttcccccgcatcctgcggcggaggaagggcaagcgggagtttgggaagaccatcacccacatcgtggccaagatgatgaccacagagatgatcaaggacctgagcagtgacaccctgctgcagcagcacggggacctggacctggccctggacaactgctacagcggggacaccgtcatcatcttccctggagagtaccaggccgccaacctggccctgctgacagatgacatcatcatcaagggcgtgggcaagcgggaggagatcatgatcaccagcgagcccagccgggacagctttgtggtgtccaaggctgacaacgtgaagctgatgcacctgagcctcatccagcagggcaccgtggatggcatcgtggtggtggagagcggccacatgaccctggagaactgcatcctgaagtgtgagggcactggagtgtgtgtgctgactggagctgccctgaccatcacagacagcgagatcactggagcccagggcgctggggtggagctgtacccaggcagcatcgccatcctggagagaaatgagatccaccactgcaacaacctgcggaccagcaacagcagcaagagcaccctgggcggcgtgaacatgaaggtgctgcctgcccccaagctgaagatgaccaacaaccacatctacagcaacaagggctatggagtgtccatcctgcagcccatggagcagttcttcatcgtggccgaggaggccctgaacaagagggccagcagcggggacaagaaggatgacaagatgctgttcaaggtgatgcagaacctgaacctggagatgaacaacaacaagattgaggccaacgtgaagggggacatcagaattgtgaccagctag

SEQ ID NO: 42221 - DNA, 1617 bp, Artificial Sequence
  Description of Artificial Sequence: Synthetic coding sequence
atgcctgccctgctgctgctggtgctgctggccagcagcgctggccaggcccgggcccggcccagcaatgccaccagcgctgagcccgccggccccctgcctgccctgctggcccacctgcggcggctgaccggggccctgaccggcggcggcggggccgccagccctggggccaacggcaccaggactggacctgctgggggcgctggggccgccgcccgggcccctcctcctgctgagctgtgccacggctactatgatgtgatgggccagtatgatgccaccttcaactgcagcacaggcagctaccgcttctgctgcggcacctgccactaccgcttctgctgtgagcaccgccacatgaggctggcccaggccagctgcagcaactatgacaccccccgctgggccaccaccccaccacccctggccggcggggccggcggggccggcggggccggcggcggccctggccctggccaggccggctggctggagggcggccgcactggaggagctgggggccggggcggggagggccctgggggcagcacagcctacgtggtgtgtggggtcatcagctttgccctggccgtgggcgtgggcgccaaggtggccttcagcaaggccagccgggccccccgggcccaccgggacatcaacgtgccccgggccctggtggacatcctgcggcaccaggccggccctggcaccaggccagaccgggcccggagcagcagcctgaccccaggcatcggcggccctgacagcatgccacccaggacccccaagaacctgtacaacacagtgaagacccccaacctggactggagggccctgcccccacccagccccagcctgcactacagcaccctgagctgcagccgctccttccacaacctgagccacctgcccccatcctatgaggccgctgtgaagtctgagctgaaccgctacagcagcctgaagaggctggccgagaaggacctggatgaggcctacctgaagagaagacccctggagctgccccggggcaccctgcccctgcacgccctgcggcggcccggcactggaggcggctacaggatggaggcctggggcggccctgaggagctgggcctggccccagcccccaaccccaggagagtgatgagccaggagcacctgctgggagatggcggccgcagccgctatgagttcaccctgccccgggcccggctggtgtcccaggagcacctgctgctgagcagccctgaggccctgcggcagagccgggagcacctgctgagccccccaagaagccctgccctgcccccagaccccacagcccgggccagcctggccgccagccacagcaacctgctgctgggccctgggggcccccccacccccctgcggggcctgcccccacccagcagcctgcacgcccaccaccaccacgccctgcacggcagcccccagcctgcctggatgtctgatgctgggggcggcggcggcaccctggcccggcggccccccttccagaggcagggcaccctggagcagctgcagttcatccctggccaccacctgccccagcacctgaggacagccagcaagaatgaggtgacagtgtag

SEQ ID NO: 42222 - DNA, 960 bp, Artificial Sequence
  Description of Artificial Sequence: Synthetic coding sequence
atgggctggaggaggaagagggtgccccagaggggcaggaaggcccccccaccccagctgcacggcaacatcaacaacctgtacttccccatccgctggagggaccggctgcactgggacagccccaacccagctgctgagtgccagagacatgaggtgaccctggtgtccaggaagccaggccctggccgcatcacctgggatgagctggccgccagcggcctgcccagctgtgatgctgctgtgaacctggccggggagaacatcctgaaccccctgcggcgctggaatgagaccttccagaaggaggtgattggcagccggctggagaccacccagctgctggccaaggccatcaccaaggccccccagccccccaaggcctgggtgctggtgactggagtggcctactaccagcccagcctgacagcagaatatgatgaggacagccctggaggagactttgacttcttcagcaacctggtgaccaagtgggaggccgccgcccggctgcccggggacagcacccggcaggtggtggtgcgctctggagtggtgctgggccggggcggcggggccatgggccacatgctgctgcccttccggctgggcctgggcggccccatcggcagcggccaccagttcttcccctggatccacatcggggacctggccggcatcctgacccacgccctggaggccaaccacgtgcacggcgtgctgaatggagtggcccccagcagcgccaccaatgctgagtttgcccagaccctgggcgccgccctgggccggcgggccttcatccccctgcccagcgctgtggtgcaggccgtgtttggccggcagagggccatcatgctgctggagggccagaaggtgatcccccagaggaccctggccaccggctaccagtacagcttccctgagctgggcgccgccctgaaggagatcgtggcctag

SEQ ID NO: 42223 - DNA, 597 bp, Artificial Sequence
  Description of Artificial Sequence: Synthetic coding sequence
atggccctgagccccaacggggagatcctgcgggcccgggaggcctactaccagcccagcctgacagcagaatatgatgaggacagccctggaggagactttgacttcttcagcaacctggtgaccaagtgggaggccgccgcccggctgcccggggacagcacccggcaggtggtggtgcgcagcggcgtggtgctgggccggggcggcggggccatgggccacatgctgctgcccttccggctgggcctgggcggccccatcggcagcggccaccagttcttcccctggatccacatcggggacctggccggcatcctgacccacgccctggaggccaaccacgtgcatggagtgctgaatggagtggcccccagcagcgccaccaatgctgagtttgcccagaccctgggcgccgccctgggcagaagagccttcatccccctgcccagcgctgtggtgcaggccgtgtttggccggcagagggccatcatgctgctggagggccagaaggtgatcccccagaggaccctggccaccggctaccagtacagcttccctgagctgggcgccgccctgaaggagatcgtggcctag

SEQ ID NO: 42224 - DNA, 882 bp, Artificial Sequence
  Description of Artificial Sequence: Synthetic coding sequence
atgagggtgctggtgggcggcggcaccggcttcatcggcacagccctgacccagctgctgaatgcccggggccacgaggtgaccctggtgtccaggaagccaggccctggccgcatcacctgggatgagctggccgccagcggcctgcccagctgtgatgctgctgtgaacctggccggggagaacatcctgaaccccctgcggcgctggaatgagaccttccagaaggaggtgattggcagccggctggagaccacccagctgctggccaaggccatcaccaaggccccccagccccccaaggcctgggtgctggtgactggagtggcctactaccagcccagcctgacagcagaatatgatgaggacagccctggaggagactttgacttcttcagcaacctggtgaccaagtgggaggccgccgcccggctgcccggggacagcacccggcaggtggtggtgcgctctggagtggtgctgggccggggcggcggggccatgggccacatgctgctgcccttccggctgggcctgggcggccccatcggcagcggccaccagttcttcccctggatccacatcggggacctggccggcatcctgacccacgccctggaggccaaccacgtgcacggcgtgctgaatggagtggcccccagcagcgccaccaatgctgagtttgcccagaccctgggcgccgccctgggccggcgggccttcatccccctgcccagcgctgtggtgcaggccgtgtttggccggcagagggccatcatgctgctggagggccagaaggtgatcccccagaggaccctggccaccggctaccagtacagcttccctgagctgggcgccgccctgaaggagatcgtggcctag

SEQ ID NO: 42225 - DNA, 468 bp, Artificial Sequence
  Description of Artificial Sequence: Synthetic coding sequence
ttccacgtggccagctatggcatgtctggagctgagaagctgcagaaggagcagatcgagagcatcaacgtgggcggcaccaagctggtgattgatgtgtgtgtgagaagaagagtgcccaggctcatctacaccagcacagtgaatgtggccttcggcggcaagcccatcgagcagggagatgaggacagcgtgccctacttccccctggatgaacatgtggaccactacagcaggaccaaggccatcgctgaccagctgaccctgatggccaacggcatgcccctgcccggcggcggcaccctgcggacctgtgtgctgcggcccccaggcatctacggccctgaggagcagaggcacctgccccgggtggccggccacatcaagaagaggctcttcatgttccgctttggagaccacaaggccaggatgaactgggtgcacgtgcacaacctggtgcaggcctag

SEQ ID NO: 42226 - DNA, 4482 bp, Artificial Sequence
  Description of Artificial Sequence: Synthetic coding sequence
atggagaacagacctggcagcttccagtatgtgcctgtgcagctgcagggcggggccccctggggcttcaccctgaagggcggcctggagcactgtgagcccctgactgtgtccaagattgaagatggcggcaaggccgccctgagccagaagatgaggactggagatgagctggtgaacatcaatggcacccccctgtatggcagccggcaggaggccctgatcctgatcaagggcagcttccgcatcctgaagctgattgtgagaagaagaaatgcccctgtgtcccggccccacagctggcacgtggccaagctgctggagggctgcccagaggccgccaccaccatgcacttccccagcgaggccttcagcctgtcctggcacagcggctgcaacaccagtgatgtgtgtgtgcagtggtgccccctgagccgccactgcagcacagagaagagcagcagcatcggctccatggagagcctggagcagcccggccaggccacctatgagagccacctgctgcccatcgaccagaacatgtaccccaaccagagggacagcgcctacagcagcttcagcgccagcagcaatgccagtgactgtgccctgagcctgcggcctgaggagcccgccagcacagactgcatcatgcagggccctggccccaccaaggcccccagcggccggcccaacgtggccgagaccagcggcggcagcaggaggaccaacggcggccacctgacccccagcagccagatgagcagccggccccaggagggctaccagagcggccctgccaaggctgtgcggggccccccccagccccctgtgagaagagacagcctgcaggccagccgggcccagctgctgaatggagagcagaggcgggccagcgagcctgtggtgcccctgccccagaaggagaagctgagcctggagcctgtgctgcctgccaggaaccccaaccgcttctgctgcctgagcggccatgaccaggtgaccagcgagggccaccagaactgtgagttcagccagcccccagagagcagccagcagggcagcgagcacctgctgatgcaggccagcaccaaggctgtgggcagccccaaggcctgtgaccgggccagctctgtggacagcaaccccctgaatgaggccagcgctgagctggccaaggccagctttggccggcccccccacctgattggccccaccggccaccgccacagcgcccctgagcagctgctggccagccacctgcagcacgtgcacctggacacccggggcagcaagggcatggagctgccccctgtgcaggacggccaccagtggaccctgagccccctgcacagcagccacaagggcaagaagagcccctgcccccccaccggcggcacccatgaccagagcagcaaggagaggaagacccggcaggtggatgacaggagcctggtgctgggccaccagagccagagcagcccccctcatggagaggctgatggccaccccagcgagaagggcttcctggaccccaacagaaccagccgggccgccagcgagctggccaaccagcagcccagcgccagcggcagcctggtgcagcaggccacagactgcagcagcaccaccaaggccgccagcggcacagaggccggggaggagggggacagcgagcccaaggagtgcagcaggatgggcggcagaagaagtggcggcacccggggccgcagcatccagaacagaaggaagtcagaaagatttgccaccaacctgagaaatgagatccagaggaggaaggcccagctgcagaagagcaagggccccctgagccagctgtgtgacaccaaggagcctgtggaggagacccaggagcccccagagagcccccccctgacagccagcaacaccagcctgctgagcagctgcaagaagccacccagcccccgggacaagctgttcaacaagtccatgatgctgcgggcccggagcagcgagtgcctgagccaggcccctgagagccatgagagcaggacaggcctggagggccgcatcagccctggccagaggcctggccagagcagcctgggcctgaacacctggtggaaggccccagaccccagcagcagtgaccctgagaaggcccacgcccactgcggcgtgcggggcggccactggcgctggagccctgagcacaacagccagcccctggtggccgccgccatggagggccccagcaaccctggggacaacaaggagctgaaggccagcacagcccaggccggagaagatgccatcctgctgccctttgctgacaggaggaagttctttgaggagagcagcaagagcctgagcaccagccacctgcccggcctgaccacccacagcaacaagaccttcacccagaggcccaagcccatcgaccagaacttccagcccatgagcagcagctgccgggagctgcggcggcaccccatggaccagagctaccacagcgctgaccagccctaccacgccacagaccagagctaccacagcatgagccccctgcagagcgagacccccacctacagtgaatgttttgccagcaagggcctggagaacagcatgtgctgcaagcccctgcactgtggggactttgactaccacaggacctgcagctacagctgcagcgtgcagggcgccctggtgcatgacccctgcatctactgcagcggggagatctgcccagccctgctgaagaggaacatgatgcccaactgctacaactgccgctgccaccaccaccagtgcatccgctgcagcgtgtgctaccacaacccccagcacagcgccctggaggacagcagcctggcccctggcaacacctggaagcccaggaagctgactgtgcaggagttccctggggacaagtggaaccccatcaccggcaacaggaagaccagccagagcggccgggagatggcccacagcaagaccagcttctcctgggccacccccttccacccctgcctggagaacccagccctggacctgagcagctaccgggccatcagcagcctggacctgctgggggacttcaagcacgccctgaagaagtctgaggagacctctgtgtatgaggagggcagcagcctggcctccatgccccaccccctgcggagccgggccttcagcgagagccacatcagcctggccccccagagcacccgggcctggggccagcacagaagagagctgttcagcaaaggagatgagacccagagcgacctgctgggcgccaggaagaaggccttccccccaccccggcccccaccacccaactgggagaagtaccgcctcttccgggccgcccagcagcagaagcagcagcagcagcagcagaagcagcaggaggaggaggaggaggaggaggaggaggaggaggaggaggaggaggaggaggaggaggaggccgaggaggaggaggaggagctgcccccccagtacttcagcagcgagaccagcggcagctgtgccctgaaccctgaggaggtgctggagcagccccagcccctgagctttggccacctggagggcagccggcagggcagccagagcgtgcctgctgagcaggagagctttgccctgcacagcagtgacttcctgccccccatccggggccacctgggcagccagcctgagcaggcccagcccccctgctactacggcatcggcggcctgtggaggaccagcggccaggaggccacagagagcgccaagcaggagttccagcacttcagcccccccagcggggcccctggcatccccaccagctacagcgcctactacaacatctctgtggccaaggccgagctgctgaacaagctgaaggaccagcctgagatggccgagatcggcctgggggaggaggaggtggaccacgagctggcccagaagaagatccagctgattgagagcatcagcaggaagctgtctgtgctgcgggaggcccagaggggcctgctggaggacatcaatgccaacagcgccctgggggaggaggtggaggccaacctgaaggctgtgtgcaagagcaatgaatttgagaagtaccacctgtttgtgggggacctggacaaggtggtgaacctgctgctgagcctgagcggccgcctggcccgggtggagaatgccctgaacagcattgacagcgaggccaaccaggagaagctggtgctgattgagaagaagcagcagctgaccggccagctggctgatgccaaggagctgaaggagcacgtggaccggcgggagaagctggtgtttggcatggtgagccgctacctgccccaggaccagctgcaggactaccagcactttgtgaagatgaagagcgccctgatcatcgagcagcgggagctggaggagaagatcaagctgggggaggagcagctgaagtgcctgcgggagagcctgctgctgggccccagcaacttctag

SEQ ID NO: 42227 - DNA, 1365 bp, Artificial Sequence
  Description of Artificial Sequence: Synthetic coding sequence
atggtgcccggccaggcccagccccagagccctgagatgctgctgctgcccctgctgctgcctgtgctgggcgccggcagcctgaacaaggaccccagctacagcctgcaggtgcagaggcaggtgcctgtgcctgagggcctgtgtgtgattgtgtcctgcaacctgagctaccccagagatggctgggatgagagcacagctgcctacggctactggttcaagggctggaccagccccaagacaggagcccctgtggccaccaacaaccagagccgggaggtggagatgagcacccgggaccgcttccagctgaccggggaccccgggaagggcagctgcagcctggtgatcagagatgcccagcgggaggatgaggcctggtacttcttccgggtggagcggggcagccgggtgcgccacagctttgtgaacaacctcttctctgtgtctgccccagccctgacccagaagccagatgtgtacatccctgagaccctggagcccggccagcctgtgaccgtcatctgtgtgttcaactgggccttcaagaagtgcccagcccccagcttctcctggacaggagctgccctgagccccaggaggacccggcccagcaccagccacttctctgtgctgtccttcacccccagcccccaggaccatgacacagacctgacctgccacgtggacttcagcaggaaaggagtgtctgcccagaggacagtgcggctgcgggtggcctatgcccccaaggacctgatcatcagcatcagccatgacaacaccagcgccctggagctgcagggcaatgtcatctacctggaggtgcagaagggccagttcctgcggctgctgtgtgccgctgacagccagcccccagccaccctgtcctgggtgctgcaggacagagtgctgagcagcagccacccctggggccccaggaccctgggcctggagctgcggggcgtgcgggccggggacagcggccgctacacctgcagagcagaaaatcggctgggcagccagcagagggccctggacctgtctgtgcagtacccacctgagaacctgcgggtgatggtgtcccaggccaacagaacagtgctggagaacctgagaaatggcaccagcctgcgggtgctggagggccagagcctgcggctggtgtgtgtgacccacagcagccccccagcccggctgtcctggacccgctggggccagacagtgggccccagccagcccagcgaccccggggtgctggagctgccccgggtgcagatggagcacgagggggagttcacctgccacgcccggcaccccctgggcagccagagggtgtccctgtccttctctgtgcactag

SEQ ID NO: 42228 - DNA, 1446 bp, Artificial Sequence
  Description of Artificial Sequence: Synthetic coding sequence
atgctgctgctgcccctgctgctgcctgtgctgggcgccggcagcctgaacaaggaccccagctacagcctgcaggtgcagaggcaggtgcctgtgcctgagggcctgtgtgtgattgtgtcctgcaacctgagctaccccagagatggctgggatgagagcacagctgcctacggctactggttcaagggctggaccagccccaagacaggagcccctgtggccaccaacaaccagagccgggaggtggagatgagcacccgggaccgcttccagctgaccggggaccccgggaagggcagctgcagcctggtgatcagagatgcccagcgggaggatgaggcctggtacttcttccgggtggagcggggcagccgggtgcgccacagctttgtgaacaacctcttctctgtgtctgccccagccctgacccagaagccagatgtgtacatccctgagaccctggagcccggccagcctgtgaccgtcatctgtgtgttcaactgggccttcaagaagtgcccagcccccagcttctcctggacaggagctgccctgagccccaggaggacccggcccagcaccagccacttctctgtgctgtccttcacccccagcccccaggaccatgacacagacctgacctgccacgtggacttcagcaggaaaggagtgtctgcccagaggacagtgcggctgcgggtggccagcctggagctgcagggcaatgtcatctacctggaggtgcagaagggccagttcctgcggctgctgtgtgccgctgacagccagcccccagccaccctgtcctgggtgctgcaggacagagtgctgagcagcagccacccctggggccccaggaccctgggcctggagctgcggggcgtgcgggccggggacagcggccgctacacctgcagagcagaaaatcggctgggcagccagcagagggccctggacctgtctgtgcagtacccacctgagaacctgcgggtgatggtgtcccaggccaacagaacagtgctggagaacctgagaaatggcaccagcctgcgggtgctggagggccagagcctgcggctggtgtgtgtgacccacagcagccccccagcccggctgtcctggacccgctggggccagacagtgggccccagccagcccagcgaccccggggtgctggagctgccccgggtgcagatggagcacgagggggagttcacctgccacgcccggcaccccctgggcagccagagggtgtccctgtccttctctgtgcactgcaagagcggccccatgactggagtggtgctggtggccgtgggggaggtggccatgaagatcctgctgctgtgcctgtgcctgatcctgctgcgggtgcgcagctgcaggaggaaggccgcccgggccgccctgggcatggaggccgcagatgctgtgacagactag

SEQ ID NO: 42229 - DNA, 924 bp, Artificial Sequence
  Description of Artificial Sequence: Synthetic coding sequence
atggctgctgctgtggccgccgccctggcccggctgctggccgccttcctgctgctggccgcccaggtggcctgtgaatatggcatggtgcacgtggtgtcccaggccggcggccctgagggcaaggactactgcatcctgtacaacccccagtgggcccacctgccccatgacctgagcaaggccagcttcctgcagctgaggaactggacagccagcctgctgtgcagcgctgctgacctgcctgcccggggcttcagcaaccagatccccctggtggcccggggcaactgcaccttctatgagaaggtgcggctggcccagggcagcggggcccggggcctgctgattgtgtcccgggagcggctggtgcccccaggcggcaacaagacccagtatgatgagatcggcatccctgtggccctgctgagctacaaggacatgctggacatcttcaccaggtttggaagaacagtgcgggccgccctgtatgcccccaaggagcctgtgctggactacaacatggtgatcatcttcatcatggctgtgggcaccgtggccatcggcggctactgggccggcagcagagatgtgaagaagcgctacatgaagcacaagagagatgatggccctgagaagcaggaggatgaggccgtggatgtgacccctgtgatgacctgtgtgtttgtggtgatgtgctgcagcatgctggtgctgctgtactacttctatgacctgctggtgtatgtggtgattggcatcttctgcctggccagcgccaccggcctgtacagctgcctggccccctgtgtgcggcggctgcccagcggcaagaagaggccccaggccaggatgctgctgctggccctcttctgtgtggccgtgtctgtggtgtggggcgtcttcagaaatgaagaccagtag

SEQ ID NO: 42230 - DNA, 1533 bp, Artificial Sequence
  Description of Artificial Sequence: Synthetic coding sequence
atggctgctgctgtggccgccgccctggcccggctgctggccgccttcctgctgctggccgcccaggtggcctgtgaatatggcatggtgcacgtggtgtcccaggccggcggccctgagggcaaggactactgcatcctgtacaacccccagtgggcccacctgccccatgacctgagcaaggccagcttcctgcagctgaggaactggacagccagcctgctgtgcagcgctgctgacctgcctgcccggggcttcagcaaccagatccccctggtggcccggggcaactgcaccttctatgagaaggtgcggctggcccagggcagcggggcccggggcctgctgattgtgtcccgggagcggctggtgcccccaggcggcaacaagacccagtatgatgagatcggcatccctgtggccctgctgagctacaaggacatgctggacatcttcaccaggtttggaagaacagtgcgggccgccctgtatgcccccaaggagcctgtgctggactacaacatggtgatcatcttcatcatggctgtgggcaccgtggccatcggcggctactgggccggcagcagagatgtgaagaagcgctacatgaagcacaagagagatgatggccctgagaagcaggaggatgaggccgtggatgtgacccctgtgatgacctgtgtgtttgtggtgatgtgctgcagcatgctggtgctgctgtactacttctatgacctgctggtgtatgtggtgattggcatcttctgcctggccagcgccaccggcctgtacagctgcctggccccctgtgtgcggcggctgtttggaaaatgtcgcatccccaacaacagcctgccctacttccacaagaggccccaggccaggatgctgctgctggccctcttctgtgtggccgtgtctgtggtgtggggcgtcttcagaaatgaagaccagtgggcctgggtgctgcaggatgccctgggcatcgccttctgcctgtacatgctgaagaccatccggctgcccaccttcaaggcctgcaccctgctgctgctggtgctcttcctgtatgacatcttctttgtgttcatcacccccttcctgaccaagagcggcagcagcatcatggtggaggtggccaccggccccagcgacagcgccacccgggagaagctgcccatggtgctgaaggtgccccggctgaacagcagccccctggccctgtgtgaccggcccttcagcctgctgggctttggagacatcctggtgcccggcctgctggtggcctactgccacagatttgacatccaggtgcagagcagccgggtgtactttgtggcctgcaccatcgcctacggcgtgggcctgctggtgacctttgtggccctggccctgatgcagaggggccagcctgccctgctgtacctggtgccctgcaccctggtgaccagctgtgctgtggccctgtggaggcgggagctgggcgtcttctggacaggcagcggctttgctgtgaacaccagcctgctgtag

SEQ ID NO: 42231 - DNA, 522 bp, Artificial Sequence
  Description of Artificial Sequence: Synthetic coding sequence
atggccgccatggccagcctgggcgccctggccctgctgctgctgagcagcctgagccgctgcagcgctgaggcctgcctggagccccagatcacccccagctactacaccaccagtgatgctgtgatcagcacagaaacagtgttcatcgtggagatcagcctgacctgcaagaacagagtgcagaacatggccctgtatgcagatgtgggcggcaagcagtttcctgtgacccggggccaggatgtgggccgctaccaggtgtcctggagcctggaccacaagagcgcccatgctggcacctatgaggtgcgcttctttgatgaggagagctacagcctgctgaggaaggcccagaggaacaatgaagacatcagcatcatccccccactcttcaccgtgtctgtggaccaccggggcacctggaatggcccctgggtgtccacagaggtgctggccgccgccatcggcctggtgatctactacctggccttcagcgccaagagccacatccaggcctag

SEQ ID NO: 42232 - DNA, 522 bp, Artificial Sequence; identical to SEQ ID NO: 42231
  Description of Artificial Sequence: Synthetic coding sequence

SEQ ID NO: 42233 - DNA, 522 bp, Artificial Sequence; identical to SEQ ID NO: 42231
  Description of Artificial Sequence: Synthetic coding sequence

SEQ ID NO: 42234 - DNA, 2961 bp, Artificial Sequence
  Description of Artificial Sequence: Synthetic coding sequence
atgccccgggccacctgggccaacagcaaggagaggtcctgggccgagagcgagcggggcccccgggacacaggaaatggaggcagcaaggccgagcggcacatccaggagattgagaccggccggggcggggaccgggccaaggcccaccggcggcagaggatgaggctgcggggcacagagcgggccagcctgggccctggaagaaggctgggggacagccggggcacagacatgcctggggcccgggcccagggcctggccgccgccatgacagaggagagcgaggagaccgtgctgtacatcgagcaccgctacgtgtgcagcgagtgcaaccagctgtatggcagcctggaggaggtgctgatgcaccagaacagccacgtgccccagcagcactttgagctggtgggcgtggccgaccccggggtgacagtggccacagacacagccagcggcaccggcctgtaccagaccctggtgcaggagagccagtaccagtgcctggagtgtggccagctgctgatgagccccagccagctgctggagcaccaggagctgcacctgaagatgatggccccccaggaggccgtgcctgctgagcccagccccaaggccccacccctgagcagcagcaccatccactatgaatgtgtggactgcaaggccctgtttgccagccaggagctgtggctgaaccaccggcagacccacctgcgggccacccccaccaaggccccagcccctgtggtgctgggcagccctgtggtgctgggcccccctgtgggccaggcccgggtggccgtggagcacagctacaggaaggccgaggagggcggggagggcgccaccgtgcccagcgctgctgccaccaccacagaggtggtgacagaggtggagctgctgctgtacaagtgcagcgagtgcagccagctgttccagctgcctgctgacttcctggagcaccaggccacccacttccctgcccctgtgcctgagagccaggagcccgccctgcagcaggaggtgcaggccagcagccctgctgaggtgcctgtgtcccagcctgaccccctgcctgccagtgaccacagctatgagctgagaaatggagaggccatcggccgggaccggcggggcagaagagcccggaggaacaacagcggggaggccggcggggccgccacccaggagctgttctgcagcgcctgtgaccagctgttcctgagcccccaccagctgcagcagcacctgcggagccaccgggagggcgtcttcaagtgccccctgtgcagcagggtcttccccagccccagcagcctggaccagcacctgggggaccacagcagcgagagccacttcctgtgtgtggactgtggcctggcctttggaacagaggccctgctgctggcccacagaagagcccacacccccaaccccctgcacagctgcccctgtgggaagacctttgtgaacctgaccaagttcctgtaccacaggaggacccatggagtgggcggcgtgcccctgcccaccacccctgtgcccccagaggagcccgtcatcggcttccctgagcccgccccagctgagaccggggagcctgaggcccctgagccccctgtgtctgaggagaccagcgctggccctgctgcccctggcacctaccgctgcctgctgtgcagccgggagtttgggaaggccctgcagctgaccaggcaccagagatttgtgcaccggctggagaggaggcacaagtgcagcatctgtgggaagatgttcaagaagaagagccacgtgaggaaccacctgcggacccacactggagagcggcccttcccctgcccagactgcagcaagcccttcaacagccctgccaacctggcccggcaccggctgacccacactggagagcggccctaccgctgtggggactgtgggaaggccttcacccagagcagcaccctgcggcagcaccggctggtgcacgcccagcacttcccctaccgctgccaggagtgtggggtgcgcttccaccggccctaccgcctgctgatgcaccgctaccaccacactggagagtacccctacaagtgcagagaatgtcccaggagcttcctgctgcggcggctgctggaggtgcaccagctggtggtgcatgctggccggcagccccaccgctgccccagctgtggggccgccttccccagcagcctgcggctgcgggagcaccgctgtgccgctgctgctgcccaggcccccaggagatttgaatgtggcacctgtgggaagaaggtgggcagcgctgcccggctgcaggcccatgaagctgcccacgccgccgccggccctggagaggtgctggccaaggagcccccagccccccgggccccccgggccacccgggcccctgtggccagccctgctgccctgggcagcacagccacagccagccctgctgccccagccaggagaagaggcctggagtgcagcgagtgcaagaagctgttcagcacagagaccagcctgcaggtgcaccggcgcatccacactggagagcggccctacccctgcccagactgtgggaaggccttccggcagagcacccacctgaaggaccaccggcggctgcacactggagagcggccctttgcctgtgaggtgtgtgggaaggcctttgccatctccatgaggctggccgagcaccggcgcatccacactggagagcggccctacagctgcccagactgtgggaagagctaccgctccttcagcaacctgtggaagcacaggaagacccaccagcagcagcaccaggccgctgtgcggcagcagctggccgaggccgaggccgctgtgggcctggccgtgatggagacagctgtggaggccctgcccctggtggaggccatcgagatctaccccctggccgaggccgagggcgtgcagatctctggatag

SEQ ID NO: 42235 - DNA, 447 bp, Artificial Sequence
  Description of Artificial Sequence: Synthetic coding sequence
atgttcagaagacctgtgctgcaggtgctgcggcagtttgtgagacatgagagcgagaccaccaccagcctggtgctggagaggagcctgaacagagtgcacctgctgggccgggtgggccaggaccctgtgctgcggcaggtggagggcaagaaccctgtgaccatcttcagcctggccaccaatgagatgtggaggtctggggacagcgaggtgtaccagctgggagatgtgtcccagaagaccacctggcaccgcatcagcgtcttccggcccggcctgagagatgtggcctaccagtatgtgaagaagggcagccgcatctacctggagggcaagattgattatggagagtacatggacaagaacaacgtgcggcggcaggccaccaccatcatcgctgacaacatcatcttcctgagtgaccagaccaaggagaaggagtag

SEQ ID NO: 42236 - DNA, 447 bp, Artificial Sequence; identical to SEQ ID NO: 42235
  Description of Artificial Sequence: Synthetic coding sequence

SEQ ID NO: 42237 - DNA, 408 bp, Artificial Sequence
  Description of Artificial Sequence: Synthetic coding sequence
atgttcagaagacctgtgctgcaggtgctgcggcagtttgtgagacatgagagcgagaccaccaccagcctggtgctggagaggagcctgaacagagtgcacctgctgggccgggtgggccaggaccctgtgctgcggcaggtggagggcaagaaccctgtgaccatcttcagcctggccaccaatgagatgtggaggtctggggacagcgaggtgtaccagctgggagatgtgtcccagaagaccacctggcaccgcatcagcgtcttccggcccggcctgagagatgtggcctaccagtatgtgaagaagggcagccgcatctacctggagggcaagattgattatggagagtacatggacaagaacaacgtgcggcggcaggccaccaccatcatcgctgactag

SEQ ID NO: 42238 - DNA, 447 bp, Artificial Sequence; identical to SEQ ID NO: 42235
  Description of Artificial Sequence: Synthetic coding sequence

SEQ ID NO: 42239 - DNA, 576 bp, Artificial Sequence
  Description of Artificial Sequence: Synthetic coding sequence
atgggctacaagctgcaggacctgacagatgtgcagatcatggcccggctgcaggaggagaacaagctgcggcgctccatgcccaacctggccaggatgcccagcaccacagccatcagcagcaacatcagcagccctgtgacagtgaggaacagccagagctttgacagcagcctgcacggggctggaaatggcatcagccgcatccagagctgcatccccagccctggccagctgcagcaccgggtgcacagcgtgggccacttccctgtgtccatccggcagcccctgaaggccacagcctacgtgagccccaccgtgcagggcagcagcaacatgcccctgagcaatggcctgcagctgtacagcaacacaggcatccccacccccaacaaggccgccgccagcggcatcatgggccgcagcgccctgccccggcccagcctggccatcaatggcagcaacctgcccaggagcaagatcgcccagcctgtgcgctccttcctgcagccccccaagcccctgagcagcctgagcaccctgagagatggcaactggagagatggctgctactag

SEQ ID NO: 42240 - DNA, 918 bp, Artificial Sequence
  Description of Artificial Sequence: Synthetic coding sequence
atgggctacaagctgcaggacctgacagatgtgcagatcatggcccggctgcaggaggagagcctgcggcaggactatgccagcaccagcgcctctgtgagccgccacagcagctctgtgtccctgagcagcggcaagaagggcacctgcagcgaccaggagtatgaccagtacagcctggaggatgaggaggagtttgaccacctgcccccaccccagccccggctgccccgctgcagccccttccagaggggcatcccccacagccagaccttcagcagcatcagagaatgtagaagaagccccagcagccagtacttccccagcaacaactaccagcagcagcagtactacagcccccaggcccagaccccagaccagcagcccaacagaacaaatggagacaagctgcggcgctccatgcccaacctggccaggatgcccagcaccacagccatcagcagcaacatcagcagccctgtgacagtgaggaacagccagagctttgacagcagcctgcacggggctggaaatggcatcagccgcatccagagctgcatccccagccctggccagctgcagcaccgggtgcacagcgtgggccacttccctgtgtccatccggcagcccctgaaggccacagcctacgtgagccccaccgtgcagggcagcagcaacatgcccctgagcaatggcctgcagctgtacagcaacacaggcatccccacccccaacaaggccgccgccagcggcatcatgggccgcagcgccctgccccggcccagcctggccatcaatggcagcaacctgcccaggagcaagatcgcccagcctgtgcgctccttcctgcagccccccaagcccctgagcagcctgagcaccctgagagatggcaactggagagatggctgctactag

SEQ ID NO: 42241 - DNA, 918 bp, Artificial Sequence; identical to SEQ ID NO: 42240
  Description of Artificial Sequence: Synthetic coding sequence

SEQ ID NO: 42242 - DNA, 255 bp, Artificial Sequence
  Description of Artificial Sequence: Synthetic coding sequence
atgtaccgctaccagagctgccgctggaagaacaccctcttcctgtgtgtgtctggctacaccagccggggcagccccctgagcccccagagcagcattgattctgagctgagcaccagcgagctggaggatgacagcatctccatgggctacaagctgcaggacctgacagatgtgcagatcatggcccggctgcaggaggagagcctgcggcaggactatgccagcaccagcgcctctgtgagccgccactag

SEQ ID NO: 42243 - DNA, 1707 bp, Artificial Sequence
  Description of Artificial Sequence: Synthetic coding sequence
atgatggccgagcaggtgaagtgtgccagcgctggggtgtcctctggagctggcagcggccctgtggtgaatgctgagctggaggtgaagaagctgcaggagctggtgaggaagctggagaagcagaatgagcagctgcggagccgggccgccagcgctgctgctgccccccacctgctgctgctgcccccacctcctcctgctgcccctcctcctgctggcctgcagcccctgggccccaggagccccccagctgccacagccacagctgctgccagcggcggcctgggccctgccttccctggcaccttctgcctgcccagccctgcccccagcctgctgtgcagcctggcccagcccccagaggccccctttgtgtacttcaagccagctgctggcttctttggagctgggggcggcggccctgagcccggcggggccggcaccccacctggagctgctgctgccccacccagccccccacccaccctgctggatgaggtggagctgctggacctggagagcgtggccgcctggagagatgaagatgactacacctggctgtacatcggcagcagcaagaccttcaccagcagcgagaagagcctgacccccctgcagtggtgcagacatgtgctggacaaccccaccccagagatggaggccgcccggcgcagcctgtgcttccggctggagcagggctacaccagccggggcagccccctgagcccccagagcagcattgacagcgagctgagcaccagcgagctggaggatgacagcatctccatgggctacaagctgcaggacctgacagatgtgcagatcatggcccggctgcaggaggagagcctgcggcaggactatgccagcaccagcgcctctgtgagccgccacagcagctctgtgtccctgagcagcggcaagaagggcacctgcagcgaccaggagtatgaccagtacagcctggaggatgaggaggagtttgaccacctgcccccaccccagccccggctgccccgctgcagccccttccagaggggcatcccccacagccagaccttcagcagcatccgggagtgccgccgcagccccagcagccagtacttccccagcaacaactaccagcagcagcagtactacagcccccaggcccagaccccagaccagcagcccaacagaaccaacggggacaagctgcggcgctccatgcccaacctggccaggatgcccagcaccacagccatcagcagcaacatcagcagccctgtgacagtgaggaacagccagagctttgacagcagcctgcatggagctggaaatggcatcagccgcatccagagctgcatccccagccctggccagctgcagcaccgggtgcacagcgtgggccacttccctgtgtccatccggcagcccctgaaggccacagcctacgtgagccccaccgtgcagggcagcagcaacatgcccctgagcaatggcctgcagctgtacagcaacacaggcatccccacccccaacaaggctgctgccagcggcatcatgggccgcagcgccctgccccggcccagcctggccatcaatggcagcaacctgcccaggagcaagatcgcccagcctgtgcgctccttcctgcagccccccaagcccctgagcagcctgagcaccctgagagatggcaactggagagatggctgctactag

SEQ ID NO: 42244 - DNA, 1050 bp, Artificial Sequence
  Description of Artificial Sequence: Synthetic coding sequence
atggaggccgcccggcgcagcctgtgcttccggctggagcagggctacaccagccggggcagccccctgagcccccagagcagcattgattctgagctgagcaccagcgagctggaggatgacagcatctccatgggctacaagctgcaggacctgacagatgtgcagatcatggcccggctgcaggaggagagcctgcggcaggactatgccagcaccagcgcctctgtgagccgccacagcagctctgtgtccctgagcagcggcaagaagggcacctgcagcgaccaggagtatgaccagtacagcctggaggatgaggaggagtttgaccacctgcccccaccccagccccggctgccccgctgcagccccttccagaggggcatcccccacagccagaccttcagcagcatcagagaatgtagaagaagccccagcagccagtacttccccagcaacaactaccagcagcagcagtactacagcccccaggcccagaccccagaccagcagcccaacagaacaaatggagacaagctgcggcgctccatgcccaacctggccaggatgcccagcaccacagccatcagcagcaacatcagcagccctgtgacagtgaggaacagccagagctttgacagcagcctgcacggggctggaaatggcatcagccgcatccagagctgcatccccagccctggccagctgcagcaccgggtgcacagcgtgggccacttccctgtgtccatccggcagcccctgaaggccacagcctacgtgagccccaccgtgcagggcagcagcaacatgcccctgagcaatggcctgcagctgtacagcaacacaggcatccccacccccaacaaggccgccgccagcggcatcatgggccgcagcgccctgccccggcccagcctggccatcaatggcagcaacctgcccaggagcaagatcgcccagcctgtgcgctccttcctgcagccccccaagcccctgagcagcctgagcaccctgagagatggcaactggagagatggctgctactag

SEQ ID NO: 42245 - DNA, 723 bp, Artificial Sequence
  Description of Artificial Sequence: Synthetic coding sequence
atgggctacaagctgcaggacctgacagatgtgcagatcatggcccggctgcaggaggagagcctgcggcaggactatgccagcaccagcgcctctgtgagccgccacagcagctctgtgtccctgagcagcggcaagaagggcacctgcagcgaccaggagtatgaccagtacagcctggaggatgaggaggagtttgaccacctgcccccaccccagccccggctgccccgctgcagccccttccagaggggcatcccccacagccagaccttcagcagcatcagagaatgtagaagaagccccagcagccagtacttccccagcaacaactaccagcagcagcagtactacagcccccaggcccagaccccagaccagcagcccaacagaacaaatggagacaagctgcggcgctccatgcccaacctggccaggatgcccagcaccacagccatcagcagcaacatcagcagccctgtgacagtgaggaacagccagagctttgacagcagcctgcacggggctggaaatggcatcagccgcatccagagctgcatccccagccctggccagctgcagcaccgggtgcacagcgtgggccacttccctgtgtccatccggcagcccctgaaggccacagcctacgtgagccccaccgtgcagggcagcagcaacatgcccctgagcaatggcctgcagctgtacagcaacacaggatag

SEQ ID NO: 42246 - DNA, 1707 bp, Artificial Sequence; identical to SEQ ID NO: 42243
  Description of Artificial Sequence: Synthetic coding sequence

SEQ ID NO: 42247 - DNA, 444 bp, Artificial Sequence
  Description of Artificial Sequence: Synthetic coding sequence
atgggctacaagctgcaggacctgacagatgtgcagatcatggcccggctgcaggaggagagcctgcggcaggactatgccagcaccagcgcctctgtgagccgccacagcagctctgtgtccctgagcagcggcaagaagggcacctgcagcgaccaggagtatgaccagtacagcctggaggatgaggaggagtttgaccacctgcccccaccccagccccggctgccccgctgcagccccttccagaggggcatcccccacagccagaccttcagcagcatcagagaatgtagaagaagccccagcagccagtacttccccagcaacaactaccagcagcagcagtactacagcccccaggcccagaccccagaccagcagcccaacagaacaaatggagacaagctgcggcgctccatgcccaacctggccaggatgtag

SEQ ID NO: 42248 - DNA, 39 bp, Artificial Sequence
  Description of Artificial Sequence: Synthetic coding sequence
atgggctacaagctgcaggacctgacagatgtgcagtag

SEQ ID NO: 42249 - DNA, 1281 bp, Artificial Sequence
  Description of Artificial Sequence: Synthetic coding sequence
atggtgggcgtgggcctgtgcctgcggctgctgctcttcttccgcttcaagaggaccctggaccgcatctgtgtgctcttcctgctgggctggcacaggaagcccaggagtgatggcagcctcttcatcgagcggctgtacatcggcagcagcaagaccttcaccagcagcgagaagagcctgacccccctgcagtggtgcagacatgtgctggacaaccccaccccagagatggaggccgcccggcgcagcctgtgcttccggctggagcagggctacaccagccggggcagccccctgagcccccagagcagcattgacagcgagctgagcaccagcgagctggaggatgacagcatctccatgggctacaagctgcaggacctgacagatgtgcagatcatggcccggctgcaggaggagagcctgcggcaggactatgccagcaccagcgcctctgtgagccgccacagcagctctgtgtccctgagcagcggcaagaagggcacctgcagcgaccaggagtatgaccagtacagcctggaggatgaggaggagtttgaccacctgcccccaccccagccccggctgccccgctgcagccccttccagaggggcatcccccacagccagaccttcagcagcatccgggagtgccgccgcagccccagcagccagtacttccccagcaacaactaccagcagcagcagtactacagcccccaggcccagaccccagaccagcagcccaacagaaccaacggggacaagctgcggcgctccatgcccaacctggccaggatgcccagcaccacagccatcagcagcaacatcagcagccctgtgacagtgaggaacagccagagctttgacagcagcctgcatggagctggaaatggcatcagccgcatccagagctgcatccccagccctggccagctgcagcaccgggtgcacagcgtgggccacttccctgtgtccatccggcagcccctgaaggccacagcctacgtgagccccaccgtgcagggcagcagcaacatgcccctgagcaatggcctgcagctgtacagcaacacaggcatccccacccccaacaaggctgctgccagcggcatcatgggccgcagcgccctgccccggcccagcctggccatcaatggcagcaacctgcccaggagcaagatcgcccagcctgtgcgctccttcctgcagccccccaagcccctgagcagcctgagcaccctgagagatggcaactggagagatggctgctactag

SEQ ID NO: 42250 - DNA, 408 bp, Artificial Sequence
  Description of Artificial Sequence: Synthetic coding sequence
atgggctacaagctgcaggacctgacagatgtgcagatcatggcccggctgcaggaggagagcctgcggcaggactatgccagcaccagcgcctctgtgagccgccacagcagctctgtgtccctgagcagcggcaagaagggcacctgcagcgaccaggagtatgaccagtacagcctggaggatgaggaggagtttgaccacctgcccccaccccagccccggctgccccgctgcagccccttccagaggggcatcccccacagccagaccttcagcagcatcagagaatgtagaagaagccccagcagccagtacttccccagcaacaactaccagcagcagcagtactacagcccccaggcccagaccccagaccagcagcccaacagaacaaatggaggatag

SEQ ID NO: 42251 - DNA, 2538 bp, Artificial Sequence
  Description of Artificial Sequence: Synthetic coding sequence
atgctgtctggagtgtggttcctgtctgtgctgactgtggccggcatcctgcagacagagagcaggaagacagccaaggacatctgcaagatccgctgcctgtgtgaggagaaggaaaatgtgctgaacatcaactgtgaaaataaaggcttcaccaccgtgtccctgctgcagcccccccagtaccgcatctaccagctgttcctgaatggaaacctgctgacccggctgtacccaaatgaatttgtgaactacagcaatgctgtgaccctgcacctgggcaacaacggcctgcaggagatcagaactggagccttcagcggcctgaagaccctgaagaggctgcacctgaacaacaacaagctggagatcctgcgggaggacaccttcctgggcctggagagcctggagtacctgcaggccgactacaactacatcagcgccattgaagctggggccttcagcaagctgaacaagctgaaggtgctgatcctgaatgacaacctgctgctgagcctgcccagcaatgtgttccgctttgtgctgctgacccacctggacctgcggggcaaccggctgaaggtgatgccctttgctggggtgctggagcacatcggcggcatcatggagatccagctggaggagaacccctggaactgcacctgtgacctgctgcccctgaaggcctggctggacaccatcaccgtgtttgtgggggagatcgtgtgtgagacccccttccggctgcacggcaaggatgtgacccagctgacccggcaggacctgtgccccaggaagagcgccagtgacagcagccagaggggcagccacgccgacacccacgtgcagaggctgagccccaccatgaacccagccctgaaccccacccgggcccccaaggccagccggccccccaagatgaggaaccggcccaccccccgggtgacagtgtccaaggaccggcagagctttggccccatcatggtgtaccagaccaagagccctgtgcccctgacctgccccagcagctgtgtgtgcaccagccagagcagtgacaatggcctgaatgtgaactgccaggagaggaagttcaccaacatcagtgacctgcagcccaagcccaccagccccaagaagctgtacctgactggaaactacctgcagacagtgtacaagaatgacctgctggagtacagcagcctggacctgctgcacctgggcaacaacagaattgctgtgatccaggagggcgccttcaccaacctgaccagcctgcggcggctgtacctgaatggaaactacctggaggtgctgtaccccagcatgtttgatggcctgcagagcctgcagtacctgtacctggagtacaacgtcatcaaggagatcaagcccctgacctttgatgccctgatcaacctgcagctgctcttcctgaacaacaacctgctgcggagcctgcctgacaacatctttggaggaacagccctgacccggctgaacctgaggaacaaccacttcagccacctgcctgtgaagggcgtgctggaccagctgcctgccttcatccagattgacctgcaggagaacccctgggactgcacctgtgacatcatgggcctgaaggactggacagagcacgccaacagccctgtgatcatcaatgaggtgacctgtgagagccctgccaagcatgctggggagatcctgaagttcctgggccgggaggccatctgcccagacagccccaacctgagtgatggcaccgtgctgtccatgaaccacaacacagacacccccaggagcctgtctgtgagccccagcagctacccagagctgcacacagaggtgcccctgtctgtgctgatcctgggcctgctggtggtgttcatcctgtctgtgtgctttggagctggcctgtttgtgtttgtgctgaagaggaggaagggcgtgcccagcgtgcccaggaacaccaacaacctggatgtgagcagcttccagctgcagtatggcagctacaacacagagacccatgacaagacagatggccacgtgtacaactacatccccccacctgtgggccagatgtgccagaaccccatctacatgcagaaggagggggaccctgtggcctactacagaaacctgcaggagttctcctacagcaacctggaggagaagaaggaggagcccgccaccccagcctacaccatcagcgccacagagctgctggagaagcaggccaccccccgggagcctgagctgctgtaccagaacattgctgagcgggtgaaggagctgcccagcgctggcctggtgcactacaacttctgcaccctgcccaagaggcagtttgcccccagctatgagagccggcggcagaaccaggaccgcatcaacaagacagtgctgtatggcacccccaggaaatgttttgtgggccagagcaagcccaaccaccccctgctgcaggccaagccccagagcgagccagactacctggaggtgctggagaagcagacagccatcagccagctgtag

SEQ ID NO: 42252 - DNA, 2538 bp, Artificial Sequence; identical to SEQ ID NO: 42251
  Description of Artificial Sequence: Synthetic coding sequence

SEQ ID NO: 42253 - DNA, 2538 bp, Artificial Sequence; identical to SEQ ID NO: 42251
  Description of Artificial Sequence: Synthetic coding sequence

SEQ ID NO: 42254 - DNA, 333 bp, Artificial Sequence
  Description of Artificial Sequence: Synthetic coding sequence
atggcccggggcaaccagcgggagctggcccggcagaagaacatgaagaagacccaggagatcagcaagggcaagaggaaggaggacagcctgacagccagccagaggaagcagagcagcggcggccagaagtctgagagcaagatgtctgctggcccccacctgcccctgaaggccccccgggagaacccctgcttccccctgcctgctgctgggggcagccgctactacctggcctacggcagcatcacccccatcagcgcctttgtgtttgtggtgttcttcagcgtcttcttccccagcttctatgaggacttctgctgctggatctag

SEQ ID NO: 42255 - DNA, 189 bp, Artificial Sequence
  Description of Artificial Sequence: Synthetic coding sequence
atggcccggggcaaccagcgggagctggcccggcagaagaacatgaagaagacccaggagatcagcaagggcaagaggaaggaggacagcctgacagccagccagaggaagcagagggacagcgagatcatgcaggagaagcagaaggccgccaatgagaagaagtccatgcagacccgggagaagtag

SEQ ID NO: 42256 - DNA, 915 bp, Artificial Sequence
  Description of Artificial Sequence: Synthetic coding sequence
atgagcagcatcaagcacctggtgtatgctgtgatccgcttcctgcgggagcagagccagatggacacctacaccagtgatgagcaggagagcctggaggtggccatccagtgcctggagaccgtcttcaagatcagccctgaggacacccacctggccgtgtcccagcccctgacagagatgttcaccagcagcttctgcaagaatgatgtgctgcccctgagcaacagcgtgcctgaagatgtgggcaaggctgaccagctgaaggatgagggcaacaaccacatgaaggaggagaactatgctgctgctgtggactgctacacccaggccatcgagctggaccccaacaatgctgtgtactactgcaacagagctgctgcccagagcaagctgggccactacacagatgccatcaaggactgtgagaaggccatcgccatcgacagcaagtacagcaaggcctacggccgcatgggcctggccctgacagccctgaacaagtttgaggaggccgtgaccagctaccagaaggccctggacctggaccctgaaaatgacagctacaagagcaacctgaagattgctgagcagaagctgcgggaggtgagcagccccactggaacaggcctgagctttgacatggccagcctcatcaacaacccagccttcatctccatggccgccagcctgatgcagaacccccaggtgcagcagctgatgagcggcatgatgaccaatgccatcggcggccctgctgctggggtgggcggcctgacagacctgagcagcctcatccaggccggccagcagtttgcccagcagatccagcagcagaaccctgagctgattgagcagctgaggaaccacatccgcagccgctccttcagcagcagcgctgaggagcacagctag

SEQ ID NO: 42257 - DNA, 588 bp, Artificial Sequence
  Description of Artificial Sequence: Synthetic coding sequence
atgagcagcatcaagcacctggtgtatgctgtgatccgcttcctgcgggagcagagccagatggacacctacaccagtgatgagcaggagagcctggaggtggccatccagtgcctggagaccgtcttcaagatcagccctgaggacacccacctggccgtgtcccagcccctgacagagatgttcaccagcagcttctgcaagaatgatgtgctgcccctgagcaacagcgtgcctgaagatgtgggcaaggctgaccagctgaaggatgagggcaacaaccacatgaaggaggagaactatgctgctgctgtggactgctacacccaggccatcgagctggaccccaacaatgctgtgtactactgcaacagagctgctgcccagagcaagctgggccactacacagatgccatcaaggactgtgagaaggccatcgccatcgacagcaagtacagcaaggcctacggccgcatgggcctggccctgacagccctgaacaagtttgaggaggccgtgaccagctaccagaaggccctggacctggaccctgaaaatgacagctacaagagcaacctgaagatctag

SEQ ID NO: 42258 - DNA, 237 bp, Artificial Sequence
  Description of Artificial Sequence: Synthetic coding sequence
atgcagccccaggagagccacgtgcactacagccgctgggaggatggcagcagagatggagtgtccctgggcgctgtgagcagcacagaggaggccagccgctgccgccgcatcagccagaggctgtgcaccgggaagctgggcatcgccatgaaggtgctgggcggcgtggccctcttctggatcatcttcatcctgggctacctgaccggctactacgtgcacaagtgcaagtag

SEQ ID NO: 42259 - DNA, 189 bp, Artificial Sequence; identical to SEQ ID NO: 36493
  Description of Artificial Sequence: Synthetic coding sequence

SEQ ID NO: 42260 - DNA, 279 bp, Artificial Sequence
  Description of Artificial Sequence: Synthetic coding sequence
atggcctacagcggccagggccagaaggtgcagaaggtgatggtgcagcccatcaacctgatcttccgctacctgcagaacagaagccagatccaggtgtggctgtatgagcaggtgaacatgcagatcgagggctgcatcatcggctttgatgagtacatgaacctggtgctggatgatgctgaggagatccacagcaagaccaagagcaggaagcagctgggccgcatcatgctgaagggggacaacatcaccctgctgcagagcgtgagcaactag

SEQ ID NO: 42261 - DNA, 297 bp, Artificial Sequence
  Description of Artificial Sequence: Synthetic coding sequence
atgcaggtgcccctgacccccctgtgggagctgggcctgggccgggtggtggagaatgctgatgccctggccatcgccatcgtgctgaacaaccagtggagcctggtgcccaacagaggcatcctgtacttcctgcctgtgtccatgaagctgggcggggacagagtgtcctgccagttcctgacagccaccagccaccagtggctgcacagcgtgtccctgacccagcacatggcccaggagtgcctgcccagcgtgtctgtgtccacagctgccatcccccgctgctggagctag

SEQ ID NO: 42262 - DNA, 423 bp, Artificial Sequence
  Description of Artificial Sequence: Synthetic coding sequence
atgaggcgctgcctgcgggtgaagacccggcggggccagctgggcctggccagcagctgctttgagcagcacagctgcttcagcccccgggtgaaccgcatcctgtctgctgtgcagaacaccctgtgcaccggccccagcagccaggccccaccccagcccccccaggccagccccccagctgctgctgaccacagcaggacccccagcctgctggccagcagccacagcgccagcggcggggagagcctcttccagctgtacatcgccagcctggcctggccccagaactgctgcgtgctggagagctgccgccgcatccccctgggcggcctgagctccatggagaacagaagacccctgctgaggaagggccgcctgctgcggggccagatccaccacagccagaccaatgagctgtag

SEQ ID NO: 42263 - DNA, 2814 bp, Artificial Sequence
  Description of Artificial Sequence: Synthetic coding sequence
atgatcagcgccccagatgtggtggccttcaccaaggaggaggagtatgaggaggagccctacaatgagcccgccctgcctgaggagtacagcgtgcccctcttcccctttgccagccagggcgccaacccctggagcaagctgagcggggccaagttcagccgggacttcatcctgatcagcgagttcagcgagcaggtgggcccccagcccctgctgaccatccccaatgacaccaaggtgtttggcacctttgacctgaactacttcagcctgcgcatcatgtctgtggactaccaggccagctttgtgggccaccccccaggcagcgcctaccccaagctgaactttgtggaggacagcaaggtggtgctgggggacagcaaggagggcgcctttgcctacgtgcaccacctgaccctgtatgacctggaggcccggggctttgtgcggcccttctgcatggcctacatctctgctgaccagcacaagatcatgcagcagttccaggagctgtctgctgagttcagccgggcctctgaatgtctgaagacaggcaacaggaaggcctttgctggggagctggagaagaagctgaaggacctggactacaccaggacagtgctgcacacagaaacagagatccagaagaaggccaatgacaagggcttctacagcagccaggccatcgagaaggccaatgagctggcctctgtggagaagagcatcatcgagcaccaggacctgctgaagcagatccgcagctacccccacaggaagctgaagggccatgacctgtgccctggagagatggagcacatccaggaccaggccagccaggccagcaccaccagcaacccagatgagagcgctgacacagacctgtacacctgcaggcctgcctacacccccaagctgatcaaggccaagagcaccaagtgctttgacaagaagctgaagaccctggaggagctgtgtgacacagagtacttcacccagaccctggcccagctgagccacatcgagcacatgttccggggggacctgtgctacctgctgaccagccagattgaccgggccctgctgaagcagcagcacatcaccaacttcctgtttgaagattttgtggaggtggatgacaggatggtggagaagcaggagagcatccccagcaagcccagccaggaccggccccccagcagcagcctggaggagtgccccatccccaaggtgctgatctctgtgggcagctacaagagctctgtggagagcgtgctgatcaagatggagcaggagctgggagatgaggagtacaaggaggtggaggtgacagagctgagcagctttgacccccaggagaacctggactacctggacatggacatgaagggcagcatcagcagcggggagagcattgaggtgctgggcacagagaagagcacctctgtgctgagcaagagtgacagccaggccagcctgactgtgcccctgagcccccaggtggtgcgcagcaaggctgtgagccacaggaccatcagcgaggacagcattgaggtgctgagcacctgccccagcgaggccctgatcccagatgacttcaaggccagctaccccagcgccatcaatgaggaggagagctacccagatggaaatgaaggagccatccgcttccaggccagcatcagccccccagagctgggggagacagaggagggcagcattgagaacacccccagccagattgacagcagctgctgcatcggcaaggagagtgatggccagctggtgctgcccagcaccccagcccacacccacagtgatgaagatggagtggtgagcagccccccccagaggcaccggcagaaggaccagggcttccgggtggacttctctgtggagaatgccaaccccagcagccgggacaacagctgtgagggcttccctgcctatgagctggaccccagccacctgctggccagccgggacatcagcaagaccagcctggacaactacagcgacaccaccagctatgtgtcctctgtggccagcaccagcagtgaccgcatccccagcgcctacccagctggcctgagcagtgacagacacaagaagagagctggccagaatgccctgaagttcatccggcagtacccctttgcccacccagccatctacagcctgctgagcggccgcaccctggtggtgctgggggaggatgaggccatcgtgaggaagctggtgacagccctggccatctttgtgcccagctatggctgctacgccaagcctgtgaagcactgggccagcagccccctgcacatcatggacttccagaagtggaagctgattggcctgcagagggtggccagccctgctggggccggcaccctgcacgccctgagccgctacagccgctacaccagcatcctggacctggacaacaagaccctgcgctgccccctgtaccggggcaccctggtgccccggctggccgaccacaggacccagatcaagaggggcagcacctactacctgcacgtgcagagcatgctgacccagctgtgcagcaaggccttcctgtacaccttctgccaccacctgcacctgcccacccatgacaaggagacagaggagctggtggccagccggcagatgtccttcctgaagctgaccctgggcctggtgaatgaagatgtgcgggtggtgcagtacctggccgagctgctgaagctgcactacatgcaggagagccctggcaccagccaccccatgctgcgctttgattatgtgcccagcttcctgtacaagatctag

SEQ ID NO: 42264 - DNA, 954 bp, Artificial Sequence
  Description of Artificial Sequence: Synthetic coding sequence
atgaggaagaccagcaacagctgcatcatggagaatggccaccagcccggggccggccctggagatggccccccagaaattgcccagaacttcagcgccccagaccccccccggcccaggcctgtgtccctgagcctgcggctgccccaccagcctgtgacagccatcaccagggtgtctgaccgcttcagcggggagaccagcgctgctgccctgagccccatgtctgctgccaccctgggcggcctgaaccccagccccagcgaggtgatcaccccctggacccccagccccagcgagaagaacagcagcttcacctggagcgtgcccagcagcggctacggggctgtgacagccagcaagcacagcaacagcccccccctggtgaccccaccccagagccctgtgagcccccagcccccagccatcacccaggtgcaccggcagggcgagaggagaagagagctggtgcgcagccagaccctgcccaggaccagcgaggcccaggccaggaaggccctgtttgagaagtgggagcaggagacagctgctgggaagggcaagggggaggcccgggcccggctgaagaggagccagagctttggagtggccagcgccagcagcatcaagcagatcctgctggagtggtgccgcagcaagaccctgggctaccagcacgtggacctgcagaacttcagcagctcctggagcgatggcatggccttctgtgccctggtgcacagcttcttcccagatgcctttgactacaacagcctgagccccacccagaggcagaagaactttgagctggccttcaccatggccgagaacctggccaactgtgagcggctgattgaggtggaggacatgatggtgatgggcaggaagccagaccccatgtgtgtgttcacctacgtgcagagcctgtacaaccacctgcggagatttgaatag

SEQ ID NO: 42265 - DNA, 1386 bp, Artificial Sequence
  Description of Artificial Sequence: Synthetic coding sequence
atggagcccgccccagatgcccaggaggccaggacagtgcgggaggccctgggccgctatgaggccgccctggagggcgctgtgcgggccctgcacgaggacatgaggggcctgcagaggggcgtggagcggcgggtggccgaggccatgaggctggccggccccctggccaggacagtggccgacctgcagagggacaaccagaggctgcaggcccagctggagcggctgacccggcaggtggaggccctgggcctggccagcggcatgagccctgtgcccggcaccccaggcacccccagccccccaccagcccctggggtgcctgaccgggccccccggctgggcagcgccaggtttgccagccacgccaccttcagcctgagcggccggggccagagcctggaccatgatgaggccagcgagagcgagatgaggaagaccagcaacagctgcatcatggagaatggccaccagcccggggccggccctggagatggccccccagaaattgcccagaacttcagcgccccagaccccccccggcccaggcctgtgtccctgagcctgcggctgccccaccagcctgtgacagccatcaccagggtgtctgaccgcttcagcggggagaccagcgctgctgccctgagccccatgtctgctgccaccctgggcggcctgaaccccagccccagcgaggtgatcaccccctggacccccagccccagcgagaagaacagcagcttcacctggagcgtgcccagcagcggctacggggctgtgacagccagcaagcacagcaacagcccccccctggtgaccccaccccagagccctgtgagcccccagcccccagccatcacccaggtgcaccggcagggcgagaggagaagagagctggtgcgcagccagaccctgcccaggaccagcgaggcccaggccaggaaggccctgtttgagaagtgggagcaggagacagctgctgggaagggcaagggggaggcccgggcccggctgaagaggagccagagctttggagtggccagcgccagcagcatcaagcagatcctgctggagtggtgccgcagcaagaccctgggctaccagcacgtggacctgcagaacttcagcagctcctggagcgatggcatggccttctgtgccctggtgcacagcttcttcccagatgcctttgactacaacagcctgagccccacccagaggcagaagaactttgagctggccttcaccatggccgagaacctggccaactgtgagcggctgattgaggtggaggacatgatggtgatgggcaggaagccagaccccatgtgtgtgttcacctacgtgcagagcctgtacaaccacctgcggagatttgaatag

SEQ ID NO: 42266 - DNA, 216 bp, Artificial Sequence
  Description of Artificial Sequence: Synthetic coding sequence
atggctgatgagaagcccaaggagggcgtgaagacagaaaataatgaccacatcaacctgaaggtggccggccaggacggctctgtggtgcagttcaagatcaagaggcacacccccctgagcaagctgatgaaggcctactgtgagcggcagctggagatggaggatgaggacaccattgatgtgttccagcagcagacaggaggagtgtactag

SEQ ID NO: 42267 - DNA, 288 bp, Artificial Sequence
  Description of Artificial Sequence: Synthetic coding sequence
atggctgatgagaagcccaaggagggcgtgaagacagaaaataatgaccacatcaacctgaaggtggccggccaggacggctctgtggtgcagttcaagatcaagaggcacacccccctgagcaagctgatgaaggcctactgtgagcggcagggcctgtccatgaggcagatccgcttccgctttgatggccagcccatcaatgaaacagacaccccagcccagctggagatggaggatgaggacaccattgatgtgttccagcagcagacaggaggagtgtactag

SEQ ID NO: 42268 - DNA, 1257 bp, Artificial Sequence
  Description of Artificial Sequence: Synthetic coding sequence
atggccgcctccatgtgtgatgtgttctccttctgtgtgggcgtggccggccgggcccgggtgtctgtggaggtgcgctttgtgagcagcgccaagggcaagggcctgtttgccacccagctgatcaggaagggggagaccatctttgtggagcggcccctggtggccgcccagttcctgtggaatgccctgtaccgctaccgggcctgtgaccactgcctgcgggccctggagaaggccgaggagaatgcccagaggctgaccgggaagccaggccaggtgctgccccaccctgagctgtgcaccgtgaggaaggacctgcaccagaactgcccccactgccaggtgatgtactgcagcgctgagtgccgcctggccgccacagagcagtaccaccaggtgctgtgccccggccccagccaggatgaccccctgcaccccctgaacaagctgcaggaggcctggaggagcatccactacccacctgagacagccagcatcatgctgatggccaggatggtggccaccgtgaagcaggccaaggacaaggaccgctggatccgcctcttcagccagttctgcaacaagacagccaatgaggaggaggagatcgtgcacaagctgctgggggacaagttcaagggccagctggagctgctgcggcggctcttcacagaggccctgtatgaggaggccgtgtcccagtggttcaccccagatggcttccgcagcctgtttgccctggtgggcaccaacggccagggcatcggcaccagcagcctgagccagtgggtgcacgcctgtgacaccctggagctgaagccccaggaccgggagcagctggatgccttcatcgaccagctgtacaaggacatcgaggccgccaccggggagttcctgaactgtgagggcagcggcctgtttgtgctgcagagctgctgcaaccacagctgtgtgcccaatgctgagaccagcttccctgagaacaacttcctgctgcacgtgacagccctggaggacatcaagccaggagaggagatctgcatctcctacctggactgctgccagcgggagaggagccgccacagccgccacaagatcctgcgggagaactacctgtttgtgtgcagctgccccaagtgcctggccgaggctgatgagcccaacgtgaccagcgaggaggaggaggaggaggaggaggaggaggagggggagccagaagatgctgagctgggagatgagatgacagatgtgtag

SEQ ID NO: 42269 - DNA, 285 bp, Artificial Sequence
  Description of Artificial Sequence: Synthetic coding sequence
atggagcaggcccgggaccacctgcacctgcgctggaccacagagcagcacatgcctgaggtggaggtgcaggtgaagtacagaacagctgccctgagcaaccaggagtgccagctgtacctgcggcacagccagcagcagcaggtgctggtggtggacttccaggccaagctgcggcaggtgttcatcacagagaccccccgctgtgggaagaagccctactggaacaatgaggaggccgagagcaagcagaaccctggcagcatctactgcctgctgctgtag

SEQ ID NO: 42270 - DNA, 1128 bp, Artificial Sequence
  Description of Artificial Sequence: Synthetic coding sequence
atggccggcttcaacatgggcggggacctgcgggagcctgctgccagcatccccccaggcagcctggccgctgtgggcatctcctggttcctgtacatcatctttgtgttcctgctgggcgccatctgcacccgggaggccctgcgctatgacttcctgattgctgagaaggtgtccctgatgggcttcctgttcctgctgggcctgtacatcagcagcctggccagctgcatgggcggcctgtatggagccccccgcatcctgcagtgcatcgcccaggagaaggtgatcccagccctggcctgcctgggccagggcaagggccccaacaagacccctgtggccgccatctgcctgaccagcctggtgaccatggcctttgtgtttgtgggccaggtgaatgtgctggcccccatcgtgaccatcaacttcatgctgacctacgtggccgtggactacagctacttcagcctgtccatgtgcagctgcagcctgacccctgtgcctgagcctgtgctgcgggagggcgctgagggcctgcactgcagcgagcacctgctgctggagaaggcccccagctatggcagcgagggccctgcccagagggtgctggagggcaccctgctggagttcaccaaggacatggaccagctgctgcagctgaccaggaagctggagagcagccagccccggcagggcgagggcaacagaacacctgagagccagaagaggaagagcaagaaggccaccaagcagaccctgcaggacagcttcctgctggacctgaagagccccccatccttccctgtggagatcagtgaccggctgcctgctgcctcctgggagggccaggagagctgctggaacaagcagaccagcaagtctgagggcacccagcctgagggcacctacggggagcagctggtgcctgagctgtgcaaccagagcgagagcagtggagagggggacctgcggagcccccaggagcagatcatcctggcccccagcctggccaaggtggacatggagatgacccagctgacccaggagaatgctgactttgccacccgggaccgctaccaccacagcagcctggtgaaccgggagcagctgatgccccactactag

SEQ ID NO: 42271 - DNA, 2232 bp, Artificial Sequence
  Description of Artificial Sequence: Synthetic coding sequence
atgctgcccctggagaggaccatcacctacagagacatgagcagcttcatccaggtgaagaaccacttcaacgtggtgaatgtgacctgtgtgtcctaccgcagcacctgcttccgggacatgaggcgcttcatcctggatgccctggcccagccccagccctggtggaagacccagctgttcatgtgggagcctgtgctgtttggcacctgggatggagtcttcaccagctgcatgatcaacatctttggagtggtgctcttcctgaggacaggctggctggtgggcaacacaggagtgctgctgggcatgttcctggtgtcctttgtgatcctggtggccctggtgacagtgctgagcggcatcggcgtgggggagaggagcagcatcggcagcggcggcgtgtacagcatgatcagctctgtgctgggcggccagacaggaggcaccatcggcctgctgtatgtgtttggccagtgtgtggccggggccatgtacatcaccggctttgctgagagcatcagtgacctgctgggcctgggcaacatctgggccgtgcggggcatctctgtggccgtgctgctggccctgctgggcatcaacctggccggcgtgaagtggatcatccggctgcagctgctgctgctcttcctgctggccgtgtccaccctggactttgtggtgggcagcttcacccacctggaccctgagcacggcttcatcggctacagccctgagctgctgcagaacaacaccctgcctgactacagccctggagagagcttcttcaccgtgtttggagtcttcttccctgctgccaccggggtgatggccggcttcaacatgggcggggacctgcgggagcctgctgccagcatccccccaggcagcctggccgctgtgggcatctcctggttcctgtacatcatctttgtgttcctgctgggcgccatctgcacccgggaggccctgcgctatgacttcctgattgctgagaaggtgtccctgatgggcttcctgttcctgctgggcctgtacatcagcagcctggccagctgcatgggcggcctgtatggagccccccgcatcctgcagtgcatcgcccaggagaaggtgatcccagccctggcctgcctgggccagggcaagggccccaacaagacccctgtggccgccatctgcctgaccagcctggtgaccatggcctttgtgtttgtgggccaggtgaatgtgctggcccccatcgtgaccatcaacttcatgctgacctacgtggccgtggactacagctacttcagcctgtccatgtgcagctgcagcctgacccctgtgcctgagcctgtgctgcgggagggcgctgagggcctgcactgcagcgagcacctgctgctggagaaggcccccagctatggcagcgagggccctgcccagagggtgctggagggcaccctgctggagttcaccaaggacatggaccagctgctgcagctgaccaggaagctggagagcagccagccccggcagggcgagggcaacagaacacctgagagccagaagaggaagagcaagaaggccaccaagcagaccctgcaggacagcttcctgctggacctgaagagccccccatccttccctgtggagatcagtgaccggctgcctgctgcctcctgggagggccaggagagctgctggaacaagcagaccagcaagtctgagggcacccagcctgagggcacctacggggagcagctggtgcctgagctgtgcaaccagagcgagagcagtggagaggacttcttcctgaagagccggctgcaggagcaggatgtgtggaggaggagcaccagcttctacacccacatgtgcaacccctgggtgtccctgctgggcgctgtgggcagcctgctgatcatgtttgtgatccagtgggtgtacaccctggtgaacatgggcgtggccgccatcgtgtacttctacatcggccgggccagccctggcctgcacctgggcagcgccagcaacttctccttcttccgctggatgaggagcctgctgctgcccagctgccgcagcctgcggagcccccaggagcagatcatcctggcccccagcctggccaaggtggacatggagatgacccagctgacccaggagaatgctgactttgccacccgggaccgctaccaccacagcagcctggtgaaccgggagcagctgatgccccactactag

SEQ ID NO: 42272 - DNA, 1548 bp, Artificial Sequence
  Description of Artificial Sequence: Synthetic coding sequence
atgagaagagctgctgctgggggcctggccgtgggccagctgcctggagagggccctgctggggaggagggcgccgccctgggcaaggccatgagaggaggcggctgcagcccccacagccccagcggctgcctgagcggcgtgatggccggcttcaacatgggcggggacctgcgggagcctgctgccagcatccccccaggcagcctggccgctgtgggcatctcctggttcctgtacatcatctttgtgttcctgctgggcgccatctgcacccgggaggccctgcgctatgacttcctgattgctgagaaggtgtccctgatgggcttcctgttcctgctgggcctgtacatcagcagcctggccagctgcatgggcggcctgtatggagccccccgcatcctgcagtgcatcgcccaggagaaggtgatcccagccctggcctgcctgggccagggcaagggccccaacaagacccctgtggccgccatctgcctgaccagcctggtgaccatggcctttgtgtttgtgggccaggtgaatgtgctggcccccatcgtgaccatcaacttcatgctgacctacgtggccgtggactacagctacttcagcctgtccatgtgcagctgcagcctgacccctgtgcctgagcctgtgctgcgggagggcgctgagggcctgcactgcagcgagcacctgctgctggagaaggcccccagctatggcagcgagggccctgcccagagggtgctggagggcaccctgctggagttcaccaaggacatggaccagctgctgcagctgaccaggaagctggagagcagccagccccggcagggcgagggcaacagaacacctgagagccagaagaggaagagcaagaaggccaccaagcagaccctgcaggacagcttcctgctggacctgaagagccccccatccttccctgtggagatcagtgaccggctgcctgctgcctcctgggagggccaggagagctgctggaacaagcagaccagcaagtctgagggcacccagcctgagggcacctacggggagcagctggtgcctgagctgtgcaaccagagcgagagcagtggagaggacttcttcctgaagagccggctgcaggagcaggatgtgtggaggaggagcaccagcttctacacccacatgtgcaacccctgggtgtccctgctgggcgctgtgggcagcctgctgatcatgtttgtgatccagtgggtgtacaccctggtgaacatgggcgtggccgccatcgtgtacttctacatcggccgggccagccctggcctgcacctgggcagcgccagcaacttctccttcttccgctggatgaggagcctgctgctgcccagctgccgcagcctgcggagcccccaggagcagatcatcctggcccccagcctggccaaggtggacatggagatgacccagctgacccaggagaatgctgactttgccacccgggaccgctaccaccacagcagcctggtgaaccgggagcagctgatgccccactactag

SEQ ID NO: 42273 - DNA, 723 bp, Artificial Sequence
  Description of Artificial Sequence: Synthetic coding sequence
atgcagaccacctacgtgctgcagagcctgcacctgcgcatccctgagatcagcaacatcaccaccaccccccacaccctgcctgctgcctggctgaccatgtttgatgctgtgctgatcctgctgctgatccccctgaaggacaagctggtggaccccatcctgcggcggcacggcctgctgcccagcagcctgaagagaattgctgtgggcatgttctttgtgatgtgcagcgcctttgctgctggcatcctggagagcaagaggctgaacctggtgaaggagaagaccatcaaccagaccatcggaaatgtggtgtaccacgccgctgacctgagcctgtggtggcaggtgccccagtacctgctgattggcatcagcgagatctttgccagcattgctggcctggagtttgcctacagcgctgcccccaagtccatgcagagcgccatcatgggcctcttcttcttcttctctggagtgggcagctttgtgggcagcggcctgctggccctggtgtccatcaaggccatcggctggatgagcagccacacagactttggaaacatcaatggctgctacctgaactactacttcttcctgctggccgccatccagggcgccaccctgctgctcttcctgatcatctctgtgaagtatgaccaccaccgggaccaccagaggagccgggccaacggggtgcccaccagccggcgggcctag

SEQ ID NO: 42274 - DNA, 1572 bp, Artificial Sequence
  Description of Artificial Sequence: Synthetic coding sequence
atgacccagaacaagctgaagctgtgcagcaaggccaacgtgtacacagaggtgcctgatggcggctggggctgggccgtggccgtgtccttcttctttgtggaggtgttcacctacggcatcatcaagacctttggagtcttcttcaatgacctgatggacagcttcaatgaaagcaacagccgcatctcctggatcatcagcatctgtgtgtttgtgctgaccttcagcgcccccctggccaccgtgctgagcaaccgcttcggccaccggctggtggtgatgctgggcggcctgctggtgtccacaggcatggtggccgccagcttcagccaggaggtgagccacatgtatgtggccatcggcatcatcagcggcctgggctactgcttctccttcctgcccaccgtgaccatcctgagccagtactttgggaagagaagaagcatcgtgacagctgtggccagcactggagaatgttttgctgtgtttgcctttgccccagccatcatggccctgaaggagagaattggctggagatacagcctgctgtttgtgggcctgctgcagctgaacatcgtcatctttggagccctgctgcggcccatcttcatccggggccctgccagccccaagatcgtcatccaggagaacaggaaggaggcccagtacatgctggagaatgagaagaccaggaccagcattgacagcattgacagcggcgtggagctgaccaccagccccaagaatgtgcccacccacaccaacctggagctggagcccaaggctgacatgcagcaggtgctggtgaagaccagcccccggcccagcgagaagaaggcccccctgctggacttcagcatcctgaaggagaagagcttcatctgctacgccctgtttggcctgtttgccaccctgggcttctttgcccccagcctgtacatcatccccctgggcatcagcctgggcatcgaccaggacagagctgccttcctgctgagcaccatggccatcgccgaggtgtttggaagaattggagctggctttgtgctgaaccgggagcccatcaggaagatctacatcgagctgatctgtgtgatcctgctgactgtgtccctgtttgccttcacctttgccacagagttctggggcctgatgagctgcagcatcttcttcggcttcatggtgggcaccatcggcggcacccacatccccctgctggctgaagatgatgtggtgggcatcgagaagatgagcagcgctgctggggtgtacatcttcatccagagcattgctggcctggccggcccccccctggccggcctgctggtggaccagagcaagatctacagccgggccttctacagctgtgccgccggcatggccctggccgctgtgtgcctggccctggtgcggccctgcaagatgggcctgtgccagcaccaccacagcggggagaccaaggtggtgagccaccggggcaagaccctgcaggacatccctgaggacttcctggagatggacctggccaagaatgagcaccgggtgcacgtgcagatggagcctgtgtag

SEQ ID NO: 42275 - DNA, 453 bp, Artificial Sequence
  Description of Artificial Sequence: Synthetic coding sequence
atgagatgtgccgagggcgcctggtggttctccccagatggccctgctggcagcgctgccagcatctggccagctgagggcgctgagggcctgcccggccagctgggccgggaccggctggaggtggtgtacagcgtgcctgacaacgtgcccggccagaatggcagcagaagacccctggtgtgcaagatcaccgggaagtgcctgtctgtgtgcagtgaagaaaatgccaaggccggcggctgcagcgccttccccctgctgctgagccagctgggcgccaggatgacaggccgggagcacgcccacaagggccctgagctgaccaccccagattctggcctgccccggccccccaacccagccctggccggcttccgggccctggcccagcacagcccccccctgggcaccagcacccccagcgctgtgctgctgtctgctgccacctag

SEQ ID NO: 42276 - DNA, 453 bp, Artificial Sequence; identical to SEQ ID NO: 42275
  Description of Artificial Sequence: Synthetic coding sequence

SEQ ID NO: 42277 - DNA, 762 bp, Artificial Sequence
  Description of Artificial Sequence: Synthetic coding sequence
atgggagagctgcccggcagcgagggcatgtgggagaactgccccctgggctgggtgaagaagaaggccagcggcaccctggcccccctggacttcctgctgcagaggaagaggctgtggctgtgggccagcgagcctgtgcggccccagccccagggcatccaccgcttccgggaggcccggcggcagttctgcaggatgaggggcagccggctgactggaggcaggaaaggatttggcagcagcggcctgcgcttcggccggggcggcttcagcgaggaggtgatgccccagcctgtgctgaaggccatgagatgtgccgagggcgcctggtggttctccccagatggccctgctggcagcgctgccagcatctggccagctgagggcgctgagggcctgcccggccagctgggccgggaccggctggaggtggtgtacagcgtgcctgacaacgtgcccggccagaatggcagccggcggcccctggtgtgcaagatcaccgggaagtgcctgtctgtgtgcagcgaggagaatgccaaggccggcggctgcagcgccttccccctgctgctgagccagctgggcgccaggatgacaggccgggagcacgcccacaagggccctgagctgaccaccccagacagcggcctgcccaggcctcccaacccagccctggccggcttccgggccctggcccagcacagcccccccctgggcaccagcaccccatctgctgtgctgctgtctgctgccacctag

SEQ ID NO: 42278 - DNA, 825 bp, Artificial Sequence
  Description of Artificial Sequence: Synthetic coding sequence
atggaccggcccggctttgtggccgccctggtggccggcggcgtggccggcgtgtctgtggacctgatcctcttccccctggacaccatcaagacccggctgcagagcccccagggcttcagcaaggccggcggcttccacggcatctatgccggcgtgcccagcgctgccatcggcagcttccccaatgctgctgccttcttcatcacctatgaatatgtgaagtggttcctgcacgccgacagcagcagctacctgacccccatgaagcacatgctggccgccagcgctggggaggtggtggcctgcctgatccgggtgcccagcgaggtggtgaagcagagggcccaggtgtctgccagcaccaggaccttccagatcttcagcaacatcctgtatgaggagggcatccagggcctgtaccggggctacaagagcacagtgctgcgggagatccccttcagcctggtgcagttccccctgtgggagagcctgaaggccctgtggagctggaggcaggaccacgtggtggacagctggcagagcgctgtgtgtggggcctttgctgggggctttgctgctgctgtgaccacccccctggatgtggccaagacccgcatcaccctggccaaggccggcagcagcacagcagatggaaatgtgctgtctgtgctgcacggcgtgtggaggagccagggcctggccggcctgtttgctggggtcttccccaggatggccgccatcagcctgggcggcttcatcttcctgggcgcctatgacaggacccacagcctgctgctggaggtgggcaggaagagcccctag

SEQ ID NO: 42279 - DNA, 927 bp, Artificial Sequence
  Description of Artificial Sequence: Synthetic coding sequence
ctgctggtggccctgctgggcggcggcctgcctgctggctttgtgggccccctgagcaggatggcctaccaggccagcaacctgcccagcctggagctggtgatctgccgctgcctcttccacctgcccatcgccctgctgctgaagctgcggggggaccccctgctgggccccccagacatccggggccgcacctgcttctgtgccctgctgaatgtgctgaacatcggctgtgcctacagcgctgtgcaggtggtgcccactggaaatgctgccaccgtgaggaagcacagcagcacagtgtgcagcgccatcctgaccctgtgcctggagagccaggtgctgagcggctatgactggtgtggcctgctgggcagcatcctgggcctcatcatcatcgtgggccctggcctgtggaccctgcaggagggcaccaccggggtgtacacaggcctgggctacgtgcaggccttcctgggcggcctggccctgagcctgggcctgctggtgtaccgcagcctgcacttccccagctgcctgcccaccgtggccttcctgagcggcctggtgggcctgctgggctctgtgcccggcctgtttgtgctgcagagccctgtgctgcccagcgacctgctgtcctggagctgtgtgggcgctgtgggcatcctgaccctggtgtccttcacctgtgtgggctatgctgtgaccaaggcccacccagccctggtgtgtgctgtgctgcacagcgaggtggtgatggccctgatcctgcagtacttcatgctgcatgaaacagtggcccccagcgacatcatgggcgctggggtggtgctgggcagcatcgccatcatcacagccaggaacctgatctgtgagaggacaggcaaggtggaggagcagaggctgaagaccaagaagaagaagtag

SEQ ID NO: 42280 - DNA, 1017 bp, Artificial Sequence
  Description of Artificial Sequence: Synthetic coding sequence
atggccggcagccacccctacctgaaccccccagacagcacccaccccagcccccccagcgccccacccagcctgcgctggcaccagtgctgccagcccagtgatgccaccaacggcctgctggtggccctgctgggcggcggcctgcctgctggctttgtgggccccctgagccacatggcctaccaggccagcaacctgcccagcctggagctgctgatctgccgctgcctcttccacctgcccatcgccctgctgctgaagctgcggggggaccccctgctgggccccccagacatccggggccgggcctacttctacgccctgctgaatgtgctgagcatcggctgtgcctacagcgctgtgcaggtggtgcctgctggaaatgctgccaccgtgaggaagggcagcagcacagtgtgcagcgctgtgctgaccctgtgcctggagagccagggcctgagcggctatgactggtgtggcctgctgggcagcatcctgggcctcatcatcatcgtgggccctggcctgtggaccctgcaggagggcatcactggagtgtacacagccctgggctacggccaggcctttgtgggcggcctggccctgagcctgggcctgctggtgtaccgcagcctgcacttccccagctgcctgcccaccgtggccttcctgagcggcctggtgggcctgctgggctctgtgcccggcctgtttgtgctgcagccccctgtgctgcccagcgacctgcccagctggagctgtgtgggcgctgtgggcatcctggccctggtgtccttcacctgtgtgtcctatgctgtgaccaaggcccacccagccctggtgtgtgctgtgctgcacagcgaggtggtggtggccctgatcctgcagtactacatgctgcacgagaccgtggcccccagcgacatcgtgggcgccggcgtggtgctgggcagcatcgccatcatcacagcctggaacctgagctgtgagcgggagggcaaggtggaggagtag

SEQ ID NO: 42281 - DNA, 1308 bp, Artificial Sequence
  Description of Artificial Sequence: Synthetic coding sequence
atggagggccagaccccaggcagccggggcctgcctgagaagccccacccagccacagctgctgccaccctgagctccatgggcgctgtgttcatcctgatgaagagcgccctgggcgccggcctgctgaacttcccctgggccttcagcaaggccggcggcgtggtgcctgccttcctggtggagctggtgtccctggtgttcctgatcagcggcctggtgatcctgggctatgctgctgctgtgtctggccaggccacctaccagggcgtggtgcggggcctgtgtggccctgccatcggcaagctgtgtgaggcctgcttcctgctgaacctgctgatgatctctgtggccttcctgcgggtgattggagaccagctggagaagctgtgtgacagcctgctgagcggcaccccaccagccccccagccctggtatgctgaccagcgcttcaccctgcccctgctgtctgtgctggtgatcctgcccctgagcgccccccgggagatcgccttccagaagtacaccagcatcctgggcaccctggccgcctgctacctggccctggtgatcaccgtgcagtactacctgtggccccagggcctggtgcgggagagccaccccagcctgagccctgcctcctggacctctgtgttcagcgtcttccccaccatctgcttcggcttccagtgccacgaggccgctgtgtccatctactgcagcatgaggaagaggagcctgagccactgggccctggtgtctgtgctgagcctgctggcctgctgcctgatctacagcctgactggagtgtatggcttcctgaccttcggcacagaggtgtctgcagatgtgctgatgagctacccaggaaatgacatggtgatcatcgtggcccgggtgctgtttgctgtgtccatcgtgacagtgtaccccatcgtgctcttcctgggccgctctgtgatgcaggacttctggaggaggagctgcctgggcggctggggccccagcgccctggccgaccccagcggcctgtgggtgaggatgcccctgaccatcctgtgggtgacagtgaccctggccatggccctcttcatgccagacctgtctgaaattgtgtccatcattggaggcatcagcagcttcttcatcttcatcttccctggcctgtgcctgatctgtgccatgggcgtggagcccatcggcccccgggtgaagtgctgcctggaggtgtggggcgtggtgtctgtgctggtgggcaccttcatcttcggccagagcacagctgctgctgtgtgggagatgttttag

SEQ ID NO: 42282 - DNA, 2397 bp, Artificial Sequence
  Description of Artificial Sequence: Synthetic coding sequence
atgggcaaggccagccctgccagcggcctgagccggcccaagaccctggtgagccccctgcggagcaaccagtggagcctgcagaagggcctgcctgagcagtactacagcctgacctggttcctgagccccatcctgggcctcatcttcacccccctcatcggcagcgccagtgaccgctgcaccctgtcctggggcagaagaagacccttcatcctggccctgtgtgtgggcgtgctgtttggagtggccctcttcctgaatggcagcgccatcggcctggccctgggagatgtgcccaaccggcagcccatcggcatcgtgctgactgtgctgggcgtggtggtgctggacttcagcgcagatgccacagagggccccatccgggcctacctgctggatgtggtggacagcgaggagcaggacatggccctgaacatccacgccttctctgctggcctgggcggggccatcggctacgtgctgggcggcctggactggacccagaccttcctgggctcctggttccgcacccagaaccaggtgctcttcttctttgctgccatcatcttcaccgtgtctgtggccctgcacctgttcagcattgatgaggagcagtacagcccccagcaggagaggtctgctgaggagcccggggccctggatggaggagagccccatggagtgcctgccttcccagatgaggtgcagagcgagcacgagctggccctggactacccagatgtggacatcatgaggagcaagagtgacagcgccctgcacgtgcctgacacagccctggacctggagcctgagctgctcttcctgcatgacatcgagcccagcatcttccatgatgccagctacccagccacccccaggagcaccagccaggagctggccaagaccaagctgccccggctggccaccttcctgaaggaggccgccaaggaggatgagaccctgctggacaaccacctgaatgaggccaaggtgcccaacggcagcggcagccccaccaaggatgccctgggcggctacaccagggtggacaccaagcccagcgccaccagcagctccatgagaagaagaagacatgccttccggcggcaggccagcagcaccttctcctactacggcaagctgggcagccactgctaccgctaccgccgggccaatgctgtggtgctgatcaagcccagccgctccatgtctgacctgtatgacatgcagaagaggcagaggcagcaccgccacaggaaccagagcggggccaccaccagcagcggggacacagagagcgaggagggggagggggagaccaccgtgcggctgctgtggctgtccatgctgaagatgccccgggagctgatgaggctgtgcctgtgccacctgctgacctggttctctgtgattgctgaggccgtgttctacacagacttcatgggccaggtgatctttgaaggagaccccaaggcccccagcaacagcacagcctggcaggcctacaatgccggcgtgaagatgggctgctggggcctggtgatctatgctgccaccggggccatctgcagcgccctgctgcagaagtacctggacaactatgacctgtctgtgcgggtcatctacgtgctgggcaccctgggcttctctgtgggcacagctgtgatggccatgttccccaacgtgtatgtggccatggtgaccatcagcaccatgggcatcgtgtccatgagcatctcctactgcccctatgccctgctgggccagtaccatgacatcaagcagtacatccaccacagccctggcaacagcaagaggggctttggaattgactgtgccatcctgagctgccaggtgtacatcagccagatcctggtggccagcgccctgggcggcgtggtggatgctgtgggcaccgtgcgggtcatccccatggtggcctctgtgggcagcttcctgggcttcctgacagccaccttcctggtgatctacccaaatgtgtctgaggaggccaaggaggagcagaagggcctgagcagccccctggccggggagggccgggccggcggcaacagcgagaagcccaccgtgctgaagctgaccaggaaggagggcctgcagggccctgtggagacagagcggctgcaggtgctgacctctgtgcgcagccgccacatcggctggtgccgcagctgctggagggtcttcttcttcatgatcatcctggagaagaagttctccttcccccagtgtggcagcctgcggaggatgacctacctgctcttcctgtctgagctggacaccctgtgccccggccagccctgcccctgggccgccacagcccaccagagctgggaggaggccggccctgggggcctgggccggcggcagtag

SEQ ID NO: 42283 - DNA, 2253 bp, Artificial Sequence
  Description of Artificial Sequence: Synthetic coding sequence
atgtttggccgggagttctgctacgccatggagacagccctggtgacccccatcctgctgcagatcggcctgcctgagcagtactacagcctgacctggttcctgagccccatcctgggcctcatcttcacccccctgattggcagcgccagtgaccgctgcaccctgtcctggggcagaagaagacccttcatcctggccctgtgtgtgggcgtgctgtttggagtggccctcttcctgaatggaagtgccatcggcctggccctgggagatgtgcccaaccggcagcccatcggcatcgtgctgactgtgctgggcgtggtggtgctggacttcagcgcagatgccacagagggccccatccgggcctacctgctggatgtggtggacagcgaggagcaggacatggccctgaacatccacgccttctctgctggcctgggcggggccatcggctacgtgctgggcggcctggactggacccagaccttcctgggctcctggttccgcacccagaaccaggtgctcttcttctttgctgccatcatcttcaccgtgtctgtggccctgcacctgttcagcattgatgaggagcagtacagcccccagcaggagaggtctgctgaggagcccggggccctggatggaggagagccccacggcgtgcctgccttcccagatgaggtgcagagcgagcacgagctggccctggactacccagatgtggacatcatgaggagcaagagtgacagcgccctgcacgtgcctgacacagccctggacctggagcctgagctgctcttcctgcatgacatcgagcccagcatcttccatgatgccagctacccagccacccccaggagcaccagccaggagctggccaagaccaagctgccccggctggccaccttcctgaaggaggccgccaaggaggatgagaccctgctggacaaccacctgaatgaggccaaggtgcccaatggaagtggcagccccaccaaggatgccctgggcggctacaccagggtggacaccaagcccagcgccaccagcagctccatgagaagaagaagacatgccttccggcggcaggccagcagcaccttctcctactacggcaagctgggcagccactgctaccgctacagaagagccaatgctgtggtgctgatcaagcccagccgctccatgtctgacctgtatgacatgcagaagaggcagaggcagcaccgccacaggaaccagagcggggccaccaccagcagcggggacacagaaagtgaggagggggagggggagaccaccgtgcggctgctgtggctgtccatgctgaagatgccccgggagctgatgaggctgtgcctgtgccacctgctgacctggttctctgtgattgctgaggccgtgttctacacagacttcatgggccaggtgatctttgaaggagaccccaaggcccccagcaacagcacagcctggcaggcctacaatgctggggtgaagatgggctgctggggcctggtgatctatgctgccactggagccatctgcagcgccctgctgcagaagtacctggacaactatgacctgtctgtgcgggtcatctacgtgctgggcaccctgggcttctctgtgggcacagctgtgatggccatgttccccaacgtgtatgtggccatggtgaccatcagcaccatgggcatcgtgtccatgagcatctcctactgcccctatgccctgctgggccagtaccatgacatcaagcagtacatccaccacagccctggcaacagcaagaggggcttcggcatcgactgtgccatcctgagctgccaggtgtacatcagccagatcctggtggccagcgccctgggcggcgtggtggatgctgtgggcaccgtgcgggtcatccccatggtggcctctgtgggcagcttcctgggcttcctgacagccaccttcctggtgatctaccccaacgtgtctgaggaggccaaggaggagcagaagggcctgagcagccccctggccggggagggccgggccggcggcaacagcgagaagcccaccgtgctgaagctgaccaggaaggagggcctgcagggccctgtggagacagagagcgtgaccccagctggcattgatgtgtgccagatcagcagccactggctggtgccccagctgctggagagcatcttcctgtatgactacttcaggaagaagatcttcttcagcaccatgtggttctcctag

SEQ ID NO: 42284 - DNA, 2427 bp, Artificial Sequence
  Description of Artificial Sequence: Synthetic coding sequence
atgaagatggccccccagaatgctgaccctgagagcatgcaggtgcaggagctgtctgtgcccctgcctgacccccagaaggccggcggcgctgaggccgagaactgtgagaccatcagcgagggcagcattgaccgcatccccatgaggctgtgggtgatgcatggagctgtgatgtttggccgggagttctgctacgccatggagacagccctggtgacccccatcctgctgcagatcggcctgcctgagcagtactacagcctgacctggttcctgagccccatcctgggcctcatcttcacccccctgattggcagcgccagtgaccgctgcaccctgtcctggggcagaagaagacccttcatcctggccctgtgtgtgggcgtgctgtttggagtggccctcttcctgaatggaagtgccatcggcctggccctgggagatgtgcccaaccggcagcccatcggcatcgtgctgactgtgctgggcgtggtggtgctggacttcagcgcagatgccacagagggccccatccgggcctacctgctggatgtggtggacagcgaggagcaggacatggccctgaacatccacgccttctctgctggcctgggcggggccatcggctacgtgctgggcggcctggactggacccagaccttcctgggctcctggttccgcacccagaaccaggtgctcttcttctttgctgccatcatcttcaccgtgtctgtggccctgcacctgttcagcattgatgaggagcagtacagcccccagcaggagaggtctgctgaggagcccggggccctggatggaggagagccccacggcgtgcctgccttcccagatgaggtgcagagcgagcacgagctggccctggactacccagatgtggacatcatgaggagcaagagtgacagcgccctgcacgtgcctgacacagccctggacctggagcctgagctgctcttcctgcatgacatcgagcccagcatcttccatgatgccagctacccagccacccccaggagcaccagccaggagctggccaagaccaagctgccccggctggccaccttcctgaaggaggccgccaaggaggatgagaccctgctggacaaccacctgaatgaggccaaggtgcccaatggaagtggcagccccaccaaggatgccctgggcggctacaccagggtggacaccaagcccagcgccaccagcagctccatgagaagaagaagacatgccttccggcggcaggccagcagcaccttctcctactacggcaagctgggcagccactgctaccgctacagaagagccaatgctgtggtgctgatcaagcccagccgctccatgtctgacctgtatgacatgcagaagaggcagaggcagcaccgccacaggaaccagagcggggccaccaccagcagcggggacacagaaagtgaggagggggagggggagaccaccgtgcggctgctgtggctgtccatgctgaagatgccccgggagctgatgaggctgtgcctgtgccacctgctgacctggttctctgtgattgctgaggccgtgttctacacagacttcatgggccaggtgatctttgaaggagaccccaaggcccccagcaacagcacagcctggcaggcctacaatgctggggtgaagatgggctgctggggcctggtgatctatgctgccactggagccatctgcagcgccctgctgcagaagtacctggacaactatgacctgtctgtgcgggtcatctacgtgctgggcaccctgggcttctctgtgggcacagctgtgatggccatgttccccaacgtgtatgtggccatggtgaccatcagcaccatgggcatcgtgtccatgagcatctcctactgcccctatgccctgctgggccagtaccatgacatcaagcagtacatccaccacagccctggcaacagcaagaggggcttcggcatcgactgtgccatcctgagctgccaggtgtacatcagccagatcctggtggccagcgccctgggcggcgtggtggatgctgtgggcaccgtgcgggtcatccccatggtggcctctgtgggcagcttcctgggcttcctgacagccaccttcctggtgatctaccccaacgtgtctgaggaggccaaggaggagcagaagggcctgagcagccccctggccggggagggccgggccggcggcaacagcgagaagcccaccgtgctgaagctgaccaggaaggagggcctgcagggccctgtggagacagagagcgtgaccccagctggcattgatgtgtgccagatcagcagccactggctggtgccccagctgctggagagcatcttcctgtatgactacttcaggaagaagatcttcttcagcaccatgtggttctcctag

SEQ ID NO: 42285 - DNA, 2154 bp, Artificial Sequence
  Description of Artificial Sequence: Synthetic coding sequence
atgggcaaggccagccctgccagcggcctgagccggcccaagaccctggtgagccccctgcggagcaaccagtggagcctgcagaagggcctgcctgagcagtactacagcctgacctggttcctgagccccatcctgggcctcatcttcacccccctcatcggcagcgccagtgaccgctgcaccctgtcctggggcagaagaagacccttcatcctggccctgtgtgtgggcgtgctgtttggagtggccctcttcctgaatggcagcgccatcggcctggccctgggagatgtgcccaaccggcagcccatcggcatcgtgctgactgtgctgggcgtggtggtgctggacttcagcgcagatgccacagagggccccatccgggcctacctgctggatgtggtggacagcgaggagcaggacatggccctgaacatccacgccttctctgctggcctgggcggggccatcggctacgtgctgggcggcctggactggacccagaccttcctgggctcctggttccgcacccagaaccaggtgctcttcttctttgctgccatcatcttcaccgtgtctgtggccctgcacctgttcagcattgatgaggagcagtacagcccccagcaggagaggtctgctgaggagcccggggccctggatggaggagagccccatggagtgcctgccttcccagatgaggtgcagagcgagcacgagctggccctggactacccagatgtggacatcatgaggagcaagagtgacagcgccctgcacgtgcctgacacagccctggacctggagcctgagctgctcttcctgcatgacatcgagcccagcatcttccatgatgccagctacccagccacccccaggagcaccagccaggagctggccaagaccaagctgccccggctggccaccttcctgaaggaggccgccaaggaggatgagaccctgctggacaaccacctgaatgaggccaaggtgcccaacggcagcggcagccccaccaaggatgccctgggcggctacaccagggtggacaccaagcccagcgccaccagcagctccatgagaagaagaagacatgccttccggcggcaggccagcagcaccttctcctactacggcaagctgggcagccactgctaccgctaccgccgggccaatgctgtggtgctgatcaagcccagccgctccatgtctgacctgtatgacatgcagaagaggcagaggcagcaccgccacaggaaccagagcggggccaccaccagcagcggggacacagagagcgaggagggggagggggagaccaccgtgcggctgctgtggctgtccatgctgaagatgccccgggagctgatgaggctgtgcctgtgccacctgctgacctggttctctgtgattgctgaggccgtgttctacacagacttcatgggccaggtgatctttgaaggagaccccaaggcccccagcaacagcacagcctggcaggcctacaatgccggcgtgaagatgggctgctggggcctggtgatctatgctgccaccggggccatctgcagcgccctgctgcagaagtacctggacaactatgacctgtctgtgcgggtcatctacgtgctgggcaccctgggcttctctgtgggcacagctgtgatggccatgttccccaacgtgtatgtggccatggtgaccatcagcaccatgggcatcgtgtccatgagcatctcctactgcccctatgccctgctgggccagtaccatgacatcaagcagtacatccaccacagccctggcaacagcaagaggggctttggaattgactgtgccatcctgagctgccaggtgtacatcagccagatcctggtggccagcgccctgggcggcgtggtggatgctgtgggcaccgtgcgggtcatccccatggtggcctctgtgggcagcttcctgggcttcctgacagccaccttcctggtgatctacccaaatgtgtctgaggaggccaaggaggagcagaagggcctgagcagccccctggccggggagggccgggccggcggcaacagcgagaagcccaccgtgctgaagctgaccaggaaggagggcctgcagggccctgtggagacagaatctgtggtgtag

SEQ ID NO: 42286 - DNA, 1338 bp, Artificial Sequence
  Description of Artificial Sequence: Synthetic coding sequence
atggccgcccccaccccagcccggcctgtgctgacccacctgctggtggccctgtttggcatgggctcctgggccgctgtgaatggcatctgggtggagctgcctgtggtggtgaaggagctgcctgagggctggagcctgcccagctatgtgtctgtgctggtggccctgggcaacctgggcctgctggtggtgaccctgtggaggcggctggcccctgggaaggatgagcaggtgcccatccgggtggtgcaggtgctgggcatggtgggcacagccctgctggccagcctgtggcaccacgtggcccctgtggccggccagctgcacagcgtggccttcctggccctggcctttgtgctggccctggcctgctgtgccagcaatgtgaccttcctgcccttcctgagccacctgcccccacgcttcctgcggagcttcttcctgggccagggcctgagcgccctgctgccctgtgtgctggccctggtgcagggcgtgggccgcctggagtgccccccagcccccatcaatggcaccccaggcccccccctggacttcctggagcgcttccctgccagcaccttcttctgggccctgacagccctgctggtggccagcgctgctgccttccagggcctgctgctgctgctgcccccacctccttctgtgcccaccggggagctgggcagcggcctgcaggtgggcgcccctggagctgaggaggaggtggaggagagcagccccctgcaggagccccccagccaggccgccggcaccaccccaggccctgaccccaaggcctaccagctgctgagcgcccggagcgcctgcctgctgggcctgctggccgccaccaatgccctgaccaatggagtgctgcctgctgtgcagagcttcagctgcctgccctacggccgcctggcctaccacctggccgtggtgctgggcagcgctgccaaccccctggcctgcttcctggccatgggcgtgctgtgccgcagcctggccggcctgggcggcctgagcctgctgggcgtcttctgtggcggctacctgatggccctggccgtgctgagcccctgcccccccctggtgggcaccagcgctggggtggtgctggtggtgctgtcctgggtgctgtgcctgggcgtcttctcctatgtgaaggtggccgccagcagcctgctgcacggcggcggccgcccagccctgctggccgccggcgtggccatccaggtgggcagcctgctgggcgctgtggccatgtttcctcccaccagcatctaccacgtgttccacagcaggaaggactgtgccgacccctgtgacagctag

SEQ ID NO: 42287 - DNA, 1338 bp, Artificial Sequence; identical to SEQ ID NO: 42286
  Description of Artificial Sequence: Synthetic coding sequence

SEQ ID NO: 42288 - DNA, 1338 bp, Artificial Sequence; identical to SEQ ID NO: 42286
  Description of Artificial Sequence: Synthetic coding sequence

SEQ ID NO: 42289 - DNA, 1923 bp, Artificial Sequence
  Description of Artificial Sequence: Synthetic coding sequence
atgaagatcagcaccacccagatcgagaggagatttgagatcagcagcagcctggtgggcctgattgatggcagctttgagatcggcaacctcttcgtcatcgtgtttgtgtcctacttcggcagcaagctgcaccggcccaagctgattggcatcggctgcttcctgatgggcaccggcagcatcctgatggccctgccccacttcttcatgggctactaccgctacagcaaggagaccaacatcgaccccagcgagaacagcaccagcaacctgcccaactgcctgatcaaccagatgctgagcctgaacagaacacccagcgagatcatcgagcggggctgtgtgaaggagagcggcagccacatgtggatctacgtgttcatgggcaacatgctgcggggcatcggggagacccccatcgtgcccctgggcatctcctacattgatgactttgccaaggagggccacagcagcctgtacctgggcaccgtgaatgtgatgggcatgacaggcctggtgtttgccttcatgctgggcagcctgtttgccaagatgtatgtggacatcggctacgtggacctgagcaccatccgcatcacccccaaggacagccgctgggtgggcgcctggtggctgggcttcctggtgtctggcatcgtgtccatcatcagcagcatccccttcttcttcctgcccctgaaccccaacaagccccagaaggagaggaaggtgtccctcttcctgcacgtgctgaagaccaatgacaagaggaaccagatcgccaacctgaccaacagaaggaagtacatcaccaagaatgtgacaggcttcttccagagcctgaagagcatcctgaccaaccccctgtatgtgatcttcgtcatcttcaccctgctgcacatgagcagctacatcgccagcctgacctacatcatcaagatggtggagcagcagtatggctggagcgccagcaagaccaacttcctgctgggcgtgctggccctgcctgctgtggccatcggcatgttttctgggggctacatcatcaagaagttcaagctgagcctggtgggcctggccaagctggccttctgcagcgccaccgtgcacctgctgagccaggtgctgtacttcttcctgatctgtgagagcaagtctgtggccggcctgaccctgacctatgatggcaacagccctgtgcgcagccacgtggatgtgcccctgagctactgcaacagcgagtgcaactgtgatgagagccagtgggagcctgtgtgtggcaacaacggcatcacctacctgagcccctgcctggccggctgcaagagcagcagcggcaacaaggagcccatcgtgttctacaactgcagctgtgtggaggtgattggcctgcagaacaagaactacagcgcccacctgggggagtgccccagagatgatgcctgcaccaggaagagctatgtgtactttgtgatccaggtgctggatgccttcctgtgtgctgtgggcctgaccagctacagcgtgctggtgatcagaattgtgcagcctgagctgaaggccctggccatcggcttccacagcatgatcatgaggagcctgggcggcatcctggtgcccatctactttggagccctgattgacaccacctgcatgaagtggagcaccaacagctgtggggcccggggggcctgccgcatctacaacagcacctacctgggccgggccttcttcggcctgaaggtggccctgatcttccctgtgctggtgctgctgaccgtcttcatctttgtggtgaggaagaagagccacggcaaggacaccaaggtgctggagaatgaaaggcaggtgatggatgaggccaacctggagttcctgaatgacagcgagcactttgtgcccagcgctgaggagcagtag

SEQ ID NO: 42290 - DNA, 2064 bp, Artificial Sequence
  Description of Artificial Sequence: Synthetic coding sequence
atggaccagcaccagcacctgaacaagacagctgagagcgccagcagcgagaagaagaagacccggcgctgcaatggcttcaagatgttcctggccgccctgtccttctcctacatcgccaaggccctgggcggcatcatcatgaagatcagcatcacccagattgaaagaagatttgacatcagcagcagcctggccggcctgattgatggcagctttgaaattggcaacctgctggtgattgtgtttgtgtcctacttcggcagcaagctgcaccggcccaagctgattggaattggctgcctgctgatgggcaccggcagcatcctgaccagcctgccccacttcttcatgggctactaccgctacagcaaggagaccaacatcgaccccagcgagaacagcaccagcaacctgcccaactgcctgatcaaccagatgctgagcctgaacagaacaccttctgagatcatcgagcggggctgtgtgaaggagagcggcagccacatgtggatctacgtgttcatgggcaacatgctgcggggcattggagagacccccatcgtgcccctgggcatctcctacattgatgactttgccaaggagggccacagcagcctgtacctgggcaccgtgaatgtgatgggcatgacaggcctggtgtttgccttcatgctgggcagcctgtttgccaagatgtatgtggacatcggctacgtggacctgagcaccatccgcatcacccccaaggacagccgctgggtgggcgcctggtggctgggcttcctggtgtctggaattgtgtccatcatcagcagcatccccttcttcttcctgcccctgaaccccaacaagccccagaaggagaggaaggtgtccctcttcctgcacgtgctgaagaccaatgacaagaggaaccagatcgccaacctgaccaacagaaggaagtacatcaccaagaatgtgacaggcttcttccagagcctgaagagcatcctgaccaaccccctgtatgtgatctttgtgatcttcaccctgctgcacatgagcagctacatcgccagcctgacctacatcatcaagatggtggagcagcagtatggctggagcgccagcaagaccaacttcctgctgggcgtgctggccctgcctgctgtggccatcggcatgttcagcggcggctacatcatcaagaagttcaagctgagcctggtgggcctggccaagctggccttctgcagcgccaccgtgcacctgctgagccaggtgctgtacttcttcctgatctgtgagagcaagtctgtggccggcctgaccctgacctatgatggcaacagccctgtgcgcagccacgtggatgtgcccctgagctactgcaacagcgagtgcaactgtgatgagagccagtgggagcctgtgtgtggcaacaacggcatcacctacctgagcccctgcctggccggctgcaagagcagcagcggcaacaaggagcccatcgtgttctacaactgcagctgtgtggaggtgattggcctgcagaacaagaactacagcgcccacctgggagaatgtcccagagatgatgcctgcaccaggaagagctatgtgtacttcgtcatccaggtgctggatgccttcctgtgtgctgtgggcctgaccagctacagcgtgctggtgatccgcatcgtgcagcctgagctgaaggccctggccatcggcttccacagcatgatcatgaggagcctgggcggcatcctggtgcccatctactttggagccctgattgacaccacctgcatgaagtggagcaccaacagctgtggggcccggggggcctgccgcatctacaacagcacctacctgggccgggccttcttcggcctgaaggtggccctgatcttccctgtgctggtgctgctgactgtgttcatctttgtggtgaggaagaagagccacggcaaggacaccaaggtgctggagaatgaaaggcaggtgatggatgaggccaacctggagttcctgaatgattctgagcactttgtgcccagcgctgaggagcagtag

SEQ ID NO: 42291 - DNA, 813 bp, Artificial Sequence
  Description of Artificial Sequence: Synthetic coding sequence
atgggcttctggtgcaggatgtctgagaaccaggagcaggaggaggtgatcaccgtgcgggtgcaggacccccgggtgcagaatgaaggctcctggaacagctatgtggactacaagatcttcctgcacaccaacagcaaggccttcaccgccaagaccagctgtgtgagaagacgctaccgggagtttgtgtggctgaggaagcagctgcagagaaatgccggcctggtgcctgtgcctgagctgcccgggaagagcaccttcttcggcaccagtgatgagttcatcgagaagaggcggcagggcctgcagcacttcctggagaaggtgctgcagagcgtggtgctgctgagtgacagccagctgcacctgttcctgcagagccagctgtctgtgcctgagattgaggcctgtgtgcagggccgcagcaccatgacagtgtctgatgccatcctgcgctatgccatgagcaactgtggctgggcccaggaggagcggcagagcagcagccacctggccaagggggaccagcccaagagctgctgcttcctgcccaggtctggaagaagaagcagccccagccccccacccagcgaggagaaggaccacctggaggtgtgggcccctgtggtggacagcgaggtgcccagcctggagagccccaccctgccccccctgagcagccccctgtgctgtgactttggccggcccaaggagggcaccagcaccctgcagagcgtgcggcgggctgtgggcggggaccatgctgtgcccctggaccccggccagctggagaccgtgctggagaagtag

SEQ ID NO: 42292 - DNA, 813 bp, Artificial Sequence; identical to SEQ ID NO: 42291
  Description of Artificial Sequence: Synthetic coding sequence

SEQ ID NO: 42293 - DNA, 630 bp, Artificial Sequence
  Description of Artificial Sequence: Synthetic coding sequence
atgagggcccctggcaccctgatgtggatcatccgctacagctccatgcctgtgcctgagctgcccgggaagagcaccttcttcggcaccagtgatgagttcatcgagaagaggcggcagggcctgcagcacttcctggagaaggtgctgcagagcgtggtgctgctgagtgacagccagctgcacctgttcctgcagagccagctgtctgtgcctgagattgaggcctgtgtgcagggccgcagcaccatgacagtgtctgatgccatcctgcgctatgccatgagcaactgtggctgggcccaggaggagcggcagagcagcagccacctggccaagggggaccagcccaagagctgctgcttcctgcccaggagcggccgccgcagcagccccagccccccaccttctgaggagaaggaccacctggaggtgtgggcccctgtggtggacagcgaggtgcccagcctggagagccccaccctgccccccctgagcagccccctgtgctgtgactttggccggcccaaggagggcaccagcaccctgcagagcgtgagaagagctgtgggcggggaccatgctgtgcccctggaccccggccagctggagaccgtgctggagaagtag

SEQ ID NO: 42294 - DNA, 381 bp, Artificial Sequence
  Description of Artificial Sequence: Synthetic coding sequence
atgacagtgtctgatgccatcctgcgctatgccatgagcaactgtggctgggcccaggaggagcggcagagcagcagccacctggccaagggggaccagcccaagagctgctgcttcctgcccaggtctggaagaagaagcagccccagccccccacccagcgaggagaaggaccacctggaggtgtgggcccctgtggtggacagcgaggtgcccagcctggagagccccaccctgccccccctgagcagccccctgtgctgtgactttggccggcccaaggagggcaccagcaccctgcagagcgtgcggcgggctgtgggcggggaccatgctgtgcccctggaccccggccagctggagaccgtgctggagaagtag

SEQ ID NO: 42295 - DNA, 477 bp, Artificial Sequence
  Description of Artificial Sequence: Synthetic coding sequence
atgtctgacacagctgtggccgacacccggcggctgaacagcaagccccaggacctgacagatgcctacggcccccccagcaacttcctggagattgacatcttcaacccccagacagtgggcgtgggccgggcccgcttcaccacctatgagaccaacctgcccatcttcaagctgaaggagagctgtgtgagaagacgctacagcgactttgagtggctgaagaatgagctggagcgggacagcaagatcgtggtgccccccctgcccgggaaggccctgaagaggcagctgcccttcagaggagatgagggcatctttgaggagagcttcatcgaggagcggcggcagggcctggagcagttcatcaacaagattgctggccaccccctggcccagaatgaacgctgcctgcacatgttcctgcaggaggaggccatcgacagaaattatgtgcctgggaaggtgcggcagtag

SEQ ID NO: 42296 - DNA, 489 bp, Artificial Sequence
  Description of Artificial Sequence: Synthetic coding sequence
atgtctgacacagctgtggccgacacccggcggctgaacagcaagccccaggacctgacagatgcctacggcccccccagcaacttcctggagattgacatcttcaacccccagacagtgggcgtgggccgggcccgcttcaccacctatgaggtgaggatgaggaccaacctgcccatcttcaagctgaaggagagctgtgtgagaagacgctacagcgactttgagtggctgaagaatgagctggagcgggacagcaagatcgtggtgccccccctgcccgggaaggccctgaagaggcagctgcccttcagaggagatgagggcatctttgaggagagcttcatcgaggagcggcggcagggcctggagcagttcatcaacaagattgctggccaccccctggcccagaatgaacgctgcctgcacatgttcctgcaggaggaggccatcgacagaaattatgtgcctgggaaggtgcggcagtag

SEQ ID NO: 42297 - DNA, 3327 bp, Artificial Sequence
  Description of Artificial Sequence: Synthetic coding sequence
atgagctctgtgaagaggccccggggccggccccccagcagcaagaagagtgatggcagcggcacctacaccaagctgcagaacacccaggtgcgggtgatgtctgagaagaagcagaggaagaaggtggagagcgagagcaagcaggagaaggccaaccgcatcatcagcgaggccatcgccaaggccaaggagcggggggagaggaacatcccccgggtgatgagccctgagaacttccccacagcctctgtggagggcaaggaggagaagaagggccgcaggatgaagagcaagcccaaggacaaggacagcaagaagaccaagacctgcagcaagctgaaggagaagaccaagattggcaagctgatcatcaccctgggcaagaagcagaagaggaagaatgaaagcagtgatgagatcagtgatgctgagcagatgccccagcacaccctgaaggaccaggacagccagaagaggaggagcaaccggcagatcaagaggaagaagtatgcagaagatattgagggcaagcagagcgaggaggaggtgaagggctccatgaagatcaagaagaacagcgcccccctgcccggggagcagcccctgcagctgtttgtggagaaccccagtgaagaagatgctgccatcgtggacaagatcctgagcagcaggacagtgaagaaggagatcagccctggggtgatgattgacacagaggagttctttgtgaagtacaagaactacagctacctgcactgtgagtgggccacagaggagcagctgctgaaggacaagaggatccagcagaagatcaagcgcttcaagctgcggcaggcccagagggcccacttctttgctgacatggaggaggagcccttcaacccagactatgtggaggtggacagagtgctggaggtgtccttctgtgaggacaaggacacaggagagcccgtcatctactacctggtgaagtggtgcagcctgccctatgaggacagcacctgggagctgaaggaggatgtggacctggccaagattgaggagtttgagcagctgcaggccagcaggccagacacccggcggctggaccggccccccagcaacatctggaagaagattgaccagagccgggactacaagaatggaaaccagctgcgggagtaccagctggagggcctgaactggctgctcttcaactggtacaacagaagaaactgcatcctggctgatgagatgggcctgggcaagaccatccagagcatcaccttcctgtatgagatcctgctgaccggcatccggggccccttcctgatcatcgcccccctgagcaccatcgccaactgggagcgggagttccgcacctggacagacatcaacgtggtggtgtaccacggcagcctcatcagccggcagatgatccagcagtatgagatgtacttccgggacagccagggccgcatcatccggggggcctaccgcttccaggccatcatcaccacctttgagatgatcctgggcggctgtggggagctgaatgccatcgagtggaggtgtgtgatcattgatgaggcccaccggctgaagaacaagaactgcaagctgctggagggcctgaagctgatgaacctggagcacaaggtgctgctgaccggcacccccctgcagaacacagtggaggagctgttcagcctgctgcacttcctggagcccctgcgcttccccagcgagagcaccttcatgcaggagtttggagacctgaagacagaggagcaggtgcagaagctgcaggccatcctgaagcccatgatgctgcggcggctgaaggaggatgtggagaagaagctggcccccaaggaggagaccatcatcgaggtggagctgaccaacatccagaagaagtactaccgggccatcctggagaagaacttctccttcctgagcaaaggagctggccagaccaacgtgcccaacctggtgaacaccatgatggagctgaggaagtgctgcaaccacccctacctgatcaagggagctgaggagaagatcctgggggagttccgggacacctacaacccagctgccagtgacttccacctgcaggccatgatccagagcgctgggaagctggtgctgattgacaagctgctgcccaagatgaaggccggcggccacaaggtgctgatcttcagccagatggtgcgctgcctggacatcctggaggactacctgatccacaagcgctacctgtatgaaagaattgatggccgggtgcggggcaacctgcggcaggccgccatcgaccgcttcagcaagccagacagcgacagatttgtgttcctgctgtgcacccgggccggcggcctgggcatcaacctgacagctgctgacacctgcatcatctttgacagcgactggaacccccagaatgacctgcaggcccaggcccgctgccacagaattggccagaacaaggctgtgaaggtgtaccgcctggtgaccagaaattcctatgaaagagagatgtttgaccgggccagcctgaagctgggcctggacaaggctgtgctgcagagcatgagcggccgggagagcaatgtgggcggcatccagcagctgagcaagaaggagattgaggacctgctgcggcggggggcctatggagccatcatggaggaggaggatgagggcagcaagttctgtgaagaagatattgaccagatcctgctgcggaggaccaagaccatcaccatcgagagcgagggccggggcagcacctttgccaaggccagctttgtggccagcggcaacagaacagacatcagcctggatgaccccaacttctggcagaagtgggccaagaaggccgagattgacatcgaggccatcagcggcaggaacagcctggtgattgacaccccccgcatcaggaagcagacccggcccttcagcgccaccaaggatgagctggccgagctgtctgaggccgagagtgaaggagatgagaagcccaagctgcggcggccctgtgacaggagcaatggctacggccgcacagagtgcttccgggtggagaagaacctgctggtgtatggctggggccgctggagggagatcctgagccacggccgcttcaagaggcagctgaatgaacatgatgtggagatcatctgccgggccctgctggcctactgcctggtgcactacagaggagatgagaagatcaagggcttcatctgggacctgatcacccccacagaagatggccagacccgggagctgcagaaccacctgggcctgagcgcccctgtgccccggggccgctag

SEQ ID NO: 42298 - DNA, 1128 bp, Artificial Sequence
  Description of Artificial Sequence: Synthetic coding sequence
atgagcggcagccagaacaatgacaagaggcagttcctgctggagcggctgctggatgctgtgaagcagtgccagatccgctttggaggcaggaaggagatcgccagtgacagcgacagccgggtgacctgcctgtgtgcccagtttgaagctgtgctgcagcacggcctgaagaggagccggggcctggccctgacagctgctgccatcaagcaggccgccggctttgccagcaagacagaaacagagcccgtcttctggtactacgtgaaggaggtgctgaacaagcatgagctgcagcgcttctacagcctgcggcacatcgccagtgatgtgggccggggccgggcctggctgcgctgtgccctgaatgagcacagcctggagcgctacctgcacatgctgctggccgaccgctgccgcctgagcaccttctatgaggactggagctttgtgatggatgaggagaggagctccatgctgcccaccatggccgccggcctgaacagcatcctgtttgccatcaacatcgacaacaaggacctgaatggccagagcaagtttgcccccaccgtgtctgacctgctgaaggagagcacccagaatgtgaccagcctgctgaaggagagcacccagggcgtgagcagcctcttccgggagatcacagccagcagcgctgtgtccatcctgatcaagccagagcaggagacagaccccctgcctgtggtgtccagaaatgtgtctgcagatgccaagtgcaagaaggagaggaagaagaagaagaaggtgaccaacatcatcagctttgatgatgaagaagatgagcagaacagcggagatgtgttcaagaagacccctggggccggggagagcagcgaggacaacagcgacaggagctctgtgaacatcatgtctgcctttgagagccccttcggccccaacagcaatggcagccagagcagcaacagctggaagattgacagcctgagcctgaatggagaatttggctaccagaagctggatgtgaagagcattgatgatgaagatgtggatgaaaatgaagatgatgtgtatggcaacagcagcggcaggaagcaccggggccacagcgagagccctgagaagtag

SEQ ID NO: 42299 - DNA, 1287 bp, Artificial Sequence
  Description of Artificial Sequence: Synthetic coding sequence
atgcacagctgggcccccctgaaggtgctgcacaatgacagcgacatcctcttccctgtgtctggagtgggcagctacagccctgcagatgcccccctgggcagcctggagaatggcaccggcccagaagatcatgtgctgcctgaccccggcctgcgctacagcgtggaggccagcagccctggccacggcagccccctgagcagcctgctgcccagcgcctctgtgcctgagagcatgaccatcagcgagctgcggcaggccaccgtggccatgatgaacaggaaggatgagctggaggaggagaacagaagcctgaggaacctgctggatggagagatggagcacagcgctgccctgcggcaggaggtggacaccctgaagaggaaggtggccgagcaggaggagcggcagggcatgaaggtgcaggccctggcccgggagaatgaggtgctgaaggtgcagctgaagaagtatgtgggcgctgtgcagatgctgaagcgggagggccagacagctgaggtgcccaacctgtggagcgtggatggagaggtgacagtggccgagcagaagccaggagaaattgctgaggagctggccagcagctatgaaaggaagctgattgaggtggccgagatgcacggggagctgattgagttcaatgaaaggctgcaccgggccctggtggccaaggaggccctggtgtcccagatgaggcaggagctgattgacctgcggggccctgtgcctggggacctgagccagaccagcgaggaccagagcctgagtgactttgagatcagcaacagagccctgatcaacgtgtggatccccagcgtcttcctgcggggcaaggccgccaatgccttccacgtgtaccaggtgtacatccgcatcaaggatgatgagtggaacatctaccgccgctacacagagttccgcagcctgcaccacaagctgcagaacaagtacccccaggtgcgggcctacaacttcccccccaagaaggccatcggcaacaaggatgccaagtttgtggaggagaggaggaagcagctgcagaactacctgcggtctgtgatgaacaaggtgatccagatggtgcctgagtttgctgccagccccaagaaggagaccctcatccagctgatgcccttctttgtggacatcaccccacctggagagcctgtgaacagccggcccaaggccgccagccgcttccccaagctgagccggggccagccccgggagaccagaaatgtggagccccagagcggggacctgtag

SEQ ID NO: 42300 - DNA, 1227 bp, Artificial Sequence
  Description of Artificial Sequence: Synthetic coding sequence
atgcacagctgggcccccctgaaggtgctgcacaatgacagcgacatcctcttccctgtgtctggagtgggcagctacagccctgcagatgcccccctgggcagcctggagaatggcaccggcccagaagatcatgtgctgcctgaccccggcctgcgctacagcgtggaggccagcagccctggccacggcagccccctgagcagcctgctgcccagcgcctctgtgcctgagagcatgaccatcagcgagctgcggcaggccaccgtggccatgatgaacaggaaggatgagctggaggaggagaacagaagcctgaggaacctgctggatggagagatggagcacagcgctgccctgcggcaggaggtggacaccctgaagaggaaggtggccgagcaggaggagcggcagggcatgaaggtgcaggccctggcccgggagaatgaggtgctgaaggtgcagctgaagaagtatgtgggcgctgtgcagatgctgaagcgggagggccagacagctgaggtgcccaacctgtggagcgtggatggagaggtgacagtggccgagcagaagccaggagaaattgctgaggagctggccagcagctatgaaaggaagctgattgaggtggccgagatgcacggggagctgattgagttcaatgaaaggctgcaccgggccctggtggccaaggaggccctggtgtcccagatgaggcaggagctgattgacctgcggggccctgtgcctggggacctgagccagaccagcgaggaccagagcctgagtgactttgagatcagcaacagagccctgatcaacgtgtggatccccagcgtcttcctgcggggcaaggccgccaatgccttccacgtgtaccaggtgtacatccgcatcaaggatgatgagtggaacatctaccgccgctacacagagttccgcagcctgcaccacaagctgcagaacaagtacccccaggtgcgggcctacaacttcccccccaagaaggccatcggcaacaaggatgccaagtttgtggaggagaggaggaagcagctgcagaactacctgcggtctgtgatgaacaaggtgatccagatggtgcctgagtttgctgccagccccaagaaggagaccctcatccagctgatgcccttctttgtggactggatcagcctgtttggaaatggccgggacagcagccgggaggagttcagcagcagctag

SEQ ID NO: 42301 - DNA, 750 bp, Artificial Sequence
  Description of Artificial Sequence: Synthetic coding sequence
atggatgaggagaggagctccatgctgcccaccatggccgccggccccaacagcatcctgtttgccatcaacatcgacaacaaggacctgaatggccagagcaagtttgcccccaccgtgtctgacctgctgaaggagagcacccagaatgtgaccctgctgaaggagagcacccagggcgtgtcctctgtgttccgggagatcacagccagcagcgccatcagcatcctgatcaagccagagcaggagacagaccccctgcctgtggtgtccagaaatgtgtctgcagatgccaagtgcaagaaggagaggaagaagaagaagcaggtgaccaacatcatcagctttgatgatgaggaggatgagcagaacagcggggacatgttcaagaagaccccaggagctggggagagcagcgaggacaacagcgaccacagctctgtgaacatcatgtctgcctttgagagccccttcggccccaacagcaatggcagccagagcagcaacagctggaagattgacagcctgagcctgaaccgggagtttggctaccagaagctggatgtgaagagcattgatgatgaagatgtggatgaaaatgaagatgatgtgtatggcaacagcagcggcaggaagcaccggggccacagcgagagccctgagaagaatggagcccacagcgtgacccaggccggcgtgcagtggcatgacctgagcagcctgcagcccctgcccccaggcttcaagtag

SEQ ID NO: 42302 - DNA, 750 bp, Artificial Sequence; identical to SEQ ID NO: 42301
  Description of Artificial Sequence: Synthetic coding sequence

SEQ ID NO: 42303 - DNA, 807 bp, Artificial Sequence
  Description of Artificial Sequence: Synthetic coding sequence
atgctgctggccgaccgctgccgcctgagcaccttctatgaggactggagctttgtgatggatgaggagaggagctccatgctgcccaccatggctgctggccccaacagcatcctgtttgccatcaacatcgacaacaaggacctgaatggccagagcaagtttgcccccaccgtgtctgacctgctgaaggagagcacccagaatgtgaccctgctgaaggagagcacccagggcgtgagcagcgtcttccgggagatcacagccagcagcgccatcagcatcctgatcaagccagagcaggagacagaccccctgcctgtggtgtccagaaatgtgtctgcagatgccaagtgcaagaaggagaggaagaagaagaagcaggtgaccaacatcatcagctttgatgatgaagaagatgagcagaacagcggggacatgttcaagaagacccctggggccggggagagcagcgaggacaacagcgaccacagctctgtgaacatcatgtctgcctttgagagccccttcggccccaacagcaatggcagccagagcagcaacagctggaagattgacagcctgagcctgaaccgggagtttggctaccagaagctggatgtgaagagcattgatgatgaagatgtggatgaaaatgaagatgatgtgtatggcaacagcagcggcaggaagcaccggggccacagcgagagccctgagaagaatggagcccacagcgtgacccaggccggcgtgcagtggcatgacctgagcagcctgcagcccctgcccccaggcttcaagtag

SEQ ID NO: 42304 - DNA, 351 bp, Artificial Sequence
  Description of Artificial Sequence: Synthetic coding sequence
atgctgctggccgaccgctgccgcctgagcaccttctatgaggactggagctttgtgatggatgaggagaggagctccatgctgcccaccatggctgctggccccaacagcatcctgtttgccatcaacatcgacaacaaggacctgaatggccagagcaagtttgcccccaccgtgtctgacctgctgaaggagagcacccagaatgtgaccctgctgaaggagagcacccagggcgtgagcagcgtcttccgggagatcacagccagcagcgccatcagcatcctgatcaagccagagcaggagacagaccccctgcctgtggtgtccagaaatgtgtctgctggatag

SEQ ID NO: 42305 - DNA, 1323 bp, Artificial Sequence
  Description of Artificial Sequence: Synthetic coding sequence
atgaagatgcacttctgcatccctgtgtcccagcagaggagtgatgccctgggcggccgctacgtgctgtacagcgtgcacctggatggcttcctgttctgccgggtgcgctacagccagctgcacggctggaatgagcagctgcggcgggtgtttggaaactgcctgccccccttcccccccaagtactacctggccatgaccacagccatggctgatgaaagaagagaccagctggagcagtacctgcagaatgtgaccatggaccccaacgtgctgcggagtgatgtgtttgtggagttcctgaagctggcccagctgaacacctttgacatcgccaccaagaaggcctacctggacatcttcctgcccaatgagcagagcatcagaattgagatcatcaccagtgacacagctgagcgggtgctggaggtggtgagccacaagattggcctgtgccgggagctgctgggctacttcggcctcttcctgatccgctttgggaaggagggcaagctgtctgtggtgaagaagctggccgactttgagctgccctacgtgtccctgggcagcagcgaggtggagaactgcaaggtgggcctgaggaagtggtacatggcccccagcctggacagcgtgctgatggactgccgggtggccgtggacctgctgtacatgcaggccatccaggacatcgagaagggctgggccaagcccacccaggcccagaggcagaagctggaggccttccagaaggaggacagccagaccaagttcctggagctggcccgggaggtgcgccactacggctacctgcagctggacccctgcacctgtgactacccagagagcggcagcggggctgtgctgtctgtgggcaacaatgagatcagctgctgcatcaccctgcctgacagccagacccaggacatcgtgttccagatgagccgggtgaagtgctggcaggtgaccttcctgggcaccctgctggacacagatggcccccagaggaccctgaaccagaacctggagctgcgcttccagtacagcgaggacagctgctggcagtggtttgtgatctacaccaagcaggccttcctgctgagcagctgcctgaagaagatgatcagcgagaagatggtgaagctggccgctgagaacacagagatgcagatcgaggtgcctgagcagagcaagagcaagaagtaccacatccagcagagccagcagaaggactacagcagcttcctgagcaggaagagcaagatcaagatcgccaaggatgactgtgtgtttggaaacatcaaggaggaggacctgtag

SEQ ID NO: 42306 - DNA, 1026 bp, Artificial Sequence
  Description of Artificial Sequence: Synthetic coding sequence
atgctgggcaacacagagaactggaacacctttgatattgccaccaagaaggcctacctggacatcttcctgcccaatgagcagagcatccgcatcgagatcatcaccagtgacacagctgagcgggtgctggaggtggtgagccacaagattggcctgtgccgggagctgctgggctacttcggcctcttcctgatccgctttgggaaggagggcaagctgtctgtggtgaagaagctggccgactttgagctgccctacgtgtccctgggcagcagcgaggtggagaactgcaaggtgggcctgaggaagtggtacatggcccccagcctggacagcgtgctgatggactgccgggtggccgtggacctgctgtacatgcaggccatccaggacatcgagaagggctgggccaagcccacccaggcccagaggcagaagctggaggccttccagaaggaggacagccagaccaagttcctggagctggcccgggaggtgcgccactacggctacctgcagctggacccctgcacctgtgactacccagagagcggcagcggggctgtgctgtctgtgggcaacaatgagatcagctgctgcatcaccctgcctgacagccagacccaggacatcgtgttccagatgagccgggtgaagtgctggcaggtgaccttcctgggcaccctgctggacacagatggcccccagaggaccctgaaccagaacctggagctgcgcttccagtacagcgaggacagctgctggcagtggtttgtgatctacaccaagcaggccttcctgctgagcagctgcctgaagaagatgatcagcgagaagatggtgaagctggccgcagaaaatacagagatgcagatcgaggtgcctgagcagagcaagagcaagaagtaccacatccagcagagccagcagaaggactacagcagcttcctgagcaggaagagcaagatcaagatcgccaaggatgactgtgtgtttggaaacatcaaggaggaggacctgtag

SEQ ID NO: 42307 - DNA, 1212 bp, Artificial Sequence
  Description of Artificial Sequence: Synthetic coding sequence
atggagacctatgcagaggtgggcaaggagggcaagcccagctgtgcctctgtggacctgcagggcgacagcagcctgcaggtggagatcagtgatgctgtgtctgagcgggacaaggtgaagttcaccgtgcagaccaagagctgcctgccccactttgcccagacagagttctctgtggtgcggcagcacgaggagttcatctggctgcatgatgcctacgtggagaatgaggagtatgccggcctcatcatccccccagccccacccaggccagactttgaggccagccgggagaagctgcagaagctgggggagggggacagctctgtgacccgggaggagtttgccaagatgaagcaggagctggaggccgagtacctggccatcttcaagaagacagtggccatgcatgaggtgttcctgcagaggctggccgcccaccccaccctgcggcgggaccacaacttctttgtgttcctggagtatggccaggacctgtctgtgcggggcaagaacaggaaggagctgctgggcggcttcctgagaaatattgtgaagtctgcagatgaggccctgatcaccggcatgagcggcctgaaggaggtggatgacttctttgaacatgagaggaccttcctgctggagtaccacacccgcatcagagatgcctgcctgcgggctgacagagtgatgagggcccacaagtgcctggctgatgactacatccccatctctgctgccctgagcagcctgggcacccaggaggtgaaccagctgcggaccagcttcctgaagctggccgagctgtttgagcggctgaggaagctggagggccgggtggccagtgatgaggacctgaagctgagtgacatgctgcgctactacatgagggacagccaggccgccaaggacctgctgtacagaaggctgcgggccctggccgactatgaaaatgccaacaaggccctggacaaggcccggaccaggaaccgggaggtgcggcctgctgagagccaccagcagctgtgctgccagagatttgagcggctgagtgacagcgccaagcaggagctgatggacttcaagagcagaagagtgtcctccttcaggaagaacctgattgagctggccgagctggagctgaagcacgccaaggccagcaccctcatcctgaggaacaccctggtggccctgaagggggagccctag

SEQ ID NO: 42308 - DNA, 384 bp, Artificial Sequence
  Description of Artificial Sequence: Synthetic coding sequence
atggagacctatgcagaggtgggcaaggagggcaagcccagctgtgcctctgtggacctgcagggcgacagcagcctgcaggtggagatcagtgatgctgtgtctgagcgggacaaggtgaagttcaccgtgcagaccaagagctgcctgccccactttgcccagacagagttctctgtggtgcggcagcacgaggagttcatctggctgcatgatgcctacgtggagggcaaggccacagagatcggccggggcggccagctgtgccacagcggccgggtgtgccaggatgaagctggagctggctctgtgtctgcccccagcttcccctgccacccccagagcccagatgtgttccccagctacctgcccatgaatgtgtag

SEQ ID NO: 42309 - DNA, 1725 bp, Artificial Sequence
  Description of Artificial Sequence: Synthetic coding sequence
atggccctgaagggccgggccctgtatgacttccacagcgagaacaaggaggagatcagcatccagcaggatgaggacctggtgatcttcagcgagaccagcctggatggctggctgcagggccagaacagcagaggagagaccggcctcttccctgccagctatgtggagatcgtgcgcagcggcatcagcaccaaccacgccgactacagcagcagccctgctggcagccctggggcccaggtgtccctgtacaacagccccagcgtggccagccctgcccggagcggcggcggcagcggcttcctgagcaaccagggcagctttgaagaagatgatgatgatgactgggatgactgggatgatggctgcaccgtggtggaggagccccgggccggcggcctgggcaccaacggccacccccccctgaacctgagctacccaggggcctaccccagccagcacatggccttccggcccaagccacccctggagcggcaggacagcctggccagcgccaagaggggctctgtggtgggcaggaacctgaaccgcttcagctgctttgtgcgcagcggcgtggaggccttcatcctgggagatgtgcccatgatggccaagattgctgagacctacagcattgagatgggcccccggggcccccagtggaaggccaacccccacccctttgcctgcagcgtggaggaccccaccaagcagaccaagttcaagggcatcaagagctacatctcctacaagctgacccccacccatgctgccagccctgtgtaccgccgctacaagcactttgactggctgtacaaccggctgctgcacaagttcaccgtcatctctgtgccccacctgcctgagaagcaggccaccggccgctttgaggaggacttcatcgagaagaggaagaggaggctcatcctgtggatggaccacatgaccagccaccctgtgctgagccagtatgagggcttccagcacttcctgagctgcctggatgacaagcagtggaagatgggcaagagaagagctgagaaggatgagatggtgggcgccagcttcctgctgaccttccagatccccacagagcaccaggacctgcaggatgtggaggacagagtggacaccttcaaggccttcagcaagaagatggatgattctgtgctgcagctgagcacagtggccagcgagctggtgaggaagcacgtgggcggcttcaggaaggagttccagaagctgggcagcgccttccaggccatcagccacagcttccagatggacccccccttctgcagcgaggccctgaacagcgccatcagccacacaggccgcacctatgaggccatcggggagatgtttgctgagcagcccaagaatgacctcttccagatgctggacaccctgagcctgtaccagggcctgctgagcaacttcccagacatcatccacctgcagaagggggcctttgccaaggtgaaggagagccagaggatgtctgatgagggccgcatggtgcaggatgaagcagatggcatcagaagacgctgccgggtggtgggctttgccctgcaggccgagatgaaccacttccaccagaggcgggagctggacttcaagcacatgatgcagaactacctgcggcagcagatcctcttctaccagagggtgggccagcagctggagaagaccctgaggatgtatgacaacctgtag

SEQ ID NO: 42310 - DNA, 312 bp, Artificial Sequence
  Description of Artificial Sequence: Synthetic coding sequence
atgggccagcagagctctgtgcggcggctgaagaggtctgtgccctgtgagagcaatgaggccaatgaggccaatgaggccaacaagaccatgcctgagacccccaccggggacagcgacccccagcctgcccccaagaagatgaagaccagcgagagcagcaccatcctggtggtgcgctacagaagaaatgtgaagaggaccagccctgaggagctgctgaatgaccacgcccgggagaaccgcatcaacccagaccagatggaggaggaggagttcatcgagatcaccacagagcggcccaagaagtag

SEQ ID NO: 42311 - DNA, 294 bp, Artificial Sequence
  Description of Artificial Sequence: Synthetic coding sequence
atggacaagcagagcagcgctggaggagtgaagaggtctgtgccctgtgacagcaatgaggccaatgagatgatgcctgagaccagcagcggctacagcgacccccagcctgcccccaagaagctgaagaccagcgagagcagcaccatcctggtggtgcgctacagaagaaacttcaagaggaccagccctgaggagctggtgaatgaccacgccaggaagaaccgcatcaaccccctgcagatggaggaggaggagttcatggagatcatggtggagatcccagccaagtag

SEQ ID NO: 42312 - DNA, 219 bp, Artificial Sequence
  Description of Artificial Sequence: Synthetic coding sequence
atggagcagcccaccagcagcatcaatggagagaagaggaagagcccctgtgagagcaacaatgaaaatgatgagatgcaggagacccccaacagagacctggcccctgagcccagcctgaagaagatgaagaccagcgagtacagcacagtgctggccttctgctacaggaaggccaagaagatccacagcaaccagctggagaatgaccagagctag

SEQ ID NO: 42313 - DNA, 543 bp, Artificial Sequence
  Description of Artificial Sequence: Synthetic coding sequence
atggagcagcccaccagcagcaccaatggagagaagaggaagagcccctgtgagagcaacaacaagaagaatgatgagatgcaggaggcccccaacagagtgctggcccccaagcagagcctgcagaagaccaagaccatcgagtacctgaccatcatcgtgtactactacaggaagcacaccaagatcaacagcaaccagctggagaaggaccagagcagagaaaattccatcaaccctgtgcaggaggaggaggatgagggcctggacagcgctgagggcagcagccaggaggatgaggacctggacagcagcgagggcagcagccaggaggatgaggacctggacagcagcgagggcagcagccaggaggatgaggacctggacagcagcgagggcagcagccaggaggatgaggacctggacagcagcgagggcagcagccaggaggatgaggacctggaccccccagagggcagcagccaggaggatgaggacctggacagcagcgagggcagcagccaggagggcggagaagattag

SEQ ID NO: 42314 - DNA, 426 bp, Artificial Sequence
  Description of Artificial Sequence: Synthetic coding sequence
atggagcagcccaccagcagcaccaatggagagaagaccaagagcccctgtgagagcaacaacaagaagaatgatgagatgcaggaggtgcccaacagagtgctggcccctgagcagagcctgaagaagaccaagaccagcgagtaccccatcatctttgtgtactacctgaggaagggcaagaagatcaacagcaaccagctggagaatgagcagagccaggagaacagcatcaaccccatccagaaggaggaggatgagggcgtggacctgtctgagggcagcagcaatgaagatgaggacctgggcccctgtgagggccccagcaaagaagacaaggacctggacagcagcgagggcagcagccaggaggatgaggacctgggcctgtctgagggcagcagccaggacagcggggaggactag

SEQ ID NO: 42315 - DNA, 300 bp, Artificial Sequence
  Description of Artificial Sequence: Synthetic coding sequence
atggaggagcccaccagcagcaccaatgaaaacaagatgaagagcccctgtgagagcaacaagaggaaggtggacaagaagaagaagaacctgcaccgggccagcgcccctgagcagagcctgaaggagacagagaaggccaagtaccccaccctggtgttctactgcaggaagaacaagaagaggaacagcaaccagctggagaacaaccagcccacagagagcagcacagaccccatcaaggagaagggggacctggacatctctgctggcagcccccaggacggcggccagaactag

SEQ ID NO: 42316 - DNA, 219 bp, Artificial Sequence
  Description of Artificial Sequence: Synthetic coding sequence
atggagaagcccaccagcagcaccaatggagagaagaggaagagcccctgtgacagcaacagcaagaatgatgagatgcaggagacccccaacagagacctggtgctggagcccagcctgaagaagatgaagaccagcgagtacagcacagtgctggtgctgtgctacaggaagaccaagaagatccacagcaaccagctggagaatgaccagagctag

SEQ ID NO: 42317 - DNA, 1011 bp, Artificial Sequence
  Description of Artificial Sequence: Synthetic coding sequence
atgcagaagcactacacagtggcctggttcctgtacagcgcccctggggtggaccccagccccccctgccgcagcctgggctggaagaggaagcgggagtggagcgatgagagcgaggaggagcctgagaaggagctggcccctgagcctgaggagacctgggtggtggagaccctgtgtggcctgaagatgaagctgaagcagcagagggtgagccccatcctgctggagcaccacaaggacttcaacagccagctggcccctggggtggaccccagccccccccacaggagcttctgctggaagaggaagatggagtggtgggacaagtctgaggagagcgaggaggagcccaggaaggtgctggcccctgagcctgaggagatctgggtggccgagatgctgtgtggcctgaagatgaagctgaagagaagaagagtgtccctggtgctgcctgagcaccacgaggccttcaaccggctgctggaggaccctgtgatcaagcgcttcctggcctgggacaaggacctgcgggtgtctgacaagtacctgctggccatggtgattgcctacttcagcagagctggcttccccagctggcagtaccagaggctgcacttcttcctggccctgtacctggccaatgacatggaggaggatgatgaggacagcaagcagaacatcttccacttcctgtatggcaagaacagaagccgcatccccctgctgaggaagaggcgcttccagctgtaccgctccatgaacccccgggccaggaagaacagaagccacatccccctggtgaggaagaggcgcttccagctgcggcgctgcatgaacccccgggccaggaagaacagaagccagatcgtgctcttccagaagaggcgcttccacttcttctgcagcatgagctgccgggcctgggtgtccccagaggagctggaggagatccaggcctatgaccctgagcactgggtgtgggcccgggaccgggcccggctgtcctag

SEQ ID NO: 42318 - DNA, 777 bp, Artificial Sequence
  Description of Artificial Sequence: Synthetic coding sequence
atggagtggtgggatgaaagtgaggagagcctggaggaggagcccaggaaggtgctggcccctgagcctgaggagatctgggtggccgagatgctgtgtggcctgaagatgaagctgaagagaagaagagtgtccctggtgctgcctgagcaccacgaggccttcaaccggctgctggaggaccccgtcatcaagcgcttcctggcctgggacaaggacctgcgggtgtctgacaagtacctgctggccatggtgattgcctacttcagccgggccggcttccccagctggcagtaccagaggatccacttcttcctggccctgtacctggccaatgacatggaggaggatgatgaggacagcaagcagaacatcttccacttcctgtacaggaagaacagaagccgcatccccctgctgaggaagccctggttccagctgggccacagcatgaacccccgggccaggaagaacagaagccgcatccccctgctgaggaagaggcgcttccagctgtaccgcagcaccaacccccgggccaggaagaacagaagccgcatccccctgctgaggaagaggcgcttccagctgtaccgctccatgaacagccgggccaggaagaacagaagccagatcgtgctcttccagaagaggcgcttccacttcttctgcagcatgagctgccgggcctgggtgtccccagaggagctggaggagatccaggcctatgaccctgagcactgggtgtgggcccgggaccgggcccacctgtcctag

SEQ ID NO: 42319 - DNA, 777 bp, Artificial Sequence; identical to SEQ ID NO: 42318
  Description of Artificial Sequence: Synthetic coding sequence

SEQ ID NO: 42320 - DNA, 1209 bp, Artificial Sequence
  Description of Artificial Sequence: Synthetic coding sequence
atggacagaacagagacccgcttcaggaagaggggccagatcaccgggaagatcaccaccagccggcagccccacccccagaatgagcagagcccccagaggagcaccagcggctaccccctgcaggaggtggtggatgatgagatgctgggccccagcgcccctggggtggaccccagccccccctgccgcagcctgggctggaagaggaagcgggagtggagcgatgagagcgaggaggagcctgagaaggagctggcccctgagcctgaggagacctgggtggtggagatgctgtgtggcctgaagatgaagctgaagcagcagagggtgagccccatcctgcctgagcaccacaaggacttcaacagccagctggcccctggggtggaccccagccccccccacaggagcttctgctggaagaggaagatggagtggtgggatgaaagtgaggagagcctggaggaggagcccaggaaggtgctggcccctgagcctgaggagatctgggtggccgagatgctgtgtggcctgaagatgaagctgaagagaagaagagtgtccctggtgctgcctgagcaccacgaggccttcaaccggctgctggaggaccccgtcatcaagcgcttcctggcctgggacaaggacctgcgggtgtctgacaagtacctgctggccatggtgattgcctacttcagccgggccggcttccccagctggcagtaccagaggatccacttcttcctggccctgtacctggccaatgacatggaggaggatgatgaggacagcaagcagaacatcttccacttcctgtacaggaagaacagaagccgcatccccctgctgaggaagccctggttccagctgggccacagcatgaacccccgggccaggaagaacagaagccgcatccccctgctgaggaagaggcgcttccagctgtaccgcagcaccaacccccgggccaggaagaacagaagccgcatccccctgctgaggaagaggcgcttccagctgtaccgctccatgaacagccgggccaggaagaacagaagccagatcgtgctcttccagaagaggcgcttccacttcttctgcagcatgagctgccgggcctgggtgtccccagaggagctggaggagatccaggcctatgaccctgagcactgggtgtgggcccgggaccgggcccacctgtcctag

SEQ ID NO: 42321 - DNA, 1650 bp, Artificial Sequence
  Description of Artificial Sequence: Synthetic coding sequence
atgaccagccaccagccccagccccaggaggagcagagcccccagaggagcaccagcggctaccccctgcaggaggtggtggatgatgaggtgtctggccccagcgcccctggggtggaccccagccccccaagaagaagcctgggctgcaagaggaagagagaatgtctggatgaaagtgatgatgagcctgagaaggagctggcccctgagcctgaggagacctgggtggccgagaccctgtgtggcctgaagatgaaggccaagagaagaagagtgtccctggtgctgcctgagtactatgaggccttcaaccggctgctggcccctggggtggaccccagccccccccggcgcagcctgggctgcaagaggaagcgggagtgcctggatgaaagtgatgatgagcctgagaaggagctggcccctgagcctgaggagacctgggtggccgagaccctgtgtggcctgaagatgaaggccaagagaagaagagtgtccctggtgctgcctgagtactatgaggccttcaaccggctgctggcccctggggtggaccccagccccccaagaagaagcctgggctgcaagaggaagagagaatgtctggatgaaagtgatgatgagcctgagaaggagctggcccctgagcctgaggagacctgggtggccgagaccctgtgtggcctgaagatgaaggccaagagaagaagagtgtccctggtgctgcctgagtactatgaggccttcaaccggctgctggcccctggggtggaccccagccccccccggcgcagcctgggctgcaagaggaagcgggagtgcctggatgaaagtgatgatgagcctgagaaggagctggcccctgagcctgaggagacctgggtggccgagaccctgtgtggcctgaagatgaaggccaagagaagaagagtgtccctggtgctgcctgagtactatgaggccttcaaccggctgctggcccctggggtggaccccagccccccaagaagaagcctgggctgcaagaggaagagagaatgtctggatgaaagtgatgatgagcctgagaaggagctggcccctgagcctgaggagacctgggtggccgagaccctgtgtggcctgaagatgaaggccaagagaagaagagtgtccctggtgctgcctgagtactatgaggccttcaaccggctgctggaggaccctgtgatcaagcgcttcctggcctgggacaaggacctgcgggtgtctgacaagtacctgctggccatggtgattgcctacttcagcagagctggcctgcccagctggcagtaccagaggatccacttcttcctggccctgtacctggccaatgacatggaggaggatgatgaggcccccaagcagaagatcttctacttcctgtatggcaagacccacagccacatccccctgcggcccaagcactggttccagctgtgccggcccatgaacccccgggccaggaagaactgcagccagatcgccctcttccagaagaggcgcttccagttcttctgcagcatgcgctgccgggcctgggtgtccccagaggagctggaggagatccaggcctatgaccctgagcactgggtgtgggcccgggaccgggcccacctgtcctag

SEQ ID NO: 42322 - DNA, 519 bp, Artificial Sequence
  Description of Artificial Sequence: Synthetic coding sequence
atgaaggccaagagaagaagagtgtccctggtgctgcctgagtactatgaggccttcaaccggctgctggaggaccccgtcatcaagcgcttcctggcctgggacaaggacctgcgggtgtctgacaagtacctgctggccatggtgattgcctacttcagccgggccggcctgcccagctggcagtaccagaggatccacttcttcctggccctgtacctggccaatgacatggaggaggatgatgaggcccccaagcagaagatcttctacttcctgtatggcaagacccacagccacatccccctgcggcccaagcactggttccagctgtgccggcccatgaacccccgggccaggaagaactgcagccagatcgccctcttccagaagaggcgcttccagttcttctgcagcatgcgctgccgggcctgggtgtccccagaggagctggaggagatccaggcctatgaccctgagcactgggtgtgggcccgggaccgggcccacctgtcctag

SEQ ID NO: 42323 - DNA, 714 bp, Artificial Sequence
  Description of Artificial Sequence: Synthetic coding sequence
atggccagcggccaggcccggcccccatttgaggaggagagcccccagcccagcaccaccgtgcgcagccctgaggtggtggtggatgatgaggtgcccggccccagcgccccctggattgaccccagcccccagccccagagcctgggcctgaagaggaagtctgagtggagcgatgaaagtgaggaggagctggaggaggagctggagctggagcgggcccctgagcctgaggacacctgggtggtggagaccctgtgtggcctgaagatgaagctgaagaggaagagggccagctctgtgctgcctgagcaccacgaggccttcaaccggctgctgggggaccctgtggtgcagaagttcctggcctgggacaaggacctgcgggtgtctgacaagtacctgctggccatggtgattgcctacttcagccgggccggcctcttctcctggcagtaccagaggatccacttcttcctggccctgtacctggccagtgacatggaggaggacaaccaggcccccaagcaggacatcttctccttcctgtatggcaagaactacagccagaggcccctcttccacaagctgcgctaccagctgctgtgcagcatgcgctggaggacctgggtgtccccagaggagatggaggagatccaggcctatgaccctgagcactgggtgtgggcccgggacaggaccctcatctcctag

SEQ ID NO: 42324 - DNA, 1209 bp, Artificial Sequence
  Description of Artificial Sequence: Synthetic coding sequence
atggacagaacagagacccgcttcaggaagaggggccagatcaccgggaagatcaccaccagccggcagccccacccccagaatgagcagagcccccagaggagcaccagcggctaccccctgcaggaggtggtggatgatgagatgctgggccccagcgcccctggggtggaccccagccccccctgccgcagcctgggctggaagaggaagcgggagtggagcgatgagagcgaggaggagcctgagaaggagctggcccctgagcctgaggagacctgggtggtggagatgctgtgtggcctgaagatgaagctgaagcagcagagggtgagcagcatcctgcctgagcaccacaaggacttcaacagccagctggcccctggggtggaccccagccccccccacaggagcttctgctggaagaggaagatggagtggtgggatgaaagtgaggagagcctggaggaggagcccaggaaggtgctggcccctgagcctgaggagatctgggtggccgagatgctgtgtggcctgaagatgaagctgaagagaagaagagtgtccctggtgctgcctgagcaccacgaggccttcaaccggctgctggaggaccccgtcatcaagcgcttcctggcctgggacaaggacctgcgggtgtctgacaagtacctgctggccatggtgattgcctacttcagccgggccggcttccccagctggcagtaccagaggatccacttcttcctggccctgtacctggccaatgacatggaggaggatgatgaggacagcaagcagaacatcttccacttcctgtacaggaagaacagaagccgcatccccctgctgaggaagccctggttccagctgggccacagcatgaacccccgggccaggaagaacagaagccgcatccccctgctgaggaagaggcgcttccagctgtaccgcagcaccaacccccgggccaggaagaacagaagccgcatccccctgctgaggaagaggcgcttccagctgtaccgctccatgaacagccgggccaggaagaacagaagccagatcgtgctcttccagaagaggcgcttccacttcttctgcagcatgagctgccgggcctgggtgtccccagaggagctggaggagatccaggcctatgaccctgagcactgggtgtgggcccgggaccgggcccacctgtcctag

SEQ ID NO: 42325 - DNA, 777 bp, Artificial Sequence; identical to SEQ ID NO: 42318
  Description of Artificial Sequence: Synthetic coding sequence

SEQ ID NO: 42326 - DNA, 1209 bp, Artificial Sequence; identical to SEQ ID NO: 42324
  Description of Artificial Sequence: Synthetic coding sequence

SEQ ID NO: 42327 - DNA, 1545 bp, Artificial Sequence
  Description of Artificial Sequence: Synthetic coding sequence
atgtctgagatcctgtgccagtggctgaacaaggagctgaaggtgtccaggacagtgagccccaagagctttgccaaggccttcagcagcggctacctgctgggggaggtgctgcacaagtttgagctgcaggatgacttcagcgagttcctggacagccgggtgtcctctgccaagctgaacaacttcagccggctggagcccaccctgaacctgctgggcgtgcagtttgaccagaatgtggcccacggcatcatcacagagaagccaggagtggccaccaagctgctgtaccagctgtacatcgccctgcagaagaagaagaagagcggcctgactggagtggagatgcagaccatgcagaggctgaccaacctgcggctgcagaacatgaagagtgacaccttccaggagcggctgcggcacatgatcccccggcagacagacttcaacctgatgaggatcacctaccgcttccaggagaagtacaagcacgtgaaggaggacctggcccacctgcactttgagaagctggagcgcttccagaagctgaaggaggagcagcgctgctttgatattgagaagcagtacctgaacagaagacggcagaatgagatcatggccaagatccaggccgccatcatccagatccccaagccagccagcaacagaaccctgaaggccctggaggcccagaagatgatgaagaagaagaaggaggccgaggatgtggctgatgagatcaagaagtttgaggccctgatcaagaaggacctgcaggccaaggagagcgccagcaagaccagcctggacacagctggccagaccaccacagacctgctgaacacctacagtgatgatgagtacatcaagaagatccagaagaggctggaggaggatgcctttgcccgggagcagcgggagaagagaagaaggaagctgctgatggaccagctgattgcccacgaggcccaggaggaggcctaccgggaggagcagctgatcaaccggctgatgaggcagagccagcaggagaggagaattgctgtgcagctgatgcacgtgagacatgagaaggaggtgctgtggcagaaccgcatcttccgggagaagcagcacgaggagcggcggctgaaggacttccaggatgccctggaccgggaggccgccctggccaagcaggccaagattgactttgaggagcagttcctgaaggagaagcgcttccatgaccagattgctgtggagcgggcccaggcccgctatgagaagcactacagcgtgtgtgccgagatcctggaccagatcgtggacctgagcaccaaggtggccgactacaggatgctgaccaacaacctgatcccctacaagctgatgcatgactggaaggagctgttcttcaatgccaagcccatctatgagcaggcctctgtgaagaccctgcctgccaaccccagccgggagcagctgacagagctggagaagagggacctgctggacaccaatgactatgaggagtacaaggtgcccacagacatgaagtag

SEQ ID NO: 42328 - DNA, 1860 bp, Artificial Sequence
  Description of Artificial Sequence: Synthetic coding sequence
atgcccagccagattggagacaggaagtggctgcacggcctgcaggccgccctgcagaacttcctgaagggctacccagccatcgtgcggcagctgcacagcgctggccggggcaagagtgacaccagccagaagaagcccaaggagctgctggagagcctgctgcaggccgacatcgtgaagtttgcccacttcctgctggatgtgatgaatgtgctgagcatcctgagctgtgtgaacaagaacagaaacagcagcattgctgacatctttgccaccctggagagcatgctggagatgctgcagatgtaccagacccggctgggccccaaggagaggatggtggacagcgccacccacttccacggcaactgcctgcggggcaaggagaacatctctgctgtgaggaacatcgtgctgacccacctgatcaagaggctgcagggctgcttcagagatgccagccagaatgtggtgcgggccaccgtcatcggcagcttcaagctgtggcccaccaagatcaaccaggagtttggagagaaggaggtgtccatcctgacagcccactatgagcctgtgctggaggccgccaacgtgaagctgtctgaggtggacacagagtggagcatgctgaagctggagatctatgcccgcttccagaacatcaggaagctgacctgggactttgtgaacagcatctacctgcacaagtaccccaacatcctgaccctggtggacctggtgctgaccctgcctgccagcagcgctgaggccgagcacggcttcagccagatgaagtggaccaagagccacatgcacgccaagatcaaggccgagagcatcatcggcaacaaggccttcacagacatcctgattgacctggtgaccctgaacctgggcaccaacaacttccccagcaactggatgcacctgacccagcctgagctgcaggagctgaccagcctgctgactgtgaacagcgagtttgtggactggaggaagttcctgctggtgacctccatgccctggcccatccccctggaggaggagctgctggagaccctgcagaagttcaaggctgtggacaaggagcagctgggcaccatcacctttgagcagtacatgcaggccggcctgtggttcaccggagatgaggacatcaagatccctgagaaccccctggagcccctgcccttcaaccggcaggagcacctgattgagttcttcttccggctgtttgctgactatgagaaggaccccccccagctggactacacccagatgctgctgtactttgcctgccacccagacacagtggagggcgtgtaccgggccctgtctgtggccgtgggcacccacgtgttccagcaggtgaaggccagcatccccagcgctgagaagaccagcagcacagatgctggccctgctgaggagttccctgagcctgaggagaatgctgcccgggaggagaggaagctgaaggatgacacagagaagcgggagcagaaggatgaggagatcccagaaaatgccaacaatgagaagatgtccatggagaccctgctgaaggtgttcaagggcggcagcgaggcccaggacagcaacagatttgccagccacctgaagattgagaacatctatgcagagggcttcatcaagaccttccaggacctgggcgccaagaacctggagcccatcgaggtggccgtgctgctgaagcaccccttcatccaggacctgatcagcaactacagcgactacaagttcccagacatcaagatcatcctgcagaggagtgaacatgtgcagggcagtgatggagagaggagccccagccgccacacagaggagaagaagtag

SEQ ID NO: 42329 - DNA, 5469 bp, Artificial Sequence
  Description of Artificial Sequence: Synthetic coding sequence
atgtctgagatcctgtgccagtggctgaacaaggagctgaaggtgtccaggacagtgagccccaagagctttgccaaggccttcagcagcggctacctgctgggggaggtgctgcacaagtttgagctgcaggatgacttcagcgagttcctggacagccgggtgtcctctgccaagctgaacaacttcagccggctggagcccaccctgaacctgctgggcgtgcagtttgaccagaatgtggcccacggcatcatcacagagaagccaggagtggccaccaagctgctgtaccagctgtacatcgccctgcagaagaagaagaagagcggcctgactggagtggagatgcagaccatgcagaggctgaccaacctgcggctgcagaacatgaagagtgacaccttccaggagcggctgcggcacatgatcccccggcagacagacttcaacctgatgaggatcacctaccgcttccaggagaagtacaagcacgtgaaggaggacctggcccacctgcactttgagaagctggagcgcttccagaagctgaaggaggagcagcgctgctttgatattgagaagcagtacctgaacagaagacggcagaatgagatcatggccaagatccaggccgccatcatccagatccccaagccagccagcaacagaaccctgaaggccctggaggcccagaagatgatgaagaagaagaaggaggccgaggatgtggctgatgagatcaagaagtttgaggccctgatcaagaaggacctgcaggccaaggagagcgccagcaagaccagcctggacacagctggccagaccaccacagacctgctgaacacctacagtgatgatgagtacatcaagaagatccagaagaggctggaggaggatgcctttgcccgggagcagcgggagaagagaagaaggaagctgctgatggaccagctgattgcccacgaggcccaggaggaggcctaccgggaggagcagctgatcaaccggctgatgaggcagagccagcaggagaggagaattgctgtgcagctgatgcacgtgagacatgagaaggaggtgctgtggcagaaccgcatcttccgggagaagcagcacgaggagcggcggctgaaggacttccaggatgccctggaccgggaggccgccctggccaagcaggccaagattgactttgaggagcagttcctgaaggagaagcgcttccatgaccagattgctgtggagcgggcccaggcccgctatgagaagcactacagcgtgtgtgccgagatcctggaccagatcgtggacctgagcaccaaggtggccgactacaggatgctgaccaacaacctgatcccctacaagctgatgcatgactggaaggagctgttcttcaatgccaagcccatctatgagcaggcctctgtgaagaccctgcctgccaaccccagccgggagcagctgacagagctggagaagagggacctgctggacaccaatgactatgaggagtacaagaacatggtgggggagtgggccctgcctgaggagatggtggacaacctgccccccagcaacaactgcatcctgggccacatcctgcaccggctggccgagaagagcctgccccccagggctgagagcaccaccccagagctgcccagctttgctgtgaagggctgcctgctgggcaagaccctgagcggcaagaccaccatcctgcggagcctgcagaaggacttccccatccagatcctgagcattgacaccctggtgcaggaggccatccaggccttccatgacaatgagaaggtgtctgaggtgctgcccatccagaagaatgatgaagaagatgccctgcctgtgctgcaggaggagatcaaggagagccaggacccccagcacgtgttttctgctggccctgtgtctgatgaggtgctgcctgagacagaaggagagaccatgctgagcgccaatgctgacaagacccccaaggccgaggaggtgaagagcagtgacagcttcctgaagctgaccacccgggcccagctgggcgccaagtctgagcagctgctgaagaagggcaagagcatcccagatgtgctgctggtggacatcatcgtgaatgccatcaatgagatccctgtgaaccaggactgcatcctggatggcttccccatgaccctgaaccaggcccagctgctggaggaggccctgaccggctgcaacagaaacctgacagaggtggagaggaagaaggcccagaagagcaccctggccattgatcctgccaccagcaaggagatccccctgcccagccctgcctttgattttgtgatcctgctggatgtgtctgacaccagctccatgagcaggatgaatgacatcatcgccgaggagctgagctacaagacagcccacgaggacatcagccagagggtggccgctgagaaccaggacaaggatggagaccagaacctgcgggaccagatccagcaccgcatcatcggcttcctggacaactggcccctgctggagcagtggttcagcgagcctgagaacatcctgatcaagatcaatgctgagattgacaaggagagcctgtgtgagaaggtgaaggagatcctgaccacagagatcgccaagaagaagaacaaggtggagaagaagctggaggagaaggaggccgagaagaaggctgctgccagcctggccgagctgcccctgcccaccccacctccagcccctcctcctgagcctgagaaggagaaggagatccaccagagccacgtggccagcaagacccccacagccaagggcaagccccagagcgaggccccccacggcaagcaggagagcctgcaggagggcaagggcaagaagggggagacagccctgaagaggaagggcagccccaagggcaagagcagcggcggcaaggtgcctgtgaagaagagccctgctgacagcacagacaccagccctgtggccatcgtgccccagccccccaagccaggcagcgaggagtgggtgtatgtgaatgaacctgtgcctgaggagatgcccctcttcctggtgccctactgggagctgattgaaaattcctacatcaacaccatcaagacagtgctgcggcacctgcgggaggaccagcacacagtgctggcctacctgtatgagatccgcaccagcttccaggagttcctgaagaggccagaccacaagcaggactttgtggcccagtggcaggccgacttcaacagcctgcctgatgacctgtgggatgatgaggagaccaaggccgagctgcaccagagggtgaatgacctgcgggaccggctgtgggacatctgtgatgccaggaaggaggaggccgagcaggagcggctggacatcatcaatgaatcctggctgcaggacaccctgggcatgaccatgaaccacttcttcagcctgatgcaggccgagctgaaccgcttccaggacaccaagaggctgctgcaggactactactggggcatggagagcaagatccctgtggaggacaacaagcgcttcacccgcatccccctggtgcagctggacagcaaggacaacagcgagagccagctgcgcatccccctggtgccccgcatcagcatcagcctggagaccgtgacccccaagcccaagaccaagtctgtgctgaagggcaagatggacaacagcctggagaatgtggagagcaactttgaagcagatgagaagctggtgatggacacctggcagcaggccagcctggccgtgagccacatggtggccgctgagatccaccagaggctgatggaggaggagaaggagaaccagcctgctgaccccaaggagaagagcccccagatgggcgccaacaagaaggtgaagaaggagccccccaagaagaagcaggaggacaagaagcccaagggcaagagcccccccatggccgaggccacccctgtgattgtgaccacagaggagattgctgagatcaagaggaagaatgagctgcgggtgaagatcaaggaggagcacctggccgccctgcagtttgaggagatcgccacccagttccggctggagctgatcaagaccaaggccctggccctgctggaggacctggtgaccaaggtggtggatgtgtacaagctgatggagaagtggctgggggagcgctacctgaatgagatggccagcacagagaagctgacagatgtggcccgctaccacatcgagaccagcaccaagatccagaatgagctgtacctgagccaggaggacttcttcatcaatggaaacatcaaggtgtttcctgaccccccacccagcatccggcccccacctgtggagaaggaggaggatggcaccctgaccatcgagcagctggacagcctgcgggaccagttcctggacatggcccccaagggcatcatcggcaacaaggccttcacagacatcctgattgacctggtgaccctgaacctgggcaccaacaacttccccagcaactggatgcacctgacccagcctgagctgcaggagctgaccagcctgctgactgtgaacagcgagtttgtggactggaggaagttcctgctggtgacctccatgccctggcccatccccctggaggaggagctgctggagaccctgcagaagttcaaggctgtggacaaggagcagctgggcaccatcacctttgagcagtacatgcaggccggcctgtggttcaccggagatgaggacatcaagatccctgagaaccccctggagcccctgcccttcaaccggcaggagcacctgattgagttcttcttccggctgtttgctgactatgagaaggaccccccccagctggactacacccagatgctgctgtactttgcctgccacccagacacagtggagggcgtgtaccgggccctgtctgtggccgtgggcacccacgtgttccagcaggtgaaggccagcatccccagcgctgagaagaccagcagcacagatgctggccctgctgaggagttccctgagccagaagaaaatgctgcccgggaggagaggaagctgaaggatgacacagagaagcgggagcagaaggatgaggagatcccagaaaatgccaacaatgagaagatgtccatggagaccctgctgaaggtgttcaagggcggcagcgaggcccaggacagcaacagatttgccagccacctgaagattgagaacatctatgcagagggcttcatcaagaccttccaggacctgggcgccaagaacctggagcccatcgaggtggccgtgctgctgaagcaccccttcatccaggacctgatcagcaactacagcgactacaagttcccagacatcaagatcatcctgcagaggtctgagcacgtgcagggcagtgatggagagaggagccccagccgccacacagaggagaagaagtag

SEQ ID NO: 42330 - DNA, 1410 bp, Artificial Sequence
  Description of Artificial Sequence: Synthetic coding sequence
atggacaacagaaacacccagatgtacacagaggaggagaagacagtgaaccccttcctgcccagcaccccaggccccaagaaggccaagggcggcggggaggccgtggagacccacccagcccctggccccctgcccccacctgaggtgcgggacattggagagcggcgggagccagaccgggcccagcagcagccccagaagccagctgtggccgccggcacccagagcctgggcaacttccggcagggcttcatgaagtgcctgctggaggtggagaagatggaggccagccaccggcgggccagcaaggcccggagccagacagcccagaagagccccaggaccctgacccctgtgcccaccagcgcccccagcctgccccagaccccagcctctgtgcctgccagcggccccagctgggcccggctgcctgcccctggccctgagcccgcccccatgggcgcccctgtgcccacctccatgccctgccctgtgctgctgggccctgccctggacctgggctggaggaggatggagctgctgcaccagagcagcgagaggaccctgtcctatgccaaggcccggcaggagcctgaggagcagagcctgcagaagctgtaccagaaccgggagaagtctgaggagcagctgaccctgaagcaggaggaggccttccgcagctactttgagatcttcaacggccctggagaggtggatgcccagagcctgaagaacatcctgctgctgatgggcttctctgtgaccctggcccaggtggaggatgccctgatgtctgcagatgtgaatggagatggccgggtggacttcaaggacttcctggccgtgatgacagacacccggcgcttcttctgcagcgtggagcagaatgccctgagtgacatggccccccacaacccccacaccctgctgtttgagatcctgagcctgctggtggagatgctggccctgcctgaggccgtgctggaggagatcaccaactactaccagaagaagctgaaggagggcacctgcaaggcccaggagatggaggccgctgtgggccgcctgcggctgcagaagctgccctacaacccccagcaggaggagagcagcgaggtgcctgagaggaaggtgctgagcatcctgagccggctgaagcagcagaactatgcccccaacctgcagagcccctatgcccaggtgccctgcatcctgctgtgcccccagctggacaagaagatggtgcggcggcagcccagcaaccactacgccctggaccagtgcaccccacctggcctggaccctgacatccgcagccccttcttccagagcggcagccagggcaaccgggagcacaacagcgacagcaggaagtggctgagctctgtgcctgcccggacccactag

SEQ ID NO: 42331 - DNA, 603 bp, Artificial Sequence
  Description of Artificial Sequence: Synthetic coding sequence
atggacaacagaaacacccagatgtacacagagggccgcaccaaggcccctggcacccagcccagccctggcctgcgcatcaccatcaagagagctggggtggagcccatcatccctggggtgtccaaggtgatgtttcctgatgccagcgaggtgggcagcaagaagcacctgagcagcgccagccggggccctgagaagggcccccggctgagagatgcctttgagaagggccccagcgagctgcgcatccaggagcagggccccccagcccggcctgggaagaagcagcccagctgggtgccccaggagggcagccaggagctgcaggccggccaggaccagagcgagctgggcctgctgcccagctgggtgcctgaggtgcctgagggcctgcagcagctgggcagcggcaaggagatcaagggccagcagggccggcagaggaacagaggaattggagaggaccagcccccagagagctgccaggccggccacggcggcagccggctgctgatcccagccctgctggaggccgagggcggccgcagccctgaggtgaagaccagcctggccaacatggtgaagccctgcctgtactag

SEQ ID NO: 42332 - DNA, 1341 bp, Artificial Sequence
  Description of Artificial Sequence: Synthetic coding sequence
atggcccagcccggggctgtggagcacgcctgccaccccagcaccctgggcggccagggcggcggcagcctggaggaggtgcgggacatcggggagcggcgggagccagaccgggcccagcagcagccccagaagccagctgtggccgccggcacccagagcctgggcaacttccggcagggcttcatgaagtgcctgctggaggtggagaagatggaggccagccacagaagagccagcaaggcccggagccagacagcccagaagagccccaggaccctgacccctgtgcccaccagcgcccccagcctgccccagaccccagcctctgtgcctgccagcggccccagctgggcccggctgcctgcccctggccctgagcccgcccccatgggcgcccctgtgcccacctccatgccctgccctgtgctgctgggccctgccctggacctgggctggaggaggatggagctgctgcaccagagcagcgagaggaccctgtcctatgccaaggcccggcaggagcctgaggagcagagcctgcagaagctgtaccagaaccgggagaagtctgaggagcagctgaccctgaagcaggaggaggccttccgcagctactttgagatcttcaatggacctggagaggtggatgcccagagcctgaagaacatcctgctgctgatgggcttctctgtgaccctggcccaggtggaggatgccctgatgtctgcagatgtgaatggagatggccgggtggacttcaaggacttcctggccgtgatgacagacacccggcgcttcttctgcagcgtggagcagaatgccctgagtgacatggccccccacaacccccacaccctgctgtttgagatcctgagcctgctggtggagatgctggccctgcctgaggccgtgctggaggagatcaccaactactaccagaagaagctgaaggagggcacctgcaaggcccaggagatggaggccgctgtgggccgcctgcggctgcagaagctgccctacaacccccagcaggaggagagcagcgaggtgcctgagaggaaggtgctgagcatcctgagccggctgaagcagcagaactatgcccccaacctgcagagcccctatgcccaggtgccctgcatcctgctgtgcccccagctggacaagaagatggtgcggcggcagcccagcaaccactacgccctggaccagtgcaccccacctggcctggaccctgacatccgcagccccttcttccagagcggcagccagggcaaccgggagcacaacagcgacagcaggaagtggctgagctctgtgcctgcccggacccactag

SEQ ID NO: 42333 - DNA, 810 bp, Artificial Sequence
  Description of Artificial Sequence: Synthetic coding sequence
atgaagaggagcctgaatgaaaattctgcccggagcacagctggctgcctgcctgtgcccctcttcaaccagaagaagaggaaccggcagcccctgaccagcaaccccctgaaggatgattctggcatcagcacccccagcgacaactatgacttcccccccctgcccacagactgggcctgggaggccgtgaaccctgagctggcccctgtgatgaagacagtggacaccggccagatcccccacagcgtgtcccggcccctgcggagccaggacagcgtcttcaacagcatccagagcaacacaggccgcagccagggcggctggagctacagagatggcaacaagaacaccagcctgaagacctggaacaagaatgacttcaagccccagtgcaagaggaccaacctggtggccaatgatggcaagaacagctgccctgtgagcagcggggcccagcagcagaagcagctgcgcatccctgagccccccaacctgagcaggaacaaggagacagagctgctgcggcagacccacagcagcaagatcagcggctgcaccatgaggggcctggacaagaacagcgccctgcagaccctgaagcccaacttccagcagaaccagtacaagaagcagatgctggatgacatccctgaggacaacaccctgaaggagaccagcctgtaccagctgcagttcaaggagaaggccagcagcctgcgcatcatctctgctgtgattgaatccatgaagtactggagggagcacgcccagaagacagtgctgctgtttgaggtgctgggcagctag

SEQ ID NO: 42334 - DNA, 963 bp, Artificial Sequence
  Description of Artificial Sequence: Synthetic coding sequence
atgaagaggagcctgaatgaaaattctgcccggagcacagctgactgggcctgggaggccgtgaaccctgagctggcccctgtgatgaagacagtggacaccggccagatcccccacagcgtgtcccggcccctgcggagccaggacagcgtcttcaacagcatccagagcaacacaggccgcagccagggcggctggagctacagagatggcaacaagaacaccagcctgaagacctggaacaagaatgacttcaagccccagtgcaagaggaccaacctggtggccaatgatggcaagaacagctgccctgtgtcctctggggcccagcagcagaagcagctgcgcatccctgagccccccaacctgagcaggaacaaggagacagagctgctgcggcagacccacagcagcaagatcagcggctgcaccatgaggggcctggacaagaacagcgccctgcagaccctgaagcccaacttccagcagaaccagtacaagaagcagatgctggatgacatccctgaggacaacaccctgaaggagaccagcctgtaccagctgcagttcaaggagaaggccagcagcctgcgcatcatctctgctgtgattgagagcatgaagtactggagggagcacgcccagaagacagtgctgctgtttgaggtgctggccgtgctggacagcgctgtgaccccaggcccctactacagcaagaccttcctgatgagagatggcaagaacaccctgccctgtgtgttctatgaaattgaccgggagctgcccaggctcatccggggccgggtgcaccgctgtgtgggcaactatgaccagaagaagaacatcttccagtgtgtgtctgtgcggcctgcctctgtgtctgagcagaagaccttccaggcctttgtgaagattgctgatgtggagatgcagtactacatcaacgtgatgaatgagacctag

SEQ ID NO: 42335 - DNA, 1092 bp, Artificial Sequence
  Description of Artificial Sequence: Synthetic coding sequence
atgaagaggagcctgaatgaaaattctgcccggagcacagctggctgcctgcctgtgcccctcttcaaccagaagaagaggaaccggcagcccctgaccagcaaccccctgaaggatgattctggcatcagcacccccagcgacaactatgacttcccccccctgcccacagactgggcctgggaggccgtgaaccctgagctggcccctgtgatgaagacagtggacaccggccagatcccccacagcgtgtcccggcccctgcggagccaggacagcgtcttcaacagcatccagagcaacacaggccgcagccagggcggctggagctacagagatggcaacaagaacaccagcctgaagacctggaacaagaatgacttcaagccccagtgcaagaggaccaacctggtggccaatgatggcaagaacagctgccctgtgagcagcggggcccagcagcagaagcagctgcgcatccctgagccccccaacctgagcaggaacaaggagacagagctgctgcggcagacccacagcagcaagatcagcggctgcaccatgaggggcctggacaagaacagcgccctgcagaccctgaagcccaacttccagcagaaccagtacaagaagcagatgctggatgacatccctgaggacaacaccctgaaggagaccagcctgtaccagctgcagttcaaggagaaggccagcagcctgcgcatcatctctgctgtgattgaatccatgaagtactggagggagcacgcccagaagacagtgctgctgtttgaggtgctggccgtgctggacagcgctgtgaccccaggcccctactacagcaagaccttcctgatgagagatggcaagaacaccctgccctgtgtgttctatgaaattgaccgggagctgcccaggctcatccggggccgggtgcaccgctgtgtgggcaactatgaccagaagaagaacatcttccagtgtgtgtctgtgcggcctgcctctgtgtctgagcagaagaccttccaggcctttgtgaagattgctgatgtggagatgcagtactacatcaacgtgatgaatgagacctag

SEQ ID NO: 42336 - DNA, 1044 bp, Artificial Sequence
  Description of Artificial Sequence: Synthetic coding sequence
atgaagaggagcctgaatgaaaattctgcccggagcacagctggctgcctgcctgtgcccctcttcaaccagaagaagaggaaccggcagcccctgaccagcaaccccctgaaggatgacagcgactgggcctgggaggccgtgaaccctgagctggcccctgtgatgaagacagtggacaccggccagatcccccacagcgtgtcccggcccctgcggagccaggacagcgtcttcaacagcatccagagcaacacaggccgcagccagggcggctggagctacagagatggcaacaagaacaccagcctgaagacctggaacaagaatgacttcaagccccagtgcaagaggaccaacctggtggccaatgatggcaagaacagctgccctgtgagcagcggggcccagcagcagaagcagctgcgcatccctgagccccccaacctgagcaggaacaaggagacagagctgctgcggcagacccacagcagcaagatcagcggctgcaccatgaggggcctggacaagaacagcgccctgcagaccctgaagcccaacttccagcagaaccagtacaagaagcagatgctggatgacatccctgaggacaacaccctgaaggagaccagcctgtaccagctgcagttcaaggagaaggccagcagcctgcgcatcatctctgctgtgattgaatccatgaagtactggagggagcacgcccagaagacagtgctgctgtttgaggtgctggccgtgctggacagcgctgtgaccccaggcccctactacagcaagaccttcctgatgagagatggcaagaacaccctgccctgtgtgttctatgaaattgaccgggagctgcccaggctcatccggggccgggtgcaccgctgtgtgggcaactatgaccagaagaagaacatcttccagtgtgtgtctgtgcggcctgcctctgtgtctgagcagaagaccttccaggcctttgtgaagattgctgatgtggagatgcagtactacatcaacgtgatgaatgagacctag

SEQ ID NO: 42337 - DNA, 1092 bp, Artificial Sequence; identical to SEQ ID NO: 42335
  Description of Artificial Sequence: Synthetic coding sequence

SEQ ID NO: 42338 - DNA, 1092 bp, Artificial Sequence; identical to SEQ ID NO: 42335
  Description of Artificial Sequence: Synthetic coding sequence

SEQ ID NO: 42339 - DNA, 1275 bp, Artificial Sequence
  Description of Artificial Sequence: Synthetic coding sequence
atgggcagcagcagcctgtctgaggactaccggcagtgcctggagcgggagctgcggcggggccgggccggcgtgtgtggggaccccagcctgcgggctgtgctgtggcagatcctggtggaggactttgacctgcacggggccctgcaggatgatgccctggccctgctgacagatggcctgtggggccgggctgacctggccccagccctgcggggcctggcccgggcctttgagctgctggagctggccgctgtgcacctgtacctgctgccctggaggaaggagttcaccaccatcaagaccttcagcggcggctacgtgcacgtgctgaagggcgtgctgagtgatgacctgctgctgaagagcttccagaagatgggctacgtgagaagagacagccaccggctgatggtgacagccctgcccccagcctgccagctggtgcaggtggccctgggctgctttgccctgcggctggagtgtgagatcctgggggaggtgctggcccagctgggcacctctgtgctgcctgctgaggagctgctgcaggcccggcgggccagcggagatgtggccagctgtgtggcctggctgcagcagaggctggcccaggatgaggagcccccacccctgcccccccggggcagccctgctgcctaccgggcccccctggacctgtacagagacctgcaggaggatgagggctctgaagatgccagcctgtatggagagcccagccctggccctgacagccccccagctgagctggcctacagaccacccctgtgggagcagagcgccaagctgtggggcactggaggccgggcctgggagcccccagctgaggagctgccccaggccagcagccccccctatggagccctggaggagggcctggagcctgagcccagcgccttctccttcctgagcctgcggcgggagctgagcaggcctggggacctggccaccccagagagcagcgctgctgccagcccccggcgcatccgggcagagggcgtgcctgccagcgcctacagatctgtgtctgagcccccaggctaccaggcccacagctgcctgagccctggggccctgcccaccctgtgctgtgacacctgccggcagctgcatgctgcccactgtgccgccctgcctgcctgccggcccggccacagcctgcgggtgctgctgggagatgcccagaggcggctgtggctgcagagggcccagatggacaccctgctgtacaacagccctggggcccggccctag

SEQ ID NO: 42340 - DNA, 459 bp, Artificial Sequence
  Description of Artificial Sequence: Synthetic coding sequence
atgggcagcagcagcctgtctgaggactaccggcagtgcctggagcgggagctgcggcggggccgggccggcgtgtgtggggaccccagcctgcgggctgtgctgtggcagatcctggtggaggactttgacctgcacggggccctgcaggatgatgccctggccctgctgacagatggcctgtggggccgggctgacctggccccagccctgcggggcctggcccgggcctttgagctgctggagctggccgctgtgcacctgtacctgctgccctggaggaaggagttcaccaccatcaagaccttcagcggcggctacgtgcacgtgctgaagggcgtgctgagtgatgacctgctgctgaagagcttccagaagatgggctacgtgagaagagacagccaccggctgatgctgtgctggagccagagcgctggcctgtgccgggtgcatggatag

SEQ ID NO: 42341 - DNA, 552 bp, Artificial Sequence
  Description of Artificial Sequence: Synthetic coding sequence
atgaagaaggtgaagaagaagaggtctgaggcccggcggcaccgggacagcaccagccagcacgccagcagcaacagcaccagccagcagcccagccctgagagcaccccccagcagcccagccctgagagcaccccccagcacagcagcctggagaccaccagccggcagcctgccttccaggccctgcctgcccctgagatcagaagaagcagctgctgcctgctgagcccagatgccaacgtgaaggccgccccccagagcaggaaggccggccccctcatccgggccggcccccacagctgcagctgtgccacctgcccctgcagcagcgcctgctggaggcggctgggcctgtgccacagccgcatctttgatgtgctgctgccccgggactggcagatggcccctggccggggcctgcccaacctgctgaccttctacaggaagagcagcaggaagcccagcagccacagaaatgcctgcccccccagccccaggaactgtggctgcggcagcggcggcagccgcagctgcctgctgcaccactag

SEQ ID NO: 42342 - DNA, 579 bp, Artificial Sequence
  Description of Artificial Sequence: Synthetic coding sequence
atgaagaaggtgaagaagaagaggtctgaggcccggcggcaccgggacagcaccagccagcacgccagcagcaacagcaccagccagcagcccagccctgagagcaccccccagcagcccagccctgagagcaccccccagcagcccagccctgagagcaccccccagcacagcagcctggagaccaccagccggcagcctgccttccaggccctgcctgcccctgagatccgccgcagcagctgctgcctgctgagcccagatgccaacgtgaaggccgccccccagagcaggaaggccggccccctcatccgggccggcccccacagctgcagctgtgccacctgcccctgcagcagcgcctgctggaggcggctgggcctgtgccacagccgcatctttgatgtgctgctgccccgggactggcagatggcccctggccggggcctgcccaacctgctgaccttctacaggaagagcagcaggaagcccagcagccacagaaatgcctgcccccccagccccaggaactgtggctgcggcagcggcggcagccgcagctgcctgctgcaccactag

SEQ ID NO: 42343 - DNA, 579 bp, Artificial Sequence; identical to SEQ ID NO: 42342
  Description of Artificial Sequence: Synthetic coding sequence

SEQ ID NO: 42344 - DNA, 579 bp, Artificial Sequence; identical to SEQ ID NO: 42342
  Description of Artificial Sequence: Synthetic coding sequence

SEQ ID NO: 42345 - DNA, 579 bp, Artificial Sequence; identical to SEQ ID NO: 42342
  Description of Artificial Sequence: Synthetic coding sequence

SEQ ID NO: 42346 - DNA, 21 bp, Artificial Sequence
  Description of Artificial Sequence: Synthetic coding sequence
tgatgcctgctgcaccactag

SEQ ID NO: 42347 - DNA, 1005 bp, Artificial Sequence
  Description of Artificial Sequence: Synthetic coding sequence
atgcccctggaggtggtggtggagctgcagatccgggccatcagctgccctggggtcttcctgcccgggaagcaggatgtgtacctgggcgtgtacctgatgaaccagtacctggagaccaacagcttccccagcgccttccccatcatgatccaggagagcatgagatttgagaagggcatcgcccccaagattgagttcagcaccaggacagccatcagagaatgtgtgttcctgcacaggaaccgcttcctggaggagagacatgagagccggcggcccctgagcaccagccatgagcccatcttccccctgaacaccatcaagatgaagctgaaggagaacaacctgaaccggctgcccaagggcatgcaggcccgggcccccagccagtacagcaccaggcacttcttccaggaccagcctgcccagctgaacctgggcaacaacttcaagatcagcggcggcagcaagcccccatttgtggtgagacatgtggacagcgccaagccctttggagagaacatcagcgagcaccacctgcggcgcagcaggaggaagagcaagttcagtgacttccccttccccacccggcgggccagcagcctggacagcctggccgccaacgtgaaggtgatcaaggagccagatgagcgcatcgtgctgcggagtgacagcagcagctgcctggacagcagccagtttgggaagagcagcagcagcaagcagggagatgctgacttccacggcaaggccagctttgccacctaccagcacagcaccagccctggccccctggaccagcccctgctgcgggagcgcttccaccctggcagccagagcacctggaagaacatccacgagcgggtgtgcagcctgctgaccagccaccgggcccagctgcaccagaacaaggaggacagcaccagcgaggtgaactacatcatcgagcggcccagctaccccctgaagaagtacagcctgcacgagcagcgctacttctag

SEQ ID NO: 42348 - DNA, 903 bp, Artificial Sequence
  Description of Artificial Sequence: Synthetic coding sequence
atgagccccagcatgctgactggaaacagcccccggggctgccgcctgcccagcatcagcagcaccacctgtggccggcagctggagaaggtgcctgagaagagggacagcggcatgacagaggtggagaggacctacagcgccaactgcagcgacttcctggagagcaagggctgctttgccaacaccacccccagcggcaagtctgtgagcagcagcagctctgtggagaccggccccagcgtgtctgagcccccaggcctgccccgggtgtctgcctacgtggacaccacagctgacctggacaggaagctgtccttcagccacagcgaccacagcagcgagatgagcctgcctgaggtgcagaaggacaagtacccagaggagttcagcctgctgaagctgcagaccaaggatggccacaggcctgagtggaccttctacccccgcttcagcagcaacatccacacctaccacgtgggcaagcagtgcttcttcaatggagtcttcctgggcaacaagaggagcctgtctgagaggacagtggacaagtgcttcggcaggaagaagtatgacatcgaccccagaaatggcatccccaagctgacccctggggacaacccctacatgtacccagagcagagcaagggcttccacaaggccggctccatgctgccccctgtgaacttcagcatcgtgccctatgagaagaagtttgacaccttcatccccctggagcccctgccccagatccccaacctgcccttctgggtgaaggagaaggccaacagcctgaagaatgagatccaggaggtggaggagctggacaactggcagcctgctgtgcccctgatgcacatgctgcacctgagcggggccctggacttcccccggcagagctag

SEQ ID NO: 42349 - DNA, 903 bp, Artificial Sequence; identical to SEQ ID NO: 42348
  Description of Artificial Sequence: Synthetic coding sequence

SEQ ID NO: 42350 - DNA, 1338 bp, Artificial Sequence
  Description of Artificial Sequence: Synthetic coding sequence
atgagccccccaggcatgtggcagcccggggtgcagcagcccggcatcagccagcaggtgcccagccacccagacatgagccagcccggcatgagccagcaggtgcccagccagcccggcatccggcagcctgacaccagccagagctgcaagaaccagacagacatgagccagccagatgccaaccagagcagcctgagtgacagcaaccagacaggcatcatccagcccagccccagcctgctgggcatgaaccagatggacatgaaccagtggagcgccagcctgtatgagatgaaccaggtggacatgaagcagcccagcatgagccaggccggcatgaggcagagcggcaccaacctgcctgacatcaaccagcccggcatgaagcagcccggcacctggcagctgggccgcagccagcccggcatgtggccccagagcctgtctgagctggtgctgtctgaggccagcatcagccagcccggccccccccagagggcccccagccagagcggcccccggcagagcagcaccagccaggccggcaccaaccagagcggcatcagccagcctgtgatgtggcagctggacatgaggcagagcggcggcagccagcccagcatgaggcaggtgggcaccagccagagcggcaccagccagatcggcatgagccagcccggcacctggcagacaggcctgagccagcctgtgccccggcagcccaacaagagccccccaggcatgtggcagaggggcatgtggcagcccggcatgagccagcaggtgcccagccagctgggcatgaggcagcccggcaccagccagagcagcaagaaccagacaggcatgagccaccctggccggggccagcccggcatctgggagcccggccccagccagcccggcctgagccagcaggacctgaaccagctggtgctgagccagcccggcctgagccagcccggccgcagccagcccagcgtgtcccagatgggcatgaggcagacctccatggactacttccagatcagacatgctgaggccggggactgcccagagatcctgcggctcatcaaggagctggccgcctgtgagaacatgctggatgccatggagctgacagctgctgacctgctgagagatggctttggagacaaccccctcttctactgcctgattgctgaggtgaatgaccagcagaagcccagcggcaagctgactgtgggctttgccatgtactacttcacctatgacagctggacaggcaaggtgctgtacctggaggacttctacgtgacccaggcctaccaggacagccaccacaacagcatgtag

SEQ ID NO: 42351 - DNA, 1527 bp, Artificial Sequence
  Description of Artificial Sequence: Synthetic coding sequence
atgagccccccaggcatgtggcagcccggggtgcagcagcccggcatcagccagcaggtgcccagccacccagacatgagccagcccggcatgagccagcaggtgcccagccagcccggcatccggcagcctgacaccagccagagctgcaagaaccagacagacatgagccagccagatgccaaccagagcagcctgagtgacagcaaccagacaggcatcatccagcccagccccagcctgctgggcatgaaccagatggacatgaaccagtggagcgccagcctgtatgagatgaaccaggtggacatgaagcagcccagcatgagccaggccggcatgaggcagagcggcaccaacctgcctgacatcaaccagcccggcatgaagcagcccggcacctggcagctgggccgcagccagcccggcatgtggccccagagcctgtctgagctggtgctgtctgaggccagcatcagccagcccggccccccccagagggcccccagccagagcggcccccggcagagcagcaccagccaggccggcaccaaccagagcggcatcagccagcctgtgatgtggcagctggacatgaggcagagcggcggcagccagcccagcatgaggcaggtgggcaccagccagagcggcaccagccagatcggcatgagccagcccggcacctggcagacaggcctgagccagcctgtgccccggcagcccaacaagagccccccaggcatgtggcagaggggcatgtggcagcccggcatgagccagcaggtgcccagccagctgggcatgaggcagcccggcaccagccagagcagcaagaaccagacaggcatgagccaccctggccggggccagcccggcatctgggagcccggccccagccagcccggcctgagccagcaggacctgaaccagctggtgctgagccagcccggcctgagccagcccggccgcagccagcccagcgtgtcccagatgggcatgaggcagacctccatggactacttccagatcagacatgctgaggccggggactgcccagagatcctgcggctcatcaaggagctggccgcctgtgagaacatgctggatgccatggagctgacagctgctgacctgctgagagatggctttggagacaaccccctcttctactgcctgattgctgaggtgaatgaccagcagaagcccagcggcaagctgactgtgggctttgccatgtactacttcacctatgacagctggacaggcaaggtgctgtacctggaggacttctacgtgacccaggcctaccagggcctgggcatcggggctgagatgctgaagaggctgagccagatcgccatcaccacccagtgcaactgcatgcacttcctggtggtgatctggaaccaggccagcatcaactactacaccagcagaggagccctggacctgagcagcgaggagggctggcacctgttccgcttcaaccgggaggagctgctggacatggcctgggaggagtag

SEQ ID NO: 42352 - DNA, 1899 bp, Artificial Sequence
  Description of Artificial Sequence: Synthetic coding sequence
atgaaccagagcggcaccaaccagagcagcctgagtgacagcaaccaggccggcatcaaccagcccagcaccaacagcctgggcatgaaccagatggacatgaaccagggcagcgccagcctgtatgagatgaaccaggtggacatgaagcagcccagcatgagccaggccggcatgaggcagagcggcaccaacctgcctgacatcaaccagcctgacatgaagcagcctgacacctggcagctgggccgcagccagcccggcatgctgcagcaggagctgagccagctggtgctgagcaaggccggcatcagccagcctgaccccagccagcccggccccagccagagcggccccagccagagcaggatgaggcagatcggcaccaaccagagcggcatgagccagcctgtgatgcagcagctggacagccagagcggcggcagccagcccagcatgaggcaggtgggcaccagccagctgggcaccagccagatcggcatgagccagcccggcacctggcagacaggcctgagccagcctgtgctgcggcagcccaacatgagccccccaggcatgtggcagcccggggtgcagcagcccggcatcagccagcaggtgcccagccacccagacatgagccagcccggcatgagccagcaggtgcccagccagcccggcatccggcagcctgacaccagccagagctgcaagaaccagacagacatgagccagccagatgccaaccagagcagcctgagtgacagcaaccagacaggcatcatccagcccagccccagcctgctgggcatgaaccagatggacatgaaccagtggagcgccagcctgtatgagatgaaccaggtggacatgaagcagcccagcatgagccaggccggcatgaggcagagcggcaccaacctgcctgacatcaaccagcccggcatgaagcagcccggcacctggcagctgggccgcagccagcccggcatgtggccccagagcctgtctgagctggtgctgtctgaggccagcatcagccagcccggccccccccagagggcccccagccagagcggcccccggcagagcagcaccagccaggccggcaccaaccagagcggcatcagccagcctgtgatgtggcagctggacatgaggcagagcggcggcagccagcccagcatgaggcaggtgggcaccagccagagcggcaccagccagatcggcatgagccagcccggcacctggcagacaggcctgagccagcctgtgccccggcagcccaacaagagccccccaggcatgtggcagaggggcatgtggcagcccggcatgagccagcaggtgcccagccagctgggcatgaggcagcccggcaccagccagagcagcaagaaccagacaggcatgagccaccctggccggggccagcccggcatctgggagcccggccccagccagcccggcctgagccagcaggacctgaaccagctggtgctgagccagcccggcctgagccagcccggccgcagccagcccagcgtgtcccagatgggcatgaggcagacctccatggactacttccagatcagacatgctgaggccggggactgcccagagatcctgcggctcatcaaggagctggccgcctgtgagaacatgctggatgccatggagctgacagctgctgacctgctgagagatggctttggagacaaccccctcttctactgcctgattgctgaggtgaatgaccagcagaagcccagcggcaagctgactgtgggctttgccatgtactacttcacctatgacagctggacaggcaaggtgctgtacctggaggacttctacgtgacccaggcctaccaggacagccaccacaacagcatgtag

SEQ ID NO: 42353 - DNA, 192 bp, Artificial Sequence
  Description of Artificial Sequence: Synthetic coding sequence
atgacccgcatcaagatctctgtgtgcatctgcttccgctactttgagttctgcttcttctacgccctgaacatcctcttccagaaggtgtctgaggccaacagccagacagagctgctgctgcggccccactgcaagaacatcctcttcaacgtgtccttcatgattgacctgcaggccgcccacttctag

SEQ ID NO: 42354 - DNA, 1062 bp, Artificial Sequence
  Description of Artificial Sequence: Synthetic coding sequence
atgggcagcctgtacagcgagtacctgaaccccaacaaggtgcaggagcactacaactacaccaaggagaccctggagacccaggagaccaccagccggcaggtggccagcgccttcatcgtcatcctgtgctgtgccatcgtggtggagaacctgctggtgctgattgctgtggccaggaacagcaagttccacagcgccatgtacctgttcctgggcaacctggccgccagtgacctgctggccggcgtggcctttgtggccaacaccctgctgagcggctctgtgaccctgcggctgacccctgtgcagtggtttgcccgggagggcagcgccttcatcaccctgagcgcctctgtgttcagcctgctggccatcgccatcgagagacatgtggccatcgccaaggtgaagctgtatggcagtgacaagagctgcaggatgctgctgctgattggagcctcctggctgatcagcctggtgctgggcggcctgcccatcctgggctggaactgcctgggccacctggaggcctgcagcacagtgctgcccctgtatgccaagcactacgtgctgtgtgtggtgaccatcttcagcatcatcctgctggccatcgtggccctgtatgtgcgcatctactgtgtggtgcgcagcagccatgctgacatggccgccccccagaccctggccctgctgaagacagtgaccatcgtgctgggcgtcttcatcgtgtgctggctgcctgccttcagcatcctgctgctggactatgcctgccctgtgcacagctgccccatcctgtacaaggcccactacttctttgctgtgtccaccctgaacagcctgctgaaccctgtgatctacacctggaggagccgggacctgcggcgggaggtgctgcggcccctgcagtgctggaggcctggggtgggcgtgcagggcagaagaagaggaggcaccccaggccaccacctgctgcccctgcggagcagcagcagcctggagcggggcatgcacatgcccaccagccccaccttcctggagggcaacacagtggtgtag

SEQ ID NO: 42355 - DNA, 789 bp, Artificial Sequence
  Description of Artificial Sequence: Synthetic coding sequence
atgctggccctggaggccgcccagctggatggcccccacttcagctgcctgtacccagatggagtcttctatgacctggacagctgcaagcacagcagctacccagattctgagggcgccccagacagcctgtgggactggacagtggcccctcctgtgcctgccaccccctatgaggcctttgatcctgctgctgctgccttcagccacccccaggccgcccagctgtgctatgagccccccacctacagccctgctggcaacctggagctggcccccagcctggaggcccctggccctggcctgcctgcctaccccacagagaactttgccagccagaccctggtgcccccagcctatgccccctaccccagccctgtgctgtctgaggaggaggacctgcccctggacagccctgccctggaggtgtctgacagcgagagtgatgaggccctggtggccggccctgagggcaaaggaagtgaagctggcaccaggaagaagctgcggctgtaccagttcctgctgggcctgctgaccaggggggacatgagagaatgtgtgtggtgggtggagcctggagctggggtcttccagttcagcagcaagcacaaggagctgctggcccggcgctggggccagcagaagggcaacaggaagaggatgacctaccagaagctggcccgggccctgaggaactatgccaagacaggagagatcaggaaggtgaagaggaagctgacctaccagtttgattctgccctgctgcctgctgtgcggcgggcctag

SEQ ID NO: 42356 - DNA, 768 bp, Artificial Sequence
  Description of Artificial Sequence: Synthetic coding sequence
atggccagcagtgacctggagcagctgtgcagccacgtgaatgagaagattggcaacatcaagaagaccctgagcctgaggaactgtggccaggagcccaccctgaagacagtgctgaacaagattggagatgagatcatcgtcatcaatgagctgctgaacaagctggagctggagatccagtaccaggagcagaccaacaacagcctgaaggagctgtgtgagagcctggaggaggactacaaggacatcgagcacctgaaggaaaatgtgcccagccacctgccccaggtgacagtgacccagagctgtgtgaagggcagtgacctggaccctgaggagcccatcaaggtggaggagcctgagcctgtgaagaagccacccaaggagcagaggagcatcaaggagatgcccttcatcacctgtgatgagttcaacggggtgcccagctacatgaagagccggctgacctacaaccagatcaatgatgtgatcaaggagatcaacaaggctgtgatcagcaagtacaagatcctgcaccagcccaagaagtccatgaacagcgtgaccaggaacctgtaccaccgcttcattgatgaggagaccaaggacaccaagggccgctacttcatcgtggaggccgacatcaaggagttcaccaccctgaaggctgacaagaagttccacgtgctgctgaacatcctgcggcactgccggcggctgtctgaggtgcggggcggcggcctgacccgctacgtgatcacctag

SEQ ID NO: 42357 - DNA, 381 bp, Artificial Sequence
  Description of Artificial Sequence: Synthetic coding sequence
atgagcaccatcaacatggaggccgaggtggacaagctggagctgatgttccagaaggccgagagtgacctggactacatccagtaccgcctggagtatgagatcaagaccaaccacccagacagcgccagcgagaagaaccctgtgaccctgctgaaggagctgagcgtcatcaagagccagtaccagaccctgtatgcccgcttcaagcctgtggccgtggagcagaaggagaccaagagccgcatctgtgccggcatgaccaagaccatgaatgtcatccagaagctgcagaagcagacagacctggacctgagccccctgaccaaggaggagaagacagctgctgagcagttcaagagccacgtgcctgacctgtag

SEQ ID NO: 42358 - DNA, 777 bp, Artificial Sequence
  Description of Artificial Sequence: Synthetic coding sequence
atgaagaccccaaatgcccaggaggccgagggccagcagaccagggctgctgctggccgggccaccggcagcgccaacatgaccaagaagaaggtgtcccagaagaagcagaggggccggcccagcagccagcccaggagaaatattgtgggctgccgcatcagccacggctggaaggagggagatgagcccatcacccagtggaagggcaccgtgctggaccaggtgcccatcaaccccagcctgtacctggtgaagtatgatggcatcgactgtgtgtatggcctggagctgcacagagatgagcgggtgctgagcctgaagatcctgagtgacagagtggccagcagccacatcagtgatgccaacctggccaacaccatcatcggcaaggctgtggagcacatgtttgaaggagaacatggcagcaaggatgagtggaggggcatggtgctggcccaggcccccatcatgaaggcctggttctacatcacctatgagaaggaccctgtgctgtacatgtaccagctgctggatgactacaaggagggggacctgcgcatcatgcctgagagcagcgagagccccccaacagagcgggagcccggcggcgtggtggatggcctcatcggcaagcacgtggagtacaccaaggaggatggcagcaagagaattggcatggtgatccaccaggtggagaccaagcccagcgtgtacttcatcaagtttgatgatgacttccacatctacgtgtatgacctggtgaagaagagctag

SEQ ID NO: 42359 - DNA, 777 bp, Artificial Sequence; identical to SEQ ID NO: 42358
  Description of Artificial Sequence: Synthetic coding sequence

SEQ ID NO: 42360 - DNA, 234 bp, Artificial Sequence
  Description of Artificial Sequence: Synthetic coding sequence
atgaagaccccatttgggaaggctgctgctggccagaggagcaggactggagctggccacggctctgtgtctgtgaccatgatcaagaggaaggccgcccacaagaagcacaggagccggcccaccagccagccccggggcaacatcgtgggctgccgcatccagcacggctggaaggatggagatgagcccctgacccagtggaagggcaccgtgctggaccagctgctgtag

SEQ ID NO: 42361 - DNA, 777 bp, Artificial Sequence
  Description of Artificial Sequence: Synthetic coding sequence
atgaagaccccatttgggaaggctgctgctggccagaggagcaggactggagctggccacggctctgtgtctgtgaccatgatcaagaggaaggccgcccacaagaagcacaggagccggcccaccagccagccccggggcaacatcgtgggctgccgcatccagcacggctggaaggatggagatgagcccctgacccagtggaagggcaccgtgctggaccaggtgcctgtgaaccccagcctgtacctgatcaagtatgatggctttgactgtgtgtatggcctggagctgcacagagatgagcgggtgagcagcctggaggtgctgcccaacagagtggccagcagccgcatcagtgacacccacctggccgagatcatggtgggcaaggctgtggagcacatctttgaaacagaggagggcagcaagaatgagtggaggggcatggtgctggcccaggcccctgtgatgaacacctggttctacatcacctatgagaaggaccctgtgctgtacatgtaccagctgctggatgactacaaggatggagacctgcgcatcctgcaggacagcaatgacagccccctggccgagcgggagcccggggaggtgattgacagcctggtgggcaagcaggtggagtatgccaaggatgatggcagcaagaggacaggcatggtgatccaccaggtggaggccaagcccagcgtgtacttcatcaagtttgatgatgacttccacatctacgtgtatgacctggtgaagaccagctag

SEQ ID NO: 42362 - DNA, 750 bp, Artificial Sequence
  Description of Artificial Sequence: Synthetic coding sequence
atgagccccccaacagtgccccccatgggcgtggatggagtgtctgcctacctgatgaagaagaggcacacccacaggaagcagaggaggaagcccaccttcctgaccaggaggaacatcgtgggctgccgcatccagcacggctggaaggagggcaatgaacctgtggagcagtggaagggcaccgtgctggagcaggtgtctgtgaagcccaccctgtacatcatcaagtatgatggcaaggacagcgtgtatggcctggagctgcaccgggacaagagggtgctggccctggagatcctgcctgagcgggtgcccaccccaagaattgacagccggctggccgacagcctgattggcaaggctgtggagcacgtgtttgaaggagaacatggcaccaaggatgagtggaagggcatggtgctggcccgggcccctgtgatggacacctggttctacatcacctatgagaaggaccctgtgctgtacatgtacaccctgctggatgactacaaggatggagacctgcgcatcatcccagacagcaactactacttccccacagctgagcaggagcctggagaggtggtggacagcctggtgggcaagcaggtggagcacgccaaggatgatggcagcaagaggacaggcatcttcatccaccaggtggtggccaagcccagcgtgtacttcatcaagtttgatgatgacatccacatctacgtgtatggcctggtgaagaccccctag

SEQ ID NO: 42363 - DNA, 696 bp, Artificial Sequence
  Description of Artificial Sequence: Synthetic coding sequence
atgaagaagaggcacacccacaggaagcagaggaggaagcccaccttcctgaccaggaggaacatcgtgggctgccgcatccagcacggctggaaggagggcaatgaacctgtggagcagtggaagggcaccgtgctggagcaggtgtctgtgaagcccaccctgtacatcatcaagtatgatggcaaggacagcgtgtatggcctggagctgcaccgggacaagagggtgctggccctggagatcctgcctgagcgggtgcccaccccaagaattgacagccggctggccgacagcctgattggcaaggctgtggagcacgtgtttgaaggagaacatggcaccaaggatgagtggaagggcatggtgctggcccgggcccctgtgatggacacctggttctacatcacctatgagaaggaccctgtgctgtacatgtacaccctgctggatgactacaaggatggagacctgcgcatcatcccagacagcaactactacttccccacagctgagcaggagcctggagaggtggtggacagcctggtgggcaagcaggtggagcacgccaaggatgatggcagcaagaggacaggcatcttcatccaccaggtggtggccaagcccagcgtgtacttcatcaagtttgatgatgacatccacatctacgtgtatggcctggtgaagaccccctag

SEQ ID NO: 42364 - DNA, 792 bp, Artificial Sequence
  Description of Artificial Sequence: Synthetic coding sequence
atgggccagacagccctggccggcggcagcagcagcacccccaccccccaggccctgtacccagacctgagctgcccagagggcctggaggagctgctgagcgcccctcctccagacctgggcgcccagaggagacatggctggaaccccaaggactgcagtgaaaatattgaggtgaaggagggcggcctgtactttgagcggcggcctgtggcccagagcacagatggagcccggggcaagaggggctacagccggggcctgcacgcctgggagatctcctggcccctggagcagaggggcacccatgctgtggtgggcgtggccacagccctggcccccctgcagacagaccactatgctgccctgctgggcagcaacagcgagagctggggctgggacatcggccggggcaagctgtaccaccagagcaaaggacctggggccccccagtacccagctggcacccagggcgagcagctggaggtgcctgagcggctgctggtggtgctggacatggaggagggcaccctgggctacgccatcggcggcacctacctgggccctgccttccggggcctgaagggccgcaccctgtacccagctgtgtctgctgtgtggggccagtgccaggtgcgcatccgctacctgggggagcggcgggcagagccccacagcctgctgcacctgagccggctgtgtgtgcgccacaacctgggggacacccggctgggccaggtgtctgccctgcccctgcccccagccatgaagcgctacctgctgtaccagtag

SEQ ID NO: 42365 - DNA, 792 bp, Artificial Sequence; identical to SEQ ID NO: 42364
  Description of Artificial Sequence: Synthetic coding sequence

SEQ ID NO: 42366 - DNA, 2424 bp, Artificial Sequence
  Description of Artificial Sequence: Synthetic coding sequence
atgaggctgagccctgcccccctgaagctgagcaggaccccagccctgctggccctggccctgcccctggccgccgccctggccttcagtgatgagaccctggacaaggtgcccaagtctgagggctactgcagccgcatcctgcgggcccagggcacccggcgggagggctacacagagttcagcctgcgggtggagggggaccctgacttctacaagccaggcaccagctacagagtgaccctgtctgctgccccacccagctacttccggggcttcaccctcatcgccctgcgggagaaccgggagggggacaaggaggaggaccatgctggcaccttccagatcattgatgaggaggagacccagttcatgagcaactgccctgtggccgtgacagagagcacccccaggaggaggacccgcatccaggtgttctggatcgcccccccagctggcaccggctgcgtcatcctgaaggccagcatcgtgcagaagaggatcatctacttccaggatgagggcagcctgaccaagaagctgtgtgagcaggacagcacctttgatggagtgacagacaagcccatcctggactgctgtgcctgtggcacagccaagtaccgcctgaccttctacggcaactggagcgagaagacccaccccaaggactacccccggcgggccaaccactggagcgccatcattggaggcagccacagcaagaactacgtgctgtgggagtatggaggctacgccagcgagggcgtgaagcaggtggccgagctgggcagccctgtgaagatggaggaggagatccggcagcagagtgatgaggtgctgaccgtcatcaaggccaaggcccagtggccagcctggcagcccctgaatgtgcgggccgcccccagcgctgagttctctgtggacaggaccaggcacctgatgtccttcctgaccatgatgggccccagcccagactggaatgtgggcctgtctgctgaggacctgtgcaccaaggaatgtggctgggtgcagaaggtggtgcaggacctgatcccctgggatgctggaacagattctggagtgacctatgagagccccaacaagcccaccatcccccaggagaagatccggcccctgaccagcctggaccacccccagagccccttctatgaccctgagggcggcagcatcacccaggtggcccgggtggtgattgagcgcatcgccaggaaaggagagcagtgcaacatcgtgcctgacaacgtggatgacatcgtggccgacctggcccctgaggagaaggatgaagatgacaccccagagacctgcatctacagcaactggagcccctggagcgcctgcagcagcagcacctgtgacaagggcaagaggatgaggcagaggatgctgaaggcccagctggacctgtctgtgccctgcccagacacccaggacttccagccctgcatgggccctggctgcagtgatgaagatggcagcacctgcaccatgtctgagtggatcacctggagcccctgcagcatcagctgtggcatgggcatgaggagccgggagagatatgtgaagcagttcccagaagatggctctgtgtgcaccctgcccacagaggagacagagaagtgcaccgtgaatgaagaatgtagccccagcagctgcctgatgacagagtggggcgagtgggatgaatgttctgccacctgtggcatgggcatgaagaagaggcacaggatgatcaagatgaacccagcagatggctccatgtgcaaggccgagaccagccaggccgagaagtgcatgatgcctgagtgccacaccatcccctgcctgctgagcccctggagcgagtggagcgactgcagcgtgacctgtgggaagggcatgaggacccggcagaggatgctgaagagcctggccgagctgggggactgcaatgaagacctggagcaggtggagaagtgcatgctgcctgagtgccccatcgactgtgagctgacagagtggagccagtggagcgagtgcaacaagagctgtgggaagggccacgtgatccgcaccaggatgatccagatggagccccagtttggaggagccccctgcccagagaccgtgcagaggaagaagtgccgcatcaggaagtgcctgaggaaccccagcatccagaagctgcgctggagggaggcccgggagagccgccgctctgagcagctgaaggaggagagcgagggggagcagtttcctggctgcaggatgaggccctggacagcctggagcgaatgtaccaagctgtgtggcggcggcatccaggagcgctacatgacagtgaagaagcgcttcaagagcagccagttcaccagctgcaaggacaagaaggagatccgggcctgcaatgtgcacccctgctag

SEQ ID NO: 42367 - DNA, 1329 bp, Artificial Sequence
  Description of Artificial Sequence: Synthetic coding sequence
atgaggaggacccggcggcccaggtttgtgctgatgaacaagatggatgacctgaacctgcactaccgcttcctgaactggaggcggcgcatccgggagatccgggaggtgcgggccttccgctaccaggagcgcttcaagcacatcctggtggatggagacaccctgagctaccacggcaacagcggggaggtgggctgctacgtggccagccggcccctgaccaaggacagcaactactttgaggtgtccatcgtggacagcggcgtgcggggcaccatcgctgtgggcctggtgccccagtactacagcctggaccaccagcccggctggctgcctgattctgtggcctaccacgcagatgatggcaagctgtacaacggccgggccaagggccggcagtttggcagcaagtgcaacagcggggacagaattggctgcggcatcgagcctgtgtcctttgatgtgcagacagcccagatcttcttcaccaagaatggcaagagggtgggcagcaccatcatgcccatgagcccagatggcctcttccctgctgtgggcatgcacagcctgggggaggaggtgcggctgcacctgaatgctgagctgggccgggaggatgattctgtgatgatggtggacagctatgaagatgagtggggccgcctgcatgatgtgcgggtgtgtggcaccctgctggagtacctgggcaagggcaagagcatcgtggatgtgggcctggcccaggcccggcaccccctgagcaccaggagccactactttgaggtggagatcgtggaccccggggagaagtgctacatcgccctgggcctggccaggaaggactaccccaagaacagacaccctggctggagccggggctctgtggcctaccacgcagatgatggcaagatcttccacggcagcggcgtgggggaccccttcggcccccgctgctacaagggggacatcatgggctgcggcatcatgttcccccgggactacatcctggacagcgagggggacagtgatgacagctgtgacaccgtcatcctgagccccacagcccgggctgtgagaaatgtgagaaatgtgatgtacctgcaccaggagggggaggaggaggaggaggaggaggaggaggaggaggatggagaggagattgagcctgagcacgagggcaggaaggtggtggtgttcttcaccagaaatggcaagatcatcggcaagaaggatgctgtggtgcccagcggcggcttcttccccaccatcggcatgctgagctgtggggagaaggtgaaggtggacctgcaccccctgtctggatag

SEQ ID NO: 42368 - DNA, 1359 bp, Artificial Sequence
  Description of Artificial Sequence: Synthetic coding sequence
atgaacagcggcatcctgcaggtgttccagagggccctgacctgccccatctgcatgaactacttcctggaccctgtgaccatcgactgtggccacagcttctgccggccctgcctgtacctgaactggcaggacacagctgtgctggcccagtgcagcgagtgcaagaagaccacccggcagaggaacctgaacacagacatctgcctgaagaacatggccttcatcgccaggaaggccagcctgcggcagttcctgagcagcgaggagcagatctgtggcatgcaccgggagaccaagaagatgttctgtgaggtggacaagagcctgctgtgcctgccctgcagcaacagccaggagcacaggaaccacatccactgccccatcgagtgggccgctgaggagcggcgggaggagctgctgaagaagatgcagagcctgtgggagaaggcctgtgagaacctgaggaacctgaacatggagaccaccaggacccgctgctggaaggactatgtgtccctgcgcatcgaggccatccgggcagagtaccagaagatgcctgccttcctgcacgaggaggagcagcaccacctggagcggctgaggaaggagggggaggacatcttccagcagctgaatgaaagcaaggccaggatggagcacagccgggagctgctgcggggcatgtatgaggacctgaagcagatgtgccacaaggcagatgtggagctgctgcaggccttcggggacatcctgcacagatatgagagcctgctgctgcaggtgtctgagcctgtgaaccctgagctgtctgctggccccatcaccggcctgctggacagcctgagcggcttccgggtggacttcaccctgcagcctgagcgggccaacagccacatcttcctgtgtggggacctgcgctccatgaatgtgggctgtgacccccaggatgatcctgacatcaccgggaagtctgagtgcttcctggtgtggggcgcccaggccttcaccagcggcaagtactactgggaggtgcacatgggagacagctggaactgggcctttggagtgtgcaacaactactggaaggagaagaggcagaatgacaagattgatggagaggagggcctcttcctgctgggctgtgtgaaggaggacacccactgcagcctcttcaccaccagccccctggtggtgcagtatgtgccccggcccaccagcacagtgggcctcttcctggactgtgagggccgcacagtgtcctttgtggatgtggaccagagcagcctcatctacaccatccccaactgcagcttcagcccccccctgcggcccatcttctgctgcagccacttctag

SEQ ID NO: 42369 - DNA, 591 bp, Artificial Sequence
  Description of Artificial Sequence: Synthetic coding sequence
atggccacctctgtgctgtgctgcctgcgctgctgcagagatggcggcaccggccacatccccctgaaggagatgcctgctgtgcagctggacacccagcacatgggcacagatgtggtgattgtgaagaatggccgccgcatctgtggcactggaggctgcctggccagcgcccccctgcaccagaacaagagctactttgagttcaagatccagagcacaggcatctggggcattggagtggccacccagaaggtgaacctgaaccagatccccctgggccgggacatgcacagcctggtgatgagaaatgatggagccctgtaccacaacaatgaggagaagaaccggctgcctgccaacagcctgccccaggagggagatgtggtgggcatcacctatgaccacgtggagctgaatgtgtacctgaatggcaagaacatgcactgcccagccagcggcatccggggcaccgtgtaccctgtggtgtatgtggatgacagcgccatcctggactgccagttcagcgagttctaccacaccccacctcctggctttgagaagatcctgtttgagcagcagatcttctag

SEQ ID NO: 42370 - DNA, 474 bp, Artificial Sequence
  Description of Artificial Sequence: Synthetic coding sequence
atggccacctctgtgctgtgctgcctgcgctgctgcagagatggcggcaccggccacatccccctgaaggagatgcctgctgtgcagctggacacccagcacatgggcatctggggcatcggcgtggccacccagaaggtgaacctgaaccagatccccctgggccgggacatgcacagcctggtgatgagaaatgatggagccctgtaccacaacaatgaggagaagaaccggctgcctgccaacagcctgccccaggagggagatgtggtgggcatcacctatgaccacgtggagctgaatgtgtacctgaatggcaagaacatgcactgcccagccagcggcatccggggcaccgtgtaccctgtggtgtatgtggatgattctgccatcctggactgccagttcagcgagttctaccacaccccacctcctggctttgagaagatcctgtttgagcagcagatcttctag

SEQ ID NO: 42371 - DNA, 1059 bp, Artificial Sequence
  Description of Artificial Sequence: Synthetic coding sequence
atggacttccgggagatcctgatgattgccagcaagggccagggcgtgaacaacgtgcccaagcgctacagcctggccgtgggcccccccaagaaggaccccaaggtgaagggcgtgcagagcgctgctgtgcaggccttcctgaagaggaaggaggaggagctgcggaggaaggccctggaggagaagaggaggaaggaggagctggtgaagaagagaattgagctgaagcatgacaagaaggcccgggccatggccaagaggaccaaggacaacttccacggctacaacggcatccccatcgaggagaagagcaagaagaggcaggccacagagagccacaccagccagggcacagaccgggagtatgagatggaggaggagaatgagttcctggagtacaaccacgccgagagcgagcaggagtatgaggaggagcaggagccccccaaggtggagagcaagcccaaggtgcccctgaagagcgcccccccacccatgaacttcacagacctgctgcggctggccgagaagaagcagtttgagcctgtggagatcaaggtggtgaagaagtctgaggagcggcccatgacagctgaggagctgcgggagcgggagttcctggagaggaagcacaggaggaagaagctggagacagatggcaagctgccccccaccgtgtccaagaaggcccccagccagaaggagagcgtgggcaccaagctgagcaagggcagcggggacagacaccccagcagcaagggcatgcccctgccccatgctgagaagaagagccggcccagcatggccaatgagaagcacctggccctgagcagcagcaagtccatgcctggagagcgcatcaaggccggcagcggcaacagcagccagcccagcctgcgggagggccatgacaagcctgtgttcaacggggccggcaagccccacagcagcaccagcagccccaagcacgtgtggaaggagaacaagtacatgaagagggactggctgttctacttccagtgcatcgagtacatccggctgctcttcatcttctag

SEQ ID NO: 42372 - DNA, 2058 bp, Artificial Sequence
  Description of Artificial Sequence: Synthetic coding sequence
atggacttccgggagatcctgatgattgccagcaagggccagggcgtgaacaacgtgcccaagcgctacagcctggccgtgggcccccccaagaaggaccccaaggtgaagggcgtgcagagcgctgctgtgcaggccttcctgaagaggaaggaggaggagctgcggaggaaggccctggaggagaagaggaggaaggaggagctggtgaagaagagaattgagctgaagcatgacaagaaggcccgggccatggccaagaggaccaaggacaacttccacggctacaacggcatccccatcgaggagaagagcaagaagaggcaggccacagagagccacaccagccagggcacagaccgggagtatgagatggaggaggagaatgagttcctggagtacaaccacgccgagagcgagcaggagtatgaggaggagcaggagccccccaaggtggagagcaagcccaaggtgcccctgaagagcgcccccccacccatgaacttcacagacctgctgcggctggccgagaagaagcagtttgagcctgtggagatcaaggtggtgaagaagtctgaggagcggcccatgacagctgaggagctgcgggagcgggagttcctggagaggaagcacaggaggaagaagctggagacagatggcaagctgccccccaccgtgtccaagaaggcccccagccagaaggagagcgtgggcaccaagctgagcaagggcagcggggacagacaccccagcagcaagggcatgcccctgccccatgctgagaagaagagccggcccagcatggccaatgagaagcacctggccctgagcagcagcaagtccatgcctggagagcgcatcaaggccggcagcggcaacagcagccagcccagcctgcgggagggccatgacaagcctgtgttcaacggggccggcaagccccacagcagcaccagcagccccagcgtgcccaagaccagcgccagcaggacccagaagtctgctgtggagcacaaggccaagaagagcctgagccaccccagccacagcaggcctggccccatggtgaccccccacaacaaggccaagagccctggggtgcggcagcccggcagcagcagcagcagcgcccctggccagcccagcactggagtggcccggcccaccgtgagcagcggccctgtgccccggcggcagaatggcagcagcagcagcggccctgagaggagcatcagcggcagcaagaagcccaccaatgacagcaaccccagcagaagaacagtgtctggcacctgtggccctggccagcctgccagcagcagcggcggccctggccggcccatcagcggctctgtgtcctctgcccggcccctgggcagcagccggggccctggccggcctgtgagcagcccccatgagctgcggcggcctgtgtctggcctgggccccccaggccgctctgtgtctggccctggccgcagcatcagcggcagcatcccagctggccgcacagtgagcaacagcgtgcccggccggcctgtgagcagcctgggccctggccagacagtgagcagcagcggccccaccatcaagcccaagtgcaccgtggtgtctgagaccatcagcagcaagaacatcatcagccgcagcagcaatggccagatgaatggcatgaagccacccctgagcggctaccgggccgcccagggcccccagaggctgcccttccccaccggctacaagaggcagcgggagtatgaggaggaggatgatgatgatgatgaatatgattctgagatggaggacttcattgaagatgaaggagagccccaggaggagatcagcaagcacatccgggagatcttcggctatgacaggaagaagtacaaggatgaaagtgactatgccctgcgctacatggagagctcctggaaggagcagcagaaggaggaggccaagagcctgcggctgggcatgcaggaggacctggaggagatgaggcgggaggaggaggagatgcagaggagaagagccaagaagctgaagagaagatag

SEQ ID NO: 42373 - DNA, 1488 bp, Artificial Sequence
  Description of Artificial Sequence: Synthetic coding sequence
atgcagtggagccccacccctggggccagcgcctgcctgggctgggccagcagcctggcctgcagcacagcccccaccctgctgggccgggccggccggggccccctgatggccgccaagtggttcaaggagttccccctgaacctgaagacagtgtctgagcgggccaagccaggcggcggcggcggcaagctgaggaagaacagcgaggccggcggggccggccctggccctgggaagggcaggaagaacagcgctgctgagctgggcagcggccgggccggcgtgggccccaaggacagccggctgagccgggacagcctgcagggcctcatccaggccgccgccggcaagggcaggaagaacagccgggccacagaggaggagccccacagaggagccaccaagagcagcggctgcagcacctacatcaacagactcatcaaggtggacacccaggagaagaatggcaagagcaactaccccagcagcagcagcagcagcagcagcagcagcagcagcgccagcagcagccccagcagcctgggccctgagctggacaagggcaagatcatcaagcagcaggagaccgtcatcatcctggaggactatgctgacccctatgatgccaagaggaccaagggccagagagatgctgagcgggtgggggagaatgatggctacatggagccctatgatgcccagcagatgatcacagagatcagaagaagaggcagcaaggaccccctggtgaaggccctgcagctgctggacagcccctgtgagccagcagatggcggcctgaagtctgagaccctggccaagaggaggagcagcaaggacctgctgggcaagccaccccagctgtatgacaccccctatgagcctgctgagggcggccccagggctgagggcaaggcccggcccccagacagccggctgcctgaaaatgatgagaggcctgctgctgaatatgagcagccctgggagtggaagaaggagcagatcgtgcgggccctgtctgtgcagtttgagggcgctgagcggcccagcttccgggaggagaccgtgcggcagcaccaccggcagaagtcctggacccagaagatcctgaagccagccctgagtgaccacagcgagggggagaaggtggaccccggcctgcccctggagaagcagccctggtaccatggagccatcagcagagctgaggccgagagccggctgcagccctgcaaggaggccggctacctggtgaggaacagcgagagcggcaacagccgctacagcatcgccctgaagaccagccagggctgtgtgcacatcatcgtggcccagaccaaggacaacaagtacaccctgaaccagaccagcgctgtgtttgacagcatccctgaggtggtgcactactacagcaatgagaagctgcccttcaagggagctgagcacatgaccctgctgtaccctgtgcacagcaagctgcactag

SEQ ID NO: 42374 - DNA, 1272 bp, Artificial Sequence
  Description of Artificial Sequence: Synthetic coding sequence
atgcagcaggagggcggccctgtgcgcagcgccccctgcaggacaggcaccctggagggcagccggcagggcagccctggccacaggaagagggccagccccaagggcagcctgagcagcgcccagccccacagctggatgctgacccccagccccctgaacagccactgtgcccaccgggagcccatcagcagcagcccccagcctgtggccaacggccccaagcagaagaagaagagcaactggaggagcaccacccggctgcgcatcatccggctgcgggaccggctggagccccggcccctggccatcctggaggactatgctgacccctttgatgtgcaggagactggagagggcagcgctggggccagcggggcccctgagaaggtgcctgaaaatgatggctacatggagccctatgaggcccagaagatgatggccgagatccggggcagcaaggagacagccacccagcccctgcccctgtatgacaccccctatgagcctgaggaggatggagccacagctgagggggagggcgccccctggccccgggagagccggctgcctgaagatgatgagaggcctcctgaggagtatgaccagccctgggagtggaagaaggagcgcatcagcaaggcctttgctgtggacatcaaggtgatcaaggacctgccctggcccccacctgtgggccagctggacagcagccccagcctgcctgatggagaccgggacatcagcggccctgccagccccctgcctgagcccagcctggaggacagcagcgcccagtttgagggccctgagaagagctgcctgagccctggccgggaggagaagggccgcctgcccccccggctgtctgctggcaaccccaagagcgccaagcccctgtccatggagcccagcagccccctgggggagtggacagatcctgccctgcccctggagaaccaggtgtggtaccatggagccatcagcaggacagatgctgagaacctgctgcggctgtgcaaggaggccagctacctggtgaggaacagcgagaccagcaagaatgacttcagcctgagcctgaagagcagccagggcttcatgcacatgaagctgagcaggaccaaggagcacaagtatgtgctgggccagaacagcccccccttcagctctgtgcctgagatcgtgcaccactacgccagcaggaagctgcccatcaagggagctgagcacatgagcctgctgtaccctgtggccatccgcaccctgtag

SEQ ID NO: 42375 - DNA, 1302 bp, Artificial Sequence
  Description of Artificial Sequence: Synthetic coding sequence
atggtggcccagagcctgagtgatgcccaccacgccctgaccatcatgctgtctgagcggctgtggctgggcctggagctgctgaacttcaccaggaggaagatcagcagtgaccccccaccctacaacttcctggaggcccgggaggccgccctgggccaccgctggaggatgcagcaggagggcggccctgtgcgcagcgccccctgcaggacaggcaccctggagggcagccggcagggcagccctggccacaggaagagggccagccccaagggcagcctgagcagcgcccagccccacagctggatgctgacccccagccccctgaacagccactgtgcccaccgggagcccatcagcagcagcccccagcctgtggccaacggccccaagcagaagaagaagagcaactggaggagcaccacccggctgcgcatcatccggctgcgggaccggctggagccccggcccctggccatcctggaggactatgctgacccctttgatgtgcaggagaccggggagggcagcgctggggccagcggggcccctgagaaggtgcctgaaaatgatggctacatggagccctatgaggcccagaagatgatggccgagatccggggcagcaaggagacagccacccagcccctgcccctgtatgacaccccctatgagccagaagaagatggagccacagctgagggggagggcgccccctggccccgggagagccggctgcctgaagatgatgagcggcccccagaggagtatgaccagccctgggagtggaagaaggagcgcatcagcaaggcctttgctgcccagtttgagggccctgagaagagctgcctgagccctggccgggaggagaagggccgcctgcccccccggctgtctgctggcaaccccaagagcgccaagcccctgtccatggagcccagcagccccctgggggagtggacagatcctgccctgcccctggagaaccaggtgtggtaccatggagccatcagcaggacagatgctgagaacctgctgcggctgtgcaaggaggccagctacctggtgaggaacagcgagaccagcaagaatgacttcagcctgagcctgaagagcagccagggcttcatgcacatgaagctgagcaggaccaaggagcacaagtatgtgctgggccagaacagcccccccttcagctctgtgcctgagatcgtgcaccactacgccagcaggaagctgcccatcaagggagctgagcacatgagcctgctgtaccctgtggccatccgcaccctgtag

SEQ ID NO: 42376 - DNA, 1110 bp, Artificial Sequence
  Description of Artificial Sequence: Synthetic coding sequence
atgcagcaggagggcggccctgtgcgcagcgccccctgcaggacaggcaccctggagggcagccggcagggcagccctggccacaggaagagggccagccccaagggcagcctgagcagcgcccagccccacagctggatgctgacccccagccccctgaacagccactgtgcccaccgggagcccatcagcagcagcccccagcctgtggccaacggccccaagcagaagaagaagagcaactggaggagcaccacccggctgcgcatcatccggctgcgggaccggctggagccccggcccctggccatcctggaggactatgctgacccctttgatgtgcaggagactggagagggcagcgctggggccagcggggcccctgagaaggtgcctgaaaatgatggctacatggagccctatgaggcccagaagatgatggccgagatccggggcagcaaggagacagccacccagcccctgcccctgtatgacaccccctatgagcctgaggaggatggagccacagctgagggggagggcgccccctggccccgggagagccggctgcctgaagatgatgagaggcctcctgaggagtatgaccagccctgggagtggaagaaggagcgcatcagcaaggcctttgctgtggacatcaaggtgatcaaggacctgccctggcccccacctgtgggccagctggacagcagccccagcctgcctgatggagaccgggacatcagcggccctgccagccccctgcctgagcccagcctggaggacagcagcgcccagtttgagggccctgagaagagctgcctgagccctggccgggaggagaagggccgcctgcccccccggctgtctgctggcaaccccaagagcgccaagcccctgtccatggagcccagcagccccctgggggagtggacagatcctgccctgcccctggagaaccaggtgtggtaccatggagccatcagcaggacagatgctgagaacctgagcggctgtgccaagaggcctgccacctggtgtgccaccgtgcggcctgccaggatgaccagccccagccccagcagagctgcccgggacagctgcacctag

SEQ ID NO: 42377 - DNA, 1101 bp, Artificial Sequence
  Description of Artificial Sequence: Synthetic coding sequence
atgctgctgagcggggcccctcctgctgcccccccagcccctcctccagacatcctggccgcctaccgcctgcagcgggagcgggactttgaggacccctacagcggcggcagcagcggcagcgctgccctggccacccctgtggcccctggccccaccccaccacccaggcatggcagccccccccacaggctcatccgggtggagaccccaggccccccagcccccccagcagatgagcgcatcagcggccccccagccagcagtgaccggctggccatcctggaggactatgctgacccctttgatgtgcaggagactggagagggcagcgctggggccagcggggcccctgagaaggtgcctgaaaatgatggctacatggagccctatgaggcccagaagatgatggccgagatccggggcagcaaggagacagccacccagcccctgcccctgtatgacaccccctatgagcctgaggaggatggagccacagctgagggggagggcgccccctggccccgggagagccggctgcctgaagatgatgagaggcctcctgaggagtatgaccagccctgggagtggaagaaggagcgcatcagcaaggcctttgctgcccagtttgagggccctgagaagagctgcctgagccctggccgggaggagaagggccgcctgcccccccggctgtctgctggcaaccccaagagcgccaagcccctgtccatggagcccagcagccccctgggggagtggacagatcctgccctgcccctggagaaccaggtgtggtaccacggggccatcagcaggacagatgctgagaacctgctgcggctgtgcaaggaggccagctacctggtgagaaattctgagaccagcaagaatgacttcagcctgagcctgaagagcagccagggcttcatgcacatgaagctgagcaggaccaaggagcacaagtatgtgctgggccagaacagcccccccttcagctctgtgcctgagatcgtgcaccactacgccagcaggaagctgcccatcaagggagctgagcacatgagcctgctgtaccctgtggccatccgcaccctgtag

SEQ ID NO: 42378 - DNA, 690 bp, Artificial Sequence
  Description of Artificial Sequence: Synthetic coding sequence
atgaccccccagctgctgctggccctggtgctgtgggccagctgccccccctgcagcggcaggaagggccccccagctgccctgaccctgccccgggtgcagtgccgggccagccgctaccccatcgctgtggactgctcctggaccctgcccccagcccccaacagcaccagccctgtgtccttcatcgccacctaccgcctgggcatggccgcccggggccacagctggccctgcctgcagcagacccccaccagcaccagctgcaccatcacagatgtgcagctgttctccatggccccctacgtgctgaatgtgacagctgtgcacccctggggcagcagcagcagctttgtgcccttcatcacagagcacatcatcaagccagaccccccagagggcgtgcggctgagccccctggccgagcggcagctgcaggtgcagtgggagcccccaggctcctggcccttccctgagatcttcagcctgaagtactggatccgctacaagaggcagggcgccgcccgcttccaccgggtgggccccatcgaggccaccagcttcatcctgcgggctgtgcggccccgggcccgctactacgtgcaggtggccgcccaggacctgacagattatggagagctgagtgactggagcctgcctgccacagccaccatgagcctgggcaagtag

SEQ ID NO: 42379 - DNA, 1023 bp, Artificial Sequence
  Description of Artificial Sequence: Synthetic coding sequence
atggccaagtggctgcgggactacctgagctttggaggccggcggcccccaccccagccccccaccccagactacacagaaagtgacatcctgcgggcctaccgggcccagaagaacctggactttgaggacccctatgaagatgctgagagccggctggagccagaccctgctggccctggggacagcaagaaccctggagatgccaagtatggcagccccaagcacaggctcatcaaggtggaggccgctgacatggcccgggccaaggccctgctgggcggccctggagaggagctggaggccgacacagagtacctggacccctttgatgcccagccccacccagcccccccagatgatggctacatggagccctatgatgcccagtgggtgatgtctgagctgcccggccggggcgtgcagctgtatgacaccccctatgaggagcaggaccctgagacagcagatggccccccatctggccagaagccccggcagagcaggatgccccaggaggatgagaggcctgcagatgaatatgaccagccctgggagtggaagaaggaccacatcagccgggcctttgctgtgcagtttgacagccctgagtgggagaggaccccaggcagcgccaaggagctgcggcggcccccacccaggagcccccagcctgctgagcgggtggaccctgccctgcccctggagaagcagccctggttccacggccccctgaacagagcagatgctgagagcctgctgagcctgtgcaaggagggcagctacctggtgcggctgtctgagaccaacccccaggactgcagcctgagcctgcggagcagccagggcttcctgcacctgaagtttgcccggacccgggagaaccaggtggtgctgggccagcacagcggccccttccccagcgtgcctgagctggtgctgcactacagcagccggcccctgcctgtgcagggcgctgagcacctggccctgctgtaccctgtggtgacccagaccccctag

SEQ ID NO: 42380 - DNA, 3552 bp, Artificial Sequence
  Description of Artificial Sequence: Synthetic coding sequence
atgggaaatgcccccagccaggaccctgagaggagcagcccccccatgctgtctgcagatgatgctgagtacccccgggagtaccgcaccctgggcggcggcggcggcggcggcagcggcggccgccgcttcagcaatgtgggcctggtgcacaccagcgagaggaggcacacagtgattgctgcccagagcctggaggccctgagcggcctgcagaaggcagatgctgacaggaagagagatgccttcatggaccacctgaagagcaagtacccccagcacgccctggccctgcggggccagcaggacaggatgagggagcagcccaactactggagcttcaagaccaggagcagccgccacacccagggcgcccagcccggcctggccgaccaggccgccaagctgtcctatgccagcgctgagagcctggagaccatgtctgaggccgagctgcccctgggcttcagcaggatgaaccgcttccggcagagcctgcccctgagccgcagcgccagccagaccaagctgcggagccctggggtgctcttcctgcagtttggagaggagacccggcgggtgcacatcacccatgaggtgagcagcctggacaccctgcacgccctgattgcccacatgttcccccagaagctgaccatgggcatgctgaagagccccaacacagccatcctgatcaaggatgaggccagaaatgtgttctatgagctggaggatgtgcgggacatccaggacaggagcatcatcaagatctacaggaaggagcccctgtatgctgccttccctggcagccacctgaccaacggggacctgcggcgggagatggtgtatgccagccgggagagcagccccacccggcggctgaacaacctgagccctgccccccacctggccagcggcagccccccacctggcctgcccagcggcctgcccagcggcctgcagagcggcagccccagccgcagccggctgtcctatgccggcggccggcccccatcctatgccggcagccctgtgcaccacgccgctgagcggctgggcggggccccagctgcccagggcgtgagccccagccccagcgccatcctggagaggagagatgtgaagccagatgaggacctggccagcaaggccggcggcatggtgctggtgaagggggagggcctgtatgctgacccctacggcctgctgcacgagggccgcctgagcctggccgctgctgctggggacccctttgcctacccaggagctgggggcctgtacaagaggggctctgtgcgcagcctgagcacctacagcgctgctgccctgcagagcgacctggaggacagcctgtacaaggctgctgggggcggcggccccctgtatggagatggctacggcttccggctgccccccagcagcccccagaagctggctgatgtggccgcccctcctgggggccccccaccaccccacagcccctacagcggcccccccagccggggcagccctgtgcggcagagcttcaggaaggacagcggcagcagctctgtgtttgctgagagccctgggggcaagaccaggtctgctggcagcgccagcacagctggggcccctccttctgagctgtttcctggccctggagagaggagcctggtgggctttggacctcctgtgcctgccaaggacacagagacccgggagaggatggaggccatggagaagcagatcgccagcctgaccggcctggtgcagagcgccctgctgcggggcagcgagcctgagacccccagcgagaagattgagggcagcaatggagctgccaccccatctgccccctgtggcagcggcggccgcagcagcggggccacccctgtgtctggccccccacctccttctgccagcagcaccccagctggccagcccacagctgtgtcccggctgcagatgcagctgcacctgcggggcctgcagaacagcgccagtgacctgcggggccagctgcagcagctgaggaagctgcagctgcagaaccaggagagcgtgcgggccctgctgaagaggacagaagctgagctgtccatgagggtgtctgaggccgcccggcggcaggaggaccccctgcagaggcagaggaccctggtggaggaggagcggctgcgctacctgaatgatgaggagctgatcacccagcagctgaatgacctggagaagtctgtggagaagatccagagagatgtgagccacaaccaccggctggtgcccggccctgagctggaggagaaggccctggtgctgaagcagctgggggagaccctgacagagctgaaggcccacttccctggcctgcagagcaagatgagggtggtgctgcgggtggaggtggaggccgtgaagttcctgaaggaggagccccagaggctggatggcctgctgaagcgctgccggggcgtgacagacaccctggcccagatccggcggcaggtggatgagggcgtgtggcccccacccaacaacctgctgagccagagccccaagaaggtgacagctgagacagacttcaacaagtctgtggactttgagatgcccccacccagcccccccctgaacctgcacgagctgagcggccctgctgagggcgccagcctgacccccaagggcggcaaccccaccaagggcctggacaccccaggcaagaggtctgtggacaaggctgtgtctgtggaggccgctgagcgggactgggaggagaagagagctgccctgacccagtacagcgccaaggacatcaaccggctgctggaggagacccaggccgagctgctgaaggccatcccagacctggactgtgccagcaaggcccaccctggccctgcccccaccccagaccacaagccacccaaggcccctcatggccagaaggccgcccccaggacagagcccagcggccggcggggcagtgatgagctgactgtgccccgctacagaacagagaagcccagcaagagccccccacctcctccaccccggcgctccttccccagcagccacggcctgaccaccaccaggactggagaggtggtggtgaccagcaagaaggacagcgccttcatcaagaaggccgagagcgaggagctggaggtgcagaagccccaggtgaagctgcggcgggctgtgtctgaggtggcccggcctgccagcaccccacccatcatggccagcgccatcaaggatgaagatgatgaggaccgcatcatcgccgagctggagagcggcggcggctctgtgccccccatgaaggtggtgacccctggggccagccggctgaaggccgcccagggccaggccggcagcccagacaagagcaagcacggcaagcagagagctgagtacatgaggatccaggcccagcagcaggccaccaagcccagcaaggagatgagcggcagcaatgagaccagcagccctgtgtctgagaagcccagcgccagcaggaccagcatccctgtgctgaccagctttggagccaggaacagcagcatctccttctag

SEQ ID NO: 42381 - DNA, 3108 bp, Artificial Sequence
  Description of Artificial Sequence: Synthetic coding sequence
atgtctgaggccgagctgcccctgggcttcagcaggatgaaccgcttccggcagagcctgcccctgagccgcagcgccagccagaccaagctgcggagccctggggtgctcttcctgcagtttggagaggagacccggcgggtgcacatcacccatgaggtgagcagcctggacaccctgcacgccctgattgcccacatgttcccccagaagctgaccatgggcatgctgaagagccccaacacagccatcctgatcaaggatgaggccagaaatgtgttctatgagctggaggatgtgcgggacatccaggacaggagcatcatcaagatctacaggaaggagcccctgtatgctgccttccctggcagccacctgaccaacggggacctgcggcgggagatggtgtatgccagccgggagagcagccccacccggcggctgaacaacctgagccctgccccccacctggccagcggcagccccccacctggcctgcccagcggcctgcccagcggcctgcagagcggcagccccagccgcagccggctgtcctatgccggcggccggcccccatcctatgccggcagccctgtgcaccacgccgctgagcggctgggcggggccccagctgcccagggcgtgagccccagccccagcgccatcctggagaggagagatgtgaagccagatgaggacctggccagcaaggccggcggcatggtgctggtgaagggggagggcctgtatgctgacccctacggcctgctgcacgagggccgcctgagcctggccgctgctgctggggacccctttgcctacccaggagctgggggcctgtacaagaggggctctgtgcgcagcctgagcacctacagcgctgctgccctgcagagcgacctggaggacagcctgtacaaggctgctgggggcggcggccccctgtatggagatggctacggcttccggctgccccccagcagcccccagaagctggctgatgtggccgcccctcctgggggccccccaccaccccacagcccctacagcggcccccccagccggggcagccctgtgcggcagagcttcaggaaggacagcggcagcagctctgtgtttgctgagagccctgggggcaagaccaggtctgctggcagcgccagcacagctggggcccctccttctgagctgtttcctggccctggagagaggagcctggtgggctttggacctcctgtgcctgccaaggacacagagacccgggagaggatggaggccatggagaagcagatcgccagcctgaccggcctggtgcagagcgccctgctgcggggcagcgagcctgagacccccagcgagaagattgagggcagcaatggagctgccaccccatctgccccctgtggcagcggcggccgcagcagcggggccacccctgtgtctggccccccacctccttctgccagcagcaccccagctggccagcccacagctgtgtcccggctgcagatgcagctgcacctgcggggcctgcagaacagcgccagtgacctgcggggccagctgcagcagctgaggaagctgcagctgcagaaccaggagagcgtgcgggccctgctgaagaggacagaagctgagctgtccatgagggtgtctgaggccgcccggcggcaggaggaccccctgcagaggcagaggaccctggtggaggaggagcggctgcgctacctgaatgatgaggagctgatcacccagcagctgaatgacctggagaagtctgtggagaagatccagagagatgtgagccacaaccaccggctggtgcccggccctgagctggaggagaaggccctggtgctgaagcagctgggggagaccctgacagagctgaaggcccacttccctggcctgcagagcaagatgagggtggtgctgcgggtggaggtggaggccgtgaagttcctgaaggaggagccccagaggctggatggcctgctgaagcgctgccggggcgtgacagacaccctggcccagatccggcggcaggtggatgagggcgtgtggcccccacccaacaacctgctgagccagagccccaagaaggtgacagctgagacagacttcaacaagtctgtggactttgagatgcccccacccagcccccccctgaacctgcacgagctgagcggccctgctgagggcgccagcctgacccccaagggcggcaaccccaccaagggcctggacaccccaggcaagaggtctgtggacaaggctgtgtctgtggaggccgctgagcgggactgggaggagaagagagctgccctgacccagtacagcgccaaggacatcaaccggctgctggaggagacccaggccgagctgctgaaggccatcccagacctggactgtgccagcaaggcccaccctggccctgcccccaccccagaccacaagccacccaaggcccctcatggccagaaggccgcccccaggacagagcccagcggccggcggggcagtgatgagctgactgtgccccgctacagaacagagaagcccagcaagagccccccacctcctccaccccggcgctccttccccagcagccacggcctgaccaccaccaggactggagaggtggtggtgaccagcaagaaggacagcgccttcatcaagaaggccgagagcgaggagctggaggtgcagaagccccaggtgaagctgcggcgggctgtgtctgaggtggcccggcctgccagcaccccacccatcatggccagcgccatcaaggatgaagatgatgaggaccgcatcatcgccgagctggaggtgtttgagaggagctctgtgagcagcctgccccccaccccccggcggcagctgatccccaccctgctgagcccccaggacctgggccccccaggcggcagcgcccctggccccaccaggaagagcggcggcggctctgtgccccccatgaaggtggtgacccctggggccagccggctgaaggccgcccagggccaggccggcagcccagacaagagcaagcacggcaagcagagagctgagtacatgaggatccaggcccagcagcaggtgtag

SEQ ID NO: 42382 - DNA, 2766 bp, Artificial Sequence
  Description of Artificial Sequence: Synthetic coding sequence
atgggcatgctgaagagccccaacacagccatcctgatcaaggatgaggccagaaatgtgttctatgagctggaggatgtgcgggacatccaggacaggagcatcatcaagatctacaggaaggagcccctgtatgctgccttccctggcagccacctgaccaatggagacctgcggcgggagatggtgtatgccagccgggagagcagccccacccggcggctgaacaacctgagccctgccccccacctggccagcggcagccccccacctggcctgcccagcggcctgcccagcggcctgcagagcggcagccccagccgcagccggctgtcctatgctgggggccggccccccagctatgccggcagccctgtgcaccacgccgctgagcggctgggcggggccccagctgcccagggcgtgagccccagccccagcgccatcctggagaggagagatgtgaagccagatgaggacctggccagcaaggccggcggcatggtgctggtgaagggggagggcctgtatgctgacccctacggcctgctgcacgagggccgcctgagcctggccgctgctgctggggacccctttgcctacccaggggccggcggcctgtacaagaggggctctgtgcgcagcctgagcacctacagcgctgctgccctgcagagcgacctggaggacagcctgtacaaggccgccggcggcggcggccccctgtatggagatggctacggcttccggctgccccccagcagcccccagaagctggctgatgtggccgcccctcctgggggccccccaccaccccacagcccctacagcggcccccccagccggggcagccctgtgcggcagagcttcaggaaggacagcggcagcagctctgtgtttgctgagagccctgggggcaagaccaggtctgctggcagcgccagcacagctggggccccacccagcgagctgtttcctggccctggagagaggagcctggtgggcttcggcccccctgtgcctgccaaggacacagagacccgggagaggatggaggccatggagaagcagatcgccagcctgaccggcctggtgcagagcgccctgctgcggggcagcgagcctgagaccccatctgagaagattgagggcagcaatggagctgccacccccagcgccccctgtggcagcggcggccgcagcagcggggccacccctgtgtctggccccccaccacccagcgccagcagcaccccagctggccagcccacagctgtgtcccggctgcagatgcagctgcacctgcggggcctgcagaacagcgccagtgacctgcggggccagctgcagcagctgaggaagctgcagctgcagaaccaggagagcgtgcgggccctgctgaagaggacagaggccgagctgtccatgagggtgtctgaggccgcccggcggcaggaggaccccctgcagaggcagaggaccctggtggaggaggagcggctgcgctacctgaatgatgaggagctgatcacccagcagctgaatgacctggagaagtctgtggagaagatccagagagatgtgagccacaaccaccggctggtgcccggccctgagctggaggagaaggccctggtgctgaagcagctgggggagaccctgacagagctgaaggcccacttccctggcctgcagagcaagatgagggtggtgctgcgggtggaggtggaggccgtgaagttcctgaaggaggagccccagaggctggatggcctgctgaagcgctgccggggcgtgacagacaccctggcccagatccggcggcaggtggatgaaggagtgtggcccccacccaacaacctgctgagccagagccccaagaaggtgacagctgagacagacttcaacaagtctgtggactttgagatgcccccacccagcccccccctgaacctgcacgagctgagcggccctgctgagggcgccagcctgacccccaagggcggcaaccccaccaagggcctggacacccctgggaagaggtctgtggacaaggctgtgtctgtggaggccgctgagcgggactgggaggagaagagagctgccctgacccagtacagcgccaaggacatcaaccggctgctggaggagacccaggccgagctgctgaaggccatcccagacctggactgtgccagcaaggcccaccctggccctgcccccaccccagaccacaagccacccaaggccccccacggccagaaggccgcccccaggacagagcccagcggcagaagaggaagtgatgagctgactgtgccccgctacagaacagagaagcccagcaagagccccccacctcctcctccaagaagaagcttccccagcagccacggcctgaccaccaccaggactggagaggtggtggtgaccagcaagaaggacagcgccttcatcaagaaggccgagagcgaggagctggaggtgcagaagccccaggtgaagctgcggcgggctgtgtctgaggtggcccggcctgccagcaccccacccatcatggccagcgccatcaaggatgaagatgatgaagatcgcatcatcgccgagctggagagcggcggcggctctgtgccccccatgaaggtggtgacccctggggccagccggctgaaggccgcccagggccaggccggcagcccagacaagagcaagcacggcaagcagagagctgagtacatgaggatccaggcccagcagcaggtgtag

SEQ ID NO: 42383 - DNA, 1356 bp, Artificial Sequence
  Description of Artificial Sequence: Synthetic coding sequence
atggtgtcccgggaccaggcccacctgggccccaagtatgtgggcctgtgggacttcaagagcaggacagatgaggagctgtccttccgggctggagatgtgttccacgtggccaggaaggaggagcagtggtggtgggccaccctgctggatgaagctggaggagctgtggcccagggctacgtgccccacaactacctggccgagcgggagaccgtggagagcgagccctggttcttcggctgcatcagccgctctgaggccgtgcggcggctgcaggccgagggcaatgccactggagccttcctgatccgggtgtctgagaagcccagcgctgactatgtgctgtctgtgcgggacacccaggccgtgcgccactacaagatctggaggagagctgggggccgcctgcacctgaatgaggccgtgtccttcctgagcctgcctgagctggtgaactaccaccgggcccagagcctgagccacggcctgcggctggccgccccctgcaggaagcatgagcctgagcccctgccccactgggatgactgggagcggccccgggaggagttcaccctgtgcaggaagctgggcagcggctactttggagaggtgtttgagggcctgtggaaggacagagtgcaggtggccatcaaggtgatcagccgggacaacctgctgcaccagcagatgctgcagagcgagatccaggccatgaagaagctgcggcacaagcacatcctggccctgtatgctgtggtgtctgtgggggaccctgtgtacatcatcacagagctgatggccaagggcagcctgctggagctgctgcgggacagtgatgagaaggtgctgcctgtgtctgagctgctggacatcgcctggcaggtggccgagggcatgtgctacctggagagccagaactacatccaccgggacctggccgccaggaacatcctggtgggggagaacaccctgtgcaaggtgggggactttggcctggcccggctcatcaaggaggatgtgtacctgagccatgaccacaacatcccctacaagtggacagcccctgaggccctgagccggggccactacagcaccaagagtgatgtgtggagctttggcatcctgctgcacgagatgttcagccggggccaggtgccctacccaggcatgagcaaccacgaggccttcctgcgggtggatgctggctacaggatgccctgccccctggagtgccccccatctgtgcacaagctgatgctgacctgctggtgccgggaccctgagcagaggccctgcttcaaggccctgcgggagcggctgagcagcttcaccagctatgagaaccccacctag

SEQ ID NO: 42384 - DNA, 468 bp, Artificial Sequence
  Description of Artificial Sequence: Synthetic coding sequence
atggctgtgcccggctgcaacaaggacagcgtgcgggccggctgcaagaagtgtggctacccaggccacctgacctttgaatgtagaaacttcctgcgggtggaccccaagagggacatcgtgctggatgtgagcagcaccagcagcgaggacagtgatgaagaaaatgaggagctgaacaagctgcaggccctgcaggagaagaggatcaatgaggaggaggagaagaagaaggagaagagcaaggagaagatcaagctgaagaagaagaggaagaggagctacagcagcagcagcacagaggaggacaccagcaagcagaagaagcagaagtaccagaagaaggagaagaagaaggagaagaagagcaagagcaagaagggcaagcaccacaagaaggagaagaagaagaggaagaaggagaagcacagcagcacccccaacagcagcgagttcagcaggaagtag

SEQ ID NO: 42385 - DNA, 1704 bp, Artificial Sequence
  Description of Artificial Sequence: Synthetic coding sequence
atgtctgccagcactggaggcggcggggacagcggcggcagcggcggcagcagcagcagcagccaggccagctgtggccctgagagcagcggcagcgagctggccctggccacccctgtgccccagatgctgcagggcctgctgggcagtgatgatgaggagcaggaggaccccaaggactactgcaagggcggctaccaccctgtgaagattggagatgtgttcaacggccgctaccacgtggtgaggaagctgggctggggccacttcagcacagtgtggctgtgctgggacatccagaggaagagatttgtggccctgaaggtggtgaagtctgctggccactacacagaaacagctgtggatgagatcaagctgctgaagtgtgtgcgggacagcgaccccagcgaccccaagcgggagaccatcgtgcagctgattgatgacttccgcatctctggagtgaatggagtgcacgtgtgcatggtgctggaggtgctgggccaccagctgctgaagtggatcatcaagagcaactaccagggcctgcctgtgccctgtgtgaagagcatcgtgcggcaggtgctgcacggcctggactacctgcacaccaagtgcaagatcatccacacagacatcaagccagagaacatcctgctgtgtgtgggagatgcctacatccggcggctggccgctgaggccacagagtggcagcaggccggggcccccccacccagccgcagcatcgtgtccacagccccccaggaggtgctgcagacaggcaagctgagcaagaacaagaggaagaagatgaggaggaagaggaagcagcagaagaggctgctggaggagcggctgcgggacctgcagaggctggaggccatggaggccgccacccaggccgaggacagcggcctgcggctggatggcggcagcggcagcaccagcagcagcggctgccaccctgggggcgcccgggccggccccagccctgccagcagcagccctgcccctgggggcggccgcagcctgtctgctggcagccagaccagcggcttcagcggcagcctcttcagccctgccagctgcagcatcctgagcggcagcagcaaccagcgggagactggaggcctgctgagccccagcaccccatttggagccagcaacctgctggtgaaccccctggagccccagaatgctgacaagatcaagatcaagattgctgacctgggcaatgcctgctgggtgcacaagcacttcacagaggacatccagacccggcagtacagagctgtggaggtgctgattggagcagaatatggccccccagctgacatctggagcacagcctgcatggcctttgagctggccaccggggactacctgtttgagccccacagcggggaggactacagcagagatgaggaccacatcgcccacatcgtggagctgctgggggacatccccccagcctttgccctgagcggccgctacagccgggagttcttcaacagaagaggagagctgcggcacatccacaacctgaagcactggggcctgtatgaggtgctgatggagaagtatgagtggcccctggagcaggccacccagttcagcgccttcctgctgcccatgatggagtacatccctgagaagagggccagcgctgctgactgcctgcagcacccctggctgaacccctag

SEQ ID NO: 42386 - DNA, 1602 bp, Artificial Sequence
  Description of Artificial Sequence: Synthetic coding sequence
atgtctgccagcactggaggcggcggggacagcggcggcagcggcggcagcagcagcagcagccaggccagctgtggccctgagagcagcggcagcgagctggccctggccacccctgtgccccagatgctgcagggcctgctgggcagtgatgatgaggagcaggaggaccccaaggactactgcaagggcggctaccaccctgtgaagattggagatgtgttcaacggccgctaccacgtggtgaggaagctgggctggggccacttcagcacagtgtggctgtgctgggacatccagaggaagagatttgtggccctgaaggtggtgaagtctgctggccactacacagaaacagctgtggatgagatcaagctgctgaagtgtgtgcgggacagcgaccccagcgaccccaagcgggagaccatcgtgcagctgattgatgacttccgcatctctggagtgaatggagtgcacgtgtgcatggtgctggaggtgctgggccaccagctgctgaagtggatcatcaagagcaactaccagggcctgcctgtgccctgtgtgaagagcatcgtgcggcaggtgctgcacggcctggactacctgcacaccaagtgcaagatcatccacacagacatcaagccagagaacatcctgctgtgtgtgggagatgcctacatccggcggctggccgctgaggccacagagtggcagcaggccggggcccccccacccagccgcagcatcgtgtccacagccccccaggaggtgctgaccgggaagctgagcaagaacaagaggaagaagatgaggaggaagaggaagcagcagaagaggctgctggaggagcggctgcgggacctgcagaggctggaggccatggaggccgccacccaggctgaagattctggcctgcggctggatggcggcagcggcagcaccagcagcagcggcttcagcggcagcctcttcagccctgccagctgcagcatcctgagcggcagcagcaaccagcgggagactggaggcctgctgagccccagcaccccatttggagccagcaacctgctggtgaaccccctggagccccagaatgctgacaagatcaagatcaagattgctgacctgggcaatgcctgctgggtgcacaagcacttcacagaggacatccagacccggcagtacagagctgtggaggtgctgattggagcagaatatggccccccagctgacatctggagcacagcctgcatggcctttgagctggccaccggggactacctgtttgagccccacagcggggaggactacagcagagatgaggaccacatcgcccacatcgtggagctgctgggggacatccccccagcctttgccctgagcggccgctacagccgggagttcttcaacagaagaggagagctgcggcacatccacaacctgaagcactggggcctgtatgaggtgctgatggagaagtatgagtggcccctggagcaggccacccagttcagcgccttcctgctgcccatgatggagtacatccctgagaagagggccagcgctgctgactgcctgcagcacccctggctgaacccctag

SEQ ID NO: 42387 - DNA, 120 bp, Artificial Sequence
  Description of Artificial Sequence: Synthetic coding sequence
atgacaggcttcttcaagggagcagaagatcgctacagcagccacctgtggaggccccagggcggccccaggagcaagggccctggccccaggtcctggaacacagagagcctgaggtag

SEQ ID NO: 42388 - DNA, 1023 bp, Artificial Sequence
  Description of Artificial Sequence: Synthetic coding sequence
atggtgaccctgaggaagaggaccctgaaggtgctgaccttcctggtgctcttcatcttcctgaccagcttcttcctgaactacagccacaccatggtggccaccacctggttccccaagcagatggtgctggagctgtctgagaacctgaagaggctcatcaagcaccggccctgcacctgcacccactgcatcggccagaggaagctgagcgcctggtttgatgagcgcttcaaccagaccatgcagcccctgctgacagcccagaatgccctgctggaggatgacacctaccgctggtggctgcggctgcagcgggagaagaagcccaacaacctgaatgacaccatcaaggagctgttccgggtggtgcctggaaatgtggaccccatgctggagaagaggtctgtgggctgccgccgctgtgctgtggtgggcaacagcggcaacctgcgggagagcagctatggccctgagattgacagccatgactttgtgctgaggatgaacaaggcccccacagctggctttgaagcagatgtgggcaccaagaccacccaccacctggtgtacccagagagcttccgggagctgggggacaacgtgtccatgatcctggtgcccttcaagaccatcgacctggagtgggtggtgtctgccatcaccaccggcaccatcagccacacctacatccctgtgcctgccaagatccgggtgaagcaggacaagatcctgatctaccacccagccttcatcaagtatgtgtttgacaactggctgcagggccacggccgctaccccagcacaggcatcctgagcgtcatcttctccatgcacgtgtgtgatgaggtggacctgtatggctttggagctgacagcaagggcaactggcaccactactgggagaacaaccccagcgctggggccttcaggaagacaggagtgcatgatgctgactttgagagcaatgtgacagccaccctggccagcatcaacaagatccgcatcttcaagggccgctag

SEQ ID NO: 42389 - DNA, 1023 bp, Artificial Sequence; identical to SEQ ID NO: 42388
  Description of Artificial Sequence: Synthetic coding sequence

SEQ ID NO: 42390 - DNA, 150 bp, Artificial Sequence
  Description of Artificial Sequence: Synthetic coding sequence
atggtgaccctgaggaagaggaccctgaaggtgctgaccttcctggtgctcttcatcttcctgaccagcttcttcctgaactacagccacaccatggtggccaccacctggttccccaagcagatggtgctggagctgtctgagaactag

SEQ ID NO: 42391 - DNA, 1023 bp, Artificial Sequence; identical to SEQ ID NO: 42388
  Description of Artificial Sequence: Synthetic coding sequence

SEQ ID NO: 42392 - DNA, 1023 bp, Artificial Sequence; identical to SEQ ID NO: 42388
  Description of Artificial Sequence: Synthetic coding sequence

SEQ ID NO: 42393 - DNA, 219 bp, Artificial Sequence
  Description of Artificial Sequence: Synthetic coding sequence
atggtgaccctgaggaagaggaccctgaaggtgctgaccttcctggtgctcttcatcttcctgaccagcttcttcctgaactacagccacaccatggtggccaccacctggttccccaagcagatggtgctggagctgtctgagaacctgaagaggctcatcaagcaccggccctgcacctgcacccactgcatcggccagaggaagctgagcgcctag

SEQ ID NO: 42394 - DNA, 144 bp, Artificial Sequence
  Description of Artificial Sequence: Synthetic coding sequence
atggtgaccctgaggaagaggaccctgaaggtgctgaccttcctggtgctcttcatcttcctgaccagcttcttcctgaactacagccacaccatggtggccaccacctggttccccaagcagatggtgctggagctgtcctag

SEQ ID NO: 42395 - DNA, 1221 bp, Artificial Sequence
  Description of Artificial Sequence: Synthetic coding sequence
atgatccacaccaacctgaagaagaagttcagctgctgcgtgctggtgttcctgctgtttgctgtgatctgtgtgtggaaggagaagaagaagggcagctactatgacagcttcaagctgcagaccaaggagttccaggtgctgaagagcctgggcaagctggccatgggcagtgacagccagagcgtgagcagcagcagcacccaggacccccaccggggccggcagaccctgggcagcctgcggggcctggccaaggccaagccagaggccagcttccaggtgtggaacaaggacagcagcagcaagaacctgatcccccggctgcagaagatctggaagaactacctgtccatgaacaagtacaaggtgtcctacaagggccctggccctggcatcaagttctctgctgaggccctgcgctgccacctgcgggaccacgtgaatgtgtccatggtggaggtgacagacttccccttcaacaccagcgagtgggagggctacctgcccaaggagagcatccgcaccaaggccggcccctggggccgctgtgctgtggtgtcctctgctggcagcctgaagagcagccagctgggccgggagattgatgaccatgatgctgtgctgcgcttcaacggggcccccacagccaacttccagcaggatgtgggcaccaagaccaccatccggctgatgaacagccagctggtgaccacagagaagcgcttcctgaaggacagcctgtacaatgaaggcatcctgattgtgtgggaccccagcgtgtaccacagcgacatccccaagtggtaccagaacccagactacaacttcttcaacaactacaagacctacaggaagctgcaccccaaccagcccttctacatcctgaagccccagatgccctgggagctgtgggacatcctgcaggagatcagccctgaggagatccagcccaacccccccagcagcggcatgctgggcatcatcatcatgatgaccctgtgtgaccaggtggacatctatgagttcctgcccagcaagaggaagacagatgtgtgctactactaccagaagttctttgacagcgcctgcaccatgggcgcctaccaccccctgctgtatgagaagaacctggtgaagcacctgaaccagggcacagatgaggacatctacctgctgggcaaggccaccctgcccggcttccgcaccatccactgctag

SEQ ID NO: 42396 - DNA, 228 bp, Artificial Sequence
  Description of Artificial Sequence: Synthetic coding sequence
atgatccacaccaacctgaagaagaagttcagctgctgcgtgctggtgttcctgctgtttgctgtgatctgtgtgtggaaggagaagaagaagggcagctactatgacagcttcaagctgcagaccaaggagttccaggtgctgaagagcctgggcaagctggccatgggcagtgacagccagagcgtgagcagcagcagcacccaggacccccaccggggccgctag

SEQ ID NO: 42397 - DNA, 342 bp, Artificial Sequence
  Description of Artificial Sequence: Synthetic coding sequence
atgatccacaccaacctgaagaagaagttcagctgctgcgtgctggtgttcctgctgtttgctgtgatctgtgtgtggaaggagaagaagaagggcagctactatgacagcttcaagctgcagaccaaggagttccaggtgctgaagagcctgggcaagctggccatgggcagtgacagccagagcgtgagcagcagcagcacccaggacccccaccggggccggcagaccctgggcagcctgcggggcctggccaaggccaagccagaggccagcttccaggtgtggaacaaggacagcagcagcaagaacctgatcccccggctgcagaagatctggtag

SEQ ID NO: 42398 - DNA, 384 bp, Artificial Sequence
  Description of Artificial Sequence: Synthetic coding sequence
atgatccacaccaacctgaagaagaagttcagctgctgcgtgctggtgttcctgctgtttgctgtgatctgtgtgtggaaggagaagaagaagggcagctactatgacagcttcaagctgcagaccaaggagttccaggtgctgaagagcctgggcaagctggccatgggcagtgacagccagagcgtgagcagcagcagcacccaggacccccaccggggccggcagaccctgggcagcctgcggggcctggccaaggccaagccagaggccagcttccaggtgtggaacaaggacagcagcagcaagaacctgatcccccggctgcagaagatctggaagaactacctgtccatgaacaagtacaaggtgtcctacaagtag

SEQ ID NO: 42399 - DNA, 129 bp, Artificial Sequence
  Description of Artificial Sequence: Synthetic coding sequence
atgatccacaccaacctgaagaagaagttcagctgctgcgtgctggtgttcctgctgtttgctgtgatctgtgtgtggaaggagaagaagaagggcagctactatgacagcttcaagctgcagacctag

SEQ ID NO: 42400 - DNA, 294 bp, Artificial Sequence
  Description of Artificial Sequence: Synthetic coding sequence
atgatccacaccaacctgaagaagaagttcagctgctgcgtgctggtgttcctgctgtttgctgtgatctgtgtgtggaaggagaagaagaagggcagctactatgacagcttcaagctgcagaccaaggagttccaggtgctgaagagcctgggcaagctggccatgggcagtgacagccagagcgtgagcagcagcagcacccaggacccccaccggggccggcagaccctgggcagcctgcggggcctggccaaggccaagccagaggccagcttccaggtgtggaactag

SEQ ID NO: 42401 - DNA, 138 bp, Artificial Sequence
  Description of Artificial Sequence: Synthetic coding sequence
atgatccacaccaacctgaagaagaagttcagctgctgcgtgctggtgttcctgctgtttgctgtgatctgtgtgtggaaggagaagaagaagggcagctactatgacagcttcaagctgcagaccaaggagttctag

SEQ ID NO: 42402 - DNA, 276 bp, Artificial Sequence
  Description of Artificial Sequence: Synthetic coding sequence
atgatccacaccaacctgaagaagaagttcagctgctgcgtgctggtgttcctgctgtttgctgtgatctgtgtgtggaaggagaagaagaagggcagctactatgacagcttcaagctgcagaccaaggagttccaggtgctgaagagcctgggcaagctggccatgggcagtgacagccagagcgtgagcagcagcagcacccaggacccccaccggggccggcagaccctgggcagcctgcggggcctggccaaggccaagccagaggcctag

SEQ ID NO: 42403 - DNA, 1221 bp, Artificial Sequence; identical to SEQ ID NO: 42395
  Description of Artificial Sequence: Synthetic coding sequence

SEQ ID NO: 42404 - DNA, 297 bp, Artificial Sequence
  Description of Artificial Sequence: Synthetic coding sequence
atgatccacaccaacctgaagaagaagttcagctgctgcgtgctggtgttcctgctgtttgctgtgatctgtgtgtggaaggagaagaagaagggcagctactatgacagcttcaagctgcagaccaaggagttccaggtgctgaagagcctgggcaagctggccatgggcagtgacagccagagcgtgagcagcagcagcacccaggacccccaccggggccggcagaccctgggcagcctgcggggcctggccaaggccaagccagaggccagcttccaggtgtggaacaagtag

SEQ ID NO: 42405 - DNA, 528 bp, Artificial Sequence
  Description of Artificial Sequence: Synthetic coding sequence
atgaacagccagctggtgaccacagagaagcgcttcctgaaggacagcctgtacaatgaaggcatcctgattgtgtgggaccccagcgtgtaccacagcgacatccccaagtggtaccagaacccagactacaacttcttcaacaactacaagacctacaggaagctgcaccccaaccagcccttctacatcctgaagccccagatgccctgggagctgtgggacatcctgcaggagatcagccctgaggagatccagcccaacccccccagcagcggcatgctgggcatcatcatcatgatgaccctgtgtgaccaggtggacatctatgagttcctgcccagcaagaggaagacagatgtgtgctactactaccagaagttctttgattctgcctgcaccatgggcgcctaccaccccctgctgtatgagaagaacctggtgaagcacctgaaccagggcacagatgaggacatctacctgctgggcaaggccaccctgcccggcttccgcaccatccactgctag

SEQ ID NO: 42406 - DNA, 78 bp, Artificial Sequence
  Description of Artificial Sequence: Synthetic coding sequence
atgatccacaccaacctgaagaagaagttcagctgctgcgtgctggtgttcctgctgtttgctgtgatctgtgtgtag

SEQ ID NO: 42407 - DNA, 876 bp, Artificial Sequence
  Description of Artificial Sequence: Synthetic coding sequence
atggagaagctggccgccagcacagagccccagggccccaggcctgtgctgggccgggagagcgtgcaggtgcctgatgaccaggacttccgctccttccgctcagaatgtgaggccgaggtgggctggaacctgacctacagccgggccggcgtgtctgtgtgggtgcaggccgtggagatggacaggaccctgcacaagatcaagtgcaggatggagtgctgtgatgtgcctgctgagaccctgtatgatgtgctgcatgacatcgagtacaggaagaagtgggacagcaatgtcatcgagacctttgatattgcccggctgactgtgaatgctgatgtgggctactacagctggcgctgccccaagcccctgaagaacagagatgtgatcaccctgcgctcctggctgcccatgggcgctgactacatcatcatgaactacagcgtgaagcaccccaagtacccacccaggaaggacctggtgcgggctgtgtccatccagacaggctacctgatccagagcacaggccccaagagctgtgtgatcacctacctggcccaggtggaccccaagggcagcctgcccaagtgggtggtgaacaagagcagccagttcctggcccccaaggccatgaagaagatgtacaaggcctgcctgaagtacccagagtggaagcagaagcacctgccccacttcaagccctggctgcaccctgagcagagccccctgcccagcctggccctgtctgagctgtctgtgcagcacgccgacagcctggagaacattgatgagagcgctgtggccgagagccgggaggagaggatgggcggggccggcggggagggcagtgatgatgacaccagcctgacctag

SEQ ID NO: 42408 - DNA, 270 bp, Artificial Sequence
  Description of Artificial Sequence: Synthetic coding sequence
atggagaagctggccgccagcacagagccccagggccccaggcctgtgctgggccgggagagcgtgcaggtgcctgatgaccaggacttccgctccttccgctcagaatgtgaggccgaggtgggctggaacctgacctacagccgggccggcgtgtctgtgtgggtgcaggccgtggagatggacaggaccctgcacaagatcaagtgcaggatggagtgctgtgatgtgcctgctgagaccctgtatgatgtgctgcatgacatctag

SEQ ID NO: 42409 - DNA, 759 bp, Artificial Sequence
  Description of Artificial Sequence: Synthetic coding sequence
atggagaagctggccgccagcacagagccccagggccccaggcctgtgctgggccgggagagcgtgcaggtgcctgatgaccaggacttccgctccttccgctcagaatgtgaggccgaggtgggctggaacctgacctacagccgggccggcgtgtctgtgtgggtgcaggccgtggagatggacaggaccctgcacaagatcaagtgcaggatggagtgctgtgatgtgcctgctgagaccctgtatgatgtgctgcatgacatcgagtacaggaagaagtgggacagcaatgtcatcgagacctttgatattgcccggctgactgtgaatgctgatgtgggctactacagctggcgctgccccaagcccctgaagaacagagatgtgatcaccctgcgctcctggctgcccatgggcgctgactacatcatcatgaactacagcgtgaagcaccccaagtacccacccaggaaggacctggtgcgggctgtgtccatccagacaggctacctgatccagagcacaggccccaagagctgtgtgatcacctacctggcccaggtggaccccaagggcagcctgcccaagtgggtggtgaacaagagcagccagttcctggcccccaaggccatgaagaagatgtacaaggcctgcctgaagtacccagagtggaagcagaagcacctgccccacttcaagccctggctgcaccctgagcagagccccctgcccagcctggccctgtctgagctgtag

SEQ ID NO: 42410 - DNA, 39 bp, Artificial Sequence
  Description of Artificial Sequence: Synthetic coding sequence
atggagaagctggccgccagcacagagccccagggctag

SEQ ID NO: 42411 - DNA, 576 bp, Artificial Sequence
  Description of Artificial Sequence: Synthetic coding sequence
atggagaagctggccgccagcacagagccccagggccccaggcctgtgctgggccgggagagcgtgcaggtgcctgatgaccaggacttccgctccttccgctcagaatgtgaggccgaggtgggctggaacctgacctacagccgggccggcgtgtctgtgtgggtgcaggccgtggagatggacaggaccctgcacaagatcaagtgcaggatggagtgctgtgatgtgcctgctgagaccctgtatgatgtgctgcatgacatcgagtacaggaagaagtgggacagcaatgtcatcgagacctttgatattgcccggctgactgtgaatgctgatgtgggctactacagctggcgctgccccaagcccctgaagaacagagatgtgatcaccctgcgctcctggctgcccatgggcgctgactacatcatcatgaactacagcgtgaagcaccccaagtacccacccaggaaggacctggtgcgggctgtgtccatccagacaggctacctgatccagagcacaggccccaagagctgtgtgatcacctacctggcccaggtggacccctag

SEQ ID NO: 42412 - DNA, 876 bp, Artificial Sequence; identical to SEQ ID NO: 42407
  Description of Artificial Sequence: Synthetic coding sequence

SEQ ID NO: 42413 - DNA, 417 bp, Artificial Sequence
  Description of Artificial Sequence: Synthetic coding sequence
atggagaagctggccgccagcacagagccccagggccccaggcctgtgctgggccgggagagcgtgcaggtgcctgatgaccaggacttccgctccttccgctcagaatgtgaggccgaggtgggctggaacctgacctacagccgggccggcgtgtctgtgtgggtgcaggccgtggagatggacaggaccctgcacaagatcaagtgcaggatggagtgctgtgatgtgcctgctgagaccctgtatgatgtgctgcatgacatcgagtacaggaagaagtgggacagcaatgtcatcgagacctttgatattgcccggctgactgtgaatgctgatgtgggctactacagctggcgctgccccaagcccctgaagaacagagatgtgatcaccctgcgctcctggctgccctag

SEQ ID NO: 42414 - DNA, 14103 bp, Artificial Sequence
  Description of Artificial Sequence: Synthetic coding sequence
atggccaacgtgcaggtggccgtgcgggtgcggcccctgagcaagcgggagaccaaggagggcggccgcatcatcgtggaggtggatggcaaggtggccaagatccggaacctgaaggtggacaacagaccagatggctttggagacagccgggagaaggtgatggcctttggatttgactactgctactggagcgtgaaccctgaggacccccagtatgccagccaggatgtggtgttccaggacctgggcatggaggtgctgtctggagtggccaagggctacaacatctgcctgtttgcctacggccagacaggcagcggcaagacctacaccatgctgggcaccccagcctctgtgggcctgaccccccgcatctgtgagggcctgtttgtgcgggagaaggactgtgccagcctgcccagcagctgccgcatcaaggtgtccttcctggagatctacaatgaaagagtgcgggacctgctgaagcagagcggccagaagaagagctacaccctgcgggtgcgggagcaccctgagatgggcccctacgtgcagggcctgagccagcacgtggtgaccaactacaagcaggtgatccagctgctggaggagggcatcgccaaccgcatcacagctgccacccacgtgcatgaggccagcagccgcagccacgccatcttcaccatccactacacccaggccatcctggagaacaacctgcccagcgagatggccagcaagatcaacctggtggacctggccggcagcgagagagctgaccccagctactgcaaggacagaattgctgagggcgccaacatcaacaagagcctggtgaccctgggcatcgtcatcagcaccctggcccagaacagccaggtgttcagcagctgccagagcctgaacagctctgtgtccaatggaggagacagcggcatcctgagcagccccagcggcaccagcagtggaggagcccccagccggcggcagagctacatcccctacagagattctgtgctgacctggctgctgaaggacagcctgggcggcaacagcaagaccatcatggtggccaccgtgtccccagcccacaccagctacagcgagaccatgagcaccctgcgctatgccagcagcgccaagaacatcatcaacaagccccgggtgaatgaagatgccaacctgaagctgatccgggagctgcgggaggagattgaaaggctgaaggccctgctgctgagctttgagctgaggaacttcagcagcctgagtgatgagaacctgaaggagctggtgctgcagaatgagctgaagattgaccagctgaccaaggactggacccagaagtggaatgactggcaggccctgatggagcactacagcgtggacatcaacagaagaagagctggggtggtgattgacagcagcctgccccacctgatggccctggaggatgatgtgctgagcactggagtggtgctgtaccacctgaaggagggcaccaccaagattggaagaattgacagcgaccaggagcaggacatcgtgctgcagggccagtggattgagcgggaccactgcaccatcaccagcgcctgtggggtggtggtgctgcggcctgcccggggggcccgctgcaccgtgaatggccgggaggtgacagccagctgccgcctgacccagggcgccgtcatcaccctgggcaaggcccagaagttccgcttcaaccaccctgctgaggccgctgtgctgcggcagaggcggcaggtgggggaggccgccgccggccggggcagcctggagtggctggacctggatggagacctggccgccagccggctgggcctgagccccctgctgtggaaggagcggcgggccctggaggagcagtgtgatgaggaccaccagaccccaagagatggagagaccagccaccgggcccagatccagcagcagcagagctatgtggaggacctgcggcaccagatcctggccgaggagatccgggccgccaaggagctggagtttgaccaggcctggatcagccagcagatcaaggagaaccagcagtgcctgctgcgggaggagacctggctggccagcctgcagcagcagcagcaggaggaccaggtggccgagaaggagctggaggcctctgtggccctggatgcctggctgcagacagatcctgagatccagcccagcccctttgtgcagagccagaagagggtggtgcacctgcagctgctgcggcggcacaccctgcgggctgctgagagaaatgtgcggaggaagaaggtgtccttccagctggagcgcatcatcaagaagcagaggctgctggaggcccagaagaggctggagaagctgaccaccctgtgctggctgcaggatgacagcacccaggagcccccctaccaggtgctgagcccagatgccaccgtgcccaggcctccctgccgcagcaagctgaccagctgcagcagcctgagcccccagaggctgtgcagcaagcacatgccccagctgcacagcatcttcctgtcctgggaccccagcaccaccctgccccccaggccagaccccacccaccagaccagcgagaagaccagcagcgaggagcacctgccccaggccgccagctacccagccaggacaggctgcctgaggaagaatggcctgcacagcagcggccacggccagccctgcacagcccgggccgccctggccaggaaaggagccagcgccccagatgcctgcctgaccatgagccccaacagcgtgggcatccaggagatggagatgggcgtgaagcagccccaccagatggtgtcccagggcctggccagcctgaggaagagcgccaacaagctgaagcccaggcatgagcccaagatcttcaccagcaccacccagaccaggggggccaagggcctggccgaccccagccacacccaggccggctggaggaaggagggcaacctgggcacccacaaggccgccaagggggccagctgcaacagcctgtacccccacggcccccggcagacagctggccacggcaaggctgtgaagaccttctggacagagtacaagccacccagccccagccgggccagcaagaggcaccagagggtgctggccaccagggtgaggaacatcaccaagaagagcagccacctgcccctgggcagccccctgaagaggcagcagaacacccgggaccctgacaccatggtgcccctgacagacttcagccctgtgatggaccacagccgggagaaggacaatgacctgagtgacacagacagcaactacagcctggacagcctgagctgtgtgtatgccaaggccctgattgagcccctgaagccagaggagaggaagtgggacttccctgagccagaaaattctgagagtgatgacagccagctgtctgaggacagcctggccgagaagcgctaccagagccccaagaaccggctgggcggcaaccggcccaccaacaacagaggccagcccaggaccaggacccgggcctctgtgcggggcttcaccgctgccagtgacagcgacctgctggcccagacccaccgctccttcagcctggacagcctgattgatgctgaggaggagctgggggaggaccagcaggaggagcccttccctggcagcgcagatgagatccccacagagaccttctggcacctggaggacagcagcctgcctgtgatggaccaggaggccatctgccgcctgggccccatcaactacagaacagctgcccggctggatgctgtgctgcccatgagcagcagcttctacctggacccccagttccagccccactgtgagctgcagccccactgtgagctgcagccccactgtgagctgcagccccactgtgagcaggccgagagccaggtggagcccagctacagcgagcaggccgacagcctgcagggcatgcagctgagccgggagagccccctgatgtccatggacagctggttcagctgtgacagcaagatcaaccccagcagccccccaggcatcgtgggcagcctgtgccccagcccagacatgcaggagttccacagctgcaagggggagcggcccggctactggcccaacacagaggagctgaagcccagtgatgctgagaccgtgctgccctacagcagcaagctgcaccagggcagcacagagctgctgtgcagcgccagagatgagcacacagccagcgctgctgacaccagccggctgagcctgtggggcatccagaggctcatccagcccggggctgatggcaccttccagggccgctgcatcccagacatgacccagcagggcagcagcgaggccagccacaacagctctgtgtccaatgtgctggccgccagcgccaccaccctgacccacgtgggcagcacccatgagcgggactggagcgccctgcagcagaagtacctgctggagctgagctgccctgtgctggaggccatcggggcccccaagccagcctacccctacctggaggaggacagcggcagcctggcccaggccagcagcaagggcggggacaccctgctgcctgtgggcccccgggtgagcagcaacctgaacctgaacaacttccctgtgcacctgagccgcatccggcggctgcgggcagagaaggagcaggacagcctgaatgccaagctggagggcgtgtctgacttcttcagcaccagcgagaaggaggccagctatgatgagacctacagcgctgacctggagagcctgagcgccagccgcagcaccaatgcccaggtgtttgccacagaaaatgccatcccagacagcatgacagaggcctgtgaggtgaagcagaacaacctggaggagtgcctgcagagctgcaggaagccaggcctgatgaccagcagtgatgaggacttcttccagaagaatgcctgccacagcaatgtgaccacagccaccaaggctgaccactggagccagggctgggcccccctgaggaagaacagcgctgtgcagcccggccagctgagcccagacagccactaccccctggaggaggagaagacagactgccaggagagcagcaaggaggccgtgcggcggcacatcaacgtgtcctttgccctgcccagcggccctgagctgtacctgcacagcgccccctggaaccccctgagcagcagcctgcagccccccctgctggagaccttctacgtgaccaagagcagagatgccctgacagaaacagccctggagatcccagcctgccgggaggtgcgggtgcccagccccccaccccgggaggcctggggcttcggccacaaccaccaggccctgcagggcgcctacctgaagaacaacctgcctgtgctgctgcagaaccagaacagcaagatcgccagcagccagcaggtgacagctgagatccctgtggacctgaacacccgggaggtgatccgggagagcggcaagtgccccggcaacatcacagaggagagccatgacagcgtgtacagctctgtgacccagaacagacacttcctgcccagcaccagcaccaaggtgtgtgaatttgagaaccaggtggtgatcctgaacaagaagcacagcttccctgccctggagggcggggaggtgacagcccagagctgctgcggggccagcagtgacagcacagagagcggcaagagcctgctcttccgggagagcgaggcccgggaggaggaggagctggaccagaacacagtgctgcggcagaccatcaacgtgtccctggagaaggacatgcctggagagagcgctgtgtccctgaagagccgctctgtggaccggcgggtgagcagccctgtgatggtggcccagggcggcggccccacccccaagtgggagggcaagaatgagaccggcctgctggagaagggcctgcggcccaaggacagcagcgaggagttcaagctgcccggcaccaagccagcctatgagcgcttccagctggtggcctgcccccaggagaggaaccccagcgagtgcaagagccaggagatgctgaaccccaaccgggagcccagcggcaagaagcagaacaagagggtgaacaacacagatgagatggcccggctcatccgctctgtgatgcagctggagaatggcatcctggagattgagagcaagcagaacaagcaggtgcacgccagccacaccccaggcacagacaaggagctggtgttccaggaccagaaggagcaggagaagacagaccacgccttccggccagacagcagcggcaaccccctgcccagcaaggaccagcccagcagcccccggcagacagatgacacagtgttccgggacagcgaggccggggccatggaggtgaacagcatcggcaaccacccccaggtgcagaagatcacccccaaccccttccgcagccgggagggcgtgcgggagagcgagcctgtgcgggagcacacccaccctgctggcagtgacaggcctgcccgggacatctgtgacagcctgggcaagcacaccacctgccgggagttcaccaacaccagcctgcacccccagaggatgaaggccctggcccgggccctgcccctgcagccccggctggagaggagcagcaagaacaacggccagtttgtgaaggccagcgccagcctgaagggccagccctggggcctgggcagcctggaggagctggagaccgtgaagggcttccaggagagccaggtggccgagcacgtgagcagcagcaaccaggaggagcccaaggcccagggcaaggtggaggagatgcccatgcagagaggaggcagcctgcaggaggagaacaaggtgacccagaagttccccagcctgagccagctgtgccgggacaccttcttccggcaggagaccgtgagccccctgctgagcaggacagagttctgcacagcccccctgcaccaggacctgagcaacaccctgcccctgaacagcccccgctggccccggcgctgcctgcacgtgcctgtggccctgggcatcagcagcctggactgtgtgctggacctgaccatgctgaagatccacaacagccccctggtgactggagtggagcaccaggaccagagcacagagaccaggagccacagccctgagggcaatgtgcggggccgcagcagcgaggcccacacagcctggtgtggctctgtgcgctccatggccatgggcagccacagccagagcggcgtgcctgagagcatccccctgggcacagaagatcgcatcagcgccagcaccagcccccaggaccacggcaaggacctgcgcatcaccctgctgggcttcagcaccagcgaggactttgccagcgaggccgaggtggccgtgcagaaggagatccgggtgagcagcctgaacaaggtgagcagccagcctgagaagagggtgtccttcagcctggaggaggacagcgaccaggccagcaagccccggcagaaggccgagaaggagacagaagatgtgggcctgaccagcggcgtgtccctggcccctgtgtccctgccccgggtgcccagccctgagccccggctgctggagcccagcgaccacgcctccatgtgcctggccatcctggaggagatccggcaggccaaggcccagaggaagcagctgcatgactttgtggcccggggcaccgtgctgagctactgtgagaccctgctggagccagaatgtagcagccgggtggccggccggccccagtgcaagcagattgaccagagcagcagtgaccagaccagaaatgaaggagaggcccctggcttccacgtggccagcctgtctgctgaggccggccagattgacctgctgcctgatgagaggaaggtgcaggccaccagcctgtctgctgacagctttgagagcctgcccaacacagaaacagaccgggagccctgggaccctgtgcaggccttcagccatgctgccccagcccaggacaggaagagaagaactggagagctgcggcagtttgctggggccagcgagcccttcatctgccacagcagcagcagcgagatcatcgagaagaagaaggatgccaccaggacccccagcagcgctgaccccctggccccagacagccccaggagcagcgcccctgtggaggaggtgagaagagtggtgtccaagaaggtggtggccgccctgcccagccaggccccctatgatgacccccgggtgaccctgcacgagctgagccagagcgtgccccaggagacagctgagggcatccccccaggcagccaggacagcagccctgagcaccaggagcccaggaccctggacaccacctatggagaggtgtctgacaacctgctggtgacagcccagggcgagaagacagcccactttgagagccagagcgtgacctgtgatgtgcagaacagcaccagcgccagcggccccaagcaggaccacgtgcagtgcccagaggccagcacaggctttgaggagggccgggccagccccaagcaggacaccatcctgcccggggccctgaccagggtggccctggaggcccccacccagcagtgtgtgcagtgcaaggagagcgtgggcagcggcctgacagaggtgtgccgggccggcagcaagcacagccggcccatccccctgcctgaccagaggcccagcgccaaccctgggggcatcggggaggaggccccctgccgccacccccgggaggccctggatggccctgtgttcagcaggaaccctgagggcagcaggaccctgagccccagccggggcaaggagagcaggaccctgccctgccggcagccctgcagcagccagcctgtggccacccacgcctacagcagccacagcagcaccctgctgtgcttcagagatggagacctgggcaaggagcccttcaaggccgccccccacaccatccaccccccctgtgtggtgcccagccgggcctatgagatggatgagaccggggagatcagccggggcccagatgtgcacctgacccacggcctggagcccaaggatgtgaaccgggagttccggctgacagagagcagcacctgtgagcccagcacagtggccgctgtgctgagccgggcccagggctgccgcagccccagcgccccagatgtgaggacaggcagcttcagccacagcgccacagatggctctgtgggcctcatcggcgtgcctgagaagaaggtggccgagaagcaggccagcacagagctggaggccgccagcttccctgctggcatgtacagcgagcccctgcggcagttccgggacagctctgtgggggaccagaatgcccaggtgtgccagaccaaccctgagcccccagccaccacccagggcccccacaccctggacctgtctgagggcagcgctgagagcaagctggtggtggagccccagcacgagtgcctggagaacaccacccgctgcttcctggagaagccccagttcagcacagagctgcgggaccacaaccggctggacagccaggccaagtttgtggcccggctgaagcacacctgcagcccccaggaggacagcccctggcaggaggaggagcagcaccgggaccaggccagcggcggcggggagggctttgcccagggcgtgaaccccctgcctgatgaagatggcctggatggctgccagatcctggatgctggccgggaggaggtggccgtggccaagccccctgtgtccaagatcctgagccagggcttcaaggaccctgccaccgtgtccctgcggcagaatgagaccccccagcctgctgcccagaggagcggccacctgtacacaggccgggagcagcctgcccccaaccaccggggcagcctgcctgtgaccaccatcttcagcggccccaagcacagccgcagcagccccaccccccagttctctgtggtgggcagcagccgcagcctgcaggagctgaacctgtctgtggagccccccagccccacagatgaggacacccagggccccaaccggctgtggaacccccacctgcggggctacagcagcggcaagtctgtggcccggaccagcctgcaggccgaggacagcaaccagaaggccagcagccggctggatgatggcaccacagaccaccgccacctgaagccagccaccccaccctaccccatgcccagcaccctgagccacatgcccaccccagacttcaccacctcctggatgagcggcaccctggagcaggcccagcagggcaagcgggagaagctgggcgtgcaggtgcggcctgagaactggtgcagccagatggacaagggcatgctgcacttcggcagcagtgacatcagcccctatgccctgccctggaggcctgaggagcccgcccgcatctcctggaagcagtacatgagcggcagcgctgtggatgtgtcctgcagccagaagccccagggcctgaccctgagcaatgtggcccgctgcagctccatggacaatggcctggaggaccagaacagccccttccacagccacctgagcacctacgccaacatctgtgacctgagcaccacccacagcagcacagaaaatgcccagggcagcaatgaggcctgggaggtgttccggggcagcagcagcatcgccctgggggacccccacatccccaccagccctgagggcgtggcccccaccagcggccatgaccggcggccccagttccggggccccagcggggaggccgactgcctgcggagcaagccacccctggccaagggcagcgctgctggccctgtggatgagatcatgctgctgtaccccagcgaggccggctgccctgtgggccagaccaggaccaacacctttgagcagggcacccagaccctgggcagccgccgccactggagcagcacagacatcagctttgcccagcctgaggccagcgctgtgtctgcctttgacctggcctcctggacctccatgcacaacctgagcctgcacctgagccagctgctgcacagcaccagcgagctgctgggcagcctgagccagccagatgtggcccggcgggagcagaacaccaagagggacatcccagacaaggccccccaggccctgatgatggatggcagcacccagaccaccgtggatgagggcagccagacagacctgaccctgcccaccctgtgcctgcagaccagcgaggccgagccccagggcgccaacgtcatcctggagggcctgggcagtgacaccagcacagtgtcccaggaggagggagatgtgcctggggtgccccagaagcgggaggccgaggagacagcccagaagatggcccagctgctgtacctgcaggaggagagcaccccctacaagccccagagccccagcatccccagcagccacctgcgcttccagaaggcccctgtgggccagcacctgcccagcgtgagccccagcgtgtctgatgccttcctgccccccagcagccagcctgaggagagctactgcctggtggtgagcagccccagccccagcagcccccacagccctggcctcttccccagcaccagcgagtacccaggggacagccgggtgcagaagaagctgggccccaccagcgccctgtttgtggaccgggccagcagccccatcctgaccctgagcgccagcacccaggagcccggcctgagccctggcagcctgaccctgagcgcccccagcacccaccctgtggagggccaccagaagctggacagcagcccagaccctgtggatgcccccaggacccccatggacaactacagccagaccacagatgagctgggcggcagccagaggggccgcagcagcctgcagaggagcaatggccgctccttcctggagctgcacagcccccacagcccccagcagagccccaagctgcagttctccttcctgggccagcacccccagcagctgcagcccaggaccaccatcggcgtgcagagccggctgctgcccccacccctgcggcacaggagccagaggctgggcaacagctttgtgcctgagaaggtggccagccctgagcactgccccctgagcggccgggagcccagccagtggcagagcaggacagaaaatggaggagagagcagcgccagccctggagagccccagaggaccctggaccggcccagctcctggggcggcctgcagcacctgagcccctgccctgtgtctgagctgacagacacagctggcctgcggggcagcgccctgggcctgccccaggcctgccagcctgaggagctgctgtgcttcagctgccagatgtgcatggcccctgagcaccagcaccacagcctgcgggacctgcctgtgcacaacaagttcagcaactggtgtggggtgcagaagggcagccctgggggcctggacatgacagaggaggagctgggcgccagcggggacctgagcagcgagaagcaggagcagagccccccccagcccccaaatgaccacagccaggacagcgagtggagcaagcgggagcagatccccctgcaggtgggcgcccagaacctgagcctgtctgtggagctgacagaggccaagctgcaccacggctttggagaggctgatgccctgctgcaggtgctgcagagcggcactggagaggccctggccgcagatgagcctgtgaccagcacctggaaggagctgtatgcccggcagaagaaggccatcgagaccctgcggcgggagcgggcagagcggctgggcaacttctgcaggaccaggagcctgagcccccagaagcagctgagcctgctgcccaacaaggacctcttcatctgggacctggacctgcccagcagaagaagagagtacctgcagcagctgaggaaggatgtggtggagaccaccaggagccctgagagcgtgagccgcagcgcccacacccccagcgacatcgagctgatgctgcaggactaccagcaggcccacgaggaggccaaggtggagatcgcccgggcccgggaccagctgcgggagaggacagagcaggagaagctgcgcatccaccagaagatcatcagccagctgctgaaggaggaggacaagctgcacaccctggccaacagcagcagcctgtgcaccagcagcaatggcagcctgagcagcggcatgaccagcggctacaacagcagccctgccctgagcggccagctgcagtttcctgagaacatgggccacaccaacctgcctgacagcagagatgtgtggattggagatgagcggggcggccacagcgctgtgaggaagaacagcgcctacagccaccgggccagcctgggcagctgctgctgcagccccagcagcctgagcagcctgggcacctgcttcagcagcagctaccaggacctggccaagcacgtggtggacacctccatggctgatgtgatggccgcctgcagcgacaacctgcacaacctcttcagctgccaggccacagctggctggaactaccagggcgaggagcaggccgtgcagctgtactacaaggtgttcagccccaccaggcatggcttcctgggcgccggcgtggtgtcccagcccctgagccgggtgtgggccgctgtgtctgaccccaccgtgtggcccctgtactacaagcccatccagacagcccggctgcaccagagggtgaccaacagcatcagcctggtgtacctggtgtgcaacaccaccctgtgtgccctgaagcagccccgggacttctgctgcgtgtgtgtggaggccaaggagggccacctgtctgtgatggccgcccagagcgtgtatgacacctccatgccccggcccagcaggaagatggtgcggggggagatcctgcccagcgcctggatcctgcagcccatcaccgtggagggcaaggaggtgaccagggtcatctacctggcccaggtggagctgggcgcccctggcttccccccccagctgctgagcagcttcatcaagaggcagcccctggtgattgcccggctggccagcttcctgggccgctag

SEQ ID NO: 42415 - DNA, 570 bp, Artificial Sequence
  Description of Artificial Sequence: Synthetic coding sequence
atgaccctggccgcctacaaggagaagatgaaggagctgcccctggtgtccctcttctgcagctgcttcctggccgaccccctgaacaagagcagctacaagtatgaagctgacacagtggacctgaactggtgtgtgatcagtgacatggaggtgattgagctgaacaagtgcaccagcggccagagctttgaggtgatcctgaagccacccagctttgatggagtgcctgagttcaatgccagcctgccccggcggcgggaccccagcctggaggagatccagaagaagctggaggccgctgaggagaggaggaagtaccaggaggccgagctgctgaagcacctggccgagaagcgggagcacgagcgggaggtgatccagaaggccatcgaggagaacaacaacttcatcaagatggccaaggagaagctggcccagaagatggagagcaacaaggagaaccgggaggcccacctggccgccatgctggagcggctgcaggagaaggacaagcacgccgaggaggtgaggaagaacaaggagctgaaggaggaggccagcaggtag

SEQ ID NO: 42416 - DNA, 651 bp, Artificial Sequence
  Description of Artificial Sequence: Synthetic coding sequence
atgaccctggccgcctacaaggagaagatgaaggagctgcccctggtgtccctcttctgcagctgcttcctggccgaccccctgaacaagagcagctacaagtatgagggctggtgtggccggcagtgcaggaggaaggatgagagccagaggaaggacagcgctgactggagggagcggcgggcccaggccgacacagtggacctgaactggtgtgtgatcagtgacatggaggtgattgagctgaacaagtgcaccagcggccagagctttgaagtcatcctgaagcccccatcctttgatggagtgcctgagttcaatgccagcctgcccaggagaagagaccccagcctggaggagatccagaagaagctggaggccgctgaggagaggaggaagtaccaggaggccgagctgctgaagcacctggccgagaagcgggagcacgagcgggaggtgatccagaaggccatcgaggagaacaacaacttcatcaagatggccaaggagaagctggcccagaagatggagagcaacaaggaaaatcgggaggcccacctggccgccatgctggagcggctgcaggagaaggacaagcatgctgaggaggtgaggaagaacaaggagctgaaggaggaggccagcaggtag

SEQ ID NO: 42417 - DNA, 945 bp, Artificial Sequence
  Description of Artificial Sequence: Synthetic coding sequence
atgtccttcctggtgtccaagccagagcgcatccgcaccaatgatgccagcagcgagagcatcgccagcttcagcaagcaggaggtgatgagcagcttcctgcctgagggcggctgctatgagctgctgaccgtcatcggcaagggctttgaggacctgatgacagtgaacctggcccgctacaagcccaccggggagtatgtgacagtgcggcgcatcaacctggaggcctgcagcaatgagatggtgaccttcctgcagggcgagctgcacgtgtccaagctgttcaaccaccccaacatcgtgccctaccgggccaccttcatcgctgacaatgagctgtgggtggtgaccagcttcatggcctacggcagcgccaaggacctgatctgcacccacttcatggatggcatgaatgagctggccatcgcctacatcctgcagggcgtgctgaaggccctggactacatccaccacatgggctacgtgcacaggtctgtgaaggccagccacatcctgatctctgtggatggcaaggtgtacctgagcggcctgcggagcaacctgtccatgatcagccacggccagaggcagagggtggtgcatgacttccccaagtacagcgtgaaggtgctgccctggctgagccctgaggtgctgcagcagaacctgcagggctatgatgccaagagtgacatctacagcgtgggcatcacagcctgtgagctggccaatggacatgtgcccttcaaggacatgcctgccacccagatgctgctggagaagctgaatggcaccgtgccctgcctgctggacaccagcaccatcccagctgaggagctgaccatgagccccagccgctctgtggccaacagcggcctgagtgacagcctgaccaccagcaccccccggcccagcaatggacctgtgcctgcccccagctag

SEQ ID NO: 42418 - DNA, 2073 bp, Artificial Sequence
  Description of Artificial Sequence: Synthetic coding sequence
atgggcgctgtggcccgggcccacggcggcctgcgggtggcccgggcccgggagagcgtggccggcggccgccacagaggagctggccggcctggggcccgggccgccggggctgctgctggcctggtgcgggcagaggccggcggccggcgggccggccggggccggcggcccggccggggcctgcccaccggcggcggcggcctggccgctgctgctgtgggccgggaggtggcccagggcctgtgtgatgccatccggctggatggcggcctggacctgctgctgcggctgctgcaggcccctgagctggagaccagggtgcaggccgcccggctgctggagcagatcctggtggctgaaaatagagacagagtggccagaattggcctgggcgtcatcctgaacctggccaaggagcgggagcctgtggagctggcccggagcggcagcggcatcctggagcacatgttcaagcacagcgaggagacctgccagaggctggtggccgccggcggcctggatgctgtgctgtactggtgcagaagaacagatcctgccctgctgcggcactgtgccctggccctgggcaactgtgccctgcacggcggccaggccgtgcagaggaggatggtggagaagagagctgctgagtggctgttccccctggccttcagcaaggaggatgagctgctgagcctgcacgcctgcctggccgtggccgtgctggccaccaacaaggaggtggagcgggaggtggagaggagcggcaccctggccctggtggagcccctggtggccagcctggaccccggccgctttgcccgctgcctggtggatgccagtgacaccagccagggccggggcccagatgacctgcagaggctggtgcccctgctggacagcaaccggctggaggcccagtgcatcggggccttctacctgtgtgccgaggccgccatcaagagcctgcagggcaagaccaaggtgttcagtgacatcggggccatccagagcctgaagaggctggtgtcctacagcaccaacggcaccaagagcgccctggccaagagggccctgcggctgctgggggaggaggtgccccggcccatcctgcccagcgtgcccagctggaaggaggccgaggtgcagacctggctgcagcagatcggcttcagcaagtactgtgagagcttccgggagcagcaggtggatggagacctgctgctgcggctgacagaggaggagctgcagacagacctgggcatgaagagcggcatcaccaggaagcgcttcttccgggagctgacagagctgaagacctttgccaactacagcacctgtgacaggagcaacctggccgactggctgggcagcctggacccccgcttccggcagtacacctacggcctggtgtcctgtggcctggacaggagcctgctgcaccgggtgtctgagcagcagctgctggaggactgtggcatccacctgggcgtgcaccgggcccgcatcctgacagctgcccgggagatgctgcacagccccctgccctgcacaggaggcaagcccagcggggacaccccagatgtgttcatctcctacagaagaaacagcggcagccagctggccagcctgctgaaggtgcacctgcagctgcacggcttcagcgtcttcattgatgtggagaagctggaggccggcaagtttgaggacaagctgatccagagcgtgatgggcgccaggaactttgtgctggtgctgagccctggggccctggacaagtgcatgcaggaccatgactgcaaggactgggtgcacaaggagatcgtgacagccctgagctgtgggaagaacatcgtgcccatcattgatggctttgagtggccagagccccaggtgctgcctgaggacatgcaggccgtgctgaccttcaacggcatcaagtggagccatgagtaccaggaggccaccatcgagaagatcatccgcttcctgcagggccgcagcagccgggacagcagcgctggcagtgacaccagcctggagggcgccgcccccatgggccccacctag

SEQ ID NO: 42419 - DNA, 2169 bp, Artificial Sequence
  Description of Artificial Sequence: Synthetic coding sequence
atggtgctgaccctgctgctgagcgcctacaagctgtgccgcttctttgccatgagcggccccaggagaggagctgagcggctggccgtgcccggcccagatggcggcggcggcaccggcccctggtgggccgccggcggccctggcccccgggtgtcccctggggccggcacagaggtgcaggatgccctggagcgggccctgcctgagctgcagcaggccctgagcgccctgaagcaggccggcggggcccgggctgtgggcgccggcctggccgaggtgttccagctggtggaggaggcctggctgctggccgtgggccgggaggtggcccagggcctgtgtgatgccatccggctggatggcggcctggacctgctgctgcggctgctgcaggcccctgagctggagaccagggtgcaggccgcccggctgctggagcagatcctggtggctgaaaatagagacagagtggccagaattggcctgggcgtcatcctgaacctggccaaggagcgggagcctgtggagctggcccggagcggcagcggcatcctggagcacatgttcaagcacagcgaggagacctgccagaggctggtggccgccggcggcctggatgctgtgctgtactggtgcagaagaacagatcctgccctgctgcggcactgtgccctggccctgggcaactgtgccctgcacggcggccaggccgtgcagaggaggatggtggagaagagagctgctgagtggctgttccccctggccttcagcaaggaggatgagctgctgagcctgcacgcctgcctggccgtggccgtgctggccaccaacaaggaggtggagcgggaggtggagaggagcggcaccctggccctggtggagcccctggtggccagcctggaccccggccgctttgcccgctgcctggtggatgccagtgacaccagccagggccggggcccagatgacctgcagaggctggtgcccctgctggacagcaaccggctggaggcccagtgcatcggggccttctacctgtgtgccgaggccgccatcaagagcctgcagggcaagaccaaggtgttcagtgacatcggggccatccagagcctgaagaggctggtgtcctacagcaccaacggcaccaagagcgccctggccaagagggccctgcggctgctgggggaggaggtgccccggcccatcctgcccagcgtgcccagctggaaggaggccgaggtgcagacctggctgcagcagatcggcttcagcaagtactgtgagagcttccgggagcagcaggtggatggagacctgctgctgcggctgacagaggaggagctgcagacagacctgggcatgaagagcggcatcaccaggaagcgcttcttccgggagctgacagagctgaagacctttgccaactacagcacctgtgacaggagcaacctggccgactggctgggcagcctggacccccgcttccggcagtacacctacggcctggtgtcctgtggcctggacaggagcctgctgcaccgggtgtctgagcagcagctgctggaggactgtggcatccacctgggcgtgcaccgggcccgcatcctgacagctgcccgggagatgctgcacagccccctgccctgcacaggaggcaagcccagcggggacaccccagatgtgttcatctcctacagaagaaacagcggcagccagctggccagcctgctgaaggtgcacctgcagctgcacggcttcagcgtcttcattgatgtggagaagctggaggccggcaagtttgaggacaagctgatccagagcgtgatgggcgccaggaactttgtgctggtgctgagccctggggccctggacaagtgcatgcaggaccatgactgcaaggactgggtgcacaaggagatcgtgacagccctgagctgtgggaagaacatcgtgcccatcattgatggctttgagtggccagagccccaggtgctgcctgaggacatgcaggccgtgctgaccttcaacggcatcaagtggagccatgagtaccaggaggccaccatcgagaagatcatccgcttcctgcagggccgcagcagccgggacagcagcgctggcagtgacaccagcctggagggcgccgcccccatgggccccacctag

SEQ ID NO: 42420 - DNA, 1254 bp, Artificial Sequence
  Description of Artificial Sequence: Synthetic coding sequence
atggccagcagcaagctgcgggagcctgtggatgaggtgtttgacctggacctggccgtgcctgagacagcccggctggacagcagcctgcacaaggcccgggcccagctgctggccaagggccgccgccaccggcccagccgcagccggctgcgggacagcgccagcagcgcagaagatggagagggcagtgatggccctgggggcaaggtgacagatggctgcggcagccccctgcaccggctgcggagccccctgcacagcggccctggcagccctgctgggggcagcttctgcctggaccccccaggcctgcggcgcagcctggatgaagatgagcccccacccagccccctgacccgctaccggcccctgcacaatgctgccagccatgagggcctggccgccgccagctgcagccccccaagaagtgcccccagcagtgacagcagccccagctttgtgcggcggcaccccagggctgagccccacagtgaagatgacagcagagatgccagccccccagagcccgccagccccaccatcggcctggacaagaagaccaggaggaagttcctggacctgggcgtgaccctgcggcgggccagcacaggcaagagcaggaaggagaagggcagcaaccggctgtccatgggcagccgggagagcgtggagggcagcggccgcagcggcggcagccccttcctgcccttctcctggttcacagacagcggcaagggcagcgccagcagcggcagcaccaccagccccacctgcagccccaagcatgagggcttcagccccaagaagagcgccagccaggagagcaccctgagtgatgacagcaccccacccagcagcagccccaagatccccagcggcccctggcaggaggccaagtgcagctacccctaccacaccctgagccagagcagtgatgagttcctggatgagcccctgccccctgtgcaccactggaccagccagcaggtgggccagtggctgcagagcctgaacctggagcagtatgctgctgagtttgctgcccggcaggtggatggcccccagctgctgcagctggatggcagcaagctgaagagcctgggcctgagcaacagccatgaccgggccctggtgaagaggaagctgaaggagatggctgctgctgctgagaaggagaggaaggcccaggagaaggccgcccggcagcgggagaagctgcggcggcgggagcaggaggccaagaagagctag

SEQ ID NO: 42421 - DNA, 1338 bp, Artificial Sequence
  Description of Artificial Sequence: Synthetic coding sequence
atggccagcagcaagctgcgggagcctgtggatgaggtgtttgacctggacctggccgtgcctgagacagcccggctggacagcagcctgcacaaggcccgggcccagctgctggccaagggccgccgccaccggcccagccgcagccggctgcgggacagcgccagcagcgcagaagatggagagggcagtgatggccctgggggcaaggtgacagatggctgcggcagccccctgcaccggctgcggagccccctgcacagcggccctggcagccctgctgggggcagcttctgcctggaccccccaggcctgcggcgcagcctggatgaagatgagcccccacccagccccctgacccgctaccggcccctgcacaatgctgccagccatgagggcctggccgccgccagctgcagccccccaagaagtgcccccagcagtgacagcagccccagctttgtgcggcggcaccccagggctgagccccacagtgaagatgacagcagagatgccagccccccagagcccgccagccccaccatcggcctggacaagaagaccaggaggaagttcctggacctgggcgtgaccctgcggcgggccagcacaggcaagagcaggaaggagaagggcagcaaccggctgtccatgggcagccgggagagcgtggagggcagcggccgcagcggcggcagccccttcctgcccttctcctggttcacagacagcggcaagggcagcgccagcagcggcagcaccaccagccccacctgcagccccaagcatgagggcttcagccccaagaagagcgccagccaggcccagctgctggcccacgcccaggaggccctgagcaacagctggtgcctggtgcaggactttggcagcacccagatcggcatggagagcaccctgagtgatgacagcaccccacccagcagcagccccaagatccccagcggcccctggcaggaggccaagtgcagctacccctaccacaccctgagccagagcagtgatgagttcctggatgagcccctgccccctgtgcaccactggaccagccagcaggtgggccagtggctgcagagcctgaacctggagcagtatgctgctgagtttgctgcccggcaggtggatggcccccagctgctgcagctggatggcagcaagctgaagagcctgggcctgagcaacagccatgaccgggccctggtgaagaggaagctgaaggagatggctgctgctgctgagaaggagaggaaggcccaggagaaggccgcccggcagcgggagaagctgcggcggcgggagcaggaggccaagaagagctag

SEQ ID NO: 42422 - DNA, 42 bp, Artificial Sequence
  Description of Artificial Sequence: Synthetic coding sequence
atggccagcagcaagctgcgggagcctgtggatgaggtgtag

SEQ ID NO: 42423 - DNA, 978 bp, Artificial Sequence
  Description of Artificial Sequence: Synthetic coding sequence
atgtctgacctgcaggccgctgagggccctggctcctggagccccacagcccggcccggcagcgctgggggcgtgggggactgccagggcgtggagggcagccaggccgccgcctctgaaaatgaagacctggagaacaaggacaccagcctgctggccagcgccacagatcctgagccctgcagcagcccccaccggccccagatggtgtcccctgtgtccaaggatgccacagaggacctgaggaaggccaccggccccctggaggcccaggccctggtgaagcaggacctgctgcctgctgaccaggcccaggtgctgaatgagatggccaagtaccaggtgccccagaggtctggggacatcgtgatgatccagagcgagcacactggagccattgatgtgctgtctgctgacctggagagcgctgacctgctgggggaccacaggaaggtgagcccccccctgatggccccaccctgcatctggacctttgccaaggtgaaggagttcaagagcaagctgggcaaggagaagaacagccggctggtggtgaagagaggagaggtggtgaccatccgggtgcccacccaccctgagggcaagagggtgtgctgggagtttgccacagatgattatgacattggatttggagtgtactttgactggacccctgtgaccagcacagacatcaccgtgcaggtgtctgacagcagtgatgatgaagatgaggaggaggaggaggaggaggagattgaggagcctgtgcctgctggagatgtggagcggggcagccgcagcagcctgcggggccgctatggagaggtgatgcctgtgtacagaagagacagccacagagatgtgcaggccggcagccatgactacccaggagagggcatctacctgctgaagtttgacaacagctacagcctgctgaggaacaagaccctgtacttccacatctactacaccagctag

SEQ ID NO: 42424 - DNA, 666 bp, Artificial Sequence
  Description of Artificial Sequence: Synthetic coding sequence
atggagacctggagcgtggagcaggtgtgctcctggctggtggagaagaacctgggggagctggtgcaccgcttccaggaggaggaggtgtctggagctgccctgctggccctgaatgacaggatggtgcagcagctggtgaagaagattggccaccaggccgtgctgatggacctgatcaagaagtacaagcagaacacccagggcctgaagagccctgagaaccccaagaaggccgccctggtgatgcagacagaagctgcccgggactacagagatgaggagagcagcagccctgcccggcacggggagcagatgcccagcttctacccagctgagaacctggacaatggcctgattgaccagagggtgctgaagcagaggagaaatgtgaagcagatcctggcccggagcaaggccctgcagtggaccaagagctatgtgctgcctgagttcccctatgatgtgaagtgcatgctggccgagcagaagtgcccagaccacagcatgaggatccgcatcatcgagttcctgcaggccgacatgaccaagtacctggagggcagcctgtaccccagcacccagcagtacaatgatgtggtgaatgccctgctgcaggcccaccccttcctggatgaagatggctgcggctttgctggggtgtag

SEQ ID NO: 42425 - DNA, 1563 bp, Artificial Sequence
  Description of Artificial Sequence: Synthetic coding sequence
atggagacctggagcgtggagcaggtgtgctcctggctggtggagaagaacctgggggagctggtgcaccgcttccaggaggaggaggtgtctggagctgccctgctggccctgaatgacaggatggtgcagcagctggtgaagaagattggccaccaggccgtgctgatggacctgatcaagaagtacaagcagaacacccagggcctgaagagccctgagaaccccaagaaggccgccctggtgatgcagacagaagctgcccgggactacagagatgaggagagcagcagccctgcccggcacggggagcagatgcccagcttctacccagctgagaacctggacaatggcctgattgaccagagggtgctgaagcagaggagaaatgtgaagcagatcctggcccggagcaaggccctgcagtggaccaagagctatgtgctgcctgagttcccctatgatgtgaagtgcatgctggccgagcagaagtgcccagaccacagcatgaggatccgcatcatcgagttcctgcaggccgacatgaccaagtacctggagggcagcctgtaccccagcacccagcagtacaatgatgtggtgaatgccctgctgcaggcccaccccttcctggatgaagatggctgcggcttcttcctgtggaagagggccctgaaggaccgcttcaagtatgtgagaagacccattgaagatgatgagcaggtgatccggaacaagtgcaagtttggccaccggcggggccagaccaggaagagcctggccgacatccgctttgatgagatcaagctggtgcagatcaaggaggaggccgtgtgctttgacagcgagctggatgagcacatcaagtggttccagcaggagtatgtgaagacagagaaggactggagagaaattgacaagaggatgagccagaccctggagatccggaggaagatgattggcagcaggacccccctgaaggacatcctgaagctgttccccttcctgaagtgcccctaccagatgttccgggagttccagctgctgaccaggacagacatctacaagaagaccaggcacatcctggagagctacagcgagaacatcctgaccagcttctctgtggtggacaaccccatcaacatcgtgctgcaggagaagatgaagcactacacagatgaggacatgctgaagtacatgaagatgacagccacctgcctgctgctgcctgatgtgtttggagatgaccccagcctcttcgtcatcatgaatgagcaggtgcaggtgtccacccctgtgctggaggtgaagaaccccttcaacatggaggtgtgtgagttcagcctgtacctggagcgggagcggctgaccaaggtggatgactgtgtgacagccctggccgccctggtggccgccttccacgtgttcagaattgaatgtccccggcggctgagccagaccttcaacttcctggagaccctcatctttgacatgcacagcccctacttccccagcctgaaggagaaggaaaatgaggtgggcttccagcaccccctgacctag

SEQ ID NO: 42426 - DNA, 1563 bp, Artificial Sequence; identical to SEQ ID NO: 42425
  Description of Artificial Sequence: Synthetic coding sequence

SEQ ID NO: 42427 - DNA, 1563 bp, Artificial Sequence; identical to SEQ ID NO: 42425
  Description of Artificial Sequence: Synthetic coding sequence

SEQ ID NO: 42428 - DNA, 522 bp, Artificial Sequence
  Description of Artificial Sequence: Synthetic coding sequence
atggagacctggagcgtggagcaggtgtgctcctggctggtggagaagaacctgggggagctggtgcaccgcttccaggaggaggaggtgtctggagctgccctgctggccctgaatgacaggatggtgcagcagctggtgaagaagattggccaccaggccgtgctgatggacctgatcaagaagtacaagcagaacacccagggcctgaagagccctgagaaccccaagaaggccgccctggtgatgcagacagaagctgcccgggactacagagatgaggagagcagcagccctgcccggcacggggagcagatgcccagcttctacccagctgagaacctggacaatggcctgattgaccagagggtgctgaagcagaggagaaatgtgaagcagatcctggcccggagcaaggccctgcagtggaccaagagctatgtgctgcctgagttcccctatgatgtgaagtgcatgctggccgagcagaagtgcccagaccacagcatgaggatcagatag

SEQ ID NO: 42429 - DNA, 2085 bp, Artificial Sequence
  Description of Artificial Sequence: Synthetic coding sequence
atgatgttccgggaccaggtgggcatcctggccggctggttcaagggctggaatgaatgtgagcagacagtggccctgctgagcctgctgaagagggtgaccaggacccaggcccgcttcctgcagctgtgcctggagcacagcctggccgactgcaatgacatccacctgctggagagcgaggccaacagcgctgccatcgtgtcccagtggcagcaggagagcaaggagaaggtggtgtccctgctgctgagccacctgcccctgctgcagcccggcaacacagaggccaagtctgagtacatgaggctgctgcagaaggtgctggcctacagcattgagagcaatgccttcatcgaggagagccggcagctgctgtcctatgccctgatccacccagccaccaccctggaggacagaaatgccctggccctgtggctgagccacctggaggagcggctggccagcggcttccgcagcaggcctgagcccagctaccacagccggcagggcagtgatgagtggggcggccctgctgagctgggccctggagaggccggccctggctggcaggacaagcccccaagagaaaatggccacgtgcccttccaccccagcagctctgtgcccccagccatcaacagcatcggcagcaatgccaacacaggcctgccctgccagatccaccccagccccctgaagaggtccatgagcctcatccccaccagcccccaggtgcctggagagtggcccagccctgaggagctgggcgcccgggccgccttcaccaccccagaccacgcccccctgagcccccagagctctgtggccagcagcggcagcgagcagacagaggagcagggcagcagcaggaacaccttccaggaggatggcagcggcatgaaggatgtgcccagctggctgaagagcctgcggctgcacaagtatgctgccctcttcagccagatgtcctatgaggagatgatgaccctgacagagcagcacctggagagccagaatgtgaccaagggggcccggcacaagatcgccctgagcatccagaagctgcgggagcggcagagcgtgctgaagagcctggagaaggatgtgctggagggcggcaacctgagaaatgccctgcaggagctgcagcagatcatcatcacccccatcaaggcctacagcgtgctgcaggccaccgtggccgccgccaccaccacccccacagccaaggatggagcccctggagagccccccctgcctggagctgagccccccctggcccaccctggaacagacaagggcacagaggccaaggaccccccagctgtggagaactacccacctcctccagccccagcccccacagatggcagcgagcccgccccagcccctgtggctgatggagacatccccagccagttcaccagggtgatgggcaaggtgtgcacccagctgctggtgtccaggccagatgaggagaacatcaccagctacctgcagctgattgagaagtgcctgacccatgaggccttcacagagacccagaagaagaggctgctgtcctggaagcagcaggtgctgaagctgctgcggaccttccccaggaaggccgccctggagatgcagaactaccggcagcagaagggctgggccttcggcagcaacagcctgcccatcgccggctctgtgggcatgggcgtggcccggaggacccagaggcagttccccatgccaccccgggccctgcccccaggccgcatgggcctgctgagccccagcggcatcggcggcgtgagccccaggcatgccctgaccagccccagcctgggcggccagggccggcagaacctgtggtttgccaaccctgggggcagcaacagcatgcccagccagagccgcagctctgtgcagaggacccacagcctgcctgtgcacagcagcccccaggccatcctgatgttccccccagactgccctgtgcccggccctgacctggagatcaaccccaccctggagagcctgtgcctgtccatgacagagcacgccctgggagatggaacagacaagaccagcaccatctag

SEQ ID NO: 42430 - DNA, 1992 bp, Artificial Sequence
  Description of Artificial Sequence: Synthetic coding sequence
atgatgttccgggaccaggtgggcatcctggccggctggttcaagggctggaatgaatgtgagcagacagtggccctgctgagcctgctgaagagggtgaccaggacccaggcccgcttcctgcagctgtgcctggagcacagcctggccgactgcaatgacatccacctgctggagagcgaggccaacagcgctgccatcgtgtcccagtggcagcaggagagcaaggagaaggtggtgtccctgctgctgagccacctgcccctgctgcagcccggcaacacagaggccaagtctgagtacatgaggctgctgcagaaggtgctggcctacagcattgagagcaatgccttcatcgaggagagccggcagctgctgtcctatgccctgatccacccagccaccaccctggaggacagaaatgccctggccctgtggctgagccacctggaggagcggctggccagcggcttccgcagcaggcctgagcccagctaccacagccggcagggcagtgatgagtggggcggccctgctgagctgggccctggagaggccggccctggctggcaggacaagcccccaagagaaaatggccacgtgcccttccaccccagcagctctgtgcccccagccatcaacagcatcggcagcaatgccaacacaggcctgccctgccagatccaccccagccccctgaagaggtccatgagcctcatccccaccagcccccaggtgcctggagagtggcccagccctgaggagctgggcgcccgggccgccttcaccaccccagaccacgcccccctgagcccccagagctctgtggccagcagcggcagcgagcagacagaggagcagggcagcagcaggaacaccttccaggaggatggcagcggcatgaaggatgtgcccagctggctgaagagcctgcggctgcacaagtatgctgccctcttcagccagatgtcctatgaggagatgatgaccctgacagagcagcacctggagagccagaatgtgaccaagggggcccggcacaagatcgccctgagcatccagaagctgcgggagcggcagagcgtgctgaagagcctggagaaggatgtgctggagggcggcaacctgagaaatgccctgcaggagctgcagcagatcatcatcacccccatcaaggcctacagcgtgctgcaggccaccgtggccgccgccaccaccacccccacagccaaggatggagcccctggagagccccccctgcctggagctgagccccccctggcccaccctggaacagacaagggcacagaggccaaggaccccccagctgtggagaactacccacctcctccagccccagcccccacagatggcagcgagcccgccccagcccctgtggctgatggagacatccccagccagttcaccagggtgatgggcaaggtgtgcacccagctgctggtgtccaggccagatgaggagaacatcaccagctacctgcagctgattgagaagtgcctgacccatgaggccttcacagagacccagaagaagaggctgctgtcctggaagcagcaggtgctgaagctgctgcggaccttccccaggaaggccgccctggagatgcagaactaccggcagcagaagggctgggccttcggcagcaacagcctgcccatcgccggctctgtgggcatgggcgtggcccggaggacccagaggcagttccccatgccaccccgggccctgcccccaggccgcatgggcctgctgagccccagcggcatcggcggcgtgagccccaggcatgccctgaccccccagccctggaggcctggccccacagagcctgtggtgtgccagccctggaggcagcagcagcacgcccagagcgagccccagctgtgtgccgcccaccccctggcccctggccccctggtgaccccaggccacagccacgtgcccagccggctgcccggctcctgggcctag

SEQ ID NO: 42431 - DNA, 522 bp, Artificial Sequence
  Description of Artificial Sequence: Synthetic coding sequence
atgtgcaccaacatcgtgtatgagtggctgaaggccctgcagctgccccagtatgcagagagctttgtggacaatggctatgatgacctggaggtgtgcaagcagatcggggaccctgacctggatgccatcggcgtgctggccccagcccacagaagacgcatcctggaggccgtgcggcggctgcgggagcaggatgccaatgctgctggcctgtacttcaccctggagccccagcctgcccctcctggccccccagcagatgctgtgcccaccggccggcggggggagccctgtggcggccctgcccagggcaccaggggggacagccggggccacaccacagcccccaggagccgggagctggtgtcctaccccaagctgaagctgaagatcatgatccgggacaagctggtgagagatggcatccacctgagcaagccaccctacagcaggaaggtgcccatggccggcatcctggagtacctgatgaactggcccaagagcagccagagcaggtag

SEQ ID NO: 42432 - DNA, 1341 bp, Artificial Sequence
  Description of Artificial Sequence: Synthetic coding sequence
atggctgtgaaccccctgctgacccccaccggccagcagaccatccccctcatccccagccccttcggcccccccaccgtggacagagatgtgctgcccagcacagtggcccccacagacccccggcagttctgtgtgcccagccagtttggcagctctgtgctgcccaacaccaacatggccaacgtgctgagcagccgcatctacccaggctggggcatcctgcccccagagagcatcaaggctgtggccaggagaaatgagatgatccagaggcaccacacagccaggacagagatggagatgtatgccatctaccagcagaggaggatggagaagatcaaccccaagggcctggccggcctgggcatccccttcctgtatggcagctctgtgcctgctgccccagctgcctaccacggccgctccatgctgcctgctggggacctgcacttccacaggagcaccctgaggaacctgcagggcaaccccatgctggccgccacagccccccactttgaggagagctggggccagcgctgccggcggctgaggaagaacacaggcaaccagaaggccctggacagtgatgctgagagcagcaagagccaggccgaggagaagatcctgggccagacccatgctgtgccctatgaggaggaccactacgccaaggaccctgacatcgaggcccccagcaaccagaagagcagcgagaccaatgagaagcccaccacagccctggccaacacctgtggggagctggagcccacccacaggaagccctggggcagccacaccaccaccctgaaggccaaggcctgggatgatggcaaggaggaggccagcgagcagatctttgccacctgtgatgagaagaatggagtgtgcccccctgtgccccggcccagcctgcccggcacccacgccctggtgaccatcggcggcaacctgagcctggatgaggacatccagaagtggacagtggatgatgtgcacagcttcatccgcagcctgcccggctgcagcgactatgcccaggtgttcaaggaccacgccattgatggagagaccctgcccctgctgacagaggagcacctgcggggcaccatgggcctgaagctgggccctgccctgaagatccagagccaggtgtcccagcacgtgggctccatgttctacaagaagaccctgtccttccccatccggcaggcctttgaccagcctgctgacaccagccccctgctggaccccaacagctggagcgacaccatgaacatcttctgcccccaggacaccatcatccccaagggcatcgagcggggctccatgagaaattag

SEQ ID NO: 42433 - DNA, 1341 bp, Artificial Sequence; identical to SEQ ID NO: 42432
  Description of Artificial Sequence: Synthetic coding sequence

SEQ ID NO: 42434 - DNA, 2781 bp, Artificial Sequence
  Description of Artificial Sequence: Synthetic coding sequence
atgaagaagaccaggagcaccaccctgcggcgggcctggcccagcagtgacttcagtgaccgggccagtgacaggatgaggagccgctctgagaaggactaccgcctgcacaagcgcttccctgctgcctttgccccccaggccagccggggctacatgaccagcggagatgtgagccccatctccatgagccccatcagccagagccagttcatccccctgggggagatcctgtgcctggccatcagcgccatgaacagcgccaggaagcctgtgacccaggaggccctgatggagcacctgaccacctgcttccctggggtgcccacccccagccaggagatcctgcggcacaccctgaacaccctggtgcgggagaggaagatctaccccaccccagatggctacttcatcgtgaccccccagacctacttcatcacccccagcctcatccgcaccaacagcaagtggtaccacctggatgagcgcatcccagacaggagccagtgcaccagcccccagcccggcaccatcaccccatctgccagcggctgtgtgcgggagaggaccctgcccaggaaccactgtgacagctgccactgctgccgggaggatgtgcacagcacccacgcccccaccctgcagaggaagagcgccaaggactgcaaggacccctactgcccccccagcctgtgccaggtgcccccaacagagaagagcaagagcacagtgaacttctcctacaagacagagaccctgagcaagcccaaggacagcgagaagcagagcaagaagtttggcctgaagctgttccggctgtccttcaagaaggacaagaccaagcagctggccaacttcagcgcccagtttcctcctgaggagtggcccctgagagatgaggacaccccagccaccatcccccgggaggtggagatggagatcatccgccgcatcaacccagacctgactgtggagaatgtgatgaggcacacagccctgatgaagaagctggaggaggagaaggcccagaggagcaaggccggcagcagcgcccaccacagcggccgcagcaagaagagcaggacccacaggaagagccacggcaagagccgcagccacagcaagaccagggtgtccaagggggaccccagtgatggcagccacctggacatcccagctgagcgggagtatgacttctgtgaccccctgaccagggtgccccgggagggctgcttcatcatcgagcacaagggggacaacttcatcatgcacagcaacaccaacgtgctggagagccacttccccatgaccccagagtgggatgtgtctggagagctggccaagagaagaacagagatgcccttccctgagcccagccggggcagcagccacagcaaggtgcacaggagccacagccacacccaggacagaagaagcagaaatgaaagaagcaacaaggccaaggagaggagccgctccatggacaacagcaagggccccctgggcgccagcagcctgggcaccccagaggacctggccgagggctgcagccaggatgaccagacccccagccagagctacattgatgacagcaccctgcggcctgcccagacagtgtccctgcagagggcccacatcagcagcaccagctacaaggaggtgtgcatccctgagatcgtgtctggcagcaaggagcccagcagcgcctgcagcctgctggagcccgggaagcccccagagagcctgcccagctatggagagctgaacagctgccccaccaagacagccacagatgactacttccagtgcaacaccagcagcgagaccgtgctgacagcccccagccccctgggcaagaacaaggaggaccatgacaccctgaccctggccgagggcgtgaagaagctgagccccagcgaccggcaggtgccccacagcagccgggagcctgtgggccacaaggaggagagccccaagggccctgggggcggccctgctgccagcggcggcgtggccgagggcatcgccaacggccgcctggtgcagcaccacggggctgagcccagcagcctggacaagaggaaggagatcttcagcaaggacaccctcttcaagcccctgcacagcaccctgtctgtgaacagctaccacaagagcagcctgagcctgctgaagagccaccccaagaccccagctgacaccctgcccggccgctgtgagaagctggagcccagcctgggcaccagcgctgcccaggccatgcctgccagccagaggcagcaggagagcggcggcaaccaggaggccagctttgactactacaacgtgtctgatgatgatgacagcgaggagggcgccaacaagaacacagaggaggagaagaacagagaagatgtgggcaccatgcagtggctgctggagcgggagaaggagcgggacctgcagaggaagtttgagaagaacctgaccctgctggcccccaaggagacagacagcagcagcaaccagagggccacccacagcgcccggctggacagcatggacagcagcagcatcaccgtggacagcggcttcaacagccccaggacccgggagagcctggccagcaacaccagcagcatcgtggagagcaacagacggcagaacccagccctgagccctgcccatggaggagctggccctgccttcaacttccgggccagcgctgagccccccaccaatgaagctgagaagctgcagaagcccagcaactgcctgcaggcctctgtgacctctgtgtag

SEQ ID NO: 42435 - DNA, 2592 bp, Artificial Sequence
  Description of Artificial Sequence: Synthetic coding sequence
atgaagaagaccaggagcaccaccctgcggcgggcctggcccagcagtgacttcagtgaccgggccagtgacaggatgaggagccgctctgagaaggactaccgcctgcacaagcgcttccctgctgcctttgccccccaggccagccggggctacatgaccagcggagatgtgagccccatctccatgagccccatcagccagagccagttcatccccctgggggagatcctgtgcctggccatcagcgccatgaacagcgccaggaagcctgtgacccaggaggccctgatggagcacctgaccacctgcttccctggggtgcccacccccagccaggagatcctgcggcacaccctgaacaccctggtgcgggagaggaagatctaccccaccccagatggctacttcatcgtgaccccccagacctacttcatcacccccagcctcatccgcaccaacagcaagtggtaccacctggatgagcgcatcccagacaggagccagtgcaccagcccccagcccggcaccatcaccccatctgccagcggctgtgtgcgggagaggaccctgcccaggaaccactgtgacagctgccactgctgccgggaggatgtgcacagcacccacgcccccaccctgcagaggaagagcgccaaggactgcaaggacccctactgcccccccagcctgtgccaggtgcccccaacagagaagagcaagagcacagtgaacttctcctacaagacagagaccctgagcaagcccaaggacagcgagaagcagagcaagaagtttggcctgaagctgttccggctgtccttcaagaaggacaagaccaagcagctggccaacttcagcgcccagtttcctcctgaggagtggcccctgagagatgaggacaccccagccaccatcccccgggaggtggagatggagatcatccgccgcatcaacccagacctgactgtggagaatgtgatgaggcacacagccctgatgaagaagctggaggaggagaaggcccagaggagcaaggccggcagcagcgcccaccacagcggccgcagcaagaagagcaggacccacaggaagagccacggcaagagccgcagccacagcaagaccagggtgtccaagggggaccccagtgatggcagccacctggacatcccagctgagcgggagtatgacttctgtgaccccctgaccagggtgccccgggagggctgcttcatcatcgagcacaagggggacaacttcatcatgcacagcaacaccaacgtgctggagagccacttccccatgaccccagagtgggatgtgtctggagagctggccaagagaagaacagagatgcccttccctgagcccagccggggcagcagccacagcaaggtgcacaggagccacagccacacccaggacagaagaagcagaaatgaaagaagcaacaaggccaaggagaggagccgctccatggacaacagcaagggccccctgggcgccagcagcctgggcaccccagaggacctggccgagggctgcagccaggatgaccagacccccagccagagctacattgatgacagcaccctgcggcctgcccagacagtgtccctgcagagggcccacatcagcagcaccagctacaaggaggtgtgcatccctgagatcgtgtctggcagcaaggagcccagcagcgcctgcagcctgctggagcccgggaagcccccagagagcctgcccagctatggagagctgaacagctgccccaccaagacagccacagatgactacttccagtgcaacaccagcagcgagaccgtgctgacagcccccagccccctgggcaagaacaaggaggaccatgacaccctgaccctggccgagggcgtgaagaagctgagccccagcgaccggcaggtgccccacagcagccgggagcctgtgggccacaaggaggagagccccaagggccctgggggcggccctgctgccagcggcggcgtggccgagggcatcgccaacggccgcctggtgcagcaccacggggctgagcccagcagcctggacaagaggaaggagatcttcagcaaggacaccctcttcaagcccctgcacagcaccctgtctgtgaacagctaccacaagagcagcctgagcctgctgaagagccaccccaagaccccagctgacaccctgcccggccgctgtgagaagctggagcccagcctgggcaccagcgctgcccaggccatgcctgccagccagaggcagcaggagagcggcggcaaccaggaggccagctttgactactacaacgtgtctgatgatgatgacagcgaggagggcgccaacaagaacacagaggaggagaagaacagagaagatgtgggcaccatgcagtggctgctggagcgggagaaggagcgggacctgcagaggaagtttgagaagaacctgaccctgctggcccccaaggagacagacagcagcagcaaccagagggccacccacagcgcccggctggacagcatggacagcagcagcatcaccgtggacagcggcttcaacagccccaggaactag

SEQ ID NO: 42436 - DNA, 4155 bp, Artificial Sequence
  Description of Artificial Sequence: Synthetic coding sequence
atgagccagctgcagctgtggctgcagtttgaggccctgaacaagggcatggcccctggcagcccccagacccgggccgcccagagcagctgcagcattgctgccctgcaggtgctgcagaagagtgatgctgtgctgcggggccctgaggacagcagctactttgaggacttcagcaacatcagcatcttcagcagctctgtggacagcctgagtgacatcgtggacaccccagacttcctgcctgctgacagcctgaaccaggtgtccaccatctgggatgacaacccagcccccagcacccatgacaaggtgtctgcccctggggcccccagccagccccggcccacctctgtggccagccctgcccgggacccccacggccctgtgcggctgcggggccccaccagctgtgacctgagccggctggcccgggctgacatcctgctgcccttccagctgttccagctgagccggccctttgctggctttgaggacttcctgcccagccacagcacccccctgctggtgtcctaccaggagcagagcgtgcagagccagcctgaggaggaggatgaggccgaggaggaggaggccgaggagctgggccacacagagacctatgctgactatgtgcccagcaagagcaagattggcaagcagcacccagacagagtggtggagaccagcaccctgagctctgtgcccccaccagacatcacctacaccctggccctgcccagcgacagcggggccctgagcgccctgcagctggaggccatcacctacgcctgccagcagcacgaggtgctgctgcccagcggccagagagctggcttcctgattggagatggagctggggtgggcaagggccgcacagtggccggggtcatcctggagaaccacctgcggggcaggaagaaggccctgtggttctctgtgtccaatgacctgaagtatgatgctgagcgggacctgcgggacatcgaggccaccggcattgctgtgcacgccctgagcaaggtgggcgctgtgctgggcaaggtgggcggcaaggtgggcaccgtgccctgcaagatcaagtacggggacaccaccaccagcgagggcgtgctgtttgccacctacagcgccctgattggagagagccaggccggcggccagcacaggacccggctgcggcagatcctggactggtgtggggaggcctttgagggcgtcatcgtgtttgatgagtgccacaaggccaagaatgccggcagcaccaagatgggcaaggctgtgctggacctgcagaacaagctgcccctggcccgggtggtgtatgccagcgccaccggggccagcgagcccaggaacatgatctacatgagccggctgggcatctggggcgagggcacccccttcaggaactttgaggagttcctgcacgccatcgagaagaggggcgtgggcgccatggagatcgtggccatggacatgaaggtgtctggcatgtacatcgcccggcagctgtccttcagcggcgtgaccttccgcatcgaggagatccccctggccccagcctttgaatgtgtgtacaacagagctgccctgctgtgggccgaggccctgaatgtgttccagcaggccgctgactggattggcctggagagcaggaagagcctgtggggccagttctggagcgcccaccagcgcttcttcaagtacctgtgcatcgccgccaaggtgcggcggctggtggagctggcccgggaggagctggcccgggacaagtgtgtggtgattggcctgcagagcactggagaggcccggacccgggaggtgctgggggagaatgatggccacctgaactgctttgtgtctgctgctgagggcgtcttcctgagcctcatccagaagcacttccccagcaccaagaggaagagggacagaggagctggcagcaagaggaagccaggagtcatccgcatcagtgatgacagcagcacagaaagtgaccccggcctggacagcgacttcaacagcagccctgagagcctggtggatgatgatgtggtgattgtggatgctgtgggcctgcccagtgatgaccggggccccctgtgcctgctgcagagggacccccacggccctggggtgctggagcgggtggagcggctgaagcaggacctgctggacaaggtgcggcggctgggccgggagctgcctgtgaacaccctggatgagctgattgaccagctgggcggcccccagagggtggccgagatgacaggcaggaagggccgggtggtgtccaggccagatggcaccgtggcctttgagagcagagctgagcagggcctgagcattgaccacgtgaacctgcgggagaagcagcgcttcatgtctggagagaagctggtggccatcatcagcgaggccagcagcagtggagtgtccctgcaggccgacagaagagtgcagaaccagaggcggcgggtgcacatgaccctggagctgccctggagcgctgaccgggccatccagcagtttggaagaacccacaggagcaaccaggtgtctgccccagaatatgtgttcctgatcagcgagctggccggggagaggagatttgccagcatcgtggccaagaggctggagagcctgggcgccctgacccacggggacagaagagccacagagagccgggacctgagcaagtacaactttgagaacaagtatggcacccgggccctgcactgtgtgctgaccaccatcctgagccagacagagaacaaggtgcctgtgccccagggctacccaggaggagtgcccaccttcttccgggacatgaagcagggcctgctgtctgtgggcatcggcggccgggagagcagaaatggctgcctggatgtggagaaggactgcagcatcaccaagttcctgaaccgcatcctgggcctggaggtgcacaagcagaatgccctcttccagtacttcagtgacacctttgaccacctgattgagatggacaagcgggagggcaagtatgacatgggcatcctgggggagcaccgctgccggggcgtggtgtgggtggacctggcccctggcatcgaggagatctatgaggagagccagcaggtgttcctggcccctggccacccccaggacggccaggtggtgttctacaagatctctgtggaccggggcctgaagtgggaggatgcctttgccaagagcctggccctgaccggcccctatgatggcttctacctgagctacaaggtgcggggcaacaagcccagctgcctgctggccgagcagaacagaggccagttcttcaccgtgtacaagcccaacatcggccggcagagccagctggaggccctggacagcctgcggaggaagttccaccgggtgacagctgaggaggccaaggagccctgggagagcggctacgccctgagcctgacccactgcagccacagcgcctggaacagacactgccgcctggcccaggagggcaaggactgcctgcagggcctgcggctgcggcaccactacatgctgtgtggggccctgctgcgggtgtggggcagaattgctgctgtgatggctgatgtgagcagcagcagctacctgcagatcgtgcggctgaagaccaaggacaggaagaagcaggtgggcatcaagatccctgagggctgtgtgagaagagtgctgcaggagctgcggctgatggatgctgatgtgaagaggcggcaggccccagccctgggctgcccagcccccccagccccccggcccctggccctgccctgtggccctggagaggtgctggacctgacctacagccccccagctgaggccttccccccaccaccccacttctccttccctgcccccctgagcctggatgctggccctggggtggtgcccctgggcaccccagatgcccaggccgaccctgctgccctggcccaccagggctgtgacatcaacttcaaggaggtgctggaggacatgctgcggagcctgcatgctggccccccatctgagggcgccctgggggagggcgctggggccggcggcgctgctgggggcggccctgagcggcagagcgtcatccagttcagcccccccttccctggggcccaggcccccctgtag

SEQ ID NO: 42437 - DNA, 4101 bp, Artificial Sequence
  Description of Artificial Sequence: Synthetic coding sequence
atgctggccgtgggccctgccatggaccgggactacccccagcacgagcccccacctgctggcagcctgctgtacagccccccacccctgcagagcgccatgctgcactgcccctactggaacaccttcagcctgcccccctacccagccttcagcagtgacagccggcccttcatgagcagcgccagcttcctgggcagccagccctgcccagacaccagctatgcccctgtggccacagccagcagcctgccccccaagacctgtgactttgcccaggacagcagctactttgaggacttcagcaacatcagcatcttcagcagctctgtggacagcctgagtgacatcgtggacaccccagacttcctgcctgctgacagcctgaaccaggtgtccaccatctgggatgacaacccagcccccagcacccatgacaagctgttccagctgagccggccctttgctggctttgaggacttcctgcccagccacagcacccccctgctggtgtcctaccaggagcagagcgtgcagagccagcctgaggaggaggatgaggccgaggaggaggaggccgaggagctgggccacacagagacctatgctgactatgtgcccagcaagagcaagattggcaagcagcacccagacagagtggtggagaccagcaccctgagctctgtgcccccaccagacatcacctacaccctggccctgcccagcgacagcggggccctgagcgccctgcagctggaggccatcacctacgcctgccagcagcacgaggtgctgctgcccagcggccagagagctggcttcctgattggagatggagctggggtgggcaagggccgcacagtggccggggtcatcctggagaaccacctgcggggcaggaagaaggccctgtggttctctgtgtccaatgacctgaagtatgatgctgagcgggacctgcgggacatcgaggccaccggcattgctgtgcacgccctgagcaagatcaagtacggggacaccaccaccagcgagggcgtgctgtttgccacctacagcgccctgattggagagagccaggccggcggccagcacaggacccggctgcggcagatcctggactggtgtggggaggcctttgagggcgtcatcgtgtttgatgagtgccacaaggccaagaatgccggcagcaccaagatgggcaaggctgtgctggacctgcagaacaagctgcccctggcccgggtggtgtatgccagcgccaccggggccagcgagcccaggaacatgatctacatgagccggctgggcatctggggcgagggcacccccttcaggaactttgaggagttcctgcacgccatcgagaagaggggcgtgggcgccatggagatcgtggccatggacatgaaggtgtctggcatgtacatcgcccggcagctgtccttcagcggcgtgaccttccgcatcgaggagatccccctggccccagcctttgaatgtgtgtacaacagagctgccctgctgtgggccgaggccctgaatgtgttccagcaggccgctgactggattggcctggagagcaggaagagcctgtggggccagttctggagcgcccaccagcgcttcttcaagtacctgtgcatcgccgccaaggtgcggcggctggtggagctggcccgggaggagctggcccgggacaagtgtgtggtgattggcctgcagagcactggagaggcccggacccgggaggtgctgggggagaatgatggccacctgaactgctttgtgtctgctgctgagggcgtcttcctgagcctcatccagaagcacttccccagcaccaagaggaagagggacagaggagctggcagcaagaggaagagaagaccccggggccgcggggccaaggccccccggctggcctgtgaaacagctggggtcatccgcatcagtgatgacagcagcacagaaagtgaccccggcctggacagcgacttcaacagcagccctgagagcctggtggatgatgatgtggtgattgtggatgctgtgggcctgcccagtgatgaccggggccccctgtgcctgctgcagagggacccccacggccctggggtgctggagcgggtggagcggctgaagcaggacctgctggacaaggtgcggcggctgggccgggagctgcctgtgaacaccctggatgagctgattgaccagctgggcggcccccagagggtggccgagatgactggaaggaagggccgggtggtgtccaggccagatggcaccgtggcctttgagagcagagctgagcagggcctgagcattgaccacgtgaacctgcgggagaagcagcgcttcatgtctggagagaagctggtggccatcatcagcgaggccagcagcagcggcgtgtccctgcaggccgaccggcgggtgcagaaccagaggagaagagtgcacatgaccctggagctgccctggagcgctgaccgggccatccagcagtttggccgcacccacaggagcaaccaggtgtctgccccagaatatgtgttcctgatcagcgagctggccggggagaggagatttgccagcatcgtggccaagaggctggagagcctgggcgccctgacccatggagaccggcgggccacagagagccgggacctgagcaagtacaactttgagaacaagtatggcacccgggccctgcactgtgtgctgaccaccatcctgagccagacagagaacaaggtgcctgtgccccagggctacccaggcggcgtgcccaccttcttccgggacatgaagcagggcctgctgtctgtgggcattggaggccgggagagcagaaatggctgcctggatgtggagaaggactgcagcatcaccaagttcctgaaccgcatcctgggcctggaggtgcacaagcagaatgccctcttccagtacttcagtgacacctttgaccacctgattgagatggacaagcgggagggcaagtatgacatgggcatcctggacctggcccctggcatcgaggagatctatgaggagagccagcaggtgttcctggcccctggccacccccaggacggccaggtggtgttctacaagatctctgtggaccggggcctgaagtgggaggatgcctttgccaagagcctggccctgaccggcccctatgatggcttctacctgagctacaaggtgcggggcaacaagcccagctgcctgctggccgagcagaacagaggccagttcttcaccgtgtacaagcccaacatcggccggcagagccagctggaggccctggacagcctgcggaggaagttccaccgggtgacagctgaggaggccaaggagccctgggagagcggctacgccctgagcctgacccactgcagccacagcgcctggaacagacactgccgcctggcccaggagggcaaggactgcctgcagggcctgcggctgcggcaccactacatgctgtgtggggccctgctgcgggtgtggggcagaattgctgctgtgatggctgatgtgagcagcagcagctacctgcagatcgtgcggctgaagaccaaggacaggaagaagcaggtgggcatcaagatccctgagggctgtgtgagaagagtgctgcaggagctgcggctgatggatgctgatgtgaagaggcggcaggccccagccctgggctgcccagcccccccagccccccggcccctggccctgccctgtggccctggagaggtgctggacctgacctacagccccccagctgaggccttccccccaccaccccacttctccttccctgcccccctgagcctggatgctggccctggggtggtgcccctgggcaccccagatgcccaggccgaccctgctgccctggcccaccagggctgtgacatcaacttcaaggaggtgctggaggacatgctgcggagcctgcatgctggccccccatctgagggcgccctgggggagggcgctggggccggcggcgctgctgggggcggccctgagcggcagagcgtcatccagttcagcccccccttccctggggcccaggcccccctgtag

SEQ ID NO: 42438 - DNA, 3930 bp, Artificial Sequence
  Description of Artificial Sequence: Synthetic coding sequence
atgagggagcccctgcccggcagcgcctcctggggcaccccaggcccccccagcgctggcaccatgagccagctgcagctgtggctgcagtttgaggccctgaacaaggacagcagctactttgaggacttcagcaacatcagcatcttcagcagctctgtggacagcctgagtgacatcgtggacaccccagacttcctgcctgctgacagcctgaaccaggtgtccaccatctgggatgacaacccagcccccagcacccatgacaagctgttccagctgagccggccctttgctggctttgaggacttcctgcccagccacagcacccccctgctggtgtcctaccaggagcagagcgtgcagagccagcctgaggaggaggatgaagctgaggaggaggaggccgaggagctgggccacacagagacctacgccgactatgtgcccagcaagagcaagattggcaagcagcacccagacagagtggtggagaccagcaccctgagctctgtgcccccaccagacatcacctacaccctggccctgcccagcgacagcggggccctgagcgccctgcagctggaggccatcacctacgcctgccagcagcacgaggtgctgctgcccagcggccagagagctggcttcctgattggagatggagctggggtgggcaaaggaagaacagtggccggggtcatcctggagaaccacctgcggggcaggaagaaggccctgtggttctctgtgtccaatgacctgaagtatgatgctgagcgggacctgcgggacatcgaggccactggaattgctgtgcacgccctgagcaagatcaagtatggagacaccaccaccagcgagggcgtgctgtttgccacctacagcgccctgattggagagagccaggccggcggccagcacaggacccggctgcggcagatcctggactggtgtggggaggcctttgaaggagtgattgtgtttgatgagtgccacaaggccaagaatgccggcagcaccaagatgggcaaggctgtgctggacctgcagaacaagctgcccctggcccgggtggtgtatgccagcgccactggagccagcgagcccaggaacatgatctacatgagccggctgggcatctggggcgagggcacccccttcaggaactttgaggagttcctgcacgccatcgagaagaggggcgtgggcgccatggagatcgtggccatggacatgaaggtgtctggcatgtacatcgcccggcagctgtccttctctggagtgaccttcagaattgaggagatccccctggccccagcctttgaatgtgtgtacaacagagctgccctgctgtgggccgaggccctgaatgtgttccagcaggccgctgactggattggcctggagagcaggaagagcctgtggggccagttctggagcgcccaccagcgcttcttcaagtacctgtgcatcgccgccaaggtgcggcggctggtggagctggcccgggaggagctggcccgggacaagtgtgtggtgattggcctgcagagcactggagaggcccggacccgggaggtgctgggagaaaatgatggccacctgaactgctttgtgtctgctgctgagggcgtcttcctgagcctcatccagaagcacttccccagcaccaagaggaagagggacagaggagctggcagcaagaggaagaggcggccccggggccgcggggccaaggccccccggctggcctgtgaaacagctggggtcatccgcatcagtgatgacagcagcacagaaagtgaccccggcctggacagcgacttcaacagcagccctgagagcctggtggatgatgatgtggtgattgtggatgctgtgggcctgcccagtgatgaccggggccccctgtgcctgctgcagagggacccccacggccctggggtgctggagcgggtggagcggctgaagcaggacctgctggacaaggtgcggcggctgggccgggagctgcctgtgaacaccctggatgagctgattgaccagctgggcggcccccagagggtggccgagatgacaggcaggaagggccgggtggtgtccaggccagatggcaccgtggcctttgagagcagagctgagcagggcctgagcattgaccacgtgaacctgcgggagaagcagcgcttcatgtctggagagaagctggtggccatcatcagcgaggccagcagcagtggagtgtccctgcaggccgacagaagagtgcagaaccagaggcggcgggtgcacatgaccctggagctgccctggagcgctgaccgggccatccagcagtttggaagaacccacaggagcaaccaggtgtctgccccagaatatgtgttcctgatcagcgagctggccggggagaggagatttgccagcatcgtggccaagaggctggagagcctgggcgccctgacccacggggacagaagagccacagagagccgggacctgagcaagtacaactttgagaacaagtatggcacccgggccctgcactgtgtgctgaccaccatcctgagccagacagagaacaaggtgcctgtgccccagggctacccaggaggagtgcccaccttcttccgggacatgaagcagggcctgctgtctgtgggcatcggcggccgggagagcagaaatggctgcctggatgtggagaaggactgcagcatcaccaagttcctgaaccgcatcctgggcctggaggtgcacaagcagaatgccctcttccagtacttcagtgacacctttgaccacctgattgagatggacaagcgggagggcaagtatgacatgggcatcctggacctggcccctggcatcgaggagatctatgaggagagccagcaggtgttcctggcccctggccacccccaggacggccaggtggtgttctacaagatctctgtggaccggggcctgaagtgggaggatgcctttgccaagagcctggccctgaccggcccctatgatggcttctacctgagctacaaggtgcggggcaacaagcccagctgcctgctggccgagcagaacagaggccagttcttcaccgtgtacaagcccaacatcggccggcagagccagctggaggccctggacagcctgcggaggaagttccaccgggtgacagctgaggaggccaaggagccctgggagagcggctacgccctgagcctgacccactgcagccacagcgcctggaacagacactgccgcctggcccaggagggcaaggactgcctgcagggcctgcggctgcggcaccactacatgctgtgtggggccctgctgcgggtgtggggcagaattgctgctgtgatggctgatgtgagcagcagcagctacctgcagatcgtgcggctgaagaccaaggacaggaagaagcaggtgggcatcaagatccctgagggctgtgtgcggcgggtgctgcaggagctgcggctgatggatgctgatgtgaagaggcggcaggccccagccctgggctgcccagcccccccagccccccggcccctggccctgccctgtggccctggagaggtgctggacctgacctacagccccccagctgaggccttccccccaccaccccacttctccttccctgcccccctgagcctggatgctggccctggggtggtgcccctgggcaccccagatgcccaggccgaccctgctgccctggcccaccagggctgtgacatcaacttcaaggaggtgctggaggacatgctgcggagcctgcacgccggcccccccagcgagggcgccctgggggagggcgctggggccggcggggccgccggcggcggccctgagcggcagagcgtcatccagttcagcccccccttccctggggcccaggcccccctgtag

SEQ ID NO: 42439 - DNA, 453 bp, Artificial Sequence
  Description of Artificial Sequence: Synthetic coding sequence
atgagcggctggatcgccaccagcaagaccaggatgcaggacttctggagcctgctgaccttcagcagtgacctggtggatgtgaaggacagcggggactaccccctgacagcccctggcctgtcctggaagaagttccagggcagcttctgtgaatttgtgggcaccctggtgtgccgctgccagtacatcctgctgcatgatgacttccccatggacaacctgatcagcctgctgaccggcttcagtgacagccaggtgtgtgccttctgccacaccagcaccctggccgccatgaagctgatgaccagcctggtgcgggtggccctgcagctgagcctgcacgaggacatcaaccagaggcagtatgaagctgagagaaataaaggacctggccagagggcccctgagcggctggagagcctgctggagaagcacaaggagctgcactag

SEQ ID NO: 42440 - DNA, 453 bp, Artificial Sequence; identical to SEQ ID NO: 42439
  Description of Artificial Sequence: Synthetic coding sequence

SEQ ID NO: 42441 - DNA, 891 bp, Artificial Sequence
  Description of Artificial Sequence: Synthetic coding sequence
atgctgagccccaaggacatcctgaggaaggacctgaagctggtgcacggctaccccatgacctgtgcctttgccagcaactgggagaagattgagcagttccacagcaggccagatgacatcgtgattgccacctaccccaagagcggcaccacctgggtgtctgagatcatcgacatgatcctgaatgatggagacatcgagaagtgcaagaggggcttcatcacagagaaggtgcccatgctggagatgaccctgcccggcctgcggaccagcggcatcgagcagctggagaagaaccccagccccagaattgtgaagacccacctgcccacagacctgctgcccaagagcttctgggagaacaactgcaagatgatctacctggccagaaatgccaaggatgtgtctgtgtcctactaccactttgacctgatgaacaacctgcagcccttccctggcacctgggaggagtacctggagaagttcctgaccgggaaggtggcctacggctcctggttcacccacgtgaagaactggtggaagaagaaggaggagcaccccatcctcttcctgtactatgaggacatgaaggagaaccccaaggaggagatcaagaagatcatccgcttcctggagaagaacctgaatgatgagatcctggaccgcatcatccaccacaccagctttgaggtgatgaaggacaaccccctggtgaactacacccacctgcccaccaccgtgatggaccacagcaagagccccttcatgaggaaaggaacagctggggactggaagaactacttcaccgtggcccagaatgagaagtttgatgccatctatgaaacagagatgagcaagacagccctgcagttcagaacagagatctag

SEQ ID NO: 42442 - DNA, 468 bp, Artificial Sequence
  Description of Artificial Sequence: Synthetic coding sequence
atgctgagccccaaggacatcctgaggaaggacctgaagctggtgcacggctaccccatgacctgtgcctttgccagcaactgggagaagattgagcagttccacagcaggccagatgacatcgtgattgccacctaccccaagagcggcaccacctgggtgtctgagatcatcgacatgatcctgaatgatggagacatcgagaagtgcaagaggggcttcatcacagagaaggtgcccatgctggagatgaccctgcccggcctgcggaccagcggcatcgagcagctggagaagaaccccagccccagaattgtgaagacccacctgcccacagacctgctgcccaagagcttctgggagaacaactgcaagatgatctacctggccagaaatgccaaggatgtgtctgtgtcctactaccactttgacctgatgaacaacctgcagcccttccctggcacctag

SEQ ID NO: 42443 - DNA, 639 bp, Artificial Sequence
  Description of Artificial Sequence: Synthetic coding sequence
atggaccctgtggtgctgagctacatggacagcctgctgcggcagagtgatgtgtccctgctggaccccccatcctggctgaatgaccacatcatcggctttgcctttgagtactttgccaacagccagttccatgactgcagcgaccacgtgtccttcatcagccctgaggtgacccagttcatcaagtgcaccagcaacccagctgagatcgccatgttcctggagcccctggacctgcccaacaagagggtggtgttcctggccatcaatgacaacagcaaccaggccgccggcggcacccactggagcctgctggtgtacctgcaggacaagaacagcttcttccactatgacagccacagccgcagcaacagcgtgcacgccaagcaggtggccgagaagctggaggccttcctgggcaggaaaggagacaagctggcctttgtggaggagaaggccccagcccagcagaacagctatgactgtggcatgtatgtgatctgcaacacagaggccctgtgccagaacttcttccggcagcagacagagagcctgctgcagctgctgaccccagcctacatcaccaagaagagaggagagtggaaggacctgatcaccaccctggccaagaagtag

SEQ ID NO: 42444 - DNA, 639 bp, Artificial Sequence; identical to SEQ ID NO: 42443
  Description of Artificial Sequence: Synthetic coding sequence

SEQ ID NO: 42445 - DNA, 639 bp, Artificial Sequence; identical to SEQ ID NO: 42443
  Description of Artificial Sequence: Synthetic coding sequence

SEQ ID NO: 42446 - DNA, 639 bp, Artificial Sequence; identical to SEQ ID NO: 42443
  Description of Artificial Sequence: Synthetic coding sequence

SEQ ID NO: 42447 - DNA, 1668 bp, Artificial Sequence
  Description of Artificial Sequence: Synthetic coding sequence
atggctgacagaggaggagtgggggaggccgctgctgtgggcgccagccctgcctctgtgcccggcctgaaccccaccctgggctggagggagcggctgcgggccggcctggccggcaccggggccagcctgtggtttgtggccggcctgggcctgctgtatgccctgcgcatccccctgcggctgtgtgagaacctggccgctgtgaccgtcttcctgaacagcctgacccccaagttctacgtggccctgaccggcaccagcagcctcatcagcggcctcatcttcatctttgagtggtggtacttccacaagcacggcaccagcttcatcgagcaggtgtctgtgagccacctgcagcccctgatgggcggcacagagagcagcatcagcgagcccggcagccccagcaggaacagagaaaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagaggaaccccccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggacctgatgaaggagttcccccccctgaccatgctgaacatccacgagaacctgctggagagcctgctggagctgcaggcctacccagatgtgcaggccgtgctggccaagtatgatgacatcagcctgcccaagtctgctgccatctgctacacagctgccctgctgaagaccaggacagtgtctgagaagttcagccctgagacagccagcagaagaggcctgagcacagctgagatcaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctgcagcactggaagagaattgagggcgccctgaacctgctgcagtgcacctgggagggcaccttcaggatgatcccctaccccctggagaagggccacctgttctacccctaccccagctgcacagaaacagctgaccgggagctgctgcccaccttccaccacgtgtctgtgtaccccaagaaggagctgcccctcttcatccacttcaccgctggcttctgcagcagcacagccatgattgccatcctgacccaccagtttcctgagatcatgggcatctttgccaaggctgtgtccatgatcagcaggacctgtgtggactacctgtag

SEQ ID NO: 42448 - DNA, 1728 bp, Artificial Sequence
  Description of Artificial Sequence: Synthetic coding sequence
atggctgacagaggaggagtgggggaggccgctgctgtgggcgccagccctgcctctgtgcccggcctgaaccccaccctgggctggagggagcggctgcgggccggcctggccggcaccggggccagcctgtggtttgtggccggcctgggcctgctgtatgccctgcgcatccccctgcggctgtgtgagaacctggccgctgtgaccgtcttcctgaacagcctgacccccaagttctacgtggccctgaccggcaccagcagcctcatcagcggcctcatcttcatctttgagtggtggtacttccacaagcacggcaccagcttcatcgagcaggtgtctgtgagccacctgcagcccctgatgggcggcacagagagcagcatcagcgagcccggcagccccagcaggaacagagaaaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagaggaaccccccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggacctgatgaaggagttcccccccctgaccatgctgaacatccacgagaacctgctggagagcctgctggagctgcaggcctacccagatgtgcaggccgtgctggccaagtatgatgacatcagcctgcccaagtctgctgccatctgctacacagctgccctgctgaagaccaggacagtgtctgagaagttcagccctgagacagccagcagaagaggcctgagcacagctgagatcaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctgcagcactggaagagaattgagggcgccctgaacctgctgcagtgcacctgggagggcaccttcaggatgatcccctaccccctggagaagggccacctgttctacccctaccccagctgcacagaaacagctgaccgggagctgctgcccaccttccaccacgtgtctgtgtaccccaagaaggagctgcccctcttcatccacttcaccgctggcttctgcagcagcacagccatgattgccatcctgacccaccagtttcctgagatcatgggcatctttgccaaggctgtgctgggcctgtggtgcccccagccctgggccagcagcggctttgaggagaacacccaggacctgaagtctgaggacctgggcctgagcagcggctag

SEQ ID NO: 42449 - DNA, 1635 bp, Artificial Sequence
  Description of Artificial Sequence: Synthetic coding sequence
atggctgacagaggaggagtgggggaggccgctgctgtgggcgccagccctgcctctgtgcccggcctgaaccccaccctgggctggagggagcggctgcgggccggcctggccggcaccggggccagcctgtggtttgtggccggcctgggcctgctgtatgccctgcgcatccccctgcggctgtgtgagaacctggccgctgtgaccgtcttcctgaacagcctgacccccaagttctacgtggccctgaccggcaccagcagcctcatcagcggcctcatcttcatctttgagtggtggtacttccacaagcacggcaccagcttcatcgagcaggtgtctgtgagccacctgcagcccctgatgggcggcacagagagcagcatcagcgagcccggcagccccagcaggaacagagaaaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagaggaaccccccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggacctgatgaaggagttcccccccctgaccatgctgaacatccacgagaacctgctggagagcctgctggagctgcaggcctacccagatgtgcaggccgtgctggccaagtatgatgacatcagcctgcccaagtctgctgccatctgctacacagctgccctgctgaagaccaggacagtgtctgagaagttcagccctgagacagccagcagaagaggcctgagcacagctgagatcaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctgcagcactggaagagaattgagggcgccctgaacctgctgcagtgcacctgggagggcaccttccaccacgtgtctgtgtaccccaagaaggagctgcccctcttcatccacttcaccgctggcttctgcagcagcacagccatgattgccatcctgacccaccagtttcctgagatcatgggcatctttgccaaggctgtgctgggcctgtggtgcccccagccctgggccagcagcggctttgaggagaacacccaggacctgaagtctgaggacctgggcctgagcagtggatag

SEQ ID NO: 42450 - DNA, 690 bp, Artificial Sequence
  Description of Artificial Sequence: Synthetic coding sequence
atgagccccttcctgttcagagatgacatgaaggacctgaccgtcttcctgaacagcctgacccccaagttctacgtggccctgaccggcaccagcagcctcatcagcggcctcatcttcatctttgagtggtggtacttccacaagcacggcaccagcttcatcgagcaggtgtctgtgagccacctgcagcccctgatgggcggcacagagagcagcatcagcgagcccggcagccccagcaggaacagagaaaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagaggaaccccccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgtag

SEQ ID NO: 42451 - DNA, 966 bp, Artificial Sequence
  Description of Artificial Sequence: Synthetic coding sequence
atgggcggcacagagagcagcatcagcgagcccggcagccccagcaggaacagagaaaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagaggaaccccccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggacctgatgaaggagttcccccccctgaccatgctgaacatccacgagaacctgctggagagcctgctggagctgcaggcctacccagatgtgcaggccgtgctggccaagtatgatgacatcagcctgcccaagtctgctgccatctgctacacagctgccctgctgaagaccaggacagtgtctgagaagttcagccctgagacagccagcagaagaggcctgagcacagctgagatcaatgctgtggaggccatccacagagctgtggagttcaacccccacgtgcccaaggtggagatctaccccttcagcccccagctgaacatcaaggctgtggacaacagcgccatcagcaagtacccagccaacatgtactag

SEQ ID NO: 42452 - DNA, 1617 bp, Artificial Sequence
  Description of Artificial Sequence: Synthetic coding sequence
atggctgacagaggaggagtgggggaggccgctgctgtgggcgccagccctgcctctgtgcccggcctgaaccccaccctgggctggagggagcggctgcgggccggcctggccggcaccggggccagcctgtggtttgtggccggcctgggcctgctgtatgccctgcgcatccccctgcggctgtgtgagaacctggccgccggcaccagcagcctcatcagcggcctcatcttcatctttgagtggtggtacttccacaagcacggcaccagcttcatcgagcaggtgtctgtgagccacctgcagcccctgatgggcggcacagagagcagcatcagcgagcccggcagccccagcaggaaccgggagaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagagaaatcctccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggacctgatgaaggagttcccccccctgaccatgctgaacatccacgagaacctgctggagagcctgctggagctgcaggcctacccagatgtgcaggccgtgctggccaagtatgatgacatcagcctgcccaagtctgctgccatctgctacacagctgccctgctgaagaccaggacagtgtctgagaagttcagccctgagacagccagccggcggggcctgagcacagctgagatcaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctgcagcactggaagagaattgaaggagccctgaacctgctgcagtgcacctgggagggcaccttcaggatgatcccctaccccctggagaagggccacctgttctacccctaccccagctgcacagaaacagctgaccgggagctgctgcccaccttccaccacgtgtctgtgtaccccaagaaggagctgcccctcttcatccacttcaccgctggcttctgcagcagcacagccatgattgccatcctgacccaccagtttcctgagatcatgggcatctttgccaaggctgtgtccatgatcagcaggacctgtgtggactacctgtag

SEQ ID NO: 42453 - DNA, 1668 bp, Artificial Sequence
  Description of Artificial Sequence: Synthetic coding sequence
atggctgacagaggaggagtgggggaggccgctgctgtgggcgccagccctgcctctgtgcccggcctgaaccccaccctgggctggagggagcggctgcgggccggcctggccggcaccggggccagcctgtggtttgtggccggcctgggcctgctgtatgccctgcgcatccccctgcggctgtgtgagaacctggccgctgtgaccgtcttcctgaacagcctgacccccaagttctacgtggccctgaccggcaccagcagcctcatcagcggcctcatcttcatctttgagtggtggtacttccacaagcacggcaccagcttcatcgagcaggtgtctgtgagccacctgcagcccctgatgggcggcacagagagcagcatcagcgagcccggcagccccagcaggaacagagaaaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagaggaaccccccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggacctgatgaaggagttcccccccctgaccatgctgaacatccacgagaacctgctggagagcctgctggagctgcaggcctacccagatgtgcaggccgtgctggccaagtatgatgacatcagcctgcccaagtctgctgccatctgctacacagctgccctgctgaagaccaggacagtgtctgagaagttcagccctgagacagccagcagaagaggcctgagcacagctgagatcaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctgcagcactggaagagaattgagggcgccctgaacctgctgcagtgcacctgggagggcaccttcaggatgatcccctaccccctggagaagggccacctgttctacccctaccccagctgcacagaaacagctgaccgggagctgctgcccaccttccaccacgtgtctgtgtaccccaagaaggagctgcccctcttcatccacttcaccgctggcttctgcagcagcacagccatgattgccatcctgacccaccagtttcctgagatcatgggcatctttgccaaggctgtggtgggcgtgaagacccagaaggaaaatgctgactag

SEQ ID NO: 42454 - DNA, 1179 bp, Artificial Sequence
  Description of Artificial Sequence: Synthetic coding sequence
atgaacctgagcgcccaggaccaccagaccttcttcacctgtgacacagacttcctgcggcccagcgacacagtgatgcagaaggcctggagggagagaaatcctccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggacctgatgaaggagttcccccccctgaccatgctgaacatccacgagaacctgctggagagcctgctggagctgcaggcctacccagatgtgcaggccgtgctggccaagtatgatgacatcagcctgcccaagtctgctgccatctgctacacagctgccctgctgaagaccaggacagtgtctgagaagttcagccctgagacagccagccggcggggcctgagcacagctgagatcaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctgcagcactggaagagaattgaaggagccctgaacctgctgcagtgcacctgggagggcaccttcaggatgatcccctaccccctggagaagggccacctgttctacccctaccccagctgcacagaaacagctgaccgggagctgctgcccaccttccaccacgtgtctgtgtaccccaagaaggagctgcccctcttcatccacttcaccgctggcttctgcagcagcacagccatgattgccatcctgacccaccagtttcctgagatcatgggcatctttgccaaggctgtgctgggcctgtggtgcccccagccctgggccagcagcggctttgaggagaacacccaggacctgaagtctgaggacctgggcctgagcagtggatag

SEQ ID NO: 42455 - DNA, 978 bp, Artificial Sequence
  Description of Artificial Sequence: Synthetic coding sequence
atgggcggcacagagagcagcatcagcgagcccggcagccccagcaggaacagagaaaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagaggaaccccccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggactacctgctggagatgaagagcctcatcctgcccccagagcacatcctgaagagaggagacagcgaggccatcgcctatgccttcttccacctgcagcactggaagagaattgaaggagccctgaacctgctgcagtgcacctgggagggcaccttccaccacgtgtctgtgtaccccaagaaggagctgcccctcttcatccacttcaccgctggcttctgcagcagcacagccatgattgccatcctgacccaccagtttcctgagatcatgggcatctttgccaaggctgtgctgggcctgtggtgcccccagccctgggccagcagcggctttgaggagaacacccaggacctgaagtctgaggacctgggcctgagcagcggctag

SEQ ID NO: 42456 - DNA, 864 bp, Artificial Sequence
  Description of Artificial Sequence: Synthetic coding sequence
tgaatttctgagcccggcagccccagcaggaacagagaaaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagaggaaccccccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggactacctgctggagatgaagagcctcatcctgcccccagagcacatcctgaagagaggagacagcgaggccatcgcctatgccttcttccacctgcagcactggaagagaattgaaggagccctgaacctgctgcagtgcacctgggagggcaccttccaccacgtgtctgtgtaccccaagaaggagctgcccctcttcatccacttcaccgctggcttctgcagcagcacagccatgattgccatcctgacccaccagtttcctgagatcatgggcatctttgccaaggcctag

SEQ ID NO: 42457 - DNA, 1677 bp, Artificial Sequence
  Description of Artificial Sequence: Synthetic coding sequence
atggctgacagaggaggagtgggggaggccgctgctgtgggcgccagccctgcctctgtgcccggcctgaaccccaccctgggctggagggagcggctgcgggccggcctggccggcaccggggccagcctgtggtttgtggccggcctgggcctgctgtatgccctgcgcatccccctgcggctgtgtgagaacctggccgccggcaccagcagcctcatcagcggcctcatcttcatctttgagtggtggtacttccacaagcacggcaccagcttcatcgagcaggtgtctgtgagccacctgcagcccctgatgggcggcacagagagcagcatcagcgagcccggcagccccagcaggaaccgggagaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagagaaatcctccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggacctgatgaaggagttcccccccctgaccatgctgaacatccacgagaacctgctggagagcctgctggagctgcaggcctacccagatgtgcaggccgtgctggccaagtatgatgacatcagcctgcccaagtctgctgccatctgctacacagctgccctgctgaagaccaggacagtgtctgagaagttcagccctgagacagccagccggcggggcctgagcacagctgagatcaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctgcagcactggaagagaattgaaggagccctgaacctgctgcagtgcacctgggagggcaccttcaggatgatcccctaccccctggagaagggccacctgttctacccctaccccagctgcacagaaacagctgaccgggagctgctgcccaccttccaccacgtgtctgtgtaccccaagaaggagctgcccctcttcatccacttcaccgctggcttctgcagcagcacagccatgattgccatcctgacccaccagtttcctgagatcatgggcatctttgccaaggctgtgctgggcctgtggtgcccccagccctgggccagcagcggctttgaggagaacacccaggacctgaagtctgaggacctgggcctgagcagtggatag

SEQ ID NO: 42458 - DNA, 1500 bp, Artificial Sequence
  Description of Artificial Sequence: Synthetic coding sequence
atgagccccttcctgttcagagatgacatgaaggacctgaccgtcttcctgaacagcctgacccccaagttctacgtggccctgaccggcaccagcagcctcatcagcggcctcatcttcatctttgagtggtggtacttccacaagcacggcaccagcttcatcgagcaggtgtctgtgagccacctgcagcccctgatgggcggcacagagagcagcatcagcgagcccggcagccccagcaggaacagagaaaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagaggaaccccccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggacctgatgaaggagttcccccccctgaccatgctgaacatccacgagaacctgctggagagcctgctggagctgcaggcctacccagatgtgcaggccgtgctggccaagtatgatgacatcagcctgcccaagtctgctgccatctgctacacagctgccctgctgaagaccaggacagtgtctgagaagttcagccctgagacagccagcagaagaggcctgagcacagctgagatcaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctgcagcactggaagagaattgagggcgccctgaacctgctgcagtgcacctgggagggcaccttcaggatgatcccctaccccctggagaagggccacctgttctacccctaccccagctgcacagaaacagctgaccgggagctgctgcccaccttccaccacgtgtctgtgtaccccaagaaggagctgcccctcttcatccacttcaccgctggcttctgcagcagcacagccatgattgccatcctgacccaccagtttcctgagatcatgggcatctttgccaaggctgtgtccatgatcagcaggacctgtgtggactacctgtag

SEQ ID NO: 42459 - DNA, 1206 bp, Artificial Sequence
  Description of Artificial Sequence: Synthetic coding sequence
atggctgacagaggaggagtgggggaggccgctgctgtgggcgccagccctgcctctgtgcccggcctgaaccccaccctgggctggagggagcggctgcgggccggcctggccggcaccggggccagcctgtggtttgtggccggcctgggcctgctgtatgccctgcgcatccccctgcggctgtgtgagaacctggccgccggcaccagcagcctcatcagcggcctcatcttcatctttgagtggtggtacttccacaagcacggcaccagcttcatcgagcaggtgtctgtgagccacctgcagcccctgatgggcggcacagagagcagcatcagcgagcccggcagccccagcaggaaccgggagaatgagaccagccggcagaacctgtctgagtgcaaggtgtggaggaaccccctgaacctcttcagaggagctgagtaccgccgctacacctgggtgacaggcaaggagcccctgacctactatgacatgaacctgagcgcccaggaccaccagaccttcttcacctgtgacacagacttcctgcggcccagcgacacagtgatgcagaaggcctggagggagagaaatcctccagcccgcatcaaggccgcctaccaggccctggagctgaacaatgactgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggacctgatgaaggagttcccccccctgaccatgctgaacatccacgagaacctgctggagagcctgctggagctgcaggcctacccagatgtgcaggccgtgctggccaagtatgatgacatcagcctgcccaagtctgctgccatctgctacacagctgccctgctgaagaccaggacagtgtctgagaagttcagccctgagacagccagccggcggggcctgagcacagctgagatcaatgctgtggaggccatccacagagctgtggagttcaacccccacgtgcccaagctgctggagtag

SEQ ID NO: 42460 - DNA, 1533 bp, Artificial Sequence
  Description of Artificial Sequence: Synthetic coding sequence
atggctgacagaggaggagtgggggaggccgctgctgtgggcgccagccctgcctctgtgcccggcctgaaccccaccctgggctggagggagcggctgcgggccggcctggccggcaccggggccagcctgtggtttgtggccggcctgggcctgctgtatgccctgcgcatccccctgcggctgtgtgagaacctggccgctgtgaccgtcttcctgaacagcctgacccccaagttctacgtggccctgaccggcaccagcagcctcatcagcggcctcatcttcatctttgagtggtggtacttccacaagcacggcaccagcttcatcgagcaggtgtctgtgagccacctgcagcccctgatgggcggcacagagagcagcatcagcgagcccggcagccccagcaggaacagagaaaatgagaccagccggcagaacctgtctgagtgcaaggtgtggaggaaccccctgaacctcttcagaggagctgagtaccgcagctgtgccacagcctacgtgctgctggccgaggaggaggccaccaccatcgtggatgctgagcggctcttcaagcaggccctgaaggccggggagaccatctaccggcagagccagcagtgccagcaccagagcccccagcacgaggcccagctgcggcgggacaccaacgtgctggtgtacatcaagaggcggctggccatgtgtgccaggaagctgggccgcatccgggaggccgtgaagatcatgagggacctgatgaaggagttcccccccctgaccatgctgaacatccacgagaacctgctggagagcctgctggagctgcaggcctacccagatgtgcaggccgtgctggccaagtatgatgacatcagcctgcccaagtctgctgccatctgctacacagctgccctgctgaagaccaggacagtgtctgagaagttcagccctgagacagccagccggcggggcctgagcacagctgagatcaatgctgtggaggccatccacagagctgtggagttcaacccccacgtgcccaagtacctgctggagatgaagagcctcatcctgcccccagagcacatcctgaagagaggagacagcgaggccatcgcctatgccttcttccacctgcagcactggaagagaattgaaggagccctgaacctgctgcagtgcacctgggagggcaccttcaggatgatcccctaccccctggagaagggccacctgttctacccctaccccagctgcacagaaacagctgaccgggagctgctgcccaccttccaccacgtgtctgtgtaccccaagaaggagctgcccctcttcatccacttcaccgctggcttctgcagcagcacagccatgattgccatcctgacccaccagtttcctgagatcatgggcatctttgccaaggctgtgctgggcctgtggtgcccccagccctgggccagcagcggctttgaggagaacacccaggacctgaagtctgaggacctgggcctgagcagtggatag

SEQ ID NO: 42461 - DNA, 444 bp, Artificial Sequence
  Description of Artificial Sequence: Synthetic coding sequence
atgggcagccagggcagcggcggcgtgcccctggtgcaggccccctacacagtgctgctgctgcccctgggcaccagccggcaggaccccggggcccagagcttcttcctgtggctgcggaggatgcaggccctggagcgggagcaggatgccctgtggcagggcctggagctgctgcagcacggccaggcctggtttgaggaccacctgcgggaggcccagaggcagcagctgcacctgggcgccctgggggagaacttcctgacagacctgcacagcgagcccggccggccccccctggcccagatccagaaggtgaacatctgcctgcagaacctgattcatgagaagctgagccggcagcagaagggcgtgacccagcccaaggaggagatggcccagaggggctgcaccaagggcccccggggccccaccagggtgtag

SEQ ID NO: 42462 - DNA, 537 bp, Artificial Sequence
  Description of Artificial Sequence: Synthetic coding sequence
atgggcagccagggcagcggcggcgtgcccctggtgcaggccccctacacagtgctgctgctgcccctgggcaccagccggcaggaccccggggcccagagcttcttcctgtggctgcggaggatgcaggccctggagcgggagcaggatgccctgtggcagggcctggagctgctgcagcacggccaggcctggtttgaggaccacctgcgggaggcccagaggcagcagctgcacctgggcgccctgggggagaacttcctgacagacctgcacagcgagcccggccggccccccctggcccagatccagaaggtgaacatctgcctgcagaacctgattcatgagaagttcagccccagccccctgaacaaggccagcagctgcaccacccaggacagcaaggagcggcggcgggagcagaacctgtggcagcagcaggagctgagccggcagcagaagggcgtgacccagcccaaggaggagatggcccagaggggctgcaccaagggcccccggggccccaccagggtgtag

SEQ ID NO: 42463 - DNA, 444 bp, Artificial Sequence; identical to SEQ ID NO: 42461
  Description of Artificial Sequence: Synthetic coding sequence

SEQ ID NO: 42464 - DNA, 447 bp, Artificial Sequence
  Description of Artificial Sequence: Synthetic coding sequence
atgggcagccagggcagcggcggcgtgcccctggtgcaggccccctacacagtgctgctgctgcccctgggcaccagccggcaggaccccggggcccagagcttcttcctgtggctgcggaggatgcaggccctggagcgggagcaggatgccctgtggcagggcctggagctgctgcagcacggccaggcctggtttgaggaccacctgcgggaggcccagaggcagcagctgcacctgggcgccctgggggagaacttcctgacagacctgcacagcgagcccggccggccccccctggcccagatccagaaggtgaacatctgcctgcagaacctgattcatgagaaggagctgagccggcagcagaagggcgtgacccagcccaaggaggagatggcccagaggggctgcaccaagggcccccggggccccaccagggtgtag

SEQ ID NO: 42465 - DNA, 444 bp, Artificial Sequence; identical to SEQ ID NO: 42461
  Description of Artificial Sequence: Synthetic coding sequence

SEQ ID NO: 42466 - DNA, 444 bp, Artificial Sequence; identical to SEQ ID NO: 42461
  Description of Artificial Sequence: Synthetic coding sequence

SEQ ID NO: 42467 - DNA, 444 bp, Artificial Sequence; identical to SEQ ID NO: 42461
  Description of Artificial Sequence: Synthetic coding sequence

SEQ ID NO: 42468 - DNA, 537 bp, Artificial Sequence; identical to SEQ ID NO: 42462
  Description of Artificial Sequence: Synthetic coding sequence

SEQ ID NO: 42469 - DNA, 537 bp, Artificial Sequence; identical to SEQ ID NO: 42462
  Description of Artificial Sequence: Synthetic coding sequence

SEQ ID NO: 42470 - DNA, 537 bp, Artificial Sequence; identical to SEQ ID NO: 42462
  Description of Artificial Sequence: Synthetic coding sequence

SEQ ID NO: 42471 - DNA, 444 bp, Artificial Sequence; identical to SEQ ID NO: 42461
  Description of Artificial Sequence: Synthetic coding sequence

SEQ ID NO: 42472 - DNA, 537 bp, Artificial Sequence; identical to SEQ ID NO: 42462
  Description of Artificial Sequence: Synthetic coding sequence

SEQ ID NO: 42473 - DNA, 447 bp, Artificial Sequence; identical to SEQ ID NO: 42464
  Description of Artificial Sequence: Synthetic coding sequence

SEQ ID NO: 42474 - DNA, 447 bp, Artificial Sequence; identical to SEQ ID NO: 42464
  Description of Artificial Sequence: Synthetic coding sequence

SEQ ID NO: 42475 - DNA, 447 bp, Artificial Sequence; identical to SEQ ID NO: 42464
  Description of Artificial Sequence: Synthetic coding sequence

SEQ ID NO: 42476 - DNA, 447 bp, Artificial Sequence; identical to SEQ ID NO: 42464
  Description of Artificial Sequence: Synthetic coding sequence

SEQ ID NO: 42477 - DNA, 447 bp, Artificial Sequence; identical to SEQ ID NO: 42464
  Description of Artificial Sequence: Synthetic coding sequence

SEQ ID NO: 42478 - DNA, 99 bp, Artificial Sequence
  Description of Artificial Sequence: Synthetic coding sequence
atggctgctgctgctgctggccctgctgccagccagcgcttcttccagagcttcagtgatgccctgattgaccaggacccccaggccgccctggagtag

SEQ ID NO: 42479 - DNA, 99 bp, Artificial Sequence; identical to SEQ ID NO: 42478
  Description of Artificial Sequence: Synthetic coding sequence

SEQ ID NO: 42480 - DNA, 4986 bp, Artificial Sequence
  Description of Artificial Sequence: Synthetic coding sequence
atggaggccccagctgctgagccccctgtgcggggctgcggcccccagcctgccccagccccagccccagcccctgagaggaagaagagccaccgggcccccagccctgcccggcccaaggatgtggccggctggagcctggccaagggcagaagaggccctggccctggcagcgctgtggcctgcagcgctgccttcagcagcaggccagacaagaagggccgggctgtggcccctggggcccggggggccggcgtgcgggtggccggcgtgaggactggagtgcgggccaagggccggcccaggtctggagctggccccaggcctcctcctcctccacccagcctgacagacagcagcagcgaggtgtctgactgtgccagcgaggaggcccggctgctgggcctggagctggccctgagcagtgatgctgagagcgctgctgggggccctgctggggtgaggacaggccagcctgcccagcctgcccccagcgcccagcagcccccccggcccccagccagcccagatgagcccagcgtggccgccagctctgtgggcagcagccggctgcccctgagcgccagcctggccttcagtgacctgacagaggagatgctggactgtggccccagcggcctggtgcgggagctggaggagctgcggagtgaaaatgactacctgaaggatgaaattgaggagctgcgggcagagatgctggagatgagagatgtgtacatggaggaggatgtgtaccagctgcaggagctgcggcagcagctggaccaggccagcaagacctgccgcatcctgcagtaccgcctgaggaaggccgagcggcgcagcctgcgggccgcccagacaggccaggtggatggagagctgatccggggcctggagcaggatgtgaaggtgtccaaggacatctccatgaggctgcacaaggagctggaggtggtggagaagaagagggcccggctggaggaggagaatgaggagctgcggcagaggctgattgaaacagagctggccaagcaggtgctgcagacagagctggagcggccccgggagcacagcctgaagaagaggggcaccaggagcctgggcaaggctgacaagaagaccctggtgcaggaggacagcgctgacctgaagtgccagctgcactttgccaaggaggagagcgccctgatgtgcaagaagctgaccaagctggccaaggaaaatgacagcatgaaggaggagctgctgaagtaccgcagcctgtatggagacctggacagcgccctgtctgctgaggagctggctgatgccccccacagccgggagacagagctgaaggtgcacctgaagctggtggaggaggaggccaacctgctgagccgccgcatcgtggagctggaggtggagaacagaggcctgcgggcagagatggatgacatgaaggaccacggcggcggctgcggcggccctgaggcccggctggccttcagcgccctgggcggcggggagtgtggggagagcctggccgagctgcggcggcacctgcagtttgtggaggaggaggccgagctgctgcggcgcagcagcgctgagctggaggaccagaacaagctgctgctgaatgagctggccaagttccgctcagaacatgagctggatgtggccctgtctgaggacagctgcagcgtgctgtctgagcccagccaggaggagctggccgccgccaagctgcagatcggggagctgagcggcaaggtgaagaagctgcagtatgaaaatagagtgctgctgagcaacctgcagagatgtgacctggccagctgccagagcacccggcccatgctggagacagatgctgaggccggggacagcgcccagtgtgtgcctgcccccctgggggagacccatgagagccatgctgtgcggctgtgccgggcccgggaggccgaggtgctgcccggcctgcgggagcaggccgccctggtgtccaaggccattgatgtgctggtggctgatgccaacggcttcaccgctggcctgcggctgtgcctggacaatgaatgtgccgacttccggctgcacgaggccccagacaacagcgagggcccccgggacaccaagctgattcatgccatcctggtgcggctgtctgtgctgcagcaggagctgaatgccttcaccaggaaggcagatgctgtgctgggctgcagcgtgaaggagcagcaggagagcttcagcagcctgccccccctgggcagccagggcctgagcaaggagatcctgctggccaaggacctgggcagtgacttccagcccccagacttccgggacctgcctgagtgggagccccgcatccgggaggccttcagaactggagacctggacagcaagccagaccccagccgctccttccggccctacagagcagaagataatgacagctatgccagcgagatcaaggagctgcagctggtgctggccgaggcccatgacagcctgcggggcctgcaggagcagctgagccaggagcggcagctgaggaaggaggaggccgacaacttcaaccagaagatggtgcagctgaaggaggaccagcagagggccctgctgcggcgggagtttgagctgcagagcctgagcctgcagaggcggctggagcagaagttctggagccaggagaagaacatgctggtgcaggagagccagcagttcaagcacaacttcctgctgctcttcatgaagctgcgctggttcctgaagcgctggaggcagggcaaggtgctgcccagtgaaggagatgacttcctggaggtgaacagcatgaaggagctgtacctgctgatggaggaggaggagatcaatgcccagcacagcgacaacaaggcctgcacaggagacagctggacccagaacaccccaaatgagtacatcaagaccctggccgacatgaaggtgaccctgaaggagctgtgctggctgctgagagatgaaagaagaggcctgacagagctgcagcagcagtttgccaaggccaaggccacctgggagacagaaagagctgagctgaagggccacaccagccagatggagctgaagacaggcaagggggccggggagcgggccggccctgactggaaggccgccctgcagcgggagcgggaggagcagcagcacctgctggccgagagctacagcgctgtgatggagctgacccggcagctgcagatcagcgagaggaactggagccaggagaagctgcagctggtggagcggctgcagggcgagaagcagcaggtggagcagcaggtgaaggagctgcagaaccggctgagccagctgcagaaggctgctgacccctgggtgctgaagcacagcgagctggagaagcaggacaacagctggaaggagaccaggtctgagaagatccatgacaaggaggccgtgtctgaggtggagctgggcggcaatggcctgaagaggaccaagtctgtgtcctccatgtctgaatttgagagcctgctggactgcagcccctacctggccggaggagatgcccggggcaagaagctgcccaacaacccagcctttggatttgtgagcagcgagcccggggaccctgagaaggacaccaaggagaagccaggcctgagcagccgggactgcaaccacctgggcgccctggcctgccaggaccccccaggccggcagatgcagaggagctacacagccccagacaagacaggcatccgggtgtactacagcccccctgtggcccggcggctgggcgtgcctgtggtgcatgacaaggagggcaagatcatcatcgagcccggcttcctgttcaccacagccaagcccaaggagagcgctgaggctgatggcctggccgagagcagctatggccgctggctgtgcaacttcagccggcagaggctggatggcggcagcgctggcagccccagcgctgctggccctggcttccctgctgccctgcatgactttgagatgagcggcaacatgtctgatgacatgaaggagatcaccaactgtgtgcggcaggccatgaggagcggcagcctggagaggaaggtgaagagcaccagcagccagacagtgggcctggcctctgtgggcacccagaccatcagaacagtgtctgtgggcctgcagacagacccccccaggagcagcctgcacggcaaggcctggagccccaggagcagcagcctggtgtctgtgcgcagcaagcagatcagcagcagcctggacaaggtgcacagccgcatcgagcggccctgctgcagccccaagtatggcagccccaagctgcagaggagatctgtgtccaagctggacagcagcaaggacaggagcctgtggaacctgcaccagggcaagcagaatggaagtgcctgggcccggagcaccaccacccgggacagccctgtgctgaggaacatcaatgatggcctgagcagcctcttctctgtggtggagcacagcggcagcacagaatctgtgtggaagctgggcatgtctgagacccgggccaagccagagccccccaagtatggaattgtgcaggagttcttcagaaatgtgtgtggccgggcccccagccccaccagcagcgctggggaggagggcaccaagaagccagagcccctgagccctgccagctaccaccagcctgagggcgtggcccgcatcctgaacaagaaggccgccaagctgggcagcagcgaggaggtgcggctgaccatgctgccccaggtgggcaaggatggagtgctgagagatggagatggagctgtggtgctgcccaatgaagatgctgtgtgtgactgcagcacccagagcctgaccagctgctttgcccggagcagccgcagcgccatccgccacagccccagcaagtgccgcctgcaccccagcgagagctcctggggcggggaggagcgggccctgccccccagcgagtag

SEQ ID NO: 42481 - DNA, 3051 bp, Artificial Sequence
  Description of Artificial Sequence: Synthetic coding sequence
atgctggagatgagagatgtgtacatggaggaggatgtgtaccagctgcaggagctgcggcagcagctggaccaggccagcaagacctgccgcatcctgcagtaccgcctgaggaaggccgagcggcgcagcctgcgggccgcccagacaggccaggtggatggagagctgatccggggcctggagcaggatgtgaaggtgtccaaggacatctccatgaggctgcacaaggagctggaggtggtggagaagaagagggcccggctggaggaggagaatgaggagctgcggcagaggctgattgaaacagagctggccaagcaggtgctgcagacagagctggagcggccccgggagcacagcctgaagaagaggggcaccaggagcctgggcaaggctgacaagaagaccctggtgcaggaggacagcgctgacctgaagtgccagctgcactttgccaaggaggagagcgccctgatgtgcaagaagctgaccaagctggccaaggaaaatgacagcatgaaggaggagctgctgaagtaccgcagcctgtatggagacctggacagcgccctgtctgctgaggagctggctgatgccccccacagccgggagacagagctgaaggtgcacctgaagctggtggaggaggaggccaacctgctgagccgccgcatcgtggagctggaggtggagaacagaggcctgcgggcagagatggatgacatgaaggaccacggcggcggctgcggcggccctgaggcccggctggccttcagcgccctgggcggcggggagtgtggggagagcctggccgagctgcggcggcacctgcagtttgtggaggaggaggccgagctgctgcggcgcagcagcgctgagctggaggaccagaacaagctgctgctgaatgagctggccaagttccgctcagaacatgagctggatgtggccctgtctgaggacagctgcagcgtgctgtctgagcccagccaggaggagctggccgccgccaagctgcagatcggggagctgagcggcaaggtgaagaagctgcagtatgaaaatagagtgctgctgagcaacctgcagagatgtgacctggccagctgccagagcacccggcccatgctggagacagatgctgaggccggggacagcgcccagtgtgtgcctgcccccctgggggagacccatgagagccatgctgtgcggctgtgccgggcccgggaggccgaggtgctgcccggcctgcgggagcaggccgccctggtgtccaaggccattgatgtgctggtggctgatgccaacggcttcaccgctggcctgcggctgtgcctggacaatgaatgtgccgacttccggctgcacgaggccccagacaacagcgagggcccccgggacaccaagctgattcatgccatcctggtgcggctgtctgtgctgcagcaggagctgaatgccttcaccaggaaggcagatgctgtgctgggctgcagcgtgaaggagcagcaggagagcttcagcagcctgccccccctgggcagccagggcctgagcaaggagatcctgctggccaaggacctgggcagtgacttccagcccccagacttccgggacctgcctgagtgggagccccgcatccgggaggccttcagaactggagacctggacagcaagccagaccccagccgctccttccggccctacagagcagaagataatgacagctatgccagcgagatcaaggagctgcagctggtgctggccgaggcccatgacagcctgcggggcctgcaggagcagctgagccaggagcggcagctgaggaaggaggaggccgacaacttcaaccagaagatggtgcagctgaaggaggaccagcagagggccctgctgcggcgggagtttgagctgcagagcctgagcctgcagaggcggctggagcagaagttctggagccaggagaagaacatgctggtgcaggagagccagcagttcaagcacaacttcctgctgctcttcatgaagctgcgctggttcctgaagcgctggaggcagggcaaggtgctgcccagtgaaggagatgacttcctggaggtgaacagcatgaaggagctgtacctgctgatggaggaggaggagatcaatgcccagcacagcgacaacaaggcctgcacaggagacagctggacccagaacaccccaaatgagtacatcaagaccctggccgacatgaaggtgaccctgaaggagctgtgctggctgctgagagatgaaagaagaggcctgacagagctgcagcagcagtttgccaaggccaaggccacctgggagacagaaagagctgagctgaagggccacaccagccagatggagctgaagacaggcaagggggccggggagcgggccggccctgactggaaggccgccctgcagcgggagcgggaggagcagcagcacctgctggccgagagctacagcgctgtgatggagctgacccggcagctgcagatcagcgagaggaactggagccaggagaagctgcagctggtggagcggctgcagggcgagaagcagcaggtggagcagcaggtgaaggagctgcagaaccggctgagccagctgcagaaggctgctgacccctgggtgctgaagcacagcgagctggagaagcaggacaacagctggaaggagaccaggtctgagaagatccatgacaaggaggccgtgtctgaggtggagctgggcggcaatggcctgaagaggaccaagtctgtgtcctccatgtctgaatttgagagcctgctggactgcagcccctacctggccggaggagatgcccggggcaagaagctgcccaacaacccagcctttggatttgtgagcagcgagcccggggaccctgagaaggacaccaaggagaagccaggcctgagcagccgggactgcaaccacctgggcgccctggcctgccaggaccccccaggcagccagaagctgcccttcctgctgatcctggccccaccccagcccccacccatcctgtag

SEQ ID NO: 42482 - DNA, 4272 bp, Artificial Sequence
  Description of Artificial Sequence: Synthetic coding sequence
atgctggagatgagagatgtgtacatggaggaggatgtgtaccagctgcaggagctgcggcagcagctggaccaggccagcaagacctgccgcatcctgcagtaccgcctgaggaaggccgagcggcgcagcctgcgggccgcccagacaggccaggtggatggagagctgatccggggcctggagcaggatgtgaaggtgtccaaggacatctccatgaggctgcacaaggagctggaggtggtggagaagaagagggcccggctggaggaggagaatgaggagctgcggcagaggctgattgaaacagagctggccaagcaggtgctgcagacagagctggagcggccccgggagcacagcctgaagaagaggggcaccaggagcctgggcaaggctgacaagaagaccctggtgcaggaggacagcgctgacctgaagtgccagctgcactttgccaaggaggagagcgccctgatgtgcaagaagctgaccaagctggccaaggaaaatgacagcatgaaggaggagctgctgaagtaccgcagcctgtatggagacctggacagcgccctgtctgctgaggagctggctgatgccccccacagccgggagacagagctgaaggtgcacctgaagctggtggaggaggaggccaacctgctgagccgccgcatcgtggagctggaggtggagaacagaggcctgcgggcagagatggatgacatgaaggaccacggcggcggctgcggcggccctgaggcccggctggccttcagcgccctgggcggcggggagtgtggggagagcctggccgagctgcggcggcacctgcagtttgtggaggaggaggccgagctgctgcggcgcagcagcgctgagctggaggaccagaacaagctgctgctgaatgagctggccaagttccgctcagaacatgagctggatgtggccctgtctgaggacagctgcagcgtgctgtctgagcccagccaggaggagctggccgccgccaagctgcagatcggggagctgagcggcaaggtgaagaagctgcagtatgaaaatagagtgctgctgagcaacctgcagagatgtgacctggccagctgccagagcacccggcccatgctggagacagatgctgaggccggggacagcgcccagtgtgtgcctgcccccctgggggagacccatgagagccatgctgtgcggctgtgccgggcccgggaggccgaggtgctgcccggcctgcgggagcaggccgccctggtgtccaaggccattgatgtgctggtggctgatgccaacggcttcaccgctggcctgcggctgtgcctggacaatgaatgtgccgacttccggctgcacgaggccccagacaacagcgagggcccccgggacaccaagctgattcatgccatcctggtgcggctgtctgtgctgcagcaggagctgaatgccttcaccaggaaggcagatgctgtgctgggctgcagcgtgaaggagcagcaggagagcttcagcagcctgccccccctgggcagccagggcctgagcaaggagatcctgctggccaaggacctgggcagtgacttccagcccccagacttccgggacctgcctgagtgggagccccgcatccgggaggccttcagaactggagacctggacagcaagccagaccccagccgctccttccggccctacagagcagaagataatgacagctatgccagcgagatcaaggagctgcagctggtgctggccgaggcccatgacagcctgcggggcctgcaggagcagctgagccaggagcggcagctgaggaaggaggaggccgacaacttcaaccagaagatggtgcagctgaaggaggaccagcagagggccctgctgcggcgggagtttgagctgcagagcctgagcctgcagaggcggctggagcagaagttctggagccaggagaagaacatgctggtgcaggagagccagcagttcaagcacaacttcctgctgctcttcatgaagctgcgctggttcctgaagcgctggaggcagggcaaggtgctgcccagtgaaggagatgacttcctggaggtgaacagcatgaaggagctgtacctgctgatggaggaggaggagatcaatgcccagcacagcgacaacaaggcctgcacaggagacagctggacccagaacaccccaaatgagtacatcaagaccctggccgacatgaaggtgaccctgaaggagctgtgctggctgctgagagatgaaagaagaggcctgacagagctgcagcagcagtttgccaaggccaaggccacctgggagacagaaagagctgagctgaagggccacaccagccagatggagctgaagacaggcaagggggccggggagcgggccggccctgactggaaggccgccctgcagcgggagcgggaggagcagcagcacctgctggccgagagctacagcgctgtgatggagctgacccggcagctgcagatcagcgagaggaactggagccaggagaagctgcagctggtggagcggctgcagggcgagaagcagcaggtggagcagcaggtgaaggagctgcagaaccggctgagccagctgcagaaggctgctgacccctgggtgctgaagcacagcgagctggagaagcaggacaacagctggaaggagaccaggtctgagaagatccatgacaaggaggccgtgtctgaggtggagctgggcggcaatggcctgaagaggaccaagtctgtgtcctccatgtctgaatttgagagcctgctggactgcagcccctacctggccggaggagatgcccggggcaagaagctgcccaacaacccagcctttggatttgtgagcagcgagcccggggaccctgagaaggacaccaaggagaagccaggcctgagcagccgggactgcaaccacctgggcgccctggcctgccaggaccccccaggccggcagatgcagaggagctacacagccccagacaagacaggcatccgggtgtactacagcccccctgtggcccggcggctgggcgtgcctgtggtgcatgacaaggagggcaagatcatcatcgagcccggcttcctgttcaccacagccaagcccaaggagagcgctgaggctgatggcctggccgagagcagctatggccgctggctgtgcaacttcagccggcagaggctggatggcggcagcgctggcagccccagcgctgctggccctggcttccctgctgccctgcatgactttgagatgagcggcaacatgtctgatgacatgaaggagatcaccaactgtgtgcggcaggccatgaggagcggcagcctggagaggaaggtgaagagcaccagcagccagacagtgggcctggcctctgtgggcacccagaccatcagaacagtgtctgtgggcctgcagacagacccccccaggagcagcctgcacggcaaggcctggagccccaggagcagcagcctggtgtctgtgcgcagcaagcagatcagcagcagcctggacaaggtgcacagccgcatcgagcggccctgctgcagccccaagtatggcagccccaagctgcagaggagatctgtgtccaagctggacagcagcaaggacaggagcctgtggaacctgcaccagggcaagcagaatggaagtgcctgggcccggagcaccaccacccgggacagccctgtgctgaggaacatcaatgatggcctgagcagcctcttctctgtggtggagcacagcggcagcacagaatctgtgtggaagctgggcatgtctgagacccgggccaagccagagccccccaagtatggaattgtgcaggagttcttcagaaatgtgtgtggccgggcccccagccccaccagcagcgctggggaggagggcaccaagaagccagagcccctgagccctgccagctaccaccagcctgagggcgtggcccgcatcctgaacaagaaggccgccaagctgggcagcagcgaggaggtgcggctgaccatgctgccccaggtgggcaaggatggagtgctgagagatggagatggagctgtggtgctgcccaatgaagatgctgtgtgtgactgcagcacccagagcctgaccagctgctttgcccggagcagccgcagcgccatccgccacagccccagcaagtgccgcctgcaccccagcgagagctcctggggcggggaggagcgggccctgccccccagcgagtag

SEQ ID NO: 42483 - DNA, 3795 bp, Artificial Sequence
  Description of Artificial Sequence: Synthetic coding sequence
atgtgcaagaagctgaccaagctggccaaggaaaatgacagcatgaaggaggagctgctgaagtaccgcagcctgtatggagacctggacagcgccctgtctgctgaggagctggctgatgccccccacagccgggagacagagctgaaggtgcacctgaagctggtggaggaggaggccaacctgctgagcagaagaattgtggagctggaggtggagaacagaggcctgcgggcagagatggatgacatgaaggaccatggaggcggctgcggcggccctgaggcccggctggccttcagcgccctgggcggcggagaatgtggggagagcctggccgagctgcggcggcacctgcagtttgtggaggaggaggccgagctgctgcggcgcagcagcgctgagctggaggaccagaacaagctgctgctgaatgagctggccaagttccgctctgagcacgagctggatgtggccctgtctgaggacagctgcagcgtgctgtctgagcccagccaggaggagctggccgccgccaagctgcagattggagagctgagcggcaaggtgaagaagctgcagtatgagaacagagtgctgctgagcaacctgcagagatgtgacctggccagctgccagagcacccggcccatgctggagacagatgctgaggccggggacagcgcccagtgtgtgcctgcccccctgggggagacccatgagagccatgctgtgcggctgtgccgggcccgggaggccgaggtgctgcccggcctgcgggagcaggccgccctggtgtccaaggccattgatgtgctggtggctgatgccaacggcttcaccgctggcctgcggctgtgcctggacaatgaatgtgccgacttccggctgcacgaggccccagacaacagcgagggcccccgggacaccaagctgatccacgccatcctggtgcggctgtctgtgctgcagcaggagctgaatgccttcaccaggaaggcagatgctgtgctgggctgcagcgtgaaggagcagcaggagagcttcagcagcctgccccccctgggcagccagggcctgagcaaggagatcctgctggccaaggacctgggcagtgacttccagcccccagacttccgggacctgcctgagtgggagccccgcatccgggaggccttcagaactggagacctggacagcaagccagaccccagccgctccttccggccctacagagctgaggacaatgacagctatgccagcgagatcaaggagctgcagctggtgctggccgaggcccatgacagcctgcggggcctgcaggagcagctgagccaggagcggcagctgaggaaggaggaggccgacaacttcaaccagaagatggtgcagctgaaggaggaccagcagagggccctgctgcggcgggagtttgagctgcagagcctgagcctgcagaggcggctggagcagaagttctggagccaggagaagaacatgctggtgcaggagagccagcagttcaagcacaacttcctgctgctcttcatgaagctgcgctggttcctgaagcgctggaggcagggcaaggtgctgcccagtgaaggagatgacttcctggaggtgaacagcatgaaggagctgtacctgctgatggaggaggaggagatcaatgcccagcacagcgacaacaaggcctgcaccggggacagctggacccagaacaccccaaatgagtacatcaagaccctggccgacatgaaggtgaccctgaaggagctgtgctggctgctgagagatgagcggcggggcctgacagagctgcagcagcagtttgccaaggccaaggccacctgggagacagagcgggcagagctgaagggccacaccagccagatggagctgaagacaggaaaaggagctggggagagagctggccctgactggaaggccgccctgcagcgggagcgggaggagcagcagcacctgctggccgagagctacagcgctgtgatggagctgacccggcagctgcagatcagcgagaggaactggagccaggagaagctgcagctggtggagcggctgcagggcgagaagcagcaggtggagcagcaggtgaaggagctgcagaaccggctgagccagctgcagaaggctgctgacccctgggtgctgaagcacagcgagctggagaagcaggacaacagctggaaggagaccaggtctgagaagatccatgacaaggaggccgtgtctgaggtggagctgggcggcaatggcctgaagaggaccaagtctgtgtcctccatgtctgaatttgagagcctgctggactgcagcccctacctggccggaggagatgcccggggcaagaagctgcccaacaacccagccttcggctttgtgtcctctgagcccggggaccctgagaaggacaccaaggagaagccaggcctgagcagccgggactgcaaccacctgggcgccctggcctgccaggaccccccaggccggcagatgcagaggagctacacagccccagacaagacaggcatccgggtgtactacagcccccctgtggcccggcggctgggcgtgcctgtggtgcatgacaaggagggcaagatcatcatcgagcccggcttcctgttcaccacagccaagcccaaggagagcgctgaggctgatggcctggccgagagcagctatggccgctggctgtgcaacttcagccggcagaggctggatggcggcagcgctggcagccccagcgctgctggccctggcttccctgctgccctgcatgactttgagatgagcggcaacatgtctgatgacatgaaggagatcaccaactgtgtgcggcaggccatgaggagcggcagcctggagaggaaggtgaagagcaccagcagccagacagtgggcctggcctctgtgggcacccagaccatcagaacagtgtctgtgggcctgcagacagatcctcccaggagcagcctgcacggcaaggcctggagccccaggagcagcagcctggtgtctgtgcgcagcaagcagatcagcagcagcctggacaaggtgcacagcagaattgagcggccctgctgcagccccaagtatggcagccccaagctgcagaggagatctgtgtccaagctggacagcagcaaggacaggagcctgtggaacctgcaccagggcaagcagaatggcagcgcctgggcccggagcaccaccacccgggacagccctgtgctgaggaacatcaatgatggcctgagcagcctcttctctgtggtggagcacagcggcagcacagagagcgtgtggaagctgggcatgtctgagacccgggccaagccagagccccccaagtatggcatcgtgcaggagttcttcagaaatgtgtgtggccgggcccccagccccaccagcagcgctggggaggagggcaccaagaagccagagcccctgagccctgccagctaccaccagcctgagggcgtggcccgcatcctgaacaagaaggccgccaagctgggcagcagcgaggaggtgcggctgaccatgctgccccaggtgggcaaggatggagtgctgagagatggagatggagctgtggtgctgcccaatgaagatgctgtgtgtgactgcagcacccagagcctgaccagctgctttgcccggagcagccgcagcgccatccgccacagccccagcaaatgtcggctgcaccccagcgagagctcctggggcggggaggagcgggccctgcccccatctgagtag

SEQ ID NO: 42484 - DNA, 237 bp, Artificial Sequence
  Description of Artificial Sequence: Synthetic coding sequence
atgggcagcggcctgcccctggtgctgctgctgaccctgctgggcagcagccacggcaccggccctggcatgaccctgcagctgaagctgaaggagagcttcctgaccagcagcagctatgagagcagcttcctggagctgctggagaagctgtgcctgctgctgcacctgcccagcggcacctctgtgaccctgcaccacgcccggagccagcaccacgtggtgtgcaacacctag

SEQ ID NO: 42485 - DNA, 690 bp, Artificial Sequence
  Description of Artificial Sequence: Synthetic coding sequence
atgcctgctgctggcccccccctgctgctgctgggcaccccaggcagcggcaagacagccctgctgtttgctgctgccctggaggccgccggggagggccagggccctgtgctcttcctgacccggcggcccctgcagagcatgccccggggcaccggcaccaccctggaccccatgaggctgcagaagatccgcttccagtacccacccagcacccgggagctgttccggctgctgtgcagcgcccacgaggcccctggccctgcccccagcctgctgctgctggatggcctggaggagtacctggccgaggaccctgagccccaggaggccgcctacctgattgccctgctgctggacacagctgcccacttcagccaccggctgggccctggccgggactgtggcctgatggtggccctgcagacccaggaggaggccggcagcggagatgtgctgcacctggccctgctgcagcgctacttccctgcccagtgctggctgcagccagatgcccctggccctggagagcacggcctgcgggcctgcctggagcccggcggcctgggccccaggacagagtggtgggtgaccttcagaagtgatggagagatgatgattgccccctggcccacccaggccggggaccccagcagcggcaagggcagcagcagcggcggccagccctag

SEQ ID NO: 42486 - DNA, 2703 bp, Artificial Sequence
  Description of Artificial Sequence: Synthetic coding sequence
atgagcagcaaggagagctgtgggaagaaggagaccagccagaggaaggacaccaccaccagcagccccaactttggagagaaggacaagaaggagaggaagaccccagccagcagcaccagcagcagcagcatccgctctgtgagcagcgagaagaggaagctgaagagtgaccacacagatgtgctgtactacaacatcaagaggcggcagggcctgaagaggctgtctgtggagattgacaccctgcggcggcggcccaagattggcagcagcagccagaggcccatcaagctgaaggaggccagctacagcaatgacaaccagatcatcctgcagagccccagcagcaatggcaccaagaaggacatccacaagtgtgtggacttcaagcccaaggacatcaagctgaccaatgccggcagcaagctggaccacggcatcaagagcctgagcagccccaagatcgccagtgatgtgaagcccaaggccgagggccaggccagcgagaacaagtggagccacctgctggtgcagcgggagaagatgaaggagctgaagaagggcaggaacagcaagttccgggacaacagcgagaagtgtgtgctggagaagtggaagaggaaccagttcagccaggactacaacagcaacaagatcatcaaggagcccctgggcagccggcggcagaagatctccttcaagatccccatcaagagccgggacaccctgcagaagctggtggaggagaatgtgttcaacatcgacagcaacaacagcaagaccaagcaggaggagcgggagtacctggagagcagccaggtgtccctgaatgtgacccggcagaagacagagcacctgctgagtgacttcacctacaagaggacagtgcatgagtggaagaggaagcaccactatgaccaccaggagagcaatgacagccacagccgggagaacctgacccagagctttgaggccccctgctgcagcgtgtcctctgagagcatccaggatgctgaccaggagatgcagatcgtggaggagctgcatgctgcccgggtgggcaagtctgtggacctgcctggagagctgatgtccatggagattgacctggaggatgatgtgcacagcagcagcgccaacaacaccagtgacaggaagctgctgattgtcatcgacaccaacatcctgatgaaccacctgaagtttgtgcgcatcctgaagaccacagaggtgcccggctttgacaagctggtgctgatcatcccctgggtggtgatgcaggagctggacaggatgaaggagggcaagctgctgaagagggcccagcacaaggccatcccagctgtgcacttcatcaatgacagcctgaagaaccaggacaggaagctgtggggccagagcatccagctggccagccagaagcactacggcctgagtgatgagaacaatgatgacagagtgctgaagtgctgcctgcagcaccaggagctgttcccctgcagctttgtgatcctgtgcacagatgacaggaacctgaggaacaagggcctcatcagcggcgtgaagagcctgagcaaggaggagctgtctgctgagctgctgcacctgagcctgaacacagatgtgtgccaccagccctgcatccccaagcagcagctgaaggccgagaccacccccctgaaggagagctacaaggaggagagcaccaacagcggcctgagcatcctgctggagagcatcgtgtctgacctggagaagagcctgggcaccggcctgagcagcatcctggagacagagatgaagatcgcctttggaaacctgtggatggagatcctgtacctgaagccaccctggaccctgctgcacctgctgcagtgcttcaagaagcactggctggccgtgtttggcctggtgatggagaagaacctgctgctgaccatcgagagcctgtacaagaacctgaggaaggccaacaaggctgtggacttcaccaccgtgaagttcctgctgcaggacagccgcagcctgctgcacgccttcagcaccaggagcaactatgatggcatcctgccccagacctttgcccaggtgaacaacctgctgcagacctttgctgaggtgaagaccaagctgaagcccaacagcagcgagaacacagtgaccaagaagcaggagggcaccagcctgaagaacagccacaaccaggagatcaccgtcttcagcagcagccacctgccccagcccagccgccaccaggagatctggagcatcctggagagcgtgtggatcaccatctaccagaacagcacagatgtgttccagaggctgggcagcaacagcgccctgaccaccagcaacatcgccagctttgaggaggccttcatctgcctgcagaagctgatggctgctgtgcgggacatcctggagggcatccagaggatcctggcccccaacagcaactaccaggatgtggagaccctgtacaacttcctgatcaagtatgaggtgaacaagaatgtgaagttcaccgcccaggagatctatgactgtgtgtcccagacagagtaccgggagaagctgaccatcggctgccggcagctggtggagatggagtacaccatgcagcagtgcaatgcctctgtgtacatggaggccaagaacagaggctggtgtgaggacatgctgaactaccgcatctag

SEQ ID NO: 42487 - DNA, 2703 bp, Artificial Sequence; identical to SEQ ID NO: 42486
  Description of Artificial Sequence: Synthetic coding sequence

SEQ ID NO: 42488 - DNA, 483 bp, Artificial Sequence
  Description of Artificial Sequence: Synthetic coding sequence
atgagcagcaaggagagctgtgggaagaaggagaccagccagaggaaggacaccaccaccagcagccccaactttggagagaaggacaagaaggagaggaagaccccagccagcagcaccagcagcagcagcatccgctctgtgagcagcgagaagaggaagctgaagagtgaccacacagatgtgctgtactacaacatcaagaggcggcagggcctgaagaggctgtctgtggagattgacaccctgcggcggcggcccaagattggcagcagcagccagaggcccatcaagctgaaggaggccagctacagcaatgacaaccagatcatcctgcagagccccagcagcaatggcaccaagaaggacatccacaagtgtgtggacttcaagcccaaggacatcaagctgaccaatgccggcagcaagctggaccacggcatcaagagcctgagcagccccaagatcgccagtgatgtgtag

SEQ ID NO: 42489 - DNA, 1545 bp, Artificial Sequence
  Description of Artificial Sequence: Synthetic coding sequence
atgatgaacttcctgcggcggcggctgagtgacagcagcctcttcagcagcctgagccaggccgtgaagcagacagctgccagcgctggcctggtggatgcccctggagctgccccagctgctgccaggaaggccaaggtgctgctggtggtggatgagccccacgccgactgggccaagtgcttccggggcaagaaggtgctgggggactatgacatcaaggtggagcaggccgagttcagcgagctgaacctggtggcccatgctgatggcacctatgctgtggacatgcaggtgctgagaaatggcaccaaggtggtgcgctccttccggccagactttgtgctgatccggcagcacgccttcggcatggccgagaatgaagacttccgccacctgatcatcggcatgcagtatgccggcctgcccagcatcaacagcctggagagcatctacaacttctgtgacaagccctgggtgtttgcccagctggtggccatctacaagaccctgggcggggagaagttccccctgattgagcagacctactaccccaaccacaaggagatgctgaccctgcccaccttccctgtggtggtgaagattggccacgcccacagcggcatgggcaaggtgaaggtggagaaccactatgacttccaggacatcgcctctgtggtggccctgacccagacctacgccacagctgagcccttcatcgacagcaaatatgacatccgggtgcagaagattggcaacaactacaaggcctacatgaggaccagcatcagcggcaactggaagaccaacacaggcagcgccatgctggagcagatcgccatgtctgaccgctacaagctgtgggtggacacctgcagcgagatgtttggaggcctggacatctgtgctgtgaaggctgtgcacggcaaggatggcaaggactacatctttgaggtgatggactgcagcatgcccctgattggagagcaccaggtggaggaccggcagctgatcacagagctggtgatcagcaagatgaaccagctgctgagcaggaccccagccctgagcccccagaggcccctgaccacccagcagccccagagcggcaccctgaaggaccctgacagcagcaagaccccaccccagaggcccccaccccagggcggccctggccagccccagggcatgcagcccccaggcaaggtgctgcccccccggcggctgcccccaggccccagcctgccccccagcagcagcagcagcagcagcagcagcagcagcgccccccagaggcctgggggccccaccacccatggagatgcccccagcagcagcagcagcctggccgaggcccagccccccctggccgccccaccccagaagccccagccccacccccagctgaacaagagccagagcctgaccaatgccttctccttcagcgagagcagcttcttccgcagcagcgccaatgaagatgaggccaaggccgagaccatccgcagcctgaggaagagctttgccagcctcttcagtgactag

SEQ ID NO: 42490 - DNA, 729 bp, Artificial Sequence
  Description of Artificial Sequence: Synthetic coding sequence
atggccggcaagctgaagcccctgaatgtggaggcccctgaggccacagaggaggccgagggccaggccaagagcctgaagacagaggacctgctggccatggtgatcaagctgcagaaggagggcagcctggagccccagattgaagatctcatcagccgcatcaatgacctgcagcaggccaagaagaagagcagcgaggagctgcgggagacccacagcctgtgggaggccctgcaccgggagctggacagcctgaatggagagaaggtgcacctggaggaggtgctgggcaagaagcaggaggccctgcgcatcctgcagatgcactgccaggagaaggagagcgaggcccagaggctggatgtgcggggccagctggaggacctgatgggccagcacaaggacctgtgggagttccacatgctggagcagaggctggcccgggagatccgggccctggagaggagcaaggagcagctgctgtctgaaagaaggctggtgcgggccaagctgcgggaggtggagcggcggctgcacagccccccagaggtggagggcgccatggctgtgaatgatggcctgaaggccgagctggagatctttggagagcaggtgcgcagcgcccctgaggtgggcgctggggagggggaggccggccctgagctgccccgggccagagatgaggaggaccctgagccccctgtggccgccccagatgccctgtag

SEQ ID NO: 42491 - DNA, 267 bp, Artificial Sequence
  Description of Artificial Sequence: Synthetic coding sequence
atggatgatgctgaccctgaggagagaaattatgacaacatgctgaagatgctgagtgacctgaacaaggacctggagaagctgctggaggagatggagaagatctctgtgcaggccacctggatggcctatgacatggtggtgatgaggaccaaccccaccctggccgagagcatgaggcggctggaggatgcctttgtgaactgcaaggaggagatggagaagaactggcaggagctgctgcacgagaccaagcagaggctgtag

SEQ ID NO: 42492 - DNA, 942 bp, Artificial Sequence
  Description of Artificial Sequence: Synthetic coding sequence
atgctgctgctggccgacatggatgtggtgaaccagctggtggccggcggccagttccgggtggtgaaggagcccctgggctttgtgaaggtgctgcagtgggtgtttgccatctttgcctttgccacctgtggcagctacagcggggagctgcagctgtctgtggactgtgccaacaagacagaaagtgacctgagcattgaggtggagtttgagtaccccttccggctgcaccaggtgtactttgatgcccccacctgccggggcggcaccaccaaggtgttcctggtgggggactacagcagcagcgctgagttctttgtgacagtggccgtgtttgccttcctgtacagcatgggcgccctggccacctacatcttcctgcagaacaagtaccgggagaacaacaagggccccatgctggacttcctggccacagctgtgtttgccttcatgtggctggtgagcagcagcgcctgggccaagggcctgagtgatgtgaagatggccacagatcctgagaacatcatcaaggagatgcctgtgtgccggcagacaggcaacacctgcaaggagctgcgggaccctgtgaccagcggcctgaacacctctgtggtgtttggcttcctgaacctggtgctgtgggtgggcaacctgtggtttgtgttcaaggagaccggctgggccgcccccttcctgcgggcccctcctggggcccctgagaagcagcctgcccctggagatgcctatggagatgctggctacggccagggccctgggggctacggcccccaggacagctatggcccccagggcggctaccagcctgactatggccagcctgctggcagcggcggcagcggctacggcccccagggcgactatggccagcagggctacggcccccagggcgcccccaccagcttcagcaaccagatgtag

SEQ ID NO: 42493 - DNA, 1173 bp, Artificial Sequence
  Description of Artificial Sequence: Synthetic coding sequence
atggccgagcagctggccctggtgattggaggcaccatcggcggcctgctgctgctgctgctgattggagccagctgctgcctgtggaggcgcttctgtgccaccctgacctatgaggagctgcccggcaccccagccatggccaccacagctgccagcagcggccagagggaccggccctgccagccccacgcccggacccagctgagccggcccccagctgtgccctttgtggtgccccccaccctgcagggccgggactgggtgcccctgcacagcggggagtgggcagatgccccctgggacccctgcccagccagcgagctgctgccccacaccagcagcggcggcctgggagatgcctgcatggtgggcgccatcaaccctgagctgtacaagtttcctgaggacaagtcagaaacagacttcccagatggctgcctgggccgcctgtggttctctgtggagtatgagcaggaggccgagcggctgctggtgggcctcatcaaggcccagcacctgcaggcccccagcgagacctgcagccccctggtgaagctgtacctgctgcctgatgagcggcgcttcctgcagagcaagaccaagaggaagaccagcaacccccagtttgatgagcacttcatcttccaggtgagcagcaagaccatcacccagagggtgctgaagttctctgtgtaccacgtggaccggcagaggaagcaccagctgctgggccaggtgctcttccccctgaagaatgagaccctggtgggggactgcagaagagtcatctggagggacctggaggccgagagcctggagcccccatctgaatttggagacctgcagttctgcctgagctacaatgactacctgagccggctgactgtggtggtgctgcgggccaagggcctgcggctgcaggaggaccggggcatcgtgtctgtgtttgtgaaggtgtccctgatgaaccacaacaagtttgtgaagtgcaagaagaccagcgctgtgctgggcagcatcaaccctgtgtacaatgagaccttctccttcaaggcagatgccacagagctggacacagccagcctgagcctgactgtggtgcagaacatggagggggacaagcaggccaccaccgtggagctgttcctgttccacctgaccagcggctag

SEQ ID NO: 42494 - DNA, 1833 bp, Artificial Sequence
  Description of Artificial Sequence: Synthetic coding sequence
atggcccaggagattgacctgagcgccctgaaggagctggagcgggaggccatcctgcaggtgctgtacagagaccaggccgtgcagaacacagaggaggagaggaccaggaagctgaagacccacctgcagcacctgcgctggaagggggccaagaacacagactgggagcacaaggagaagtgctgtgcccgctgccagcaggtgctgggcttcctgctgcacagaggagctgtgtgccggggctgcagccaccgggtgtgtgcccagtgcagggtcttcctgcggggcacccacgcctggaagtgcaccgtgtgctttgaggacagaaatgtgaagatcaagacaggagagtggttctatgaggagcgggccaagaagttccccaccggcggcaagcatgagaccgtgggcggccagctgctgcagagctaccagaagctgagcaagatctctgtggtgccccccaccccacctcctgtgtctgagagccagtgcagccgcagccctggccgcctgcaggagtttggccagttccggggcttcaacaagtctgtggagaacctcttcctgagcctggccacccacgtgaagaagctgagcaagagccagaatgacatgaccagcgagaagcacctgctggccaccggcccccggcagtgtgtgggccagacagaaagaagaagccagagcgacacagctgtgaatgtgaccaccaggaaggtgtctgccccagacatcctgaagcccctgaaccaggaggaccccaagtgcagcaccaaccccatcctgaagcagcagaacctgcccagcagccctgcccccagcaccatcttcagcggcggcttcagacatggcagcctcatcagcattgacagcacctgcacagagatgggcaactttgacaatgccaacgtgactggagaaattgaatttgccatccactactgcttcaagacccacagcctggagatctgcatcaaggcctgcaagaacctggcctatggagaggagaagaagaagaagtgcaacccctacgtgaagacctacctgctgcctgacaggagcagccagggcaagaggaagacaggagtgcagaggaacacagtggaccccaccttccaggagaccctgaagtaccaggtggccccagcccagctggtgacccggcagctgcaggtgtctgtgtggcacctgggcaccctggcccggcgggtcttcctgggggaggtgatcatccccctggccacctgggactttgaggacagcaccacccagagcttccgctggcaccccctgcgggccaaggccgagaagtatgaagattctgtgccccagagcaatggagagctgactgtgcgggccaagctggtgctgcccagccggcccaggaagctgcaggaggcccaggagggcacagaccagcccagcctgcacggccagctgtgcctggtggtgctgggcgccaagaacctgcctgtgcggccagatggcaccctgaacagctttgtgaagggctgcctgaccctgcctgaccagcagaagctgcggctgaagagccctgtgctgaggaagcaggcctgcccccagtggaagcacagctttgtgttcagcggcgtgaccccagcccagctgcggcagagcagcctggagctgactgtgtgggaccaggccctgtttggcatgaatgaccggctgctgggcggcacccggctgggcagcaaaggagacacagctgtgggcggagatgcctgcagcctgagcaagctgcagtggcagaaggtgctgagcagccccaacctgtggacagacatgaccctggtgctgcactag

SEQ ID NO: 42495 - DNA, 1629 bp, Artificial Sequence
  Description of Artificial Sequence: Synthetic coding sequence
atggcccaggagattgacctgagcgccctgaaggagctggagcgggaggccatcctgcaggtgctgtacagagaccaggccgtgcagaacacagaggaggagaggaccaggaagctgaagacccacctgcagcacctgcgctggaagggggccaagaacacagactgggagcacaaggagaagtgctgtgcccgctgccagcaggtgctgggcttcctgctgcacagaggagctgtgtgccggggctgcagccaccgggtgtgtgcccagtgcagggtcttcctgcggggcacccacgcctggaagtgcaccgtgtgctttgaggacagaaatgtgaagatcaagacaggagagtggttctatgaggagcgggccaagaagttccccaccggcggcaagcatgagaccgtgggcggccagctgctgcagagctaccagaagctgagcaagatctctgtggtgccccccaccccacctcctgtgtctgagagccagtgcagccgcagccctggcaggaaggtgtctgccccagacatcctgaagcccctgaaccaggaggaccccaagtgcagcaccaaccccatcctgaagcagcagaacctgcccagcagccctgcccccagcaccatcttcagcggcggcttcagacatggcagcctcatcagcattgacagcacctgcacagagatgggcaactttgacaatgccaacgtgactggagaaattgaatttgccatccactactgcttcaagacccacagcctggagatctgcatcaaggcctgcaagaacctggcctatggagaggagaagaagaagaagtgcaacccctacgtgaagacctacctgctgcctgacaggagcagccagggcaagaggaagacaggagtgcagaggaacacagtggaccccaccttccaggagaccctgaagtaccaggtggccccagcccagctggtgacccggcagctgcaggtgtctgtgtggcacctgggcaccctggcccggcgggtcttcctgggggaggtgatcatccccctggccacctgggactttgaggacagcaccacccagagcttccgctggcaccccctgcgggccaaggccgagaagtatgaagattctgtgccccagagcaatggagagctgactgtgcgggccaagctggtgctgcccagccggcccaggaagctgcaggaggcccaggagggcacagaccagcccagcctgcacggccagctgtgcctggtggtgctgggcgccaagaacctgcctgtgcggccagatggcaccctgaacagctttgtgaagggctgcctgaccctgcctgaccagcagaagctgcggctgaagagccctgtgctgaggaagcaggcctgcccccagtggaagcacagctttgtgttcagcggcgtgaccccagcccagctgcggcagagcagcctggagctgactgtgtgggaccaggccctgtttggcatgaatgaccggctgctgggcggcacccggctgggcagcaaaggagacacagctgtgggcggagatgcctgcagcctgagcaagctgcagtggcagaaggtgctgagcagccccaacctgtggacagacatgaccctggtgctgcactag

SEQ ID NO: 42496 - DNA, 1011 bp, Artificial Sequence
  Description of Artificial Sequence: Synthetic coding sequence
atgagaaatgagcccaggaacttccagctggagggcagcctcatcagcattgacagcacctgcacagagatgggcaactttgacaatgccaacgtgactggagaaattgaatttgccatccactactgcttcaagacccacagcctggagatctgcatcaaggcctgcaagaacctggcctatggagaggagaagaagaagaagtgcaacccctacgtgaagacctacctgctgcctgacaggagcagccagggcaagaggaagacaggagtgcagaggaacacagtggaccccaccttccaggagaccctgaagtaccaggtggccccagcccagctggtgacccggcagctgcaggtgtctgtgtggcacctgggcaccctggcccggcgggtcttcctgggggaggtgatcatccccctggccacctgggactttgaggacagcaccacccagagcttccgctggcaccccctgcgggccaaggccgagaagtatgaagattctgtgccccagagcaatggagagctgactgtgcgggccaagctggtgctgcccagccggcccaggaagctgcaggaggcccaggagggcacagaccagcccagcctgcacggccagctgtgcctggtggtgctgggcgccaagaacctgcctgtgcggccagatggcaccctgaacagctttgtgaagggctgcctgaccctgcctgaccagcagaagctgcggctgaagagccctgtgctgaggaagcaggcctgcccccagtggaagcacagctttgtgttcagcggcgtgaccccagcccagctgcggcagagcagcctggagctgactgtgtgggaccaggccctgtttggcatgaatgaccggctgctgggcggcacccggctgggcagcaaaggagacacagctgtgggcggagatgcctgcagcctgagcaagctgcagtggcagaaggtgctgagcagccccaacctgtggacagacatgaccctggtgctgcactag

SEQ ID NO: 42497 - DNA, 1704 bp, Artificial Sequence
  Description of Artificial Sequence: Synthetic coding sequence
atggcccaggagattgacctgagcgccctgaaggagctggagcgggaggccatcctgcaggtgctgtacagagaccaggccgtgcagaacacagaggaggagaggaccaggaagctgaagacccacctgcagcacctgcgctggaagggggccaagaacacagactgggagcacaaggagaagtgctgtgcccgctgccagcaggtgctgggcttcctgctgcacagaggagctgtgtgccggggctgcagccaccgggtgtgtgcccagtgcagggtcttcctgcggggcacccacgcctggaagtgcaccgtgtgctttgaggacagaaatgtgaagatcaagacaggagagtggttctatgaggagcgggccaagaagttccccaccggcggcaagcatgagaccgtgggcggccagctgctgcagagctaccagaagctgagcaagatctctgtggtgccccccaccccacctcctgtgtctgagagccagtgcagccgcagccctggccgcctgcaggagtttggccagttccggggcttcaacaagtctgtggagaacctcttcctgagcctggccacccacgtgaagaagctgagcaagagccagaatgacatgaccagcgagaagcacctgctggccaccggcccccggcagtgtgtgggccagacagaaagaagaagccagagcgacacagctgtgaatgtgaccaccaggaaggtgtctgccccagacatcctgaagcccctgaaccaggaggaccccaagtgcagcaccaaccccatcctgaagcagcagaacctgcccagcagccctgcccccagcaccatcttcagcggcggcttcagacatggcagcctcatcagcattgacagcacctgcacagagatgggcaactttgacaatgccaacgtgactggagaaattgaatttgccatccactactgcttcaagacccacagcctggagatctgcatcaaggcctgcaagaacctggcctatggagaggagaagaagaagaagtgcaacccctacgtgaagacctacctgctgcctgacaggagcagccagggcaagaggaagacaggagtgcagaggaacacagtggaccccaccttccaggagaccctgaagtaccaggtggccccagcccagctggtgacccggcagctgcaggtgtctgtgtggcacctgggcaccctggcccggcgggtcttcctgggggaggtgatcatccccctggccacctgggactttgaggacagcaccacccagagcttccgctggcaccccctgcgggccaaggccgagaagtatgaagattctgtgccccagagcaatggagagctgactgtgcgggccaagctggtgctgcccagccggcccaggaagctgcaggaggcccaggagggcacagaccagcccagcctgcacggccagctgtgcctggtggtgctgggcgccaagaacctgcctgtgcggccagatggcaccctgaacagctttgtgaagggctgcctgaccctgcctgaccagcagaagctgcggctgaagagccctgtgctgaggaagcaggcctgcccccagtggaggcacagctgctggaggggctgcatgctgaccatcgaggcccctgtggccgagagccccttccagccccagagcatggacagacatgacagctgcccagccctgacctag

SEQ ID NO: 42498 - DNA, 2193 bp, Artificial Sequence
  Description of Artificial Sequence: Synthetic coding sequence
atgagcaagaacagcgagttcatcaacctgtccttcctgctggaccacgagaaggagatgatcctgggcgtgctgaagagagatgagtacctgaagaaggtggaggacaagaggatcaggaagctgaagaatgagctgctggaggccaagagaagaagtggcaagacccagcaggaggccagccgggtgtgtgtgcactgccacaggaacctgggcctcatctttgacagaggagacccctgccaggcctgcagcctgcgggtgtgcagagaatgtcgggtggccggccccaacggctcctggaagtgcaccgtgtgtgacaagatcgcccagctgcgcatcatcaccggggagtggttctttgaggagaaggccaagcgcttcaagcaggtgaatgtgctgggcacagatgtggtgcggcagagcatcctgcggcgcagccctggagctgaggaggtgcagagccaggagcagacccggcaggatgctgagaagagtgacaccagccctgtggccggcaagaaggccagccatgatggccccaagaggaagggcttcctgctgagcaagttccgcagcgccaccagaggagagatcatcacccccaagacagacaccggccgcagctacagcctggacctggatggccagcacttccgcagcctgaagagccccccaggcagtgaccggggcagcacaggcagcagtgacctgaatgaccaggagcccggccccaggacccccaagagcagccgcagcaatggagtgaccccaggcacccagagcagccctgcccccagcaccaggacagtgaccagcgtcatcagccgggagtatggctttgagaacagcatggacctggccgccatcgagggcaccagccaggagctgaccaagagccacagaagaaacaccagcggcacccccagcattgctgtgtctggcaccagcctgagcagtgaccagagccgctctgagctggacctgtctgagagcttcacagaagattctgaggacacagtgtccatccgcagcaagtctgtgcctggggccctggacaaggacagcctggaggagacagaggagagcattgatgccctggtgagcagccagctgagcaccaacacccaccggctggccagcggcctgagcaccaccagcctgaacagcatgatgtctgtgtacagcgagaccggggactatggaaatgtgaaggtgtctggagagatcctgctgcacatctcctactgctacaagacaggaggcctgtacatctttgtgaagaactgcaggaacctggccatcggagatgagaagaagcagaggacagatgcctacgtgaagagctacctgctgcctgacaagagcaggaacaacaagaggaagaccaagatcagaacaggcaccaaccctgagttcaatgagaccctgaagtacaccatcagccacacccagctggagaccaggaccctgcagctgtctgtgtggcactatgacagatttggaagaaattccttcctgggggaggtggagatcccctttgacagctggaactttgagaaccccacagatgagtggtttgtgctgcagcccaaggtggagtttgccccagacatcggcctgcagtacaagggggagctgactgtggtgctgcgctacatccccccagaggagaacctgatgctgcccccagagcagctgcagggcaacaagaccttcaagaagggcaagaagaaggagagccctgtgatcagcggcggcatcctggaggtgttcatcaaggaggccaagaacctgacagctgtgaagagcggcggcaccagtgacagctttgtgaagggctacctgctgcctgatgacagcaaggccaccaagcacaagaccctggtgatcaagaagtctgtgaacccccagtggaaccacaccttcatgttcagcggcatccacccccaggacatcaagaatgtgtgcctggagctgaccatctgggacaaggaggccttcagcagcaacatcttcctgggcggcgtgcggctgaacagcggcagcggcgtgagccacggcaagaatgtggactggatggacagccagggcgaggagcagaggctgtggcagaagatggccaacaaccctggcaccccatttgaaggagtgctgatgctgcggagctccatgggcaaatgtcggctgtag

SEQ ID NO: 42499 - DNA, 2193 bp, Artificial Sequence; identical to SEQ ID NO: 42498
  Description of Artificial Sequence: Synthetic coding sequence

SEQ ID NO: 42500 - DNA, 2259 bp, Artificial Sequence
  Description of Artificial Sequence: Synthetic coding sequence
atgagcaagaacagcgagttcatcaacctgtccttcctgctggaccacgagaaggagatgatcctgggcgtgctgaagagagatgagtacctgaagaaggtggaggacaagaggatcaggaagctgaagaatgagctgctggaggccaagagaagaagtggcaagacccagcaggaggccagccgggtgtgtgtgcactgccacaggaacctgggcctcatctttgacagaggagacccctgccaggcctgcagcctgcgggtgtgcagagaatgtcgggtggccggccccaacggctcctggaagtgcaccgtgtgtgacaagatcgcccagctgcgcatcatcaccggggagtggttctttgaggagaaggccaagcgcttcaagcaggtgaatgtgctgggcacagatgtggtgcggcagagcatcctgcggcgcagccctggagctgaggaggtgcagagccaggagcagacccggcaggatgctgagaagagtgacaccagccctgtggccggcaagaaggccagccatgatggccccaagaggaagggcttcctgctgagcaagttccgcagcgccaccagaggagagatcatcacccccaagacagacaccggccgcagctacagcctggacctggatggccagcacttccgcagcctgaagagccccccaggcagtgaccggggcagcacaggcagcagtgacctgaatgaccaggagcccggccccaggacccccaagagcagccgcagcaatggagtgaccccaggcacccagagcagccctgcccccagcaccaggacagtgaccagcgtcatcagccgggagtatggctttgagaacagcatggacctggccgccatcgagggcaccagccaggagctgaccaagagccacagaagaaacaccagcggcacccccagcattgctgtgtctggcaccagcctgagcagtgaccagagccgctctgagctggacctgtctgagagcttcacagaagattctgaggacacagtgtccatccgcagcaagtctgtgcctggggccctggacaaggacagcctggaggagacagaggagagcattgatgccctggtgagcagccagctgagcaccaacacccaccggctggccagcggcctgagcaccagcagccaggccggcagtgacaggaagtggacctacctgaatgtgcctgatgctgacagcgacaccaccagcctgaacagcatgatgtctgtgtacagcgagaccggggactatggaaatgtgaaggtgtctggagagatcctgctgcacatctcctactgctacaagacaggaggcctgtacatctttgtgaagaactgcaggaacctggccatcggagatgagaagaagcagaggacagatgcctacgtgaagagctacctgctgcctgacaagagcaggaacaacaagaggaagaccaagatcagaacaggcaccaaccctgagttcaatgagaccctgaagtacaccatcagccacacccagctggagaccaggaccctgcagctgtctgtgtggcactatgacagatttggaagaaattccttcctgggggaggtggagatcccctttgacagctggaactttgagaaccccacagatgagtggtttgtgctgcagcccaaggtggagtttgccccagacatcggcctgcagtacaagggggagctgactgtggtgctgcgctacatccccccagaggagaacctgatgctgcccccagagcagctgcagggcaacaagaccttcaagaagggcaagaagaaggagagccctgtgatcagcggcggcatcctggaggtgttcatcaaggaggccaagaacctgacagctgtgaagagcggcggcaccagtgacagctttgtgaagggctacctgctgcctgatgacagcaaggccaccaagcacaagaccctggtgatcaagaagtctgtgaacccccagtggaaccacaccttcatgttcagcggcatccacccccaggacatcaagaatgtgtgcctggagctgaccatctgggacaaggaggccttcagcagcaacatcttcctgggcggcgtgcggctgaacagcggcagcggcgtgagccacggcaagaatgtggactggatggacagccagggcgaggagcagaggctgtggcagaagatggccaacaaccctggcaccccatttgaaggagtgctgatgctgcggagctccatgggcaaatgtcggctgtag

SEQ ID NO: 42501 - DNA, 3762 bp, Artificial Sequence
  Description of Artificial Sequence: Synthetic coding sequence
atgctgtcctggaggctgcagacaggccctgagaaggccgagctgcaggagctgaatgcccggctgtatgactatgtgtgccgggtgcgggagctggagcgggagaacctgctgctggaggaggagctgcggggccggcggggccgggagggcctgtgggccgagggccaggcccgctgtgccgaggaggcccggagcctgcggcagcagctggatgagctgtcctgggccacagccctggccgagggggagagagatgccctgcggcgggagctgcgggagctgcagaggctggatgctgaggagcgggccgcccggggccgcctggatgctgagctgggcgcccagcagcgggagctgcaggaggccctgggcgcccgggccgccctggaggccctgctgggccgcctgcaggccgagcggcggggcctggatgctgcccacgagagagatgtgcgggagctgcgggcccgggccgccagcctgaccatgcacttccgggcccgggccactggacctgctgcccccccaccccggctgcgggaggtgcatgacagctatgccctgctggtggccgagagctggagggagaccgtgcagctgtatgaagatgaggtgcgggagctggaggaggccctgcggcggggccaggagagccggctgcaggccgaggaggagacccggctgtgtgcccaggaggccgaggccctgcggcgggaggccctgggcctggagcagctgcgggcccggctggaggatgccctgctgaggatgagggaggagtatggcatccaggccgaggagcggcagagggtgattgactgcctggaggatgagaaggccaccctgaccctggccatggctgactggctgcgggactaccaggacctgctgcaggtgaagacaggcctgagcctggaggtggccacctaccgggccctgctggagggggagagcaaccctgagatcgtcatctgggccgagcacgtggagaacatgcccagcgagttcaggaacaagagctaccactacacagacagcctgctgcagcgggagaatgaaagaaacctcttcagccggcagaaggcccccctggccagcttcaaccacagcagcgccctgtacagcaacctgagcggccaccggggcagccagacaggcaccagcattggaggagatgcccggcggggcttcctgggcagcggctacagcagcagcgccaccacccagcaggagaacagctatggcaaggctgtgagcagccagaccaacgtgaggaccttcagccccacctacggcctgctgaggaacacagaggcccaggtgaagaccttcccagaccggcccaaggccggggacacccgggaggtgcctgtgtacatcggggaggacagcaccatcgcccgggagagctacagagacagaagagacaaggtggccgccggggccagcgagagcaccaggagcaatgaaagaactgtcatcctgggcaagaagacagaggtgaaggccacccgggagcaggagaggaacagacctgagaccatccgcaccaagccagaggagaagatgtttgacagcaaggagaaggccagcgaggagaggaacctgcgctgggaggagctgaccaagctggacaaggaggcccggcagcgggagagccagcagatgaaggagaaggccaaggagaaggacagccccaaggagaagtctgtgcgggagcgggaggtgcccatcagcctggaggtgtcccaggacagaagagctgaggtgagccccaagggcctgcagacccctgtgaaggatgctgggggcggcaccggccgggaggccgaggcccgggagctgcgcttccggctgggcaccagtgatgccaccggcagcctgcagggcgacagcatgacagaaacagtggccgagaacatcgtgaccagcatcctgaagcagttcacccagagccctgagacagaggccagcgctgacagcttcccagacaccaaggtgacctacgtggacaggaaggagctgcctggagagaggaagaccaagacagagatcgtggtggagagcaagctgacagaagatgtggatgtgtctgatgaggccggcctggactacctgctgagcaaggacatcaaggaggtgggcctgaagggcaagtctgctgagcagatgattggagacatcatcaacctgggcctgaagggccgggagggccgggccaaggtggtgaatgtggagatcgtggaggagcctgtgtcctatgtgtctggagagaagccagaggagttctctgtgcccttcaaggtggaggaggtggaggatgtgtccccaggcccctggggcctggtgaaggaggaggagggctacggggagagtgatgtgaccttctctgtgaaccagcacaggaggaccaagcagccccaggagaacaccacccacgtggaggaggtgacagaagctggggacagcgagggggagcagagctactttgtgtccaccccagatgagcaccctgggggccatgacagagatgatggctctgtgtatggccagatccacatcgaggaggagagcaccatccgctacagctggcaggatgaaattgtgcagggcaccaggaggaggacccagaaggatggagctgtgggggagaaggtggtgaagcccctggatgtgcctgcccccagcctggagggggacctgggcagcacccactggaaggagcaggcccggtctggagagttccacgccgagcccaccgtgattgagaaggagatcaagatcccccatgagttccacacctccatgaagggcatcagcagcaaggagccccggcagcagctggtggaggtgattggccagctggaggagaccctgcctgagaggatgagggaggagctgagcgccctgacccgggagggccagggcggccctggctctgtgtctgtggatgtgaagaaggtgcagggcgctgggggcagctctgtgaccctggtggccgaggtgaatgtgtcccagacagtggatgctgaccggctggacctggaggagctgagcaaggatgaggccagcgagatggagaaggctgtggagagcgtggtgcgggagagcctgagccggcagaggagccctgcccctggcagcccagatgaggagggcggcgctgaggccccagctgctggcatccgcttccgccgctgggccacccgggagctgtacatccccagcggggagagcgaggtggccggcggggccagccacagcagcggccagaggaccccccagggccctgtgtctgccaccgtggaggtgagcagccccactggatttgcccagagccaggtgctggaggatgtgtcccaggccgcccggcacatcaagctgggccccagcgaggtgtggaggacagagaggatgtcctatgagggccccacagctgaggtggtggagatggatgtgtccaatgtggaggccatccgcagcaggacccaggaggccggggccctgggcgtgtctgaccggggctcctggagagatgctgacagcagaaatgaccaggccgtgggcgtgtccttcaaggccagcgctggggagggggaccaggcccaccgggagcagggcaaggagcaggccatgtttgacaagaaggtgcagctgcagaggatggtggaccagaggagcgtcatcagtgatgagaagaaggtggccctgctgtacctggacaatgaggaggaggagaatgatggccactggttctag

SEQ ID NO: 42502 - DNA, 3759 bp, Artificial Sequence
  Description of Artificial Sequence: Synthetic coding sequence
atgctgtcctggaggctgcagacaggccctgagaaggccgagctgcaggagctgaatgcccggctgtatgactatgtgtgccgggtgcgggagctggagcgggagaacctgctgctggaggaggagctgcggggccggcggggccgggagggcctgtgggccgagggccaggcccgctgtgccgaggaggcccggagcctgcggcagcagctggatgagctgtcctgggccacagccctggccgagggggagagagatgccctgcggcgggagctgcgggagctgcagaggctggatgctgaggagcgggccgcccggggccgcctggatgctgagctgggcgcccagcagcgggagctgcaggaggccctgggcgcccgggccgccctggaggccctgctgggccgcctgcaggccgagcggcggggcctggatgctgcccacgagagagatgtgcgggagctgcgggcccgggccgccagcctgaccatgcacttccgggcccgggccactggacctgctgcccccccaccccggctgcgggaggtgcatgacagctatgccctgctggtggccgagagctggagggagaccgtgcagctgtatgaagatgaggtgcgggagctggaggaggccctgcggcggggccaggagagccggctgcaggccgaggaggagacccggctgtgtgcccaggaggccgccctgcggcgggaggccctgggcctggagcagctgcgggcccggctggaggatgccctgctgaggatgagggaggagtatggcatccaggccgaggagcggcagagggtcatcgactgcctggaggatgagaaggccaccctgaccctggccatggctgactggctgcgggactaccaggacctgctgcaggtgaagacaggcctgagcctggaggtggccacctaccgggccctgctggagggggagagcaaccctgagatcgtcatctgggccgagcacgtggagaacatgcccagcgagttcaggaacaagagctaccactacacagacagcctgctgcagagagaaaatgaaagaaacctcttcagccggcagaaggcccccctggccagcttcaaccacagcagcgccctgtacagcaacctgagcggccaccggggcagccagacaggcaccagcattggaggagatgcccggcggggcttcctgggcagcggctacagcagcagcgccaccacccagcaggagaacagctatggcaaggctgtgagcagccagaccaacgtgaggaccttcagccccacctacggcctgctgaggaacacagaggcccaggtgaagaccttcccagaccggcccaaggccggggacacccgggaggtgcctgtgtacatcggggaggacagcaccatcgcccgggagagctacagagaccggcgggacaaggtggccgccggggccagcgagagcaccaggagcaatgaaagaactgtcatcctgggcaagaagacagaggtgaaggccacccgggagcaggagaggaacagacctgagaccatccgcaccaagccagaggagaagatgtttgacagcaaggagaaggccagcgaggagaggaacctgcgctgggaggagctgaccaagctggacaaggaggcccggcagcgggagagccagcagatgaaggagaaggccaaggagaaggacagccccaaggagaagtctgtgcgggagcgggaggtgcccatcagcctggaggtgtcccaggaccggcgggcagaggtgagccccaagggcctgcagacccctgtgaaggatgctgggggcggcaccggccgggaggccgaggcccgggagctgcgcttccggctgggcaccagtgatgccaccggcagcctgcagggcgacagcatgacagagaccgtggctgaaaatattgtgaccagcatcctgaagcagttcacccagagccctgagacagaggccagcgctgacagcttcccagacaccaaggtgacctacgtggacaggaaggagctgcccggggagaggaagaccaagacagaaattgtggtggagagcaagctgacagaagatgtggatgtgtctgatgaagctggcctggactacctgctgagcaaggacatcaaggaggtgggcctgaagggcaagtctgctgagcagatgattggagacatcatcaacctgggcctgaagggccgggagggccgggccaaggtggtgaatgtggagatcgtggaggagcctgtgtcctatgtgtctggagagaagccagaggagttctctgtgcccttcaaggtggaggaggtggaggatgtgtccccaggcccctggggcctggtgaaggaggaggagggctatggagagagtgatgtgaccttctctgtgaaccagcacaggaggaccaagcagccccaggagaacaccacccacgtggaggaggtgacagaggccggggacagcgagggggagcagagctactttgtgtccaccccagatgagcaccctgggggccatgacagagatgatggctctgtgtatggccagatccacatcgaggaggagagcaccatccgctacagctggcaggatgagatcgtgcagggcaccaggaggaggacccagaaggatggagctgtgggggagaaggtggtgaagcccctggatgtgcctgcccccagcctggagggggacctgggcagcacccactggaaggagcaggcccggagcggggagttccacgccgagcccaccgtcatcgagaaggagatcaagatcccccatgagttccacacctccatgaagggcatcagcagcaaggagccccggcagcagctggtggaggtgattggccagctggaggagaccctgcctgagaggatgagggaggagctgagcgccctgacccgggagggccagggcggccctggctctgtgtctgtggatgtgaagaaggtgcagggcgccggcggcagctctgtgaccctggtggccgaggtgaatgtgtcccagacagtggatgctgaccggctggacctggaggagctgagcaaggatgaggccagcgagatggagaaggctgtggagagcgtggtgcgggagagcctgagccggcagaggagccctgcccctggcagcccagatgaggagggcggcgctgaggccccagctgctggcatccgcttccgccgctgggccacccgggagctgtacatccccagcggggagagcgaggtggccggcggggccagccacagcagcggccagaggaccccccagggccctgtgtctgccaccgtggaggtgagcagccccaccggctttgcccagagccaggtgctggaggatgtgtcccaggccgcccggcacatcaagctgggccccagcgaggtgtggaggacagagaggatgtcctatgagggccccacagctgaggtggtggagatggatgtgtccaatgtggaggccatccgcagcaggacccaggaggccggggccctgggcgtgtctgaccggggctcctggagagatgctgacagcagaaatgaccaggccgtgggcgtgtccttcaaggccagcgctggggagggggaccaggcccaccgggagcagggcaaggagcaggccatgtttgacaagaaggtgcagctgcagaggatggtggaccagaggagcgtcatcagtgatgagaagaaggtggccctgctgtacctggacaatgaggaggaggagaatgatggccactggttctag

SEQ ID NO: 42503 - DNA, 4695 bp, Artificial Sequence
  Description of Artificial Sequence: Synthetic coding sequence
atgctgtcctggaggctgcagacaggccctgagaaggccgagctgcaggagctgaatgcccggctgtatgactatgtgtgccgggtgcgggagctggagcgggagaacctgctgctggaggaggagctgcggggccggcggggccgggagggcctgtgggccgagggccaggcccgctgtgccgaggaggcccggagcctgcggcagcagctggatgagctgtcctgggccacagccctggccgagggggagagagatgccctgcggcgggagctgcgggagctgcagaggctggatgctgaggagcgggccgcccggggccgcctggatgctgagctgggcgcccagcagcgggagctgcaggaggccctgggcgcccgggccgccctggaggccctgctgggccgcctgcaggccgagcggcggggcctggatgctgcccacgagagagatgtgcgggagctgcgggcccgggccgccagcctgaccatgcacttccgggcccgggccactggacctgctgcccccccaccccggctgcgggaggtgcatgacagctatgccctgctggtggccgagagctggagggagaccgtgcagctgtatgaagatgaggtgcgggagctggaggaggccctgcggcggggccaggagagccggctgcaggccgaggaggagacccggctgtgtgcccaggaggccgccctgcggcgggaggccctgggcctggagcagctgcgggcccggctggaggatgccctgctgaggatgagggaggagtatggcatccaggccgaggagcggcagagggtcatcgactgcctggaggatgagaaggccaccctgaccctggccatggctgactggctgcgggactaccaggacctgctgcaggtgaagacaggcctgagcctggaggtggccacctaccgggccctgctggagggggagagcaaccctgagatcgtcatctgggccgagcacgtggagaacatgcccagcgagttcaggaacaagagctaccactacacagacagcctgctgcagagagaaaatgaaagaaacctcttcagccggcagaaggcccccctggccagcttcaaccacagcagcgccctgtacagcaacctgagcggccaccggggcagccagacaggcaccagcattggaggagatgcccggcggggcttcctgggcagcggctacagcagcagcgccaccacccagcaggagaacagctatggcaaggctgtgagcagccagaccaacgtgaggaccttcagccccacctacggcctgctgaggaacacagaggcccaggtgaagaccttcccagaccggcccaaggccggggacacccgggaggtgcctgtgtacatcggggaggacagcaccatcgcccgggagagctacagagaccggcgggacaaggtggccgccggggccagcgagagcaccaggagcaatgaaagaactgtcatcctgggcaagaagacagaggtgaaggccacccgggagcaggagaggaacagacctgagaccatccgcaccaagccagaggagaagatgtttgacagcaaggagaaggccagcgaggagaggaacctgcgctgggaggagctgaccaagctggacaaggaggcccggcagcgggagagccagcagatgaaggagaaggccaaggagaaggacagccccaaggagaagtctgtgcgggagcgggaggtgcccatcagcctggaggtgtcccaggaccggcgggcagaggtgagccccaagggcctgcagacccctgtgaaggatgctgggggcggcaccggccgggaggccgaggcccgggagctgcgcttccggctgggcaccagtgatgccaccggcagcctgcagggcgacagcatgacagagaccgtggctgaaaatattgtgaccagcatcctgaagcagttcacccagagccctgagacagaggccagcgctgacagcttcccagacaccaaggtgacctacgtggacaggaaggagctgcccggggagaggaagaccaagacagaaattgtggtggagagcaagctgacagaagatgtggatgtgtctgatgaagctggcctggactacctgctgagcaaggacatcaaggaggtgggcctgaagggcaagtctgctgagcagatgattggagacatcatcaacctgggcctgaagggccgggagggccgggccaaggtggtgaatgtggagatcgtggaggagcctgtgtcctatgtgtctggagagaagccagaggagttctctgtgcccttcaaggtggaggaggtggaggatgtgtccccaggcccctggggcctggtgaaggaggaggagggctatggagagagtgatgtgaccttctctgtgaaccagcacaggaggaccaagcagccccaggagaacaccacccacgtggaggaggtgacagaggccggggacagcgagggggagcagagctactttgtgtccaccccagatgagcaccctgggggccatgacagagatgatggctctgtgtatggccagatccacatcgaggaggagagcaccatccgctacagctggcaggatgagatcgtgcagggcaccaggaggaggacccagaaggatggagctgtgggggagaaggtggtgaagcccctggatgtgcctgcccccagcctggagggggacctgggcagcacccactggaaggagcaggcccggagcggggagttccacgccgagcccaccgtcatcgagaaggagatcaagatcccccatgagttccacacctccatgaagggcatcagcagcaaggagccccggcagcagctggtggaggtgattggccagctggaggagaccctgcctgagaggatgagggaggagctgagcgccctgacccgggagggccagggcggccctggctctgtgtctgtggatgtgaagaaggtgcagggcgccggcggcagctctgtgaccctggtggccgaggtgaatgtgtcccagacagtggatgctgaccggctggacctggaggagctgagcaaggatgaggccagcgagatggagaaggctgtggagagcgtggtgcgggagagcctgagccggcagaggagccctgcccctggcagcccagatgaggagggcggcgctgaggccccagctgctggcatccgcttccgccgctgggccacccgggagctgtacatccccagcggggagagcgaggtggccggcggggccagccacagcagcggccagaggaccccccagggccctgtgtctgccaccgtggaggtgagcagccccaccggctttgcccagagccaggtgctggaggatgtgtcccaggccgcccggcacatcaagctgggccccagcgaggtgtggaggacagagaggatgtcctatgagggccccacagctgaggtggtggaggtgtctgctggaggagacctgagccaggccgccagccccaccggggccagccgctctgtgcgccacgtgaccctgggccctggccagagccccctgagccgggaggtgatcttcctgggccctgccccagcctgcccagaggcctggggcagccctgagcccggccctgctgagagcagcgctgacatggatggcagcggccgccacagcaccttcggctgccggcagttccacgccgagaaggagatcatcttccagggccccatctctgctgctgggaaggtgggggactactttgccacagaggagagcgtgggcacccagacctctgtgcggcagctgcagctgggccccaaggagggcttcagcggccagatccagttcaccgcccccctgagtgacaaggtggagctgggcgtgattggagacagcgtgcacatggagggcctgcccggcagcagcaccagcatccgccacatcagcatcggcccccagaggcaccagaccacccagcagatcgtgtaccacggcctggtgccccagctgggggagagcggggacagcgagagcacagtgcatggagagggcagcgcagatgtgcaccaggccacccacagccacaccagcggccggcagacagtgatgacagagaagagcaccttccagagcgtggtgtctgagagcccccaggaggacagcgctgaggacaccagcggggctgagatgaccagcggcgtgagccgctccttccgccacatccggctgggccccacagaaacagagaccagcgagcacatcgccatccggggccctgtgtccaggacctttgtgctggccggcagcgctgacagccctgagctgggcaagctggccgacagcagcaggaccctgcggcacatcgcccctggccccaaggagaccagcttcaccttccagatggatgtgtccaatgtggaggccatccgcagcaggacccaggaggccggggccctgggcgtgtctgaccggggctcctggagagatgctgacagcagaaatgaccaggccgtgggcgtgtccttcaaggccagcgctggggagggggaccaggcccaccgggagcagggcaaggagcaggccatgtttgacaagaaggtgcagctgcagaggatggtggaccagaggagcgtcatcagtgatgagaagaaggtggccctgctgtacctggacaatgaggaggaggagaatgatggccactggttctag

SEQ ID NO: 42504 - DNA, 567 bp, Artificial Sequence
  Description of Artificial Sequence: Synthetic coding sequence
atgaatggagatgatgcctttgtgagaagaccccgggtgggcagccagatccctgagaagatgcagaaggcctttgatgacatcgccaagtacttcagcgagaaggagtgggagaagatgaaggccagcgagaagatcatctacgtgtacatgaagaggaaatatgaggccatgaccaagctgggcttcaaggccaccctgccccccttcatgaggaacaagagggtggccgacttccagggcaatgactttgacaatgaccccaacagaggcaaccaggtggagcacccccagatgaccttcggccgcctgcagggcatcttccccaagatcaccccagagaagccagctgaggagggcaatgacagcaagggcgtgcctgaggccagcggcccccagaacaacgggaagcagctgcggcccagcggcaagctgaacaccagcgagaaggtgaacaagaccagcggccccaagaggggcaagcacgcctggacccaccgggtgcgggagaggaagcagctggtgatctatgaggagatcagtgacccccaggaggatgatgaatag

SEQ ID NO: 42505 - DNA, 885 bp, Artificial Sequence
  Description of Artificial Sequence: Synthetic coding sequence
atgaaggaccggctgcaggagctgaagcagaggaccaaggagattgagctgagccgggacagccacgtgtccaccacagaaacagaggagcagggcgtcttcctgcagcaggccgtcatctatgagcgggagcctgtggccgagcggcacctgcacgagatccagaagctgcaggagagcatcaacaacctggccgacaacgtgcagaagtttggccagcagcagaagagcctggtggcctccatgaggcgcttcagcctgctgaagcgggagagcaccatcaccaaggagatcaagatccaggccgagtacatcaacagaagcctgaatgacctggtgaaggaggtgaagaagtctgaggtggagaatggccccagctctgtggtgacccgcatcctgaagagccagcacgccgccatgttccgccacttccagcagatcatgttcatctacaatgacaccatcgccgccaagcaggagaagtgcaagaccttcatcctgcggcagctggaggtggccggcaaggagatgtctgaggaggatgtgaatgacatgctgcaccagggcaagtgggaggtgttcaatgaaagcctgctgacagagatcaacatcaccaaggcccagctgtctgaaattgagcagaggcacaaggagctggtgaacctggagaaccagatcaaggacctgcgggacctcttcatccagatcagcctgctggtggaggagcagggcgagagcatcaacaacatcgagatgacagtgaacagcaccaaggagtatgtgaacaacaccaaggagaagtttggcctggccgtgaagtacaagaagaggaacccctgccgggtgctgtgctgctggtgctgcccctgctgcagcagcaagtag

SEQ ID NO: 42506 - DNA, 393 bp, Artificial Sequence
  Description of Artificial Sequence: Synthetic coding sequence
atggagaccgtggtgaccaccctgccccgggagggcggcgtgggccccagcaggaagatgctgctgctgctgctgctgctgggccctggcagcggcctgtctgctgtggtgtcccagcaccccagcagggtcatctgcaagagcggcacctctgtgaacattgaatgtcgcagcctggacttccaggccaccaccatgttctggtaccggcagctgaggaagcagagcctgatgctgatggccaccagcaatgaaggcagcgaggtgacctatgagcagggcgtgaagaaggacaagttccccatcaaccaccccaacctgaccttcagcgccctgactgtgaccagcgcccaccctgaggacagcagcttctacatctgcagcgccaggtag

SEQ ID NO: 42507 - DNA, 345 bp, Artificial Sequence
  Description of Artificial Sequence: Synthetic coding sequence
actggcacccggctgctgggctgggtggccctgtgcctgctggccgccggctgcttccacgccaaggtgacccagaccccaggctacctggtgaagggcaagggcaggaagaccaagatgtactgcacccccaagaatggccacacctttgtgtgctggtaccagcagaaccagaacaaggagttcatgttcctgatctccttccagaatgagcaggtgctgcaggagatggagatgcacaagaagcgcttcagcagccagtgccccaagaaccccccctgcagcctggccatcctgagcagcgagcccggggacacagccctgtacctgtgtgccaccagctag

SEQ ID NO: 42508 - DNA, 339 bp, Artificial Sequence
  Description of Artificial Sequence: Synthetic coding sequence
atgaccatccgcttcctgcggcaggtggccttctacttcctggaggccggcctgaaggaggccgagatctaccagacccccaggcacagggtcatcggggccggcaagaagatcaccctggagtgcagccagaccatgggccatgacaagatgtactggagccgcagcagaaatggcatcaccccccacccccccttcctgtgggtgaacagcacagagaagggggacctgtgcagcgagagcacagtgagccgcatccgcatcgagcgcttccccctgaccctggagagcgccagccccagccacaccagccagtacctgtgtgccagcagcgagtag

SEQ ID NO: 42509 - DNA, 525 bp, Artificial Sequence
  Description of Artificial Sequence: Synthetic coding sequence
atggctgatgctgctgccacagctggggccggcggcagcggcaccaggagcggcagcaagcagagcaccaacccagctgacaactaccacctggcccggcggaggaccctgcaggtggtggtgagcagcctgctgacagaggccggctttgagagcgctgagaaggcctctgtggagaccctgacagagatgctgcagagctacatcagcgagatcggccgcagcgccaagagctactgtgagcacacagcccggacccagcccaccctgagtgacatcgtggtgaccctggtggagatgggcttcaacgtggacaccctgcctgcctatgccaagaggagccagaggatggtgatcacagcccctcctgtgaccaaccagcctgtgacccccaaggccctgacagctggccagaaccggccccaccccccccacatccccagccacttccctgagttcccagacccccacacctacatcaagacccctgtgtctgatgaggccctgggcctgcgggtggtgtag

SEQ ID NO: 42510 - DNA, 1017 bp, Artificial Sequence
  Description of Artificial Sequence: Synthetic coding sequence
atggctgatgctgctgccacagctggggccggcggcagcggcaccaggagcggcagcaagcagagcaccaacccagctgacaactaccacctggcccggcggaggaccctgcaggtggtggtgagcagcctgctgacagaggccggctttgagagcgctgagaaggcctctgtggagaccctgacagagatgctgcagagctacatcagcgagatcggccgcagcgccaagagctactgtgagcacacagcccggacccagcccaccctgagtgacatcgtggtgaccctggtggagatgggcttcaacgtggacaccctgcctgcctatgccaagaggagccagaggatggtgatcacagcccctcctgtgaccaaccagcctgtgacccccaaggccctgacagctggccagaaccggccccaccccccccacatccccagccacttccctgagttcccagacccccacacctacatcaagacccccacctaccgggagcctgtgtctgactaccaggtgctgcgggagaaggccgccagccagaggagagatgtggagcgggccctgacccgcttcatggccaagacaggagagacccagagcctcttcaaggatgatgtgtccaccttccccctgattgctgcccggcccttcaccatcccctacctgacagccctgctgcccagcgagctggagatgcagcagatggaggagacagacagcagcgagcaggatgagcagacagacacagagaacctggccctgcacatctccatgattgagagccgctctgtgacccaggccggcgtgcagtggcaggacctgggcagcctgcagcccccacctcctggcttcaagcgcttcagcagcctgagcctgctgagctcctggaactaccgccgcatcctggagcccaggaggaggacccccctgagctgcagcaggaccccaccctgccgggtggccggcatgggccgccgcaccagcagcatcaccctcatctgtggccgctag

SEQ ID NO: 42511 - DNA, 936 bp, Artificial Sequence
  Description of Artificial Sequence: Synthetic coding sequence
atggctgatgctgctgccacagctggggccggcggcagcggcaccaggagcggcagcaagcagagcaccaacccagctgacaactaccacctggcccggcggaggaccctgcaggtggtggtgagcagcctgctgacagaggccggctttgagagcgctgagaaggcctctgtggagaccctgacagagatgctgcagagctacatcagcgagatcggccgcagcgccaagagctactgtgagcacacagcccggacccagcccaccctgagtgacatcgtggtgaccctggtggagatgggcttcaacgtggacaccctgcctgcctatgccaagaggagccagaggatggtgatcacagcccctcctgtgaccaaccagcctgtgacccccaaggccctgacagctggccagaaccggccccaccccccccacatccccagccacttccctgagttcccagacccccacacctacatcaagacccccacctaccgggagcctgtgtctgactaccaggtgctgcgggagaaggccgccagccagaggagagatgtggagcgggccctgacccgcttcatggccaagacaggagagacccagagcctcttcaaggatgatgtgtccaccttccccctgattgctgcccggcccttcaccatcccctacctgacagccctgctgcccagcgagctggagatgcagcagatggaggagacagacagcagcgagcaggatgagcagacagacacagagaacctggccctgcacatctccatggaggacagcggggctgagaaggagaacacctctgtgctgcagcagaaccccagcctgagcggcagcagaaatggagaggagaacatcatcgacaacccctacctgcggcctgtgaagaagcccaagatccggaggaagaagccagacaccttctag

SEQ ID NO: 42512 - DNA, 1017 bp, Artificial Sequence; identical to SEQ ID NO: 42510
  Description of Artificial Sequence: Synthetic coding sequence

SEQ ID NO: 42513 - DNA, 795 bp, Artificial Sequence
  Description of Artificial Sequence: Synthetic coding sequence
atggagagcggcaagacagccagccccaagtccatgcccaaggatgcccagatgatggcccagatcctgaaggacatgggcatcacagaatatgagcccagggtcatcaaccagatgctggagtttgccttccgctacgtgaccaccatcctggatgatgccaagatctacagcagccacgccaagaaggccaccgtggatgctgatgatgtgcggctggccatccagtgcagagctgaccagagcttcaccagccccccaccccgggacttcctgctggacatcgcccggcagaggaaccagacccccctgcccctcatcaagccctacagcggcccccggctgcccccagaccgctactgcctgacagcccccaactaccgcctgaagagcctgcagaagaaggccagcaccagcgctggccgcatcaccgtgccccggctgtctgtgggctctgtgaccagccggcccagcacccccaccctgggcacccccaccccccagaccatgtctgtgtccaccaaggtgggcacccccatgagcctgaccggccagcgcttcaccgtgcagatgcccaccagccagagccctgctgtgaaggccagcatcccagccaccagcgctgtgcagaatgtgctgatcaaccccagcctgattggcagcaagaacatcctgatcaccaccaacatgatgagcagccagaacacagccaatgaaagcagcaatgccctgaagaggaagagagaagatgatgatgatgatgatgatgatgatgatgattatgacaacctgtag

SEQ ID NO: 42514 - DNA, 1374 bp, Artificial Sequence
  Description of Artificial Sequence: Synthetic coding sequence
atggagttcctgctgggcaaccccttcagcacccctgtgggccagtgcctggagaaggccacagatggcagcctgcagagcgaggactggaccctgaacatggagatctgtgacatcatcaatgaaacagaggagggccccaaggatgccatccgggccctgaagaagaggctgaatggaaacagaaactaccgggaggtgatgctggccctgacagcctgggcagatgccttccgcagcagcccagacctgactggagtggtgcacatctatgaggagctgaagaggaaaggagtggagttccccatggctgacctggatgccctgagccccatccacaccccccagaggtctgtgcctgaggtggaccctgctgccaccatgcccaggagccagagccagcagaggaccagcgctggcagctacagcagccccccaccagccccctacagcgccccccaggccccagccctgtctgtgacaggccccatcacagccaacagcgagcagatcgcccggctgcggtctgagctggatgtggtgcggggcaacaccaaggtgatgtctgagatgctgacagagatggtgcccggccaggaggacagcagtgacctggagctgctgcaggagctgaacagaacctgccgggccatgcagcagagaattgtggagctgatcagccgggtgtccaatgaggaggtgacagaggagctgctgcacgtgaatgatgacctgaacaacgtgttcctgcgctatgaaagatttgagcgctaccgcagcggccgctctgtgcagaatgccagcaatggagtgctgaatgaggtgacagaggacaacctgattgacctgggccctggcagccctgctgtggtgagccccatggtgggcaacacagccccacccagcagcctgagcagccagctggccggcctggacctgggcacagaatctgtgtctggcaccctgagcagcctgcagcagtgcaaccccagagatggctttgacatgtttgcccagacccggggcaacagcctggccgagcagaggaagacagtgacctatgaggacccccaggccgtgggcggcctggccagcgccctggacaacaggaagcagagcagcgagggcatccctgtggcccagcccagcgtgatggatgacatcgaggtgtggctgaggacagacctgaagggagatgacctggaggagggcgtgaccagcgaggagtttgacaagttcctggaggagcgggccaaggctgctgagatggtgcctgacctgcccagcccccccatggaggccccagccccagccagcaaccccagcggcaggaagaagccagagaggagtgaagatgccctgtttgccctgtag

SEQ ID NO: 42515 - DNA, 1524 bp, Artificial Sequence
  Description of Artificial Sequence: Synthetic coding sequence
atggagttcctgctgggcaaccccttcagcacccctgtgggccagtgcctggagaaggccacagatggcagcctgcagagcgaggactggaccctgaacatggagatctgtgacatcatcaatgaaacagaggagggccccaaggatgccatccgggccctgaagaagaggctgaatggaaacagaaactaccgggaggtgatgctggccctgactgtgctggagacctgtgtgaagaactgtggccaccgcttccacatcctggtggccaacagagacttcattgattctgtgctggtgaagatcatcagccccaagaacaacccccccaccatcgtgcaggacaaggtgctggccctgatccaggcctgggcagatgccttccgcagcagcccagacctgactggagtggtgcacatctatgaggagctgaagaggaaaggagtggagttccccatggctgacctggatgccctgagccccatccacaccccccagaggtctgtgcctgaggtggaccctgctgccaccatgcccaggagccagagccagcagaggaccagcgctggcagctacagcagccccccaccagccccctacagcgccccccaggccccagccctgtctgtgacaggccccatcacagccaacagcgagcagatcgcccggctgcggtctgagctggatgtggtgcggggcaacaccaaggtgatgtctgagatgctgacagagatggtgcccggccaggaggacagcagtgacctggagctgctgcaggagctgaacagaacctgccgggccatgcagcagagaattgtggagctgatcagccgggtgtccaatgaggaggtgacagaggagctgctgcacgtgaatgatgacctgaacaacgtgttcctgcgctatgaaagatttgagcgctaccgcagcggccgctctgtgcagaatgccagcaatggagtgctgaatgaggtgacagaggacaacctgattgacctgggccctggcagccctgctgtggtgagccccatggtgggcaacacagccccacccagcagcctgagcagccagctggccggcctggacctgggcacagaatctgtgtctggcaccctgagcagcctgcagcagtgcaaccccagagatggctttgacatgtttgcccagacccggggcaacagcctggccgagcagaggaagacagtgacctatgaggacccccaggccgtgggcggcctggccagcgccctggacaacaggaagcagagcagcgagggcatccctgtggcccagcccagcgtgatggatgacatcgaggtgtggctgaggacagacctgaagggagatgacctggaggagggcgtgaccagcgaggagtttgacaagttcctggaggagcgggccaaggctgctgagatggtgcctgacctgcccagcccccccatggaggccccagccccagccagcaaccccagcggcaggaagaagccagagaggagtgaagatgccctgtttgccctgtag

SEQ ID NO: 42516 - DNA, 1389 bp, Artificial Sequence
  Description of Artificial Sequence: Synthetic coding sequence
atggagttcctgctgggcaaccccttcagcacccctgtgggccagtgcctggagaaggccacagatggcagcctgcagagcgaggactggaccctgaacatggagatctgtgacatcatcaatgaaacagaggagggccccaaggatgccatccgggccctgaagaagaggctgaatggaaacagaaactaccgggaggtgatgctggccctgactgtgctggagacctgtgtgaagaactgtggccaccgcttccacatcctggtggccaacagagacttcattgattctgtgctggtgaagatcatcagccccaagaacaacccccccaccatcgtgcaggacaaggtgctggccctgatccagagcgtgcctgaggtggaccctgctgccaccatgcccaggagccagagccagcagaggaccagcgctggcagctacagcagccccccaccagccccctacagcgccccccaggccccagccctgtctgtgacaggccccatcacagccaacagcgagcagatcgcccggctgcggtctgagctggatgtggtgcggggcaacaccaaggtgatgtctgagatgctgacagagatggtgcccggccaggaggacagcagtgacctggagctgctgcaggagctgaacagaacctgccgggccatgcagcagagaattgtggagctgatcagccgggtgtccaatgaggaggtgacagaggagctgctgcacgtgaatgatgacctgaacaacgtgttcctgcgctatgaaagatttgagcgctacagaagtggccgctctgtgcagaatgccagcaatggagtgctgaatgaggtgacagaggacaacctgattgacctgggccctggcagccctgctgtggtgagccccatggtgggcaacacagccccacccagcagcctgagcagccagctggccggcctggacctgggcacagagagcgtgtctggcaccctgagcagcctgcagcagtgcaaccccagagatggctttgacatgtttgcccagacccggggcaacagcctggccgagcagaggaagacagtgacctatgaggacccccaggccgtgggcggcctggccagcgccctggacaacaggaagcagagcagcgagggcatccctgtggcccagcccagcgtgatggatgacatcgaggtgtggctgaggacagacctgaagggagatgacctggaggagggcgtgaccagcgaggagtttgacaagttcctggaggagcgggccaaggctgctgagatggtgcctgacctgcccagcccccccatggaggccccagccccagccagcaaccccagcggcaggaagaagccagagaggagtgaagatgccctgtttgccctgtag

SEQ ID NO: 42517 - DNA, 1452 bp, Artificial Sequence
  Description of Artificial Sequence: Synthetic coding sequence
atggagttcctgctgggcaaccccttcagcacccctgtgggccagtgcctggagaaggccacagatggcagcctgcagagcgaggactggaccctgaacatggagatctgtgacatcatcaatgaaacagaggagggccccaaggatgccatccgggccctgaagaagaggctgaatggaaacagaaactaccgggaggtgatgctggccctgactgtgctggagacctgtgtgaagaactgtggccaccgcttccacatcctggtggccaacagagacttcattgattctgtgctggtgaagatcatcagccccaagaacaacccccccaccatcgtgcaggacaaggtgctggccctgatccaggcctgggcagatgccttccgcagcagcccagacctgactggagtggtgcacatctatgaggagctgaagaggaaaggagtggagttccccatggctgacctggatgccctgagccccatccacaccccccagagaattgcccggctgcggtctgagctggatgtggtgcggggcaacaccaaggtgatgtctgagatgctgacagagatggtgcccggccaggaggacagcagtgacctggagctgctgcaggagctgaacagaacctgccgggccatgcagcagagaattgtggagctgatcagccgggtgtccaatgaggaggtgacagaggagctgctgcacgtgaatgatgacctgaacaacgtgttcctgcgctatgaaagatttgagcgctacagaagtggccgctctgtgcagaatgccagcaatggagtgctgaatgaggtgacagaggacaacctgattgacctgggccctggcagccctgctgtggtgagccccatggtgggcaacacagccccacccagcagcctgagcagccagctggccggcctggacctgggcacagagagcgtgtctggcaccctgagcagcctgcagcagtgcaaccccagagatggctttgacatgtttgcccagacccggggcaacagcctggccgagcagaggaagacagtgacctatgaggacccccaggccgtgggcggcctggccagcgccctggacaacaggaagcagagcagcgagggcaccttcctgagcagcgcccagaagaggggccggggcggggagagtgacctggagcccatcgacagctggctgatcacccagggcatgatccctgtggcccagcccagcgtgatggatgacatcgaggtgtggctgaggacagacctgaagggagatgacctggaggagggcgtgaccagcgaggagtttgacaagttcctggaggagcgggccaaggctgctgagatggtgcctgacctgcccagcccccccatggaggccccagccccagccagcaaccccagcggcaggaagaagccagagaggagtgaagatgccctgtttgccctgtag

SEQ ID NO: 42518 - DNA, 834 bp, Artificial Sequence
  Description of Artificial Sequence: Synthetic coding sequence
atggagttcctgctgggcaaccccttcagcacccctgtgggccagtgcctggagaaggccacagatggcagcctgcagagcgaggactggaccctgaacatggagatctgtgacatcatcaatgaaacagaggagggccccaaggatgccatccgggccctgaagaagaggctgaatggaaacagaaactaccgggaggtgatgctggccctgacagcctgggcagatgccttccgcagcagcccagacctgactggagtggtgcacatctatgaggagctgaagaggaaaggagtggagttccccatggctgacctggatgccctgagccccatccacaccccccagaggtctgtgcctgaggtggaccctgctgccaccatgcccaggagccagagccagcagaggaccagcgctggcagctacagcagccccccaccagccccctacagcgccccccaggccccagccctgtctgtgacaggccccatcacagccaacagcgagcagatcgcccggctgcggtctgagctggatgtggtgcggggcaacaccaaggtgatgtctgagatgctgacagagatggtgcccggccaggaggacagcagtgacctggagctgctgcaggagctgaacagaacctgccgggccatgcagcagagaattgtggagctgatcagccgggtgtccaatgaggaggtgacagaggagctgctgcacgtgaatgatgacctgaacaacgtgttcctgcgctatgagcgctgggagccagacttcttcttcttcttcttcctggagaagatcgtggccatcacagagggcttcctgtcctag

SEQ ID NO: 42519 - DNA, 1170 bp, Artificial Sequence
  Description of Artificial Sequence: Synthetic coding sequence
atggagttcctgctgggcaaccccttcagcacccctgtgggccagtgcctggagaaggccacagatggcagcctgcagagcgaggactggaccctgaacatggagatctgtgacatcatcaatgaaacagaggagggccccaaggatgccatccgggccctgaagaagaggctgaatggaaacagaaactaccgggaggtgatgctggccctgactgtgctggagacctgtgtgaagaactgtggccaccgcttccacatcctggtggccaacagagacttcattgattctgtgctggtgaagatcatcagccccaagaacaacccccccaccatcgtgcaggacaaggtgctggccctgatccagatcgcccggctgcggtctgagctggatgtggtgcggggcaacaccaaggtgatgtctgagatgctgacagagatggtgcccggccaggaggacagcagtgacctggagctgctgcaggagctgaacagaacctgccgggccatgcagcagagaattgtggagctgatcagccgggtgtccaatgaggaggtgacagaggagctgctgcacgtgaatgatgacctgaacaacgtgttcctgcgctatgaaagatttgagcgctaccgcagcggccgctctgtgcagaatgccagcaatggagtgctgaatgaggtgacagaggacaacctgattgacctgggccctggcagccctgctgtggtgagccccatggtgggcaacacagccccacccagcagcctgagcagccagctggccggcctggacctgggcacagaatctgtgtctggcaccctgagcagcctgcagcagtgcaaccccagagatggctttgacatgtttgcccagacccggggcaacagcctggccgagcagaggaagacagtgacctatgaggacccccaggccgtgggcggcctggccagcgccctggacaacaggaagcagagcagcgagggcaaaggagatgacctggaggagggcgtgaccagcgaggagtttgacaagttcctggaggagcgggccaaggctgctgagatggtgcctgacctgcccagcccccccatggaggccccagccccagccagcaaccccagcggcaggaagaagccagagaggagtgaagatgccctgtttgccctgtag

SEQ ID NO: 42520 - DNA, 1167 bp, Artificial Sequence
  Description of Artificial Sequence: Synthetic coding sequence
atggagttcctgctgggcaaccccttcagcacccctgtgggccagtgcctggagaaggccacagatggcagcctgcagagcgaggactggaccctgaacatggagatctgtgacatcatcaatgaaacagaggagggccccaaggatgccatccgggccctgaagaagaggctgaatggaaacagaaactaccgggaggtgatgctggccctgaccatcgcccggctgcggtctgagctggatgtggtgcggggcaacaccaaggtgatgtctgagatgctgacagagatggtgcccggccaggaggacagcagtgacctggagctgctgcaggagctgaacagaacctgccgggccatgcagcagagaattgtggagctgatcagccgggtgtccaatgaggaggtgacagaggagctgctgcacgtgaatgatgacctgaacaacgtgttcctgcgctatgaaagatttgagcgctaccgcagcggccgctctgtgcagaatgccagcaatggagtgctgaatgaggtgacagaggacaacctgattgacctgggccctggcagccctgctgtggtgagccccatggtgggcaacacagccccacccagcagcctgagcagccagctggccggcctggacctgggcacagaatctgtgtctggcaccctgagcagcctgcagcagtgcaaccccagagatggctttgacatgtttgcccagacccggggcaacagcctggccgagcagaggaagacagtgacctatgaggacccccaggccgtgggcggcctggccagcgccctggacaacaggaagcagagcagcgagggcaccttcctgagcagcgcccagaagaggggccggggcggggagagtgacctggagcccatcgacagctggctgatcacccagggcatgatccctgtggcccagcccagcgtgatggatgacatcgaggtgtggctgaggacagacctgaagggagatgacctggaggagggcgtgaccagcgaggagtttgacaagttcctggaggagcgggccaaggctgctgagatggtgcctgacctgcccagcccccccatggaggccccagccccagccagcaaccccagcggcaggaagaagccagagaggagtgaagatgccctgtttgccctgtag

SEQ ID NO: 42521 - DNA, 1374 bp, Artificial Sequence; identical to SEQ ID NO: 42514
  Description of Artificial Sequence: Synthetic coding sequence

SEQ ID NO: 42522 - DNA, 2571 bp, Artificial Sequence
  Description of Artificial Sequence: Synthetic coding sequence
tgatgcaccaatgaggccctggtggatgagatcatgatgaccctgaagcaggccttcaccgtggccgctgtgcagcagacagccaaggccccagcccagctgtgtgagggctgccccctgcagagcctgcacaagctgtgtgagcgcatcgagggcatgaacagcagcaagaccaagctggagctgcagaagcacctgaccaccctgaccaaccaggagcaggccaccatctttgaggaggtgcagaagctgcggcccagaaatgagcagcgggagaatgaactcatcatctccttcctgcgctgcctgtatgaggagaagcagaaggagcacatccacatcggggagatgaagcagaccagccagatggctgctgagaacatcggcagcgagctgcccccatctgccacccgcttccggctggacatgctgaagaacaaggccaagaggagcctgacagagagcctggagagcatcctgagccggggcaacaaggcccggggcctgcaggagcacagcatctctgtggacctggacagcagcctgagcagcaccctgagcaacaccagcaaggagcccagcgtgtgtgagaaggaggccctgcccatcagcgagagcagcttcaagctgctgggcagcagcgaggacctgagcagtgacagcgagagccacctgcctgaggagcccgcccccctgagcccccagcaggccttcagaagaagagccaacaccctgagccacttccccatcgagtgccaggagcccccccagcctgcccggggcagccctggggtgtcccagaggaagctgatgagataccacagcgtgtccacagagacccctcatgagaggaacatctcctacagaaatgccctgaggaagaagctgcacagcagcagctctgtgcccaacttcctgaagttcctggcccctgtggatgagaacaacaccagtgacttcatgaacaccaagagggactttgagagcaaggccaaccacctgggggacagcggcggcacccctgtgaagaccaggaggcacagctggaggcagcagatcttcctgcgggtggccaccccccagaaggcctgtgacagcagcagccgctatgaggactacagcgagctgggggagctgccccccaggagccccctggagcctgtgtgtgaagatggccccttcggccccccacctgaggagaagaagaggaccagccgggagctgcgggagctgtggcagaaggccatcctgcagcagatcctgctgctgaggatggagaaggagaaccagaagctgcaggcctctgaaaatgacctgctgaacaagaggctgaagctggactatgaggagatcaccccctgcctgaaggaggtgaccaccgtgtgggagaagatgctgagcaccccaggccgcagcaagatcaagtttgacatggagaagatgcacagcgctgtgggccagggcgtgcccaggcaccacagaggagagatctggaagttcctggccgagcagttccacctgaagcaccagttccccagcaagcagcagcccaaggatgtgccctacaaggagctgctgaagcagctgaccagccagcagcacgccatcctgattgacctgggccgcaccttccccacccacccctacttcagcgcccagctgggcgccggccagctgagcctgtacaacatcctgaaggcctacagcctgctggaccaggaggtgggctactgccagggcctgagctttgtggccggcatcctgctgctgcacatgtctgaggaggaggccttcaagatgctgaagttcctgatgtttgacatgggcctgaggaagcagtacagaccagacatgatcatcctgcagatccagatgtaccagctgagccggctgctgcatgactaccaccgggacctgtacaaccacctggaggagcacgagatcggccccagcctgtatgctgccccctggttcctgaccatgtttgccagccagttccccctgggctttgtggcccgggtgtttgacatgatcttcctgcagggcacagaggtgatcttcaaggtggccctgagcctgctgggcagccacaagcccctcatcctgcagcacgagaacctggagaccatcgtggacttcatcaagagcaccctgcccaacctgggcctggtgcagatggagaagaccatcaaccaggtgtttgagatggacatcgccaagcagctgcaggcctatgaggtggagtaccacgtgctgcaggaggagctgattgacagcagccccctgagtgacaaccagaggatggacaagctggagaagaccaacagcagcctgaggaagcagaacctggacctgctggagcagctgcaggtggccaacggccgcatccagagcctggaggccaccatcgagaagctgctgagcagcgagagcaagctgaagcaggccatgctgaccctggagctggagaggtctgccctgctgcagacagtggaggagctgcggcggcgctctgctgagcccagcgaccgggagccagaatgtacccagcctgagcccaccggggactag

SEQ ID NO: 42523 - DNA, 2682 bp, Artificial Sequence
  Description of Artificial Sequence: Synthetic coding sequence
atgttccccctgaaggatgctgagatgggcgccttcaccttctttgccagcgccctgccccatgatgtgtgtggcagcaatggcctgcccctgacccccaacagcatcaagatcctgggccgcttccagatcctgaagaccatcacccacccccggctgtgccagtatgtggacatcagccggggcaagcatgagcggctggtggtggtggccgagcactgtgagaggagcctggaggacctgctgcgggagaggaagcctgtgtcctgcagcacagtgctgtgcatcgcctttgaggtgctgcagggcctgcagtacatgaacaagcacggcatcgtgcaccgggccctgagcccccacaacatcctgctggacaggaagggccacatcaagctggccaagtttggcctgtaccacatgacagcccatggagatgatgtggacttccccatcggctaccccagctacctggcccctgaggtgattgcccagggcatcttcaagaccacagaccacatgcccagcaagaagcccctgcccagcggccccaagagtgatgtgtggagcctgggcatcatcctgtttgagctgtgtgtgggcaggaagctgttccagagcctggacatcagcgagcggctgaagttcctgctgaccctggactgtgtggatgacaccctgattgtgctggccgaggagcacggctgcctggacatcatcaaggagctgcctgagaccgtgattgacctgctgaacaagtgcctgaccttccaccccagcaagaggcccaccccagaccagctgatgaaggacaaggtgttcagcgaggtgagccccctgtacacccccttcaccaagccagccagcctcttcagcagcagcctgcgctgtgccgacctgaccctgcctgaggacatcagccagctgtgcaaggacatcaacaatgactacctggccgagaggagcattgaggaggtgtactacctgtggtgcctggccggcggggacctggagaaggagctggtgaacaaggagatcatccgcagcaagccacccatctgcaccctgcccaacttcctgtttgaagatggagagagctttggccagggccgggacaggagcagcctgctggatgacaccaccgtgaccctgagcctgtgccagctgaggaaccggctgaaggatgtgggcggggaggccttctaccccctgctggaggatgaccagagcaacctgccccacagcaacagcaacaatgagctgtctgctgctgccaccctgcccctcatcatccgggagaaggacacagagtaccagctgaaccgcatcatcctgtttgaccggctgctgaaggcctacccctacaagaagaaccagatctggaaggaggcccgggtggacatcccccccctgatgaggggcctgacctgggccgccctgctgggcgtggagggcgccatccacgccaagtatgatgccatcgacaaggacacccccatccccacagaccggcagatcgaggtggacatcccccgctgccaccagtatgatgagctgctgagcagccctgagggccacgccaagttcagaagagtgctgaaggcctgggtggtgagccacccagacctggtgtactggcagggcctggacagcctgtgtgcccccttcctgtacctgaacttcaacaatgaggccctggcctatgcctgcatgtctgccttcatccccaagtacctgtacaacttcttcctgaaggacaacagccacgtgatccaggagtacctgactgtgttcagccagatgattgccttccatgaccctgagctgagcaaccacctgaatgaaattggcttcatcccagacctgtatgccatcccctggttcctgaccatgttcacccacgtgttccccctgcacaagatcttccacctgtgggacaccctgctgctgggcaacagcagcttccccttctgcatcggcgtggccatcctgcagcagctgcgggaccggctgctggccaacggcttcaatgaatgcatcctgctcttcagtgacctgcctgagattgacatcgagcgctgtgtgcgggagagcatcaacctcttctgctggacccccaagagcgccacctaccggcagcacgcccagccccccaagcccagcagtgacagcagcggcggccgcagcagcgccccctacttctctgctgagtgcccagacccccccaagacagacctgagccgggagagcatccccctgaatgacctgaagtctgaggtgagcccccgcatctctgctgaggacctgattgacctgtgtgagctgactgtgacaggccacttcaagacccccagcaagaagaccaagagcagcaagcccaagctgctggtggtggacatccggaacagcgaggacttcatccggggccacatcagcggcagcatcaacatccccttctctgctgccttcaccgctgagggggagctgacccagggcccctacacagccatgctgcagaacttcaagggcaaggtgattgtgattgtgggccacgtggccaagcacacagctgagtttgctgcccacctggtgaagatgaagtacccccgcatctgcatcctggatggcggcatcaacaagatcaagcccaccggcctgctgaccatccccagcccccagatctag

SEQ ID NO: 42524 - DNA, 2493 bp, Artificial Sequence
  Description of Artificial Sequence: Synthetic coding sequence
atgttccccctgaaggatgctgagatgggcgccttcaccttctttgccagcgccctgccccatgatgtgtgtggcagcaatggcctgcccctgacccccaacagcatcaagatcctgggccgcttccagatcctgaagaccatcacccacccccggctgtgccagtatgtggacatcagccggggcaagcatgagcggctggtggtggtggccgagcactgtgagaggagcctggaggacctgctgcgggagaggaagcctgtgcgctaccccagctacctggcccctgaggtgattgcccagggcatcttcaagaccacagaccacatgcccagcaagaagcccctgcccagcggccccaagagtgatgtgtggagcctgggcatcatcctgtttgagctgtgtgtgggcaggaagctgttccagagcctggacatcagcgagcggctgaagttcctgctgaccctggactgtgtggatgacaccctcatcgtgctggccgaggagcacggctgcctggacatcatcaaggagctgcctgagaccgtcatcgacctgctgaacaagtgcctgaccttccaccccagcaagaggcccaccccagaccagctgatgaaggacaaggtgttttctgaggtgagccccctgtacacccccttcaccaagccagccagcctcttcagcagcagcctgcgctgtgccgacctgaccctgcctgaggacatcagccagctgtgcaaggacatcaacaatgactacctggccgagaggagcattgaggaggtgtactacctgtggtgcctggccggcggggacctggagaaggagctggtgaacaaggagatcatccgcagcaagccacccatctgcaccctgcccaacttcctgtttgaagatggagagagctttggccagggccgggacaggagcagcctgctggatgacaccaccgtgaccctgagcctgtgccagctgaggaaccggctgaaggatgtgggcggggaggccttctaccccctgctggaggatgaccagagcaacctgccccacagcaacagcaacaatgagctgtctgctgctgccaccctgcccctcatcatccgggagaaggacacagagtaccagctgaaccgcatcatcctgtttgaccggctgctgaaggcctacccctacaagaagaaccagatctggaaggaggcccgggtggacatcccccccctgatgaggggcctgacctgggccgccctgctgggcgtggagggcgccatccacgccaagtatgatgccatcgacaaggacacccccatccccacagaccggcagatcgaggtggacatcccccgctgccaccagtatgatgagctgctgagcagccctgagggccacgccaagttccggcgggtgctgaaggcctgggtggtgagccacccagacctggtgtactggcagggcctggacagcctgtgtgcccccttcctgtacctgaacttcaacaatgaggccctggcctatgcctgcatgtctgccttcatccccaagtacctgtacaacttcttcctgaaggacaacagccacgtgatccaggagtacctgaccgtcttcagccagatgattgccttccatgaccctgagctgagcaaccacctgaatgagatcggcttcatcccagacctgtatgccatcccctggttcctgaccatgttcacccacgtgttccccctgcacaagatcttccacctgtgggacaccctgctgctgggcaacagcagcttccccttctgcattggagtggccatcctgcagcagctgcgggaccggctgctggccaacggcttcaatgaatgcatcctgctcttcagtgacctgcctgagattgatattgagcgctgtgtgcgggagagcatcaacctcttctgctggacccccaagagcgccacctaccggcagcacgcccagccccccaagcccagcagtgacagcagcggcggccgcagcagcgccccctacttcagcgcagaatgtcctgacccccccaagacagacctgagccgggagagcatccccctgaatgacctgaagtctgaggtgagcccccgcatctctgctgaggacctgattgacctgtgtgagctgactgtgacaggccacttcaagacccccagcaagaagaccaagagcagcaagcccaagctgctggtggtggacatcagaaattctgaggacttcatccggggccacatcagcggcagcatcaacatccccttctctgctgccttcaccgctgagggggagctgacccagggcccctacacagccatgctgcagaacttcaagggcaaggtgattgtcatcgtgggccacgtggccaagcacacagctgagtttgctgcccacctggtgaagatgaagtacccccgcatctgcatcctggatggcggcatcaacaagatcaagcccaccggcctgctgaccatccccagcccccagatctag

SEQ ID NO: 42525 - DNA, 2565 bp, Artificial Sequence
  Description of Artificial Sequence: Synthetic coding sequence
atgttccccctgaaggatgctgagatgggcgccttcaccttctttgccagcgccctgccccatgatgtgtgtggcagcaatggcctgcccctgacccccaacagcatcaagatcctgggccgcttccagatcctgaagaccatcacccacccccggctgtgccagtatgtggacatcagccggggcaagcatgagcggctggtggtggtggccgagcactgtgagaggagcctggaggacctgctgcgggagaggaagcctgtgtcctgcagcacagtgctgtgcatcgcctttgaggtgctgcagggcctgcagtacatgaacaagcacggcatcgtgcaccgggccctgagcccccacaacatcctgctggacaggaagggccacatcaagctggccaagtttggcctgtaccacatgacagcccatggagatgatgtggacttccccatcggctaccccagctacctggcccctgagggcaggaagctgttccagagcctggacatcagcgagcggctgaagttcctgctgaccctggactgtgtggatgacaccctcatcgtgctggccgaggagcacggctgcctggacatcatcaaggagctgcctgagaccgtcatcgacctgctgaacaagtgcctgaccttccaccccagcaagaggcccaccccagaccagctgatgaaggacaaggtgttttctgaggtgagccccctgtacacccccttcaccaagccagccagcctcttcagcagcagcctgcgctgtgccgacctgaccctgcctgaggacatcagccagctgtgcaaggacatcaacaatgactacctggccgagaggagcattgaggaggtgtactacctgtggtgcctggccggcggggacctggagaaggagctggtgaacaaggagatcatccgcagcaagccacccatctgcaccctgcccaacttcctgtttgaagatggagagagctttggccagggccgggacaggagcagcctgctggatgacaccaccgtgaccctgagcctgtgccagctgaggaaccggctgaaggatgtgggcggggaggccttctaccccctgctggaggatgaccagagcaacctgccccacagcaacagcaacaatgagctgtctgctgctgccaccctgcccctcatcatccgggagaaggacacagagtaccagctgaaccgcatcatcctgtttgaccggctgctgaaggcctacccctacaagaagaaccagatctggaaggaggcccgggtggacatcccccccctgatgaggggcctgacctgggccgccctgctgggcgtggagggcgccatccacgccaagtatgatgccatcgacaaggacacccccatccccacagaccggcagatcgaggtggacatcccccgctgccaccagtatgatgagctgctgagcagccctgagggccacgccaagttccggcgggtgctgaaggcctgggtggtgagccacccagacctggtgtactggcagggcctggacagcctgtgtgcccccttcctgtacctgaacttcaacaatgaggccctggcctatgcctgcatgtctgccttcatccccaagtacctgtacaacttcttcctgaaggacaacagccacgtgatccaggagtacctgaccgtcttcagccagatgattgccttccatgaccctgagctgagcaaccacctgaatgagatcggcttcatcccagacctgtatgccatcccctggttcctgaccatgttcacccacgtgttccccctgcacaagatcttccacctgtgggacaccctgctgctgggcaacagcagcttccccttctgcattggagtggccatcctgcagcagctgcgggaccggctgctggccaacggcttcaatgaatgcatcctgctcttcagtgacctgcctgagattgatattgagcgctgtgtgcgggagagcatcaacctcttctgctggacccccaagagcgccacctaccggcagcacgcccagccccccaagcccagcagtgacagcagcggcggccgcagcagcgccccctacttcagcgcagaatgtcctgacccccccaagacagacctgagccgggagagcatccccctgaatgacctgaagtctgaggtgagcccccgcatctctgctgaggacctgattgacctgtgtgagctgactgtgacaggccacttcaagacccccagcaagaagaccaagagcagcaagcccaagctgctggtggtggacatcagaaattctgaggacttcatccggggccacatcagcggcagcatcaacatccccttctctgctgccttcaccgctgagggggagctgacccagggcccctacacagccatgctgcagaacttcaagggcaaggtgattgtcatcgtgggccacgtggccaagcacacagctgagtttgctgcccacctggtgaagatgaagtacccccgcatctgcatcctggatggcggcatcaacaagatcaagcccaccggcctgctgaccatccccagcccccagatctag

SEQ ID NO: 42526 - DNA, 2682 bp, Artificial Sequence; identical to SEQ ID NO: 42523
  Description of Artificial Sequence: Synthetic coding sequence

SEQ ID NO: 42527 - DNA, 2682 bp, Artificial Sequence; identical to SEQ ID NO: 42523
  Description of Artificial Sequence: Synthetic coding sequence

SEQ ID NO: 42528 - DNA, 207 bp, Artificial Sequence
  Description of Artificial Sequence: Synthetic coding sequence
atgttccccctgaaggatgctgagatgggcgccttcaccttctttgccagcgccctgccccatgatgtgtgtggcagcaatggcctgcccctgacccccaacagcatcaagatcctgggccgcttccagatcctgaagaccatcacccacccccggctgtgccagtatgtggacatcagccggggcaagcatgagcggctggtgtag

SEQ ID NO: 42529 - DNA, 480 bp, Artificial Sequence
  Description of Artificial Sequence: Synthetic coding sequence
atgttccccctgaaggatgctgagatgggcgccttcaccttctttgccagcgccctgccccatgatgtgtgtggcagcaatggcctgcccctgacccccaacagcatcaagatcctgggccgcttccagatcctgaagaccatcacccacccccggctgtgccagtatgtggacatcagccggggcaagcatgagcggctggtggtggtggccgagcactgtgagaggagcctggaggacctgctgcgggagaggaagcctgtgtcctgcagcacagtgctgtgcatcgcctttgaggtgctgcagggcctgcagtacatgaacaagcacggcatcgtgcaccgggccctgagcccccacaacatcctgctggacaggaagggccacatcaagctggccaagtttggcctgtaccacatgacagcccatggagatgatgtggacttccccatcggctaccccagctacctggccccctag

SEQ ID NO: 42530 - DNA, 318 bp, Artificial Sequence
  Description of Artificial Sequence: Synthetic coding sequence
atgttccccctgaaggatgctgagatgggcgccttcaccttctttgccagcgccctgccccatgatgtgtgtggcagcaatggcctgcccctgacccccaacagcatcaagatcctgggccgcttccagatcctgaagaccatcacccacccccggctgtgccagtatgtggacatcagccggggcaagcatgagcggctggtggtggtggccgagcactgtgagaggagcctggaggacctgctgcgggagaggaagcctgtgtcctgcagcacagtgctgtgcatcgcctttgaggtgctgcagggcctgcagtag

SEQ ID NO: 42531 - DNA, 753 bp, Artificial Sequence
  Description of Artificial Sequence: Synthetic coding sequence
atggagatggatggagacccctacaacctgcctgcccagggccagggcaacatcatcatcaccaagtatgagcagggccacagagctggagctgctgtggacctgggccacgagcaggtggatgtgaggaagtacaccaacaacctgggcatcgtgcatgagatggagctgccccacgtgtctgccctggaggtgaagcagaggaggaaggagagcaagaggaccaacaagtggcagaagatgctggccgactggaccaagtaccgcagcaccaagaagctgagccagagggtgtacaaggtgatccccctggccgtgcggggccgggcctggagcctgctgctggacatcgaccgcatcaagagccagaaccctgggaagtacaaggtgatgaaggagaagggcaagaggagcagccgcatcatccactgcatccagctggatgtgagccacaccctgcagaagcacatgatgttcatccagagatttggagtgaagcagcaggagctgtgtgacatcctggtggcctacagcgcctacaaccctgaggtgggctaccaccgggacctgagccgcatcacagccatcctgctgctgtgcctgcctgaggaggatgccttctgggccctgacccagctgctggccggggagcggcacagcctgtggtacagcacagcccagatcctgcccggcagccggggcagctaccgcaccaggagccgctgctgcaccagccccagccagaggagctag

SEQ ID NO: 42532 - DNA, 453 bp, Artificial Sequence
  Description of Artificial Sequence: Synthetic coding sequence
atgggccacctggacaaggagggcctgtgcacccagggcagcagcttctcctggctgctgcgggtgctgaatgatggcatcagcctgggcctgaccccctgcctgtgggacatgtacctgctggagggggagcagatgctgatgctgatcaccagcatcgccttcaaggtgcagaggagcctgtatgaggagaccaacaaggagacctggggccctgccaccccccgggccctgaagggcaccggccgggcccggcccatctgtgagagcctgcacagcagcctgcaggccctgacagccagcgagagcagccggggccccagcctgctgcagaccccaccccgggtgcccggccagcaggccctgagcagaggagacaagggcatctctgtgtccctgagcctgcccagcctgcccagcagaagaggccgctgtggccgcatcattggatag

SEQ ID NO: 42533 - DNA, 2286 bp, Artificial Sequence
  Description of Artificial Sequence: Synthetic coding sequence
atgaggcaggacaagctgaccggcagcctgcggcggggcggccgctgcctgaagaggcagggcggcggcgtgggcaccatcctgagcaatgtgctgaagaagaggagctgcatcagcaggacagccccccggctgctgtgcaccctggagcccggggtggacaccaagctgaagttcaccctggagcccagcctgggccagaatggcttccagcagtggtatgatgccctgaaggctgtggcccggctgagcacaggcatccccaaggagtggaggaggaaggtgtggctgaccctggccgaccactacctgcacagcatcgccatcgactgggacaagaccatgaggttcaccttcaatgaaagaagcaacccagatgatgacagcatgggcatccagatcgtgaaggacctgcacaggacaggctgcagcagctactgcggccaggaggccgagcaggacagagtggtgctgaagagggtgctgctggcctatgcccgctggaacaagacagtgggctactgccagggcttcaacatcctggccgccctgatcctggaggtgatggagggcaatgaaggagatgccctgaagatcatgatctacctgattgacaaggtgctgcctgagagctactttgtgaacaacctgcgggccctgtctgtggacatggctgtgttccgggacctgctgaggatgaagctgcctgagctgagccagcacctggacaccctgcagaggacagccaacaaggagagcggcggcggctatgagccccccctgaccaacgtgttcaccatgcagtggttcctgaccctgtttgccacctgcctgcccaaccagacagtgctgaagatctgggacagcgtcttctttgagggcagcgagatcatcctgcgggtgtccctggccatctgggccaagctgggggagcagatcgagtgctgtgaaacagcagatgagttctacagcaccatgggccgcctgacccaggagatgctggagaatgacctgctgcagagccatgagctgatgcagacagtgtacagcatggcccccttccccttcccccagctggccgagctgcgggagaagtacacctacaacatcacccccttccctgccaccgtgaagcccacctctgtgtctggccgccacagcaaggcccgggacagtgatgaagaaaatgaccctgatgatgaagatgctgtggtgaatgctgtgggctgcctgggccccttcagcggcttcctggcccctgagctgcagaagtaccagaagcagatcaaggagcccaatgaggagcagagcctgcggagcaacaacattgctgagctgagccctggggccatcaacagctgccgctctgagtaccacgccgccttcaacagcatgatgatggagaggatgaccacagacatcaatgccctgaagaggcagtacagccgcatcaagaagaagcagcagcagcaggtgcaccaggtgtacatccgggctgacaagggccctgtgaccagcatcctgcccagccaggtgaacagcagccctgtgatcaaccacctgctgctgggcaagaagatgaagatgaccaacagagctgccaagaatgctgtgatccacatccctggccacactggaggcaagatcagccctgtgccctatgaggacctgaagaccaagctgaacagcccctggaggacccacatccgggtgcacaagaagaacatgcccaggaccaagagccaccctggctgtggggacacagtgggcctgattgatgagcagaatgaggccagcaagaccaacggcctgggcgctgctgaggccttccccagcggctgcacagccacagctggccgggagggcagcagccctgagggcagcaccaggaggaccatcgagggccagagccctgagcctgtgtttggagatgctgatgtggatgtgtctgctgtgcaggccaagctgggcgccctggagctgaaccagagagatgctgctgctgagacagagctgcgggtgcaccccccctgccagaggcactgcccagagcccccatctgcccctgaggagaacaaggccaccagcaaggccccccagggcagcaacagcaagacccccatcttcagccccttccccagcgtgaagcccctgaggaagagcgccacagccaggaacctgggcctgtatggccccacagagaggacccccaccgtgcacttcccccagatgagccgctccttcagcaagccaggcggcggcaacagcggcaccaagaagaggtag

SEQ ID NO: 42534 - DNA, 2454 bp, Artificial Sequence
  Description of Artificial Sequence: Synthetic coding sequence
atgtaccacagcctgtctgagaccaggcaccccctgcagcctgaggagcaggaggtgggcatcgaccccctgagcagctacagcaacaagtctggaggagacagcaacaagaatggccgccgcaccagcagcaccctggacagcgagggcaccttcaacagctacaggaaggagtgggaggagctgtttgtgaacaacaactacctggccaccatccggcagaagggcatcaatggccagctgcggagcagccgcttccgcagcatctgctggaagctgttcctgtgtgtgctgccccaggacaagagccagtggatcagcagaattgaggagctgcgggcctggtacagcaacatcaaggagatccacatcaccaaccccaggaaggtggtgggccagcaggacctgatgatcaacaaccccctgagccaggatgagggcagcctgtggaacaagttcttccaggacaaggagctgcgctccatgattgagcaggatgtgaagaggaccttccctgagatgcagttcttccagcaggagaatgtgaggaagatcctgacagatgtgctcttctgctacgcccgggagaatgagcagctgctgtacaagcagggcatgcatgagctgctggcccccatcgtgtttgtgctgcactgtgaccaccaggccttcctgcacgccagcgagagcgcccagcccagcgaggagatgaagacagtgctgaaccctgagtacctggagcatgatgcctatgctgtgttcagccagctgatggagacagctgagccctggttcagcacctttgaacatgatggccagaagggcaaggagaccctgatgacccccatcccctttgcccggccccaggacctgggccccaccatcgccatcgtgaccaaggtgaaccagatccaggaccacctgctgaagaagcatgacatcgagctgtacatgcacctgaaccggctggagatcgccccccagatctacggcctgcgctgggtgcggctgctgtttggccgggagttccccctgcaggacctgctggtggtgtgggatgccctgtttgctgatggcctgagcctgggcctggtggactacatctttgtggccatgctgctgtacatcagagatgccctgatcagcagcaactaccagacctgcctgggcctgctgatgcactaccccttcatcggagatgtgcacagcctcatcctgaaggccctcttcctgcgggaccccaagaggaaccccaggcctgtgacctaccagttccaccccaacctggactactacaaggcccggggagctgacctgatgaacaagagcaggaccaatgccaagggggcccccctgaacatcaacaaggtgagcaacagcctcatcaactttggaaggaagctgatcagccctgccatggcccctggcagcgctgggggccctgtgcctgggggcaacagcagcagcagcagctctgtggtgatccccaccaggaccagcgctgaggcccccagccaccacctgcagcagcagcagcagcagcagaggctgatgaagtctgagagcatgcctgtgcagctgaacaagggagatgtggtgacaggcagtgatgcccaggtgtctgtgcctgtgcagaccctgacagacctgcagggcctgagcagcaagaacatcagcagcagccccagcgtggagagcctgcccggcggccgggagttcaccggcagcccccccagcagcgccaccaagaaggacagcttcttcagcaacatcagccgcagccgcagccacagcaagaccatgggcaggaaggagagcgaggaggagctggaggcccagatctccttcctgcagggccagctgaatgacctggatgccatgtgcaagtactgtgccaaggtgatggacacccacctggtgaacatccaggacgtcatcctgcaggagaacctggagaaggaggaccagatcctggtgtccctggccggcctgaagcagatcaaggacatcctgaagggcagcctgcgcttcaaccagagccagctggaggccgaggagaatgagcagatcaccatcgctgacaaccactactgcagcagcggccagggccagggccggggccagggccagagcgtgcagatgtctggggccatcaagcaggccagcagcgagaccccaggctgcacagaccggggcaacagtgatgacttcatcctgatcagcaaggatgatgatggcagcagcgcccggggcagcttcagcggccaggcccagcccctgcggaccctgcggagcaccagcggcaagagccaggcccctgtgtgcagccccctggtgttcagtgaccccctgatgggccctgccagcgccagcagcagcaaccccagcagcagcccagatgatgacagcagcaaggacagcggcttcaccatcgtgagccccctggacatctag

SEQ ID NO: 42535 - DNA, 624 bp, Artificial Sequence
  Description of Artificial Sequence: Synthetic coding sequence
atgctggccctgcgctgtggcagccgctggctgggcctgctgtctgtgcccaggtctgtgcccctgcggctgcctgctgcccgggcctgcagcaagggcagcggggaccccagcagcagcagcagcagcggcaaccccctggtgtacctggatgtggatgccaacgggaagcccctgggccgggtggtgctggagctgaaggcagatgtggtgcccaagacagctgagaacttccgggccctgtgcacaggagagaagggcttcggctacaagggcagcaccttccacagggtcatccccagcttcatgtgccaggccggggacttcaccaaccacaatggaactggaggcaagagcatctacggcagccgcttcccagatgagaacttcaccctgaagcacgtgggccctggggtgctgtccatggccaatgccggccccaacaccaacggcagccagttcttcatctgcaccatcaagacagactggctggatggcaagcacgtggtgtttggacatgtgaaggagggcatggatgtggtgaagaagattgagagctttggcagcaagagcggccgcaccagcaagaagatcgtcatcacagactgtggccagctgtcctag

SEQ ID NO: 42536 - DNA, 444 bp, Artificial Sequence
  Description of Artificial Sequence: Synthetic coding sequence
atgggcttcatcttcagcaagtccatgaatgaatccatgaagaaccagaaggagttcatgctgatgaatgcccggctgcagctggagcggcagctgatcatgcagagcgagatgagggagcggcagatggccatgcagatcgcctggagccgggagttcctgaagtacttcggcaccttcttcggcctggccgccatcagcctgacagctggggccatcaagaagaagaagccagccttcctggtgcccatcgtgcccctgtccttcatcctgacctaccagtatgacctgggctacggcaccctgctggagaggatgaagggggaggccgaggacatcctggagacagagaagagcaagctgcagctgccccggggcatgatcacctttgagagcattgagaaggccaggaaggagcagagccgcttcttcatcgacaagtag

SEQ ID NO: 42537 - DNA, 1203 bp, Artificial Sequence
  Description of Artificial Sequence: Synthetic coding sequence
atgagcagcctgcacaagagcagaattgctgacttccaggatgtgctgaaggagcccagcatcgccctggagaagctgcgggagctgtccttcagcggcatcccctgtgagggcggcctgcgctgcctgtgctggaagatcctgctgaactacctgcccctggagcgggcctcctggaccagcatcctggccaagcagcgggagctgtatgcccagttcctgcgggagatgatcatccagcccggcatcgccaaggccaacatgggcgtgtccagagaagatgtgacctttgaggaccaccccctgaaccccaacccagacagccgctggaacacctacttcaaggacaatgaggtgctgctgcagattgacaaggatgtgcggcggctgtgcccagacatctccttcttccagagggccacagactacccctgcctgctgatcctggacccccagaatgaatttgagaccctgaggaagagggtggagcagaccaccctgaagagccagacagtggccaggaacagaagtggagtgaccaacatgagcagcccccacaagaacagcgtgcccagcagcctgaatgaatatgaggtgctgcccaacggctgtgaggcccactgggaggtggtggagcgcatcctcttcatctatgccaagctgaaccctggcatcgcctacgtgcagggcatgaatgagatcgtgggccccctgtactacacctttgccacagaccccaacagcgagtggaaggagcacgccgaggccgacaccttcttctgcttcaccaacctgatggccgagatccgggacaacttcatcaagagcctggatgacagccagtgtggcatcacctacaagatggagaaggtgtacagcaccctgaaggacaaggatgtggagctgtacctgaagctgcaggagcagaacatcaagccccagttctttgccttccgctggctgaccctgctgctgagccaggagttcctgctgcctgatgtgatccgcatctgggacagcctgtttgctgatgacaacagatttgacttcctgctgctggtgtgctgtgccatgctgatgctgatccgggagcagctgctggagggggacttcaccgtgaacatgaggctgctgcaggactaccccatcacagatgtgtgccagatcctgcagaaggccaaggagctgcaggacagcaagtag

SEQ ID NO: 42538 - DNA, 660 bp, Artificial Sequence
  Description of Artificial Sequence: Synthetic coding sequence
atgagcagcccccacaagaacagcgtgcccagcagcctgaatgaatatgaggtgctgcccaacggctgtgaggcccactgggaggtggtggagcgcatcctcttcatctatgccaagctgaaccctggcatcgcctacgtgcagggcatgaatgaaattgtgggccccctgtactacacctttgccacagaccccaacagcgagtggaaggagcacgccgaggccgacaccttcttctgcttcaccaacctgatggccgagatccgggacaacttcatcaagagcctggatgacagccagtgtggcatcacctacaagatggagaaggtgtacagcaccctgaaggacaaggatgtggagctgtacctgaagctgcaggagcagaacatcaagccccagttctttgccttccgctggctgaccctgctgctgagccaggagttcctgctgcctgatgtgatccgcatctgggacagcctgtttgctgatgacaacagatttgacttcctgctgctggtgtgctgtgccatgctgatgctgatccgggagcagctgctggagggggacttcaccgtgaacatgaggctgctgcaggactaccccatcacagatgtgtgccagatcctgcagaaggccaaggagctgcaggacagcaagtag

SEQ ID NO: 42539 - DNA, 2082 bp, Artificial Sequence
  Description of Artificial Sequence: Synthetic coding sequence
atgacagatggcaagctgagcaccagcaccaatggagtggccttcatgggcatcctggatggccggcccggcaaccccctgcagaacctgcagcacgtgaacctgaaggccccccggctgctgagcgccccagaatatggccccaagctgaagctgcgggccctggaggacagacacagcctgcagagcgtggacagcggcatccccaccctggagatcggcaaccctgagcctgtgccctgcagcgctgtgcacgtgcggaggaagcagagcgacagcgacctgatccctgagcgggccttccagagcgcctgtgccctgcccagctgtgcccccccagcccccagcagcacagagcgggagcagagcgtgaggaagagcagcaccttccccaggacaggctatgattctgtgaagctgtacagccccaccagcaaggccctgaccaggagtgatgatgtgtctgtgtgcagcgtgagcagcctgggcacagagctgagcaccaccctgtctgtgtccaatgaagacatcctggacctggtggtgaccagcagcagcagcgccatcgtgaccctggagaatgatgatgacccccagttcaccaacgtgaccctgagcagcatcaaggagacccggggcctgcaccagcaggactgtgtgcatgaagctgaggagggcagcaagctgaagatcctgggccccttcagcaacttctttgccaggaacctgctggccaggaagcagagcgcccggctggacaagcacaatgacctgggctggaagctgtttgggaaggcccccctgcgggagaatgcccagaaggacagcaagaggatccagaaggagtatgaggacaaggccggccggcccagcaagccacccagccccaagcagaatgtgaggaagaacctggactttgagcccctgagcaccacagccctgatcctggaggacaggcctgccaacctgcctgccaagccagctgaggaggcccagaagcaccggcagcagtatgaggagatggtggtgcaggccaagaagcgggagctgaaggaggcccagaggaggaagaagcagctggaggagcgctgccgggtggaggagagcattggaaatgctgtgctgacctggaacaatgagatcctgcccaactgggagaccatgtggtgcagcaggaaggtgcgggacctgtggtggcagggcatccccccatctgtgcggggcaaggtgtggagcctggccatcggaaatgagctgaacatcacccatgagctgtttgacatctgcctggcccgggccaaggagcgctggaggagcctgagcactggaggcagcgaggtggagaatgaagatgctggcttctctgctgctgaccgggaggccagcctggagctgatcaagctggacatcagcaggaccttccccaacctgtgcatcttccagcagggcggcccctaccatgacatgctgcacagcatcctgggcgcctacacctgctacagaccagatgtgggctacgtgcagggcatgtccttcatcgctgctgtgctgatcctgaacctggacacagcagatgccttcatcgccttcagcaacctgctgaacaagccctgccagatggccttcttccgggtggaccacggcctgatgctgacctactttgctgcctttgaggtgttctttgaggagaacctgcccaagctgtttgcccacttcaagaagaacaacctgaccccagacatctacctgattgactggatcttcaccctgtacagcaagagcctgcccctggacctggcctgccgcatctgggatgtgttctgcagagatggagaggagttcctgttcagaacagccctgggcatcctgaagctgtttgaggacatcctgaccaagatggacttcatccacatggcccagttcctgacccggctgcctgaggacctgcctgctgaggagctgtttgccagcatcgccaccatccagatgcagagcaggaacaagaagtgggcccaggtgctgacagccctgcagaaggacagccgggagatggagaagggcagccccagcctgcggcactag

SEQ ID NO: 42540 - DNA, 171 bp, Artificial Sequence
  Description of Artificial Sequence: Synthetic coding sequence
atgacagatggcaagctgagcaccagcaccaatggagtggccttcatgggcatcctggatggccggcccggcaaccccctgcagaacctgcagcacgtgaacctgaaggccccccggctgctgagcgccccagaatatggccccaagctgaagctgcgggccctggagtag

SEQ ID NO: 42541 - DNA, 384 bp, Artificial Sequence
  Description of Artificial Sequence: Synthetic coding sequence
atgacagatggcaagctgagcaccagcaccaatggagtggccttcatgggcatcctggatggccggcccggcaaccccctgcagaacctgcagcacgtgaacctgaaggccccccggctgctgagcgccccagaatatggccccaagctgaagctgcgggccctggaggacagacacagcctgcagagcgtggacagcggcatccccaccctggagatcggcaaccctgagcctgtgccctgcagcgctgtgcacgtgcggaggaagcagagcgacagcgacctgatccctgagcgggccttccagagcgcctgtgccctgcccagctgtgcccccccagcccccagcagcacagagcgggagcagagcgtgaggaagagctag

SEQ ID NO: 42542 - DNA, 1023 bp, Artificial Sequence
  Description of Artificial Sequence: Synthetic coding sequence
atgtggtgcagcaggaaggtgcgggacctgtggtggcagggcatcccccccagcgtgcggggcaaggtgtggagcctggccatcggaaatgagctgaacatcacccatgagctgtttgacatctgcctggcccgggccaaggagcgctggaggagcctgagcactggaggcagcgaggtggagaatgaagatgctggcttctctgctgctgaccgggaggccagcctggagctgatcaagctggacatcagcaggaccttccccaacctgtgcatcttccagcaggtgctgatctttgtggacttccgggtgggcctgcagaagagcttccagaagaggaaggagcgggagagcaccaagctgcagcagctgtggagctggtgcctgggcggcccctaccatgacatgctgcacagcatcctgggcgcctacacctgctacagaccagatgtgggctacgtgcagggcatgtccttcatcgctgctgtgctgatcctgaacctggacacagcagatgccttcatcgccttcagcaacctgctgaacaagccctgccagatggccttcttccgggtggaccacggcctgatgctgacctactttgctgcctttgaggtgttctttgaggagaacctgcccaagctgtttgcccacttcaagaagaacaacctgaccccagacatctacctgattgactggatcttcaccctgtacagcaagagcctgcccctggacctggcctgccgcatctgggatgtgttctgcagagatggagaggagttcctgttcagaacagccctgggcatcctgaagctgtttgaggacatcctgaccaagatggacttcatccacatggcccagttcctgacccggctgcctgaggacctgcctgctgaggagctgtttgccagcatcgccaccatccagatgcagagcaggaacaagaagtgggcccaggtgctgacagccctgcagaaggacagccgggagatggagaagggcagccccagcctgcggcactag

SEQ ID NO: 42543 - DNA, 2082 bp, Artificial Sequence; identical to SEQ ID NO: 42539
  Description of Artificial Sequence: Synthetic coding sequence

SEQ ID NO: 42544 - DNA, 1242 bp, Artificial Sequence
  Description of Artificial Sequence: Synthetic coding sequence
atggagtatgaggacaaggccggccggcccagcaagccacccagccccaagcagaatgtgaggaagaacctggactttgagcccctgagcaccacagccctgatcctggaggacaggcctgccaacctgcctgccaagccagctgaggaggcccagaagcaccggcagcagtatgaggagatggtggtgcaggccaagaagcgggagctgaaggaggcccagaggaggaagaagcagctggaggagcgctgccgggtggaggagagcattggaaatgctgtgctgacctggaacaatgagatcctgcccaactgggagaccatgtggtgcagcaggaaggtgcgggacctgtggtggcagggcatccccccatctgtgcggggcaaggtgtggagcctggccatcggaaatgagctgaacatcacccatgagctgtttgacatctgcctggcccgggccaaggagcgctggaggagcctgagcactggaggcagcgaggtggagaatgaagatgctggcttctctgctgctgaccgggaggccagcctggagctgatcaagctggacatcagcaggaccttccccaacctgtgcatcttccagcagggcggcccctaccatgacatgctgcacagcatcctgggcgcctacacctgctacagaccagatgtgggctacgtgcagggcatgtccttcatcgctgctgtgctgatcctgaacctggacacagcagatgccttcatcgccttcagcaacctgctgaacaagccctgccagatggccttcttccgggtggaccacggcctgatgctgacctactttgctgcctttgaggtgttctttgaggagaacctgcccaagctgtttgcccacttcaagaagaacaacctgaccccagacatctacctgattgactggatcttcaccctgtacagcaagagcctgcccctggacctggcctgccgcatctgggatgtgttctgcagagatggagaggagttcctgttcagaacagccctgggcatcctgaagctgtttgaggacatcctgaccaagatggacttcatccacatggcccagttcctgacccggctgcctgaggacctgcctgctgaggagctgtttgccagcatcgccaccatccagatgcagagcaggaacaagaagtgggcccaggtgctgacagccctgcagaaggacagccgggagatggagaagggcagccccagcctgcggcactag

SEQ ID NO: 42545 - DNA, 2304 bp, Artificial Sequence
  Description of Artificial Sequence: Synthetic coding sequence
atgagcctgggccgcctgctgcggcgggccagcagcaaggccagtgacctgctgaccctgacccctgggggcagcggcagcggcagccccagcgtgctggatggagagatcatctacagcaagaacaacgtgtgtgtgcaccccccagagggcctgcagggcctgggggagcaccaccctggctacctgtgcctgtacatggagaaggatgagatgctgggcgccaccctcatcctggcctgggtgcccaacagccgcatccagaggcaggatgaggaggccctgcgctacatcaccccagagagcagccctgtgaggaaggccccccggccccggggccgccgcaccaggagcagcggggccagccaccagcccagccccacagagctgcggcccaccctgacccccaaggatgaggacatcctggtggtggcccagagcgtgcctgacaggatgctggccagccctgccccagaagatgaggagaagctggcccagggcctgggcgtggatggagcccagcctgccagccagcctgcctgcagccccagcggcatcctgagcacagtgagcccccaggatgtgacagaggagggccgggagcccaggcctgaggccggggaggaggatggcagcctggagctgtctgctgagggcgtgtcccgggacagcagctttgacagcgacagcgacaccttcagcagccccttctgcctgagccccatctctgctgccctggccgagagccggggcagcgtcttcctggagagtgacagcagcccccccagcagcagtgatgctggcctgcgcttcccagacagcaatggcctgctgcagaccccccgctgggatgagccccagagggtgtgtgccctggagcagatctgtggggtcttccgggtggacctgggccacatgaggagcctgcggctcttcttcagtgatgaggcctgcaccagcggccagctggtggtggccagccgggagagccagtacaaggtgttccacttccaccacggcggcctggacaagctgagtgatgtgttccagcagtggaagtactgcacagagatgcagctgaaggaccagcaggtggccccagacaagacctgcatgcagttcagcatcagaagacccaagctgcccagcagcgagacccaccctgaggagagcatgtacaagaggctgggcgtgtctgcctggctgaaccacctgaatgagctgggccaggtggaggaggagtacaagctgaggaaggccatcttctttggaggcattgatgtgtccatccggggggaggtgtggcccttcctgctgcgctactacagccatgagagcaccagcgaggagcgggaggccctgcggctgcagaagaggaaggagtacagcgagatccagcagaagaggctgtccatgaccccagaggagcaccgggccttctggagaaatgtgcagttcaccgtggacaaggatgtggtgaggacagacaggaacaaccagttcttcagaggagaggacaaccccaacgtggagagcatgaggcgcatcctgctgaactatgctgtgtacaacccagctgtgggctacagccagggcatgtctgacctggtggcccccatcctggccgaggtgctggatgaaagtgacaccttctggtgctttgtgggcctgatgcagaacaccatctttgtgagcagccccagagatgaggacatggagaagcagctgctgtacctgcgggagctgctgcggctgacccacgtgcgcttctaccagcacctggtgtccctgggagaagatggcctgcagatgctgttctgccaccgctggctgctgctgtgcttcaagcgggagttccctgaggccgaggccctgcgcatctgggaggcctgctgggcccactaccagacagactacttccacctgttcatctgtgtggccatcgtggccatctatggagatgatgtgattgagcagcagctggccacagaccagatgctgctgcacttcggcaacctggccatgcacatgaatggagagctggtgctgaggaaggcccggagcctgctgtaccagttccggctgctgccccgcatcccctgcagcctgcatgacctgtgcaagctgtgtggcagcggcatgtgggacagcggctccatgcctgctgtggagtgcaccggccaccaccctggcagcgagagctgcccctatggaggcaccgtggagatgcccagccccaagagcctgcgggagggcaagaagggccccaagaccccccaggacggcttcggcttcagaagatag

SEQ ID NO: 42546 - DNA, 1218 bp, Artificial Sequence
  Description of Artificial Sequence: Synthetic coding sequence
atgaaggtggccccagacaagacctgcatgcagttcagcatcagaagacccaagctgcccagcagcgagacccaccctgaggagagcatgtacaagaggctgggcgtgtctgcctggctgaaccacctgaatgagctgggccaggtggaggaggagtacaagctgaggaaggccatcttctttggaggcattgatgtgtccatccggggggaggtgtggcccttcctgctgcgctactacagccatgagagcaccagcgaggagcgggaggccctgcggctgcagaagaggaaggagtacagcgagatccagcagaagaggctgtccatgaccccagaggagcaccgggccttctggagaaatgtgcagttcaccgtggacaaggatgtggtgaggacagacaggaacaaccagttcttcagaggagaggacaaccccaacgtggagagcatgaggcgcatcctgctgaactatgctgtgtacaacccagctgtgggctacagccagggcatgtctgacctggtggcccccatcctggccgaggtgctggatgaaagtgacaccttctggtgctttgtgggcctgatgcagaacaccatctttgtgagcagccccagagatgaggacatggagaagcagctgctgtacctgcgggagctgctgcggctgacccacgtgcgcttctaccagcacctggtgtccctgggagaagatggcctgcagatgctgttctgccaccgctggctgctgctgtgcttcaagcgggagttccctgaggccgaggccctgcgcatctgggaggcctgctgggcccactaccagacagactacttccacctgttcatctgtgtggccatcgtggccatctatggagatgatgtgattgagcagcagctggccacagaccagatgctgctgcacttcggcaacctggccatgcacatgaatggagagctggtgctgaggaaggcccggagcctgctgtaccagttccggctgctgccccgcatcccctgcagcctgcatgacctgtgcaagctgtgtggcagcggcatgtgggacagcggctccatgcctgctgtggagtgcaccggccaccaccctggcagcgagagctgcccctatggaggcaccgtggagatgcccagccccaagagcctgcgggagggcaagaagggccccaagaccccccaggacggcttcggcttcagaagatag

SEQ ID NO: 42547 - DNA, 2154 bp, Artificial Sequence
  Description of Artificial Sequence: Synthetic coding sequence
atgggagacctgcccccctacccagagaggcctgcccagcagcccccaggccgccgcaccagccaggccagccagaggaggcacagccgggaccaggcccaggccctggccgctgaccctgaggagcggcagcagatccccccagatgcccagagaaatgcccctggctggagccagaggggcagcctgagccagcaggagaacctgctgatgccccaggtgttccaggccgaggaggcccggctgggcggcatggagtaccccagcgtgaacacaggcttccccagcgagttccagccccagccctacagtgatgagagcaggatgcaggtggccgagctgaccaccagcctgatgctgcagaggctgcagcagggccagagcagcctcttccagcagctggaccccaccttccaggagccccctgtgaaccccctgggccagttcaacctgtaccagacagaccagttcagcgagggcgcccagcacggcccctacatcagagatgatcctgccctgcagttcctgcccagcgagctgggcttcccccactacagcgcccaggtgcctgagcctgagcccctggagctggccgtgcagaatgccaaggcctacctgctgcagaccagcatcaactgtgacctgagcctgtatgagcacctggtgaacctgctgaccaagatcctgaaccagaggcctgaggaccccctgtctgtgctggagagcctgaacagaaccacccagtgggagtggttccaccccaagctggacaccctgagagatgatcctgagatgcagcccacctacaagatggccgagaagcagaaggccctcttcaccaggtctgggggcggcacagaaggagagcaggagatggaggaggaggtgggggagacccctgtgcccaacatcatggagacagccttctactttgagcaggccggcgtgggcctgagcagtgatgagagcttccgcatcttcctggccatgaagcagctggtggagcagcagcccatccacacctgccgcttctggggcaagatcctgggcatcaagaggagctacctggtggccgaggtggagttccgggagggggaggaggaggccgaggaggaggaggtggaggagatgacagagggcggggaggtgatggaggcccatggagaggaggagggggaggaggatgaggagaaggctgtggacatcgtgcccaagtctgtgtggaagcccccacctgtgatccccaaggaggagagccgcagcggggccaacaagtacctgtactttgtgtgcaatgagcccggcctgccctggacccggctgccccacgtgaccccagcccagatcgtgaatgccaggaagatcaagaagttcttcaccggctacctggacacccctgtggtgtcctacccacccttccctggaaatgaggccaactacctgcgggcccagatcgcccgcatctctgctgccacccaggtgagccccctgggcttctaccagttcagcgaggaggagggagatgaggaggaggagggcggggccggccgggacagctatgaggagaacccagactttgagggcatccctgtgctggagctggtggacagcatggccaactgggtgcaccacacccagcacatcctgccccagggccgctgcacctgggtgaaccccctgcagaagacagaggaggaggaggacctgggggaggaggaggagaaggcagatgagggccctgaggaggtggagcaggaggtgggcccccccctgctgacccccctgtctgaagatgctgagatcatgcacctggccccctggaccacccggctgagctgcagcctgtgcccccagtacagcgtggccgtggtgcgcagcaacctgtggccaggggcctatgcctatgccagcggcaagaagtttgagaacatctacatcggctggggccacaagtacagccctgagagcttcaacccagccctgcctgcccccatccagcaggagtaccccagcggccctgagatcatggagatgtctgaccccaccgtggaggaggagcaggccctgaaggccgcccaggagcaggccctgggcgccacagaggaggaggaggagggggaggaggaggaggagggggaggagacagatgactag

SEQ ID NO: 42548 - DNA, 1848 bp, Artificial Sequence
  Description of Artificial Sequence: Synthetic coding sequence
atggagggcgccggctacagagacaatgatgtgctgctgcactgggcccctgtggaggaggccggggacagcacccagatcctcttcagcaagaaggacagcagtggaggagacagctgtgccagcgaggaggagcccacctttgatcctgactatgagccagactgggccgtcatcagcacagtgcggccccagctgtgccacagcgagcccaccagaggagctgagcccagctgcccccagggctcctgggccttctctgtgtccctgggggagctgaagagcatcagaagaagcaagccaggcctgtcctgggcctacctggtgctggtgacccaggccggcggcagcctgcctgccctgcacttccaccggggcggcacccgggccctgctgcgggtgctgagccgctacctgctgctggccagcagcccccaggacagccggctgtacctggtgttcccccatgacagcagcgccctgagcaacagcttccaccacctgcagctgtttgaccaggacagcagcaatgtggtgagccgcttcctgcaggacccctacagcaccaccttcagcagcttcagccgggtgaccaacttcttccggggggccctgcagccccagcctgagggcgccgccagtgacctgcccccacctccagatgatgagcctgagcccggctttgaggtgatcagctgtgtggagctgggcccccggcccaccgtggagcggggcccccctgtgacagaggaggagtgggcccggcacgtgggccctgagggccgcctgcagcaggtgcctgagctgaagaaccgcatcttcagcggcggcctgagccccagcctgcggcgggaggcctggaagttcctgctgggctacctgtcctgggagggcacagctgaggagcacaaggcccacatcaggaagaagacagatgagtacttcaggatgaagctgcagtggaagtctgtgtccccagagcaggagaggaggaacagcctgctgcacggctaccgcagcctcatcgagagagatgtgtccaggacagacaggaccaacaagttctatgagggccctgagaaccctggcctgggcctgctgaatgacatcctgctgacctactgcatgtaccactttgacctgggctacgtgcagggcatgtctgacctgctgagccccatcctgtatgtgatccagaatgaggtggatgccttctggtgcttctgtggcttcatggagctggtgcagggcaactttgaggagagccaggagaccatgaagaggcagctgggccgcctgctgctgctgctgcgggtgctggaccccctgctgtgtgacttcctggacagccaggacagcggcagcctgtgcttctgcttccgctggctgctgatctggttcaagcgggagttccccttcccagatgtgctgcggctgtgggaggtgctgtggacaggcctgcccggccccaacctgcacctgctggtggcctgtgccatcctggacatggagcgggacaccctgatgctgagcggcttcggcagcaatgagatcctgaagcacatcaatgagctgaccatgaagctgtctgtggaggatgtgctgaccagggctgaggccctgcaccggcagctgacagcctgcccagagctgccccacaacgtgcaggagatcctgggcctggcccctcctgctgagccccacagccccagccccacagccagccccctgcccctgagccccacccgggccccacccaccccaccacccagcacagacacagccccccagcctgacagcagcctggagatcctgcctgaggaggaggatgagggcgctgacagctag

SEQ ID NO: 42549 - DNA, 1581 bp, Artificial Sequence
  Description of Artificial Sequence: Synthetic coding sequence
atgctgcaggaggagagtgacctgagcctcatcatcgcccagatcgtgcagaagctgaagggcagcaacctgtacagccagctggagcggcaggcctgggccagcctgcagaggcctgagatcaagctggagagcctgaaggaggacatcaaggagttcttcaagatcagcggctgggagaagaagctgcagaatgctgtgtacagcgagctgagcgtcttccccctgcccagccaccctgctgcccctcctgagcacctgaaggagcccctggtgtacatgaggaaggcccagggctcctgggagaagaggatcctgaagagcctgaacagcatgtgcacagagctgagcatccccctggccaggaagaggcctgtgggggagcagaaggagctgctgaacaagtggaatgagatgggcacagatgagccagacctgagcctcttccggcctgtgtatgcccccaaggacttcctggaggtgctgatcaacctgaggaaccccaactatgaaaatggagacagcctgtccttccgcacccacctgggcctcatccaggtgcccctgaaggtgaaggacatccctgagctgaaggaatgttttgtggagctgggcctgaacatcggccagctgggcattgatgacagcacccaggtgcccccagagctgtttgaaaatgagcacgtgagaattggccagaaggtgctggccgagcaggacagcgctgctgcccagcagtacatccggcagggcagccccacagccctgcgggcagagctgtgggccctgatcctgaacatcagcagccagccagaagatgtgctgtactatgagcagctgaagaccaacgtcatccagcacgacctgctggtggacagcctcatctacaaggatgtgaagctgacagccagcaatgatgactactactttgtgtttgaggactacctgtaccaggtgctgctgtgcttcagccgggacacctctgtgctgagccactttgccttcaacagcgccagcccccccaagagctacatccggggcaagctgggcctggaggagtatgctgtgttctaccccccaaatggagtcatccccttccacggcttctccatgtatgtggcccccctgtgcttcctgtaccacgagcccagcaagctgtaccagatcttccgggagatgtatgtgcgcttcttcttccggctgcacagcatcagcagccaccccagcggcatcgtgtccctgtgcctgctgtttgagaccctgctgcagacctacctgccccagctgttctaccacctgcgggagatcggggcccagcccctgcgcatctccttcaagtggatggtgcgggccttcagcggctacctggccacagaccagctgctgctgctgtgggaccgcatcctgggctacaacagcctggagatcctggccgtgctggccgctgctgtgtttgccttccgggctgtgaacctgatggaggtgaccagcctggccgctgctgaggccgtgctggccgacctgagcaccctgaaggtgatgcccctgctgcagatcttcctgtttgccaccgtgacctag

SEQ ID NO: 42550 - DNA, 1386 bp, Artificial Sequence
  Description of Artificial Sequence: Synthetic coding sequence
atgctgcaggaggagagtgacctgagcctcatcatcgcccagatcgtgcagaagctgaagggcagcaacctgtacagccagctggagcggcaggcctggggctcctgggagaagaggatcctgaagagcctgaacagcatgtgcacagagctgagcatccccctggccaggaagaggcctgtgggggagcagaaggagctgctgaacaagtggaatgagatgggcacagatgagccagacctgagcctcttccggcctgtgtatgcccccaaggacttcctggaggtgctgatcaacctgaggaaccccaactatgaaaatggagacagcctgtccttccgcacccacctgggcctcatccaggtgcccctgaaggtgaaggacatccctgagctgaaggagtgctttgtggagctgggcctgaacatcggccagctgggcattgatgacagcacccaggtgcccccagagctgtttgaaaatgaacatgtgcgcatcggccagaaggtgctggccgagcaggacagcgctgctgcccagcagtacatccggcagggcagccccacagccctgcgggcagagctgtgggccctgatcctgaacatcagcagccagccagaagatgtgctgtactatgagcagctgaagaccaacgtcatccagcacgacctgctggtggacagcctcatctacaaggatgtgaagctgacagccagcaatgatgactactactttgtgtttgaggactacctgtaccaggtgctgctgtgcttcagccgggacacctctgtgctgagccactttgccttcaacagcgccagcccccccaagagctacatccggggcaagctgggcctggaggagtatgctgtgttctacccacccaacggggtcatccccttccacggcttctccatgtatgtggcccccctgtgcttcctgtaccacgagcccagcaagctgtaccagatcttccgggagatgtatgtgcgcttcttcttccggctgcacagcatcagcagccaccccagcggcatcgtgtccctgtgcctgctgtttgagaccctgctgcagacctacctgccccagctgttctaccacctgcgggagattggagcccagcccctgcgcatctccttcaagtggatggtgcgggccttcagcggctacctggccacagaccagctgctgctgctgtgggaccgcatcctgggctacaacagcctggagatcctggccgtgctggccgctgctgtgtttgccttccgggctgtgaacctgatggaggtgaccagcctggccgctgctgaggccgtgctggccgacctgagcaccctgaaggtgatgcccctgctgcagatcttcctgtttgccaccgtgacctag

SEQ ID NO: 42551 - DNA, 1011 bp, Artificial Sequence
  Description of Artificial Sequence: Synthetic coding sequence
atgaccaccctgagccctgagaacagcctgagcgcccggcagagcgccagcttcatcctggtgaagaggaagccacccatcgacaagacagagtgggacagcttctttgatgaaagtggccacctggccaagagccgggacttcatctgtgtgaacatcctggagcggggcctgcacccctttgtgaggacagaggcctggaagttcctgaccggctacttctcctggcagagcagccaggatgagcggctgactgtggacagcatgaggaggaagaactacaaggccctgtgccagatgtatgagaagatccagcccctgctggagaacctgcacaggaacttcacagagaccaggaacaacatcgcccgggacatccagaagatctatgacaaggaccccctgggcaatgtgctgattgacaagaagaggctggagaagatcctgctgctgtcctatgtgtgcaacacccaggccgagtaccagcagggcttccacgagatgatgatgctgttccagctgatggtggagcatgaccacgagaccttctggctgttccagttcttcctgcagaagacagagcacagctgtgtgatcaacattggagtggccaagaacctggacatgctgagcaccctcatcaccttcctggaccctgtgtttgctgagcacctgaagggcaagggggccggggctgtgcagagcctcttcccctggttctgcttctgcttccagagggccttcaagagctttgatgatgtgtggaggctgtgggaggtgctgctgaccgggaagccctgcaggaacttccaggtgctggtggcctacagcatgctgcagatggtgcgggagcaggtgctgcaggagagcatgggaggagatgacatcctgctggcctgcaacaacctgattgacctggatgctgatgagctgatctctgctgcctgtgtggtgtatgcagagctgatccagaaggatgtgccccagaccctgaaggacttcttcctgtag

SEQ ID NO: 42552 - DNA, 903 bp, Artificial Sequence
  Description of Artificial Sequence: Synthetic coding sequence
atgaccaccctgagccctgagaacagcctgagcgcccggcagagcgccagcttcatcctgggcctgcacccctttgtgaggacagaggcctggaagttcctgaccggctacttctcctggcagagcagccaggatgagcggctgactgtggacagcatgaggaggaagaactacaaggccctgtgccagatgtatgagaagatccagcccctgctggagaacctgcacaggaacttcacagagaccaggaacaacatcgcccgggacatccagaagatctatgacaaggaccccctgggcaatgtgctgattgacaagaagaggctggagaagatcctgctgctgtcctatgtgtgcaacacccaggccgagtaccagcagggcttccacgagatgatgatgctgttccagctgatggtggagcatgaccacgagaccttctggctgttccagttcttcctgcagaagacagagcacagctgtgtgatcaacattggagtggccaagaacctggacatgctgagcaccctcatcaccttcctggaccctgtgtttgctgagcacctgaagggcaagggggccggggctgtgcagagcctcttcccctggttctgcttctgcttccagagggccttcaagagctttgatgatgtgtggaggctgtgggaggtgctgctgaccgggaagccctgcaggaacttccaggtgctggtggcctacagcatgctgcagatggtgcgggagcaggtgctgcaggagagcatgggaggagatgacatcctgctggcctgcaacaacctgattgacctggatgctgatgagctgatctctgctgcctgtgtggtgtatgcagagctgatccagaaggatgtgccccagaccctgaaggacttcttcctgtag

SEQ ID NO: 42553 - DNA, 1554 bp, Artificial Sequence
  Description of Artificial Sequence: Synthetic coding sequence
atggccagtgatggagccaggaagcagttctggaagaggagcaacagcaagctgcccggcagcatccagcacgtgtatggagcccagcaccccccatttgaccccctgctgcacggcaccctgctgcggagcacagccaagatgcccaccacccctgtgaaggccaagagggtgtccaccttccaggagtttgagagcaacaccagtgatgcctgggatgctggggaggatgatgatgagctgctggccatggctgctgagagcctgaacagcgaggtggtgatggagacagccaacagagtgctgaggaaccacagccagaggcagggccggcccaccctgcaggagggccctggcctgcagcagaagcccaggcctgaggccgagccccccagccccccatctggggacctgcggctggtgaagtctgtgtctgagagccacaccagctgcccagctgagagcgccagtgatgctgcccccctgcagaggagccagagcctgccccacagcgccaccgtgaccctgggcggcaccagtgaccccagcaccctgagcagcagcgccctgtctgagcgggaggccagccggctggacaagttcaagcagctgctggccggccccaacacagacctggaggagctgcggcggctgtcctggagcggcatccccaagcctgtgcggcccatgacctggaagctgctgagcggctacctgcctgccaacgtggacagaagacctgccaccctgcagaggaagcagaaggagtactttgccttcatcgagcactactatgacagcagaaatgatgaggtgcaccaggacacctaccggcagatccacatcgacatccccaggatgagccctgaggccctgatcctgcagcccaaggtgacagagatctttgagcgcatcctcttcatctgggccatccgccacccagccagcggctacgtgcagggcatcaatgacctggtgacccccttctttgtggtgttcatctgtgagtacatcgaggccgaggaggtggacacagtggatgtgtctggagtgcctgctgaggtgctgtgcaacattgaagctgacacctactggtgcatgagcaagctgctggatggcatccaggacaactacacctttgcccagcccggcatccagatgaaggtgaagatgctggaggagctggtgtccagaattgatgagcaggtgcaccgccacctggaccagcacgaggtgcgctacctgcagtttgccttccgctggatgaacaacctgctgatgagggaggtgcccctgcgctgcaccatccggctgtgggacacctaccagagcgagccagatggcttcagccacttccacctgtatgtgtgtgccgccttcctggtgcgctggaggaaggagatcctggaggagaaggacttccaggagctgctgctcttcctgcagaacctgcccacagcccactgggatgatgaggacatcagcctgctgctggccgaggcctaccgcctgaagtttgcctttgctgatgcccccaaccactacaagaagtag

SEQ ID NO: 42554 - DNA, 1320 bp, Artificial Sequence
  Description of Artificial Sequence: Synthetic coding sequence
atggccagtgatggagccaggaagcagttctggaagaggagcaacagcaagctgcccggcagcctgctgcggagcacagccaagatgcccaccacccctgtgaaggccaagagggtgtccaccttccaggagtttgagagcaacaccagtgatgcctgggatgctggagaagatgatgatgagctgctggccatggctgctgagagcctgaacagcgaggtggtgatggagacagccaacagagtgctgaggaaccacagccagaggcagggccggcccaccctgcaggagggccctggcctgcagcagaagcccaggcctgaggccgagccccccagcccccccagcggggacctgcggctggtgaagtctgtgtctgagagccacaccagctgcccagctgaggagctgcggcggctgtcctggagcggcatccccaagcctgtgcggcccatgacctggaagctgctgagcggctacctgcctgccaacgtggacagaagacctgccaccctgcagaggaagcagaaggagtactttgccttcatcgagcactactatgacagcagaaatgatgaggtgcaccaggacacctaccggcagatccacatcgacatccccaggatgagccctgaggccctgatcctgcagcccaaggtgacagagatctttgagcgcatcctcttcatctgggccatccgccacccagccagcggctacgtgcagggcatcaatgacctggtgacccccttctttgtggtgttcatctgtgagtacatcgaggccgaggaggtggacacagtggatgtgtctggagtgcctgctgaggtgctgtgcaacattgaagctgacacctactggtgcatgagcaagctgctggatggcatccaggacaactacacctttgcccagcccggcatccagatgaaggtgaagatgctggaggagctggtgtccagaattgatgagcaggtgcaccgccacctggaccagcacgaggtgcgctacctgcagtttgccttccgctggatgaacaacctgctgatgagggaggtgcccctgcgctgcaccatccggctgtgggacacctaccagagcgagccagatggcttcagccacttccacctgtatgtgtgtgccgccttcctggtgcgctggaggaaggagatcctggaggagaaggacttccaggagctgctgctcttcctgcagaacctgcccacagcccactgggatgatgaggacatcagcctgctgctggccgaggcctaccgcctgaagtttgcctttgctgatgcccccaaccactacaagaagtag

SEQ ID NO: 42555 - DNA, 975 bp, Artificial Sequence
  Description of Artificial Sequence: Synthetic coding sequence
atgcccaccacccctgtgaaggccaagagggtgtccaccttccaggagtttgagagcaacaccagtgatgcctgggatgctggagaagatgatgatgagctgctggccatggctgctgagagcctgaacagcgaggtggtgatggagacagccaacagagtgctgaggaaccacagccagaggcagggccggcccaccctgcaggagggccctggcctgcagcagaagcccaggcctgaggccgagccccccagcccccccagcggggacctgcggctggtgaagtctgtgtctgagagccacaccagctgcccagctgagagcgccagtgatgctgcccccctgcagaggagccagagcctgccccacagcgccaccgtgaccctgggcggcaccagtgaccccagcaccctgagcagcagcgccctgtctgagcgggaggccagccggctggacaagttcaagcagctgctggccggccccaacacagacctggaggagctgcggcggctgtcctggagcggcatccccaagcctgtgcggcccatgacctggaagctgctgagcggctacctgcctgccaacgtggaccggcggcctgccaccctgcagaggaagcagaaggagtactttgccttcatcgagcactactatgacagcagaaatgatgaggtgcaccaggacacctaccggcagatccacatcgacatccccaggatgagccctgaggccctgatcctgcagcccaaggtgacagagatctttgagcgcatcctcttcatctgggccatccgccacccagccagcggctacgtgcagggcatcaatgacctggtgacccccttctttgtggtgttcatctgtgagtacatcgccttccctggctgcggccggccccagatccccatcctggccgtcatctggagagatgagccctaccccaggacagatgagcagatcatcctgcggaggtag

SEQ ID NO: 42556 - DNA, 1413 bp, Artificial Sequence
  Description of Artificial Sequence: Synthetic coding sequence
atgcccaccacccctgtgaaggccaagagggtgtccaccttccaggagtttgagagcaacaccagtgatgcctgggatgctggagaagatgatgatgagctgctggccatggctgctgagagcctgaacagcgaggtggtgatggagacagccaacagagtgctgaggaaccacagccagaggcagggccggcccaccctgcaggagggccctggcctgcagcagaagcccaggcctgaggccgagccccccagcccccccagcggggacctgcggctggtgaagtctgtgtctgagagccacaccagctgcccagctgagagcgccagtgatgctgcccccctgcagaggagccagagcctgccccacagcgccaccgtgaccctgggcggcaccagtgaccccagcaccctgagcagcagcgccctgtctgagcgggaggccagccggctggacaagttcaagcagctgctggccggccccaacacagacctggaggagctgcggcggctgtcctggagcggcatccccaagcctgtgcggcccatgacctggaagctgctgagcggctacctgcctgccaacgtggaccggcggcctgccaccctgcagaggaagcagaaggagtactttgccttcatcgagcactactatgacagcagaaatgatgaggtgcaccaggacacctaccggcagatccacatcgacatccccaggatgagccctgaggccctgatcctgcagcccaaggtgacagagatctttgagcgcatcctcttcatctgggccatccgccacccagccagcggctacgtgcagggcatcaatgacctggtgacccccttctttgtggtgttcatctgtgagtacattgaagctgaggaggtggacacagtggatgtgtctggagtgcctgctgaggtgctgtgcaacatcgaggccgacacctactggtgcatgagcaagctgctggatggcatccaggacaactacacctttgcccagcccggcatccagatgaaggtgaagatgctggaggagctggtgtccagaattgatgagcaggtgcaccgccacctggaccagcacgaggtgcgctacctgcagtttgccttccgctggatgaacaacctgctgatgagggaggtgcccctgcgctgcaccatccggctgtgggacacctaccagagcgagccagatggcttcagccacttccacctgtatgtgtgtgccgccttcctggtgcgctggaggaaggagatcctggaggagaaggacttccaggagctgctgctcttcctgcagaacctgcccacagcccactgggatgatgaggacatcagcctgctgctggccgaggcctaccgcctgaagtttgcctttgctgatgcccccaaccactacaagaagtag

SEQ ID NO: 42557 - DNA, 1377 bp, Artificial Sequence
  Description of Artificial Sequence: Synthetic coding sequence
atggccagtgatggagccaggaagcagttctggaagaggagcaacagcaagctgcccggcagcatccagcacgtgtatggagcccagcaccccccatttgaccccctgctgcacggcaccctgctgcggagcacagccaagatgcccaccacccctgtgaaggccaagagggtgtccaccttccaggagtttgagagcaacaccagtgatgcctgggatgctggggaggatgatgatgagctgctggccatggctgctgagagcctgaacagcgaggtggtgatggagacagccaacagagtgctgaggaaccacagccagaggcagggccggcccaccctgcaggagggccctggcctgcagcagaagcccaggcctgaggccgagccccccagccccccatctggggacctgcggctggtgaagtctgtgtctgagagccacaccagctgcccagctgaggagctgcggcggctgtcctggagcggcatccccaagcctgtgcggcccatgacctggaagctgctgagcggctacctgcctgccaacgtggaccggcggcctgccaccctgcagaggaagcagaaggagtactttgccttcatcgagcactactatgacagcagaaatgatgaggtgcaccaggacacctaccggcagatccacatcgacatccccaggatgagccctgaggccctgatcctgcagcccaaggtgacagagatctttgagcgcatcctcttcatctgggccatccgccacccagccagcggctacgtgcagggcatcaatgacctggtgacccccttctttgtggtgttcatctgtgagtacattgaagctgaggaggtggacacagtggatgtgtctggagtgcctgctgaggtgctgtgcaacatcgaggccgacacctactggtgcatgagcaagctgctggatggcatccaggacaactacacctttgcccagcccggcatccagatgaaggtgaagatgctggaggagctggtgtccagaattgatgagcaggtgcaccgccacctggaccagcacgaggtgcgctacctgcagtttgccttccgctggatgaacaacctgctgatgagggaggtgcccctgcgctgcaccatccggctgtgggacacctaccagagcgagccagatggcttcagccacttccacctgtatgtgtgtgccgccttcctggtgcgctggaggaaggagatcctggaggagaaggacttccaggagctgctgctcttcctgcagaacctgcccacagcccactgggatgatgaggacatcagcctgctgctggccgaggcctaccgcctgaagtttgcctttgctgatgcccccaaccactacaagaagtag

SEQ ID NO: 42558 - DNA, 1518 bp, Artificial Sequence
  Description of Artificial Sequence: Synthetic coding sequence
atggctgctgagaacagcaagcagttctggaagaggtctgccaagctgcccggcagcatccagcctgtgtatggagcccagcacccccccctggacccccggctgaccaagaacttcatcaaggagaggagcaaggtgaacacagtgcccctgaagaacaagaaggccagcagcttccacgagtttgccaggaacaccagtgatgcctgggacattggagatgatgaggaggaggacttcagcagccccagcttccagaccctgaacagcaaggtggccctggccacagctgcccaggtgctggagaaccacagcaagctgcgggtgaagccagagaggagccagagcaccaccagtgatgtgcctgccaactacaaggtgatcaagagcagcagtgatgcccagctgagcaggaacagcagtgacacctgcctgaggaaccccctgcacaagcagcagagcctgcccctgcggcccatcatccccctggtggcccgcatcagtgaccagaatgccagcggggccccacccatgacagtgcgggagaagacccggctggagaagttccggcagctgctgagcagccagaacacagacctggatgagctgaggaaatgttcctggccaggagtgccccgggaggtgcggcccatcacctggaggctgctgagcggctacctgcctgccaacacagaaagaaggaagctgaccctgcagaggaagcgggaggagtacttcggcttcatcgagcagtactatgacagcagaaatgaggagcaccaccaggacacctaccggcagatccacatcgacatccccaggaccaaccccctcatccccctcttccagcagcccctggtgcaggagatctttgagcgcatcctcttcatctgggccatccgccacccagccagcggctacgtgcagggcatcaatgacctggtgacccccttctttgtggtgttcctgtctgaatatgtggaggaggatgtggagaactttgatgtgaccaacctgagccaggacatgctgcggagcattgaagctgacagcttctggtgcatgagcaagctgctggatggcatccaggacaactacacctttgcccagcccggcatccagaagaaggtgaaggccctggaggagctggtgtccagaattgatgagcaggtgcacaaccacttccgccgctatgaggtggagtacctgcagtttgccttccgctggatgaacaacctgctgatgagggagctgcccctgcgctgcaccatccggctgtgggacacctaccagagcgagcctgagggcttcagccacttccacctgtatgtgtgtgccgccttcctgatcaagtggaggaaggagatcctggatgaggaggacttccagggcctgctgatgctgctgcagaacctgcccaccatccactggggcaatgaggagatcggcctgctgctggccgaggcctaccgcctgaagtacatgtttgctgatgcccccaaccactacagaagatag

SEQ ID NO: 42559 - DNA, 2055 bp, Artificial Sequence
  Description of Artificial Sequence: Synthetic coding sequence
atggccgagggagaagatgtgccccccctgcccaccagcagtggagatggctgggagaaggacctggaggaggccctggaggccggcggctgtgacctggagaccctgaggaacatcatccagggccggcccctgcctgctgacctgcgggccaaggtgtggaagatcgccctgaatgtggccgggaaaggagacagcctggcctcctgggatggcatcctggacctgcctgagcagaacaccatccacaaggactgcctgcagttcatcgaccagctgtctgtgcctgaggagaaggctgctgagctgctgctggacattgaatctgtcatcaccttctactgcaagagcaggaacatcaagtacagcaccagcctgtcctggatccacctgctgaagcccctggtgcacctgcagctgcccaggagtgacctgtacaactgcttctacgccatcatgaacaagtacatcccccgggactgcagccagaagggccggcccttccacctgttccggctgctgatccagtaccacgagcctgagctgtgcagctacctggacaccaagaagatcaccccagacagctatgccctgaactggctgggcagcctgtttgcctgctactgcagcacagaggtgacccaggccatctgggatggctacctgcagcaggccgaccccttcttcatctacttcctgatgctgatcatcctggtgaatgccaaggaggtgatcctgacccaggagagtgacagcaaggaggaggtgatcaagttcctggagaacacccccagcagcctgaacatcgaggacattgaagatctcttcagcctggcccagtactactgcagcaagaccccagccagcttcaggaaggacaaccaccacctgtttggcagcaccctgctgggcatcaaggatgatgatgctgacctgagccaggccctgtgcctggccatctctgtgtctgagatcctgcaggccaaccagctgcagggcgagggcgtgcgcttctttgtggtggactgcaggcctgctgagcagtacaatgccggccacctgagcacagccttccacctggacagcgacctgatgctgcagaaccccagcgagtttgcccagagcgtgaagagcctgctggaggcccagaagcagagcattgaaagtggcagcattgctggaggagagcacctgtgcttcatgggcagcggccgggaggaggaggacatgtacatgaacatggtgctggcccacttcctgcagaagaacaaggagtatgtgtccatcgccagcggcggcttcatggccctgcagcagcacctggccgacatcaacgtggatggcccagaaaatggctacggccactggatcgccagcaccagcggcagccgcagcagcatcaacagcgtggatggagagagccccaacggcagcagtgaccggggcatgaagagcctggtgaacaagatgacagtggccctgaagaccaagtctgtgaatgtgcgggagaaggtgatctccttcatcgagaacaccagcacccctgtggacagacatgtgagcagcagtgacagagtgggcaagccctaccggggcgtgaagcctgtgttcagcattggagatgaggaggagtatgacacagatgaaattgacagcagctccatgtctgatgatgacaggaaggaggtggtgaacatccagacctggatcaacaagccagatgtgaagcaccacttcccctgcaaggaggtgaaggagagcggccacatgttccccagccacctgctggtgacagccacccacatgtactgcctgcgggagatcgtgtccaggaagggcctggcctacatccagagccggcaggccctgaacagcgtggtgaagatcaccagcaagaagaagcaccctgagctgatcaccttcaagtatggcaacagcagcgccagcggcatcgagatcctggccatcgagcgctacctgatccccaatgctggagatgccaccaaggccatcaagcagcagatcatgaaggtgctggatgccctggagagctag

SEQ ID NO: 42560 - DNA, 2100 bp, Artificial Sequence
  Description of Artificial Sequence: Synthetic coding sequence
atggccgagggagaagatgtgccccccctgcccaccagcagtggagatggctgggagaaggacctggaggaggccctggaggccggcggctgtgacctggagaccctgaggaacatcatccagggccggcccctgcctgctgacctgcgggccaaggtgtggaagatcgccctgaatgtggccgggaaaggagacagcctggcctcctgggatggcatcctggacctgcctgagcagaacaccatccacaaggactgcctgcagttcatcgaccagctgtctgtgcctgaggagaaggctgctgagctgctgctggacattgaatctgtcatcaccttctactgcaagagcaggaacatcaagtacagcaccagcctgtcctggatccacctgctgaagcccctggtgcacctgcagctgcccaggagtgacctgtacaactgcttctacgccatcatgaacaagtacatcccccgggactgcagccagaagggccggcccttccacctgttccggctgctgatccagtaccacgagcctgagctgtgcagctacctggacaccaagaagatcaccccagacagctatgccctgaactggctgggcagcctgtttgcctgctactgcagcacagaggtgacccaggccatctgggatggctacctgcagcaggccgaccccttcttcatctacttcctgatgctgatcatcctggtgaatgccaaggaggtgatcctgacccaggagagtgacagcaaggaggaggtgatcaagttcctggagaacacccccagcagcctgaacatcgaggacattgaagatctcttcagcctggcccagtactactgcagcaagaccccagccagcttcaggaaggacaaccaccacctgtttggcagcaccctgctgggcatcaaggatgatgatgctgacctgagccaggccctgtgcctggccatctctgtgtctgagatcctgcaggccaaccagctgcagggcgagggcgtgcgcttctttgtggtggactgcaggcctgctgagcagtacaatgccggccacctgagcacagccttccacctggacagcgacctgatgctgcagaaccccagcgagtttgcccagagcgtgaagagcctgctggaggcccagaagcagagcattgaaagtggcagcattgctggaggagagcacctgtgcttcatgggcagcggccgggaggaggaggacatgtacatgaacatggtgctggcccacttcctgcagaagaacaaggagtatgtgtccatcgccagcggcggcttcatggccctgcagcagcacctggccgacatcaacgtggatggcccagaaaatggctacggccactggatcgccagcaccagcggcagccgcagcagcatcaacagcgtggatggagagagccccaacggcagcagtgaccggggcatgaagagcctggtgaacaagatgacagtggccctgaagaccaagtctgtgaatgtgcgggagaaggtgatctccttcatcgagaacaccagcacccctgtggacaggatgtccttcaacctgccctggccagacaggagctgcacagagcggcacgtgagcagcagtgacagagtgggcaagccctacagaggagtgaagcctgtgttcagcattggagatgaggaggagtatgacacagatgaaattgacagcagctccatgtctgatgatgacaggaaggaggtggtgaacatccagacctggatcaacaagccagatgtgaagcaccacttcccctgcaaggaggtgaaggagagcggccacatgttccccagccacctgctggtgacagccacccacatgtactgcctgcgggagatcgtgtccaggaagggcctggcctacatccagagccggcaggccctgaacagcgtggtgaagatcaccagcaagaagaagcaccctgagctgatcaccttcaagtatggcaacagcagcgccagcggcatcgagatcctggccatcgagcgctacctgatccccaatgctggagatgccaccaaggccatcaagcagcagatcatgaaggtgctggatgccctggagagctag

SEQ ID NO: 42561 - DNA, 1689 bp, Artificial Sequence
  Description of Artificial Sequence: Synthetic coding sequence
atgggctggtacttccggctggccaggacagagcactacagccagaggctgcctgctgtgtactgggactgcagccagaagggccggcccttccacctgttccggctgctgatccagtaccacgagcctgagctgtgcagctacctggacaccaagaagatcaccccagacagctatgccctgaactggctgggcagcctgtttgcctgctactgcagcacagaggtgacccaggccatctgggatggctacctgcagcaggccgaccccttcttcatctacttcctgatgctgatcatcctggtgaatgccaaggaggtgatcctgacccaggagagtgacagcaaggaggaggtgatcaagttcctggagaacacccccagcagcctgaacattgaagatattgaggacctcttcagcctggcccagtactactgcagcaagaccccagccagcttcaggaaggacaaccaccacctgtttggcagcaccctgctgggcatcaaggatgatgatgctgacctgagccaggccctgtgcctggccatctctgtgtctgagatcctgcaggccaaccagctgcagggcgagggcgtgcgcttctttgtggtggactgcaggcctgctgagcagtacaatgccggccacctgagcacagccttccacctggacagcgacctgatgctgcagaaccccagcgagtttgcccagagcgtgaagagcctgctggaggcccagaagcagagcattgagagcggcagcattgctggaggagagcacctgtgcttcatgggcagcggccgggaggaggaggacatgtacatgaacatggtgctggcccacttcctgcagaagaacaaggagtatgtgtccatcgccagcggcggcttcatggccctgcagcagcacctggccgacatcaacgtggatggcccagaaaatggctacggccactggatcgccagcaccagcggcagccgcagcagcatcaacagcgtggatggagagagccccaacggcagcagtgaccggggcatgaagagcctggtgaacaagatgacagtggccctgaagaccaagtctgtgaatgtgcgggagaaggtgatctccttcatcgagaacaccagcacccctgtggacaggatgtccttcaacctgccctggccagacaggagctgcacagaaagacatgtgagcagcagtgacagagtgggcaagccctaccggggcgtgaagcctgtgttcagcattggagatgaggaggagtatgacacagatgaaattgacagcagctccatgtctgatgatgacaggaaggaggtggtgaacatccagacctggatcaacaagccagatgtgaagcaccacttcccctgcaaggaggtgaaggagagcggccacatgttccccagccacctgctggtgacagccacccacatgtactgcctgcgggagatcgtgtccaggaagggcctggcctacatccagagccggcaggccctgaacagcgtggtgaagatcaccagcaagaagaagcaccctgagctgatcaccttcaagtatggcaacagcagcgccagcggcatcgagatcctggccatcgagcgctacctgatccccaatgctggagatgccaccaaggccatcaagcagcagatcatgaaggtgctggatgccctggagagctag

SEQ ID NO: 42562 - DNA, 753 bp, Artificial Sequence; identical to SEQ ID NO: 42531
  Description of Artificial Sequence: Synthetic coding sequence

SEQ ID NO: 42563 - DNA, 633 bp, Artificial Sequence
  Description of Artificial Sequence: Synthetic coding sequence
atggagatggatgaagatcctgacaacctgcctgcccagggccagggcaacatcatcatcaccaagtatgagcagggccacagagctggagctgctgtggacctgggccacgagcaggtggatgtgaggaagtacaccaacaacctgggcatcgtgcatgagatggagctgccccgggtgtctgccctggaggtgaagcagaggaggaaggagagcaagaggaccaacaagtggcagaagatgctggccgactggaccaagtaccgcagcaccaagaagctgagccagagggtgtgcaaggtgatccccctggccgtgcggggccgggccctgagcctgctgctggacatcgacaagatcaagagccagaaccctgggaagtacaaggtgatgaaggagaagggcaagaggagcagccgcatcatccactgcatccagctggatgtgagccacaccctgcagaagcacatgatgttcatccagagatttggagtgaagcagcaggagctgtgtgacatcctggtggcctacagcgcctacaaccctgtgtccatccctggccagcgctacagctggtacctgtgcccctacagccaggcctgggtgtccctgggcggcgtggccaccagctag

SEQ ID NO: 42564 - DNA, 633 bp, Artificial Sequence; identical to SEQ ID NO: 42563
  Description of Artificial Sequence: Synthetic coding sequence

SEQ ID NO: 42565 - DNA, 453 bp, Artificial Sequence; identical to SEQ ID NO: 42532
  Description of Artificial Sequence: Synthetic coding sequence

SEQ ID NO: 42566 - DNA, 246 bp, Artificial Sequence
  Description of Artificial Sequence: Synthetic coding sequence
atgggccacctggacaaggagggcctgtgcacccagggcagcagcttctcctggctgctgcgggtgctgaatgatggcatcagcctgggcctgaccccctgcctgtgggacatgtacctgctggagggggagcagatgctgatgctgatcaccagcatcgccttcaaggtgcagaggcggcccagccgggccctggaggagccagacccctttgtgcgggccagcaccccaccctgcaagaggtag

SEQ ID NO: 42567 - DNA, 2892 bp, Artificial Sequence
  Description of Artificial Sequence: Synthetic coding sequence
atgcctggggccggggcccgggcagaggagggcggcggcggcggggagggcgccgcccagggcgctgctgctgagcccggggccggccctgcccgggagcccgcccggctgtgtggctacctgcagaagctgagcggcaagggccccctgcggggctaccgcagccgctggtttgtgtttgatgcccggcgctgctacctgtactacttcaagagcccccaggatgccctgcccctgggccacctggacattgctgatgcctgcttctcctaccagggcccagatgaagctgctgagcccggcacagagcccccagcccacttccaggtgcacagcgctggagctgtgacagtgctgaaggcccccaaccggcagctgatgacctactggctgcaggagctgcagcagaagcgctgggagtactgcaacagcctggacatggtgaagtgggacagcaggaccagccccacccctggggacttccccaagggcctggtggcccgggacaacacagacctgatctacccccaccccaatgccagcgctgagaaggccagaaatgtgctggccgtggagaccgtgcctggagagctggtgggggagcaggccgccaaccagcctgcccctggccaccccaacagcatcaacttctacagcctgaagcagtggggcaatgagctgaagaacagcatgagcagcttccggcccggccggggccacaatgacagcagaagaacagtgttctacaccaatgaggagtgggagctgctggaccccacccccaaggacctggaggagagcatcgtgcaggaggagaagaagaagctgaccccagagggcaacaagggcgtgactggaagtggcttcccctttgattttggaagaaacccctacaagggcaagaggcccctgaaggacatcatcggcagctacaagaacagacacagcagcggggaccccagcagcgagggcaccagcggcagcggctctgtgtccatcaggaagccagccagcgagatgcagctgcaggtgcagagccagcaggaggagctggagcagctgaagaaggacctgagcagccagaaggagctggtgcggctgctgcagcagacagtgcgcagcagccagtatgacaagtacttcaccagcagccggctgtgtgaaggagtgcccaaggacaccctggagctgctgcaccagaaggatgaccagatcctgggcctgaccagccagctggagcgcttcagcctggagaaggagagcctgcagcaggaggtgaggaccctgaagagcaaggtgggggagctgaatgagcagctgggcatgctgatggagaccatccaggccaaggatgaagtcatcatcaagctgtctgagggggagggcaatggacctccacccaccgtggcccccagcagccccagcgtggtgcctgtggcccgggaccagctggagctggaccggctgaaggacaacctgcagggctacaagacccagaacaagttcctgaacaaggagatcctggagctgagcgccctgcggagaaatgctgagcggcgggagcgggacctgatggccaagtacagcagcctggaggccaagctgtgccagatcgagagcaagtacctgatcctgctgcaggagatgaagacccctgtgtgcagcgaggaccagggccccacccgggaggtgattgcccagctgctggaggatgccctgcaggtggagagccaggagcagcctgagcaggcctttgtgaagccccacctggtgtctgaatatgacatctacggcttcagaacagtgcctgaagatgatgaggaggagaagctggtggccaaggtgcgggccctggacctgaagaccctgtacctgacagagaaccaggaggtgtccactggagtgaagtgggagaactactttgccagcacagtgaaccgggagatgatgtgcagccctgagctgaagaacctgatccgggccggcatcccccatgagcacaggagcaaggtgtggaagtggtgtgtggacagacacaccaggaagttcaaggacaacacagagcccggccacttccagaccctgctgcagaaggccctggagaagcagaacccagccagcaagcagatcgagctggacctgctgcggaccctgcccaacaacaagcactacagctgccccaccagcgagggcatccagaagctgagaaatgtgctgctggccttctcctggagaaatccagacatcggctactgccagggcctgaaccggctggtggccgtggccctgctgtacctggagcaggaggatgccttctggtgcctggtgaccatcgtggaggtgttcatgccccgggactactacaccaagaccctgctgggcagccaggtggaccagagggtcttccgggacctgatgtctgagaagctgccccggctgcacggccactttgagcagtacaaggtggactacaccctcatcaccttcaactggttcctggtggtgtttgtggacagcgtggtgtctgacatcctcttcaagatctgggacagcttcctgtatgagggccccaaggtgatcttccgctttgccctggccctcttcaagtacaaggaggaggagatcctgaagctgcaggacagcatgagcatcttcaagtacctgcgctacttcaccaggaccatcctggatgccaggaagctgatcagcatcagctttggagacctgaaccccttccccctgcggcagatccggaacagaagagcctaccacctggagaaggtgcggctggagctgacagagctggaggccatccgggaggacttcctgcgggagcgggacaccagcccagacaagggggagctggtgtctgatgaggaggaggacacctag

SEQ ID NO: 42568 - DNA, 2745 bp, Artificial Sequence
  Description of Artificial Sequence: Synthetic coding sequence
atgcctggggccggggcccgggcagaggagggcggcggcggcggggagggcgccgcccagggcgctgctgctgagcccggggccggccctgcccgggagcccgcccggctgtgtggctacctgcagaagctgagcggcaagggccccctgcggggctaccgcagccgctggtttgtgtttgatgcccggcgctgctacctgtactacttcaagagcccccaggatgccctgcccctgggccacctggacattgctgatgcctgcttctcctaccagggcccagatgaagctgctgagcccggcacagagcccccagcccacttccaggtgcacagcgctggagctgtgacagtgctgaaggcccccaaccggcagctgatgacctactggctgcaggagctgcagcagaagcgctgggagtactgcaacagcctggacatggtgaagtgggacagcaggaccagccccacccctggggacttccccaagggcctggtggcccgggacaacacagacctgatctacccccaccccaatgccagcgctgagaaggccagaaatgtgctggccgtggagaccgtgcctggagagctggtgggggagcaggccgccaaccagcctgcccctggccaccccaacagcatcaacttctacagcctgaagcagtggggcaatgagctgaagaacagcatgagcagcttccggcccggccggggccacaatgacagcagaagaacagtgttctacaccaatgaggagtgggagctgctggaccccacccccaaggacctggaggagagcatcgtgcaggaggagaagaagaagctgaccccagagggcaacaagggcgtgactggaagtggcttcccctttgattttggaagaaacccctacaagggcaagaggcccctgaaggacatcatcggcagctacaagaacagacacagcagcggggaccccagcagcgagggcaccagcggcagcggctctgtgtccatcaggaagccagccagcgagatgcagctgcaggtgcagagccagcaggaggagctggagcagctgaagaaggacctgagcagccagaaggagctggtgcggctgctgcagcagacagtgcgcagcagccagtatgacaagtacttcaccagcagccggctgtgtgaaggagtgcccaaggacaccctggagctgctgcaccagaaggatgaccagatcctgggcctgaccagccagctggagcgcttcagcctggagaaggagagcctgcagcaggaggtgaggaccctgaagagcaaggtgggggagctgaatgagcagctgggcatgctgatggagaccatccaggccaaggatgaagtcatcatcaagctgtctgagggggagggcaatggacctccacccaccgtggcccccagcagccccagcgtggtgcctgtggcccgggaccagctggagctggaccggctgaaggacaacctgcagggctacaagacccagaacaagttcctgaacaaggagatcctggagctgagcgccctgcggagaaatgctgagcggcgggagcgggacctgatggccaagtacagcagcctggaggccaagctgtgccagatcgagagcaagtacctgatcctgctgcaggagatgaagacccctgtgtgcagcgaggaccagggccccacccgggaggtgattgcccagctgctggaggatgccctgcaggtggagagccaggagcagcctgagcaggcctttgtgaagccccacctggtgtctgaatatgacatctacggcttcagaacagtgcctgaagatgatgaggaggagaagctggtggccaaggtgcgggccctggacctgaagaccctgtacctgacagagaaccaggaggtgtccactggagtgaagtgggagaactactttgccagcacagtgaaccgggagatgatgtgcagccctgagctgaagaacctgatccgggccggcatcccccatgagcacaggagcaaggtgtggaagtggtgtgtggacagacacaccaggaagttcaaggacaacacagagcccggccacttccagaccctgctgcagaaggccctggagaagcagaacccagccagcaagcagatcgagctggacctgctgcggaccctgcccaacaacaagcactacagctgccccaccagcgagggcatccagaagctgagaaatgtgctgctggccttctcctggagaaatccagacatcggctactgccagggcctgaaccggctggtggccgtggccctgctgtacctggagcaggaggatgccttctggtgcctggtgaccatcgtggaggtgttcatgccccgggactactacaccaagaccctgctgggcagccaggtggaccagagggtcttccgggacctgatgtctgagaagctgccccggctgcacggccactttgagcagtacaaggtggactacaccctcatcaccttcaactggttcctggtggtgtttgtggacagcgtggtgtctgacatcctcttcaagatctgggacagcttcctgtatgagggccccaaggtgatcttccgctttgccctggccctcttcaagtacaaggaggaggagatcctgaagctgcaggacagcatgagcatcttcaagtacctgcgctacttcaccaggaccatcctggatgcccggagcggcacagatgcccccaccacctggaggaagagcggctggagctag

SEQ ID NO: 42569 - DNA, 768 bp, Artificial Sequence
  Description of Artificial Sequence: Synthetic coding sequence
atggtgctggagctgaatgccagtgatgaccggggcatcgacatcatccggggccccatcctgagctttgccagcaccaggaccatcttcaagaagggcttcaagctggtgatcctggatgaagcagatgccatgacccaggatgcccagaatgccctgcggcgggtgattgagaagttcacagagaacacccgcttctgcctgatctgcaactacctgagcaagatcatcccagccctgcagagccgctgcacccgcttccgcttcggccccctgaccccagagctgatggtgccccggctggagcacgtggtggaggaggagaaggtggacatcagtgaagatggcatgaaggccctggtgaccctgagcagcggggacatgagaagagccctgaacatcctgcagagcaccaacatggccttcggcaaggtgacagaggagaccgtgtacacctgcaccggccaccccctgaagagtgacatcgccaacatcctggactggatgctgaaccaggacttcaccacagcctacagaaacatcacagagctgaagaccctgaagggcctggccctgcatgacatcctgacagagatccacctgtttgtgcaccgggtggacttccccagctctgtgcgcatccacctgctgaccaagatggctgacatcgagtaccgcctgtctgtgggcaccaatgagaagatccagctgagcagcctgattgctgccttccaggtgacccgggacctgattgtggccgaggcctag

SEQ ID NO: 42570 - DNA, 1734 bp, Artificial Sequence
  Description of Artificial Sequence: Synthetic coding sequence
atgaggcaggacaagctgaccggcagcctgcggcggggcggccgctgcctgaagaggcagggcggcggcgtgggcaccatcctgagcaatgtgctgaagaagaggagctgcatcagcaggacagccccccggctgctgtgcaccctggagcccggggtggacaccaagctgaagttcaccctggagcccagcctgggccagaatggcttccagcagtggtatgatgccctgaaggctgtggcccggctgagcacaggcatccccaaggagtggaggaggaaggacctgcacaggacaggctgcagcagctactgcggccaggaggccgagcaggacagagtggtgctgaagagggtgctgctggcctatgcccgctggaacaagacagtgggctactgccagggcttcaacatcctggccgccctgatcctggaggtgatggagggcaatgaaggagatgccctgaagatcatgatctacctgattgacaaggtgctgcctgagagctactttgtgaacaacctgcgggccctgtctgtggacatggctgtgttccgggacctgctgaggatgaagctgcctgagctgagccagcacctggacaccctgcagaggacagccaacaaggagagcggcggcggctatgagccccccctgaccaacgtgttcaccatgcagtggttcctgaccctgtttgccacctgcctgcccaaccagacagtgctgaagatctgggacagcgtcttctttgagggcagcgagatcatcctgcgggtgtccctggccatctgggccaagctgggggagcagatcgagtgctgtgaaacagcagatgagttctacagcaccatgggccgcctgacccaggagatgctggagaatgacctgctgcagagccatgagctgatgcagacagtgtacagcatggcccccttccccttcccccagctggccgagctgcgggagaagtacacctacaacatcacccccttccctgccaccgtgaagcccacctctgtgtctggccgccacagcaaggcccgggacagtgatgaagaaaatgaccctgatgatgaagatgctgtggtgaatgctgtgggctgcctgggccccttcagcggcttcctggcccctgagctgcagaagtaccagaagcagatcaaggagcccaatgaggagcagagcctgcggagcaacaacattgctgagctgagccctggggccatcaacagctgccgctctgagtaccacgccgccttcaacagcatgatgatggagaggatgaccacagacatcaatgccctgaagaggcagtacagccgcatcaagaagaagcagcagcagcaggtgcaccaggtgtacatccgggctgacaagggccctgtgaccagcatcctgcccagccaggtgaacagcagccctgtgatcaaccacctgctgctgggcaagaagatgaagatgaccaacagagctgccaagaatgctgtgatccacatccctggccacactggaggcaagatcagccctgtgccctatgaggacctgaagaccaagctgaacagcccctggaggacccacatccgggtgcacaagaagaacatgcccaggaccaagagccaccctggctgtggggacacagtgggcctgattgatgagcagaatgaggccagcaagaccaacggcctgggcgctgctgaggccttccccagcggctgcacagctggccagggctag

SEQ ID NO: 42571 - DNA, 1914 bp, Artificial Sequence
  Description of Artificial Sequence: Synthetic coding sequence
atgaggcaggacaagctgaccggcagcctgcggcggggcggccgctgcctgaagaggcagggcggcggcgtgggcaccatcctgagcaatgtgctgaagaagaggagctgcatcagcaggacagccccccggctgctgtgcaccctggagcccggggtggacaccaagctgaagttcaccctggagcccagcctgggccagaatggcttccagcagtggtatgatgccctgaaggctgtggcccggctgagcacaggcatccccaaggagtggaggaggaaggtgtggctgaccctggccgaccactacctgcacagcatcgccatcgactgggacaagaccatgaggttcaccttcaatgaaagaagcaacccagatgatgacagcatgggcatccagatcgtgaaggacctgcacaggacaggctgcagcagctactgcggccaggaggccgagcaggacagagtggtgctgaagagggtgctgctggcctatgcccgctggaacaagacagtgggctactgccagggcttcaacatcctggccgccctgatcctggaggtgatggagggcaatgaaggagatgccctgaagatcatgatctacctgattgacaaggtgctgcctgagagctactttgtgaacaacctgcgggccctgtctgtggacatggctgtgttccgggacctgctgaggatgaagctgcctgagctgagccagcacctggacaccctgcagaggacagccaacaaggagagcggcggcggctatgagccccccctgaccaacgtgttcaccatgcagtggttcctgaccctgtttgccacctgcctgcccaaccagacagtgctgaagatctgggacagcgtcttctttgagggcagcgagatcatcctgcgggtgtccctggccatctgggccaagctgggggagcagatcgagtgctgtgaaacagcagatgagttctacagcaccatgggccgcctgacccaggagatgctggagaatgacctgctgcagagccatgagctgatgcagacagtgtacagcatggcccccttccccttcccccagctggccgagctgcgggagaagtacacctacaacatcacccccttccctgccaccgtgaagcccacctctgtgtctggccgccacagcaaggcccgggacagtgatgaagaaaatgaccctgatgatgaagatgctgtggtgaatgctgtgggctgcctgggccccttcagcggcttcctggcccctgagctgcagaagtaccagaagcagatcaaggagcccaatgaggagcagagcctgcggagcaacaacattgctgagctgagccctggggccatcaacagctgccgctctgagtaccacgccgccttcaacagcatgatgatggagaggatgaccacagacatcaatgccctgaagaggcagtacagccgcatcaagaagaagcagcagcagcaggtgcaccaggtgtacatccgggctgacaagggccctgtgaccagcatcctgcccagccaggtgaacagcagccctgtgatcaaccacctgctgctgggcaagaagatgaagatgaccaacagagctgccaagaatgctgtgatccacatccctggccacactggaggcaagatcagccctgtgccctatgaggacctgaagaccaagctgaacagcccctggaggacccacatccgggtgcacaagaagaacatgcccaggaccaagagccaccctggctgtggggacacagtgggcctgattgatgagcagaatgaggccagcaagaccaacggcctgggcgctgctgaggccttccccagcggctgcacagccacagctggccgggagggcagcagccctgagggcagcagcagctacaagagcctgcagatgatctag

SEQ ID NO: 42572 - DNA, 2388 bp, Artificial Sequence
  Description of Artificial Sequence: Synthetic coding sequence
atgtaccacagcctgtctgagaccaggcaccccctgcagcctgaggagcaggaggtgggcatcgaccccctgagcagctacagcaacaagtctggaggagacagcaacaagaatggccgccgcaccagcagcaccctggacagcgagggcaccttcaacagctacaggaaggagtgggaggagctgtttgtgaacaacaactacctggccaccatccggcagaagggcatcaatggccagctgcggagcagccgcttccgcagcatctgctggaagctgttcctgtgtgtgctgccccaggacaagagccagtggatcagcagaattgaggagctgcgggcctggtacagcaacatcaaggagatccacatcaccaaccccaggaaggtggtgggccagcaggacctgatgatcaacaaccccctgagccaggatgagggcagcctgtggaacaagttcttccaggacaaggagctgcgctccatgattgagcaggatgtgaagaggaccttccctgagatgcagttcttccagcaggagaatgtgaggaagatcctgacagatgtgctcttctgctacgcccgggagaatgagcagctgctgtacaagcagggcatgcatgagctgctggcccccatcgtgtttgtgctgcactgtgaccaccaggccttcctgcacgccagcgagagcgcccagcccagcgaggagatgaagacagtgctgaaccctgagtacctggagcatgatgcctatgctgtgttcagccagctgatggagacagctgagccctggttcagcacctttgaacatgatggccagaagggcaaggagaccctgatgacccccatcccctttgcccggccccaggacctgggccccaccatcgccatcgtgaccaaggtgaaccagatccaggaccacctgctgaagaagcatgacatcgagctgtacatgcacctgaaccggctggagatcgccccccagatctacggcctgcgctgggtgcggctgctgtttggccgggagttccccctgcaggacctgctggtggtgtgggatgccctgtttgctgatggcctgagcctgggcctggtggactacatctttgtggccatgctgctgtacatcagagatgccctgatcagcagcaactaccagacctgcctgggcctgctgatgcactaccccttcatcggagatgtgcacagcctcatcctgaaggccctcttcctgcgggaccccaagaggaaccccaggcctgtgacctaccagttccaccccaacctggactactacaaggcccggggagctgacctgatgaacaagagcaggaccaatgccaagggggcccccctgaacatcaacaaggtgagcaacagcctcatcaactttggaaggaagctgatcagccctgccatggcccctggcagcgctgggggccctgtgcctgggggcaacagcagcagcagcagctctgtggtgatccccaccaggaccagcgctgaggcccccagccaccacctgcagcagcagcagcagcagcagaggctgatgaagtctgagagcatgcctgtgcagctgaacaagggcctgagcagcaagaacatcagcagcagccccagcgtggagagcctgcccggcggccgggagttcaccggcagcccccccagcagcgccaccaagaaggacagcttcttcagcaacatcagccgcagccgcagccacagcaagaccatgggcaggaaggagagcgaggaggagctggaggcccagatctccttcctgcagggccagctgaatgacctggatgccatgtgcaagtactgtgccaaggtgatggacacccacctggtgaacatccaggacgtcatcctgcaggagaacctggagaaggaggaccagatcctggtgtccctggccggcctgaagcagatcaaggacatcctgaagggcagcctgcgcttcaaccagagccagctggaggccgaggagaatgagcagatcaccatcgctgacaaccactactgcagcagcggccagggccagggccggggccagggccagagcgtgcagatgtctggggccatcaagcaggccagcagcgagaccccaggctgcacagaccggggcaacagtgatgacttcatcctgatcagcaaggatgatgatggcagcagcgcccggggcagcttcagcggccaggcccagcccctgcggaccctgcggagcaccagcggcaagagccaggcccctgtgtgcagccccctggtgttcagtgaccccctgatgggccctgccagcgccagcagcagcaaccccagcagcagcccagatgatgacagcagcaaggacagcggcttcaccatcgtgagccccctggacatctag

SEQ ID NO: 42573 - DNA, 552 bp, Artificial Sequence
  Description of Artificial Sequence: Synthetic coding sequence
atgtaccacagcctgtctgagaccaggcaccccctgcagcctgaggagcaggaggtgggcatcgaccccctgagcagctacagcaacaagtctggaggagacagcaacaagaatggccgccgcaccagcagcaccctggacagcgagggcaccttcaacagctacaggaaggagtgggaggagctgtttgtgaacaacaactacctggccaccatccggcagaagggcatcaatggccagctgcggagcagccgcttccgcagcatctgctggaagctgttcctgtgtgtgctgccccaggacaagagccagtggatcagcagaattgaggagctgcgggcctggtacagcaacatcaaggagatccacatcaccaaccccaggaaggtggtgggccagcaggacctgatgatcaacaaccccctgagccaggatgagggcagcctgtggaacaagttcttccaggacaaggagctgcgctccatgattgagcaggatgtgaagaggaccttccctgagatgcagttcttccagcaggagaatgtgaggtag

SEQ ID NO: 42574 - DNA, 2388 bp, Artificial Sequence; identical to SEQ ID NO: 42572
  Description of Artificial Sequence: Synthetic coding sequence

SEQ ID NO: 42575 - DNA, 267 bp, Artificial Sequence
  Description of Artificial Sequence: Synthetic coding sequence
atgtaccacagcctgtctgagaccaggcaccccctgcagcctgaggagcaggaggtgggcatcgaccccctgagcagctacagcaacaagtctggaggagacagcaacaagaatggccgccgcaccagcagcaccctggacagcgagggcaccttcaacagctacaggaaggagtgggaggagctgtttgtgaacaacaactacctggccaccatccggcagaagggcatcaatggccagctgcggagcagccgcttccgctcctag

SEQ ID NO: 42576 - DNA, 3423 bp, Artificial Sequence
  Description of Artificial Sequence: Synthetic coding sequence
atgtggctgaagccagaggaggtgctgctgaagaatgccctgaagctgtgggtgacccagaagagcagctgctacttcatcctgcagaggagaagaggccacggggagggcggcggccgcctgaccggccgcctggtgggcgccctggatgctgtgctggacagcaatgcccgggtggcccccttccgcatcctgctgcaggtgcccggcagccaggtgtacagccccatcgcctgtggggccaccctggaggagatcaaccagcactgggactggctggagcagaacctgctgcacaccctgtctgtgtttgacaacaaggatgacatcgccagctttgtgaagggcaaggtgaaggccctgattgctgaggagaccagcagccggctggccgagcaggaggaggagcctgagaagttccgggaggccctggtgaagtttgaggcccgcttcaacttccctgaggccgagaagctggtgacctactacagctgctgctgctggaagggccgggtgccccggcagggctggctgtacctgagcatcaaccacctgtgcttctacagcttcttcctgggcaaggagctgaagctggtggtgccctgggtggacatccagaagctggagaggaccagcaatgtgttcctgacagacaccatccgcatcaccacccagaacaaggagcgggacttctccatgttcctgaacctggatgaggtgttcaaggtgatggagcagctggctgatgtgaccctgcggcggctgctggacaatgaggtgtttgacctggaccctgacctgcaggagcccagccagatcaccaagagggacctggaggcccgggcccagaatgagttcttccgggccttcttccggctgcccaggaaggagaagctgcatgctgtggtggactgcagcctgtggacccccttcagccgctgccacaccactggaaggatgtttgccagtgacagctacatctgctttgccagcagagaagatggctgctgcaagatcatcctgcccctgcgggaggtggtgtccattgagaagatggaggacaccagcctgctgccccaccccatcatcgtgtccatccgcagcaaggtggccttccagttcatcgagctgcgggaccgggacagcctggtggaggccctgctggcccggctgaagcaggtgcacgccaaccaccctgtgcactatgacaccagcgcagatgatgacatggccagcctggtgttccacagcacctccatgtgcagcgaccacagatttggagacctggagatgatgagcagccagaacagcgaggagagcgagaaggagaagagccccctgatgcacccagatgccctggtgacagccttccagcagagcggcagccagagcccagacagcaggatgagccgggagcagatcaagatcagcctgtggaatgaccactttgtggagtatggccgcacagtgtgcatgttcagaacagagaagatcaggaagctggtggccatgggcatccctgagagcctgcggggccgcctgtggctgctcttcagtgatgctgtgacagacctggccagccaccctggctactacggcaacctggtggaggagagcctgggcaagtgctgcctggtgacagaggagattgaaagagacctgcacaggagcctgcctgagcacccagccttccagaatgagaccggcattgctgccctgcggcgggtgctgacagcctatgcccacaggaaccccaagattggctactgccagagcatgaacatcctgacctctgtgctgctgctgtacaccaaggaggaggaggccttctggctgctggtggccgtgtgtgagaggatgctgcctgactacttcaaccacagggtcatcggggcccaggtggaccagagcgtgtttgaggagctgatcaagggccacctgcctgagctggccgagcacatgaatgacctgagcgccctggcctctgtgtccctgtcctggttcctgaccctcttcctgagcatcatgcccctggagagcgctgtgaatgtggtggactgcttcttctatgatggcatcaaggccatcttccagctgggcctggccgtgctggaggccaatgctgaggacctgtgcagcagcaaggatgatggccaggccctgatgatcctgagccgcttcctggaccacatcaagaatgaagacagccctggcccccctgtgggcagccaccacgccttcttcagtgatgaccaggagccctaccctgtgacagacatcagtgacctgatccgggacagctatgagaagtttggagaccagagcgtggagcagatcgagcacctgcgctacaagcaccgcatccgggtgctgcagggccacgaggacaccaccaagcagaatgtgctgcgggtggtgattcctgaggtgtccatcctgcctgaggacctggaggagctgtatgacctcttcaagcgggagcacatgatgagctgctactgggagcagccccggcccatggccagcagacatgaccccagccggccctatgcagagcagtacagaattgatgcccggcagtttgcccacctgttccagctggtgagcccctggacctgtggggcccacacagagatcctggccgagaggaccttccggctgctggatgacaacatggaccagctgattgagttcaaggcctttgtgtcctgcctggacatcatgtacaacggggagatgaatgagaagatcaagctgctgtaccgcctgcacatccccccagccctgacagaaaatgaccgggacagccagagccccctgaggaaccccctgctgagcaccagccggcccctggtgtttgggaagcccaatggagatgctgtggactaccagaagcagctgaagcagatgatcaaggacctggccaaggagaaggacaagacagagaaggagctgcccaagatgagccagcgggagttcatccagttctgcaagaccctgtacagcatgtttcatgaggaccctgaggagaatgacctgtaccaggccatcgccaccgtgaccaccctgctgctgcagattggagaggtgggccagaggggcagcagcagcggcagctgcagccaggagtgtggggaggagctgcgggccagcgcccccagccctgaggacagcgtgtttgctgacaccgggaagaccccccaggacagccaggccttccctgaggccgctgagcgggactggacagtgtccctggagcacatcctggccagcctgctgacagagcagagcctggtgaacttctttgagaagcccctggacatgaagagcaagctggagaatgccaagatcaaccagtacaacctgaagacctttgagatgagccaccagagccagagcgagctgaagctgagcaacctgtag

SEQ ID NO: 42577 - DNA, 3468 bp, Artificial Sequence
  Description of Artificial Sequence: Synthetic coding sequence
atgtggctgaagccagaggaggtgctgctgaagaatgccctgaagctgtgggtgacccagaagagcagctgctacttcatcctgcagaggagaagaggccacggggagggcggcggccgcctgaccggccgcctggtgggcgccctggatgctgtgctggacagcaatgcccgggtggcccccttccgcatcctgctgcaggtgcccggcagccaggtgtacagccccatcgcctgtggggagctgctgaatggaagtgatgtgtactgggccatcgccaccggggccaccctggaggagatcaaccagcactgggactggctggagcagaacctgctgcacaccctgtctgtgtttgacaacaaggatgacatcgccagctttgtgaagggcaaggtgaaggccctgattgctgaggagaccagcagccggctggccgagcaggaggaggagcctgagaagttccgggaggccctggtgaagtttgaggcccgcttcaacttccctgaggccgagaagctggtgacctactacagctgctgctgctggaagggccgggtgccccggcagggctggctgtacctgagcatcaaccacctgtgcttctacagcttcttcctgggcaaggagctgaagctggtggtgccctgggtggacatccagaagctggagaggaccagcaatgtgttcctgacagacaccatccgcatcaccacccagaacaaggagcgggacttctccatgttcctgaacctggatgaggtgttcaaggtgatggagcagctggctgatgtgaccctgcggcggctgctggacaatgaggtgtttgacctggaccctgacctgcaggagcccagccagatcaccaagagggacctggaggcccgggcccagaatgagttcttccgggccttcttccggctgcccaggaaggagaagctgcatgctgtggtggactgcagcctgtggacccccttcagccgctgccacaccaccggccgcatgtttgccagtgacagctacatctgctttgccagccgggaggatggctgctgcaagatcatcctgcccctgcgggaggtggtgtccattgagaagatggaggacaccagcctgctgccccaccccatcatcgtgtccatccgcagcaaggtggccttccagttcatcgagctgcgggaccgggacagcctggtggaggccctgctggcccggctgaagcaggtgcacgccaaccaccctgtgcactatgacaccagcgcagatgatgacatggccagcctggtgttccacagcacctccatgtgcagcgaccacagatttggagacctggagatgatgagcagccagaacagcgaggagagcgagaaggagaagagccccctgatgcacccagatgccctggtgacagccttccagcagagcggcagccagagcccagacagcaggatgagccgggagcagatcaagatcagcctgtggaatgaccactttgtggagtatggccgcacagtgtgcatgttcagaacagagaagatcaggaagctggtggccatgggcatccctgagagcctgcggggccgcctgtggctgctcttcagtgatgctgtgacagacctggccagccaccctggctactacggcaacctggtggaggagagcctgggcaagtgctgcctggtgacagaggagattgagcgggacctgcacaggagcctgcctgagcacccagccttccagaatgaaacaggaattgctgccctgcggcgggtgctgacagcctatgcccacaggaaccccaagattggctactgccagagcatgaacatcctgacctctgtgctgctgctgtacaccaaggaggaggaggccttctggctgctggtggccgtgtgtgagaggatgctgcctgactacttcaaccaccgggtgattggagcccaggtggaccagagcgtgtttgaggagctgatcaagggccacctgcctgagctggccgagcacatgaatgacctgagcgccctggcctctgtgtccctgtcctggttcctgaccctcttcctgagcatcatgcccctggagagcgctgtgaatgtggtggactgcttcttctatgatggcatcaaggccatcttccagctgggcctggccgtgctggaggccaatgctgaggacctgtgcagcagcaaggatgatggccaggccctgatgatcctgagccgcttcctggaccacatcaagaatgaagacagccctggcccccctgtgggcagccaccacgccttcttcagtgatgaccaggagccctaccctgtgacagacatcagtgacctgatccgggacagctatgagaagtttggagaccagagcgtggagcagatcgagcacctgcgctacaagcaccgcatccgggtgctgcagggccacgaggacaccaccaagcagaatgtgctgcgggtggtgattcctgaggtgtccatcctgcctgaggacctggaggagctgtatgacctcttcaagcgggagcacatgatgagctgctactgggagcagccccggcccatggccagcagacatgaccccagccggccctatgcagagcagtacagaattgatgcccggcagtttgcccacctgttccagctggtgagcccctggacctgtggggcccacacagagatcctggccgagaggaccttccggctgctggatgacaacatggaccagctgattgagttcaaggcctttgtgtcctgcctggacatcatgtacaatggagagatgaatgagaagatcaagctgctgtaccgcctgcacatccccccagccctgacagaaaatgaccgggacagccagagccccctgaggaaccccctgctgagcaccagccggcccctggtgtttgggaagcccaatggagatgctgtggactaccagaagcagctgaagcagatgatcaaggacctggccaaggagaaggacaagacagagaaggagctgcccaagatgagccagcgggagttcatccagttctgcaagaccctgtacagcatgtttcatgaagatcctgaagaaaatgacctgtaccaggccatcgccaccgtgaccaccctgctgctgcagatcggggaggtgggccagaggggcagcagcagcggcagctgcagccaggagtgtggggaggagctgcgggccagcgcccccagcccagaagattctgtgtttgctgacaccgggaagaccccccaggacagccaggccttccctgaggccgctgagcgggactggacagtgtccctggagcacatcctggccagcctgctgacagagcagagcctggtgaacttctttgagaagcccctggacatgaagagcaagctggagaatgccaagatcaaccagtacaacctgaagacctttgagatgagccaccagagccagagcgagctgaagctgagcaacctgtag

SEQ ID NO: 42578 - DNA, 1899 bp, Artificial Sequence
  Description of Artificial Sequence: Synthetic coding sequence
atgtggctgaagccagaggaggtgctgctgaagaatgccctgaagctgtggctgatggagaggagcaatgactactttgtgctgcagaggagaagaggctacggggaggagggcggcggcggcctgaccggcctgctggtgggcaccctggacagcgtgctggacagcacagccaaggtggcccccttccgcatcctgcaccagaccccagacagccaggtgtacctgagcatcgcctgtggggccaaccgggaggagatcaccaagcactgggactggctggagcagaacatcatgaagaccctgtctgtgtttgacagcaatgaagacatcaccaactttgtgcagggcaagatccggggcctgattgctgaggagggcaagcactgctttgccaaggaggatgatcctgagaagttccgggaggccctgctgaagtttgagaagtgcttcggcctgcctgagaaggagaagctggtgacctactacagctgcagctactggaagggccgggtgccctgccagggctggctgtacctgagcaccaacttcctgtccttctacagcttcctgctgggcagcgagatcaagctgatcatctcctgggatgaggtgtccaagctggagaagaccagcaatgtcatcctgacagagagcatccacgtgtgcagccagggcgagaaccactacttctccatgttcctgcacatcaaccagacctacctgctgatggagcagctggccaactatgccatcagaagactctttgacaaggagacctttgacaatgaccctgtgctgtacaaccccctgcagatcaccaagaggggcctggagaacagagcccacagcgagcagttcaatgccttcttccggctgcccaagggggagagcctgaaggaggtgcatgagtgcttcctgtgggtgcccttcagccacttcaacacccacggcaagatgtgcatcagcgagaactacatctgctttgccagccaggacggcaaccagtgcagcgtcatcatccccctgcgggaggtgctggccatcgacaagaccaatgacagcagcaagagcgtcatcatcagcatcaagggcaagacagccttccgcttccacgaggtgaaggactttgagcagctggtggccaagctgcggctgcgctgtggggccgccagcacccagtaccatgacatcagcacagagctggccatcagcagcgagagcacagagcccagcgacaactttgaggtgcagagcctgaccagccagagagaatgttccaagacagtgaacacagaggccctgatgacagtgttccacccccagaacctggagaccctgaacagcaagatgctgaaggagaagatgaaggagcagagctggaagatcctgtttgctgaatgtggccggggcgtgtccatgttccgcaccaagaagacccgggacctggtggtgcggggcatccctgagaccctgcggggggagctgtggatgctgttctctggagctgtgaatgacatggccaccaacccagactactacacagaggtggtggagcagagcctgggcacctgcaacctggccacagaggagattgaaagagacctgcggcgcagcctgcctgagcacccagccttccagagcgacaccggcatcagcgccctgcggcgggtgctgacagcctatgcctacagaaaccccaagattggctactgccaggccatgaacatcctgacctctgtgctgctgctgtatgccaaggaggaggaggccttctggctgctggtggccgtgtgtgagaggatgctgcctgactacttcaacagacgcatcatcggcagtgatgacttcatgcccctggtgcgcatccagggccagtgtgtgattggagagaagtag

SEQ ID NO: 42579 - DNA, 3363 bp, Artificial Sequence
  Description of Artificial Sequence: Synthetic coding sequence
atgtggctgaagccagaggaggtgctgctgaagaatgccctgaagctgtggctgatggagaggagcaatgactactttgtgctgcagaggagaagaggctacggggaggagggcggcggcggcctgaccggcctgctggtgggcaccctggacagcgtgctggacagcacagccaaggtggcccccttccgcatcctgcaccagaccccagacagccaggtgtacctgagcatcgcctgtggggccaaccgggaggagatcaccaagcactgggactggctggagcagaacatcatgaagaccctgtctgtgtttgacagcaatgaagacatcaccaactttgtgcagggcaagatccggggcctgattgctgaggagggcaagcactgctttgccaaggaggatgatcctgagaagttccgggaggccctgctgaagtttgagaagtgcttcggcctgcctgagaaggagaagctggtgacctactacagctgcagctactggaagggccgggtgccctgccagggctggctgtacctgagcaccaacttcctgtccttctacagcttcctgctgggcagcgagatcaagctgatcatctcctgggatgaggtgtccaagctggagaagaccagcaatgtcatcctgacagagagcatccacgtgtgcagccagggcgagaaccactacttctccatgttcctgcacatcaaccagacctacctgctgatggagcagctggccaactatgccatcagaagactctttgacaaggagacctttgacaatgaccctgtgctgtacaaccccctgcagatcaccaagaggggcctggagaacagagcccacagcgagcagttcaatgccttcttccggctgcccaagggggagagcctgaaggaggtgcatgagtgcttcctgtgggtgcccttcagccacttcaacacccacggcaagatgtgcatcagcgagaactacatctgctttgccagccaggacggcaaccagtgcagcgtcatcatccccctgcgggaggtgctggccatcgacaagaccaatgacagcagcaagagcgtcatcatcagcatcaagggcaagacagccttccgcttccacgaggtgaaggactttgagcagctggtggccaagctgcggctgcgctgtggggccgccagcacccagtaccatgacatcagcacagagctggccatcagcagcgagagcacagagcccagcgacaactttgaggtgcagagcctgaccagccagagagaatgttccaagacagtgaacacagaggccctgatgacagtgttccacccccagaacctggagaccctgaacagcaagatgctgaaggagaagatgaaggagcagagctggaagatcctgtttgctgaatgtggccggggcgtgtccatgttccgcaccaagaagacccgggacctggtggtgcggggcatccctgagaccctgcggggggagctgtggatgctgttctctggagctgtgaatgacatggccaccaacccagactactacacagaggtggtggagcagagcctgggcacctgcaacctggccacagaggagattgaaagagacctgcggcgcagcctgcctgagcacccagccttccagagcgacaccggcatcagcgccctgcggcgggtgctgacagcctatgcctacagaaaccccaagattggctactgccaggccatgaacatcctgacctctgtgctgctgctgtatgccaaggaggaggaggccttctggctgctggtggccgtgtgtgagaggatgctgcctgactacttcaacagacgcatcatcggggccctggtggaccaggccgtgtttgaggagctgatccgggaccacctgccccagctgacagagcacatgacagacatgaccttcttcagctctgtgtccctgtcctggttcctgaccctcttcatctctgtgctgcccatcgagagcgctgtgaatgtggtggactgcttcttctatgatggcatcaaggccatcctgcagctgggcctggccatcctggactacaacctggacaagctgctgacctgcaaggatgatgctgaggccgtgacagccctgaaccgcttctttgacaacgtgaccaacaaggacagccccctgcccagcaatgtgcagcagggcagcaatgtgtctgatgagaagaccagccacaccagggtggacatcacagacctgatccgggagagcaatgagaagtatggcaacatccgctatgaggacatccacagcatgcgctgcaggaaccggctgtatgtgatccagaccctggaggagaccaccaagcagaatgtgctgcgggtggtgtcccaggatgtgaagctgagcctgcaggagctggatgagctgtatgtgatcttcaagaaggagctgttcctgagctgctactggtgcctgggctgccctgtgctgaagcaccacgaccccagcctgccctacctggagcagtaccagattgactgccagcagttccgggccctgtaccacctgctgagcccctgggcccacagcgccaacaaggacagcctggccctgtggaccttccggctgctggatgagaacagcgactgcctgatcaacttcaaggagttcagcagcgccatcgacatcatgtacaacggcagcttcacagagaagctgaagctgctcttcaagctgcacatccccccagcctacacagaggtgaagagcaaggatgccagcaaaggagatgagctgagcaaggaggagctgctgtacttcagccagctgcacgtgtccaagccagccaatgagaaggaggccgagagcgccaagcacagccctgagaagggcaagggcaagattgacatccaggcctacctgagccagtggcaggatgagctgttcaagaaggaggagaacatcaaggacctgcccaggatgaaccagagccagttcatccagttcagcaagaccctgtacaacctcttccatgaagatcctgaggaggagagcctgtaccaggccatcgctgtggtgaccagcctgctgctgaggatggaggaggtgggcaggaagctgcacagccccaccagcagcgccaagggcttcagcggcaccgtgtgtggcagcggcggccccagcgaggagaagacaggcagccacctggagaaggacccctgcagcttccgggaggagccccagtggagctttgcctttgagcagatcctggccagcctgctgaatgagcccgccctggtgcgcttctttgagaagcccattgatgtgaaggccaagctggagaatgcccgcatcagccagctgcggagcaggaccaagatgtag

SEQ ID NO: 42580 - DNA, 654 bp, Artificial Sequence
  Description of Artificial Sequence: Synthetic coding sequence
ttcaaccgcttctttgacaacgtgaccaacaaggacagccccctgcccagcaatgtgcagcagggcagcaatgtgtctgatgagaagaccagccacaccagggtggacatcacagacctgatccgggagagcaatgagctgcgggtggtgtcccaggatgtgaagctgagcctgcaggagctggatgagctgtatgtgatcttcaagaaggagctgttcctgagctgctactggtgcctgggctgccctgtgctgaagcaccacgaccccagcctgccctacctggagcagtaccagattgactgccagcagttccgggccctgtaccacctgctgagcccctgggcccacagcgccaacaaggacagcctggccctgtggaccttccggctgctggatgagaacagcgactgcctgatcaacttcaaggagttcagcagcgccatcgacatcatgtacaacggcagcttcacagagaagctgaagctgctcttcaagctgcacatccccccagcctacacagaggtgaagagcaaggatgccagcaaaggagatgagctgagcaaggaggagctgctgtacttcagccagctgcacgtgtccaagccagccaatgagaaggaggccgagagcgccaagcacagccctgagtag

SEQ ID NO: 42581 - DNA, 3801 bp, Artificial Sequence
  Description of Artificial Sequence: Synthetic coding sequence
atgtgggtgaaccctgaggaggtgctgctggccaatgccctgtggatcacagagcgggccaacccctacttcatcctgcagaggaggaagggccatgctggagatggcggcggcggcggcggcctggccggcctgctggtgggcaccctggatgtggtgctggacagcagcgcccgggtggccccctaccgcatcctgtaccagaccccagacagcctggtgtactggaccatcgcctgtggcggcagcaggaaggagatcacagagcactgggagtggctggagcagaacctgctgcagaccctgagcatctttgaaaatgaaaatgacatcaccacctttgtgcggggcaagatccagggcatcatcgccgagtacaacaagatcaatgatgtgaaggaggatgatgacacagagaagttcaaggaggccatcgtgaagttccaccggctgtttggcatgcctgaggaggagaagctggtgaactactacagctgcagctactggaagggcaaggtgccccggcagggctggatgtacctgagcatcaaccacctgtgcttctacagcttcctgatgggccgggaggccaagctggtgatccgctgggtggacatcacccagctggagaagaatgccaccctgctgctgcctgatgtgatcaaggtgtccaccaggagcagcgagcacttcttctctgtgttcctgaacatcaatgagaccttcaagctgatggagcagctggccaacatcgccatgaggcagctgctggacaatgaaggatttgagcaggacaggagcctgcccaagctgaagaggaagagccccaagaaggtgtctgccctgaagagggacctggatgcccgggccaagtctgagcgctaccgggccctcttccggctgcccaaggatgagaagctggatggccacacagactgcaccctgtggacccccttcaacaagatgcacatcctgggccagatgtttgtgtccaccaactacatctgcttcaccagcaaggaggagaacctgtgcagcctcatcatccccctgcgggaggtgaccatcgtggagaaggctgacagcagctctgtgctgcccagccccctgagcatcagcaccaggaacaggatgaccttcctgtttgccaacctgaaggaccgggacttcctggtgcagaggatcagtgacttcctgcagcagaccaccagcaagatctacagcgacaaggagtttgctggcagctacaacagcagtgatgatgaggtgtacagccggcccagcagcctggtgagcagcagcccccagaggagcaccagcagtgatgctgatggagagcggcagttcaacctgaatggaaattctgtgcccacagccacccagaccctgatgaccatgtacagaagaagaagccctgaggagttcaaccccaagctggccaaggagttcctgaaggagcaggcctggaagatccactttgctgaatatggccagggcatctgcatgtacagaacagagaagacccgggagctggtgctgaagggcatccctgagagcatgagaggagagctgtggctgctgctgagcggggccatcaatgagaaggccacccaccctggctactatgaggacctggtggagaagtccatgggcaagtacaacctggccacagaggagattgaaagagacctgcacaggagcctgcctgagcacccagccttccagaatgagatgggcattgctgccctgcggcgggtgctgacagcctatgccttcaggaaccccaacatcggctactgccaggccatgaacatcgtgacctctgtgctgctgctgtatgccaaggaggaggaggccttctggctgctggtggccctgtgtgagaggatgctgcctgactactacaacaccagggtggtgggcgccctggtggaccagggcgtgtttgaggagctggcccgggactatgtgccccagctgtatgactgcatgcaggacctgggcgtcatcagcaccatcagcctgtcctggttcctgaccctcttcctgtctgtgatgccctttgagagcgctgtggtggtggtggactgcttcttctatgagggcatcaaggtgatcttccagctggccctggccgtgctggatgccaacgtggacaagctgctgaactgcaaggatgatggagaggccatgacagtgctgggccgctacctggacagcgtgaccaacaaggacagcaccctgccccccatcccccacctgcacagcctgctgagtgatgatgtggagccctacccagaggtggacatcttccgcctcatccgcaccagctatgagaagtttggcaccatccgggctgacctgattgagcagatgaggttcaagcagaggctgaaggtgatccagaccctggaggacaccaccaagagaaatgtggtgaggaccatcgtgacagagaccagcttcaccattgatgagctggaggagctgtatgccctcttcaaggccgagcacctgaccagctgctactggggcggcagcagcaatgccctggacagacatgaccccagcctgccctacctggagcagtacagaattgactttgagcagttcaagggcatgtttgccctgctcttcccctgggcctgtggcacccacagtgatgtgctggccagccgcctcttccagctgctggatgaaaatggagacagcctcatcaacttccgggagtttgtgtctggcctgtctgctgcctgccacggggacctgacagagaagctgaagctgctgtacaagatgcacgtgctgcctgagcccagcagtgaccaggatgagccagacagcgcctttgaggccacccagtacttctttgaggacatcaccccagaatgtacccacgtggtgggcctggacagccgcagcaagcagggcgcagatgatggctttgtgacagtgtccctgaagccagacaagggcaagagggccaacagccaggagaacagaaactacctgcggctgtggaccccagagaacaagagcaagagcaagaatgccaaggacctgcccaagctgaaccagggccagttcatcgagctgtgcaagaccatgtacaacatgttttctgaggaccccaatgagcaggagctgtaccacgccacagctgctgtgaccagcctgctgctggagattggagaggtgggcaagctgtttgtggcccagcctgccaaggagggcggcagcggcggcagcggccccagctgccaccagggcatccctggggtgctcttccccaagaagggccctggccagccctacgtggtggagagcgtggagcccctgcctgccagcctggccccagattctgaggagcacagcctgggcggccagatggaggacatcaagctggaggacagcagcccccgggacaatggagcctgcagctccatgctgatcagtgatgatgacaccaaggatgacagctccatgagcagctacagcgtgctgtctgctggcagccatgaggaggacaagctgcactgtgaagatattggagaagatactgtgctggtgcgcagcggccagggcacagctgccctgcccaggagcaccagcctggaccgggactgggccatcacctttgagcagttcctggccagcctgctgacagagcccgccctggtgaagtactttgacaagcctgtgtgcatgatggcccgcatcaccagcgccaagaacatccgcatgatgggcaagcccctgaccagcgccagtgactatgagatcagcgccatgtctggatag

SEQ ID NO: 42582 - DNA, 1848 bp, Artificial Sequence
  Description of Artificial Sequence: Synthetic coding sequence
atggagagcatgtttgaagatgacatcagcatcctgacccaggaggccctgggccccagcgaggtgtggctggacagccctggggaccccagcctgggcggggacatgtgcagcgccagccactttgccctgatcacagcctacggggacatcaaggagcggctgggcggcctggagagagaaaatgccaccctgcggcggcggctgaaggtgtatgagatcaagtaccccctcatcagtgactttggagaggagcacggcttcagcctgtatgagatcaaggatggcagcctgctggaggtggagaaggtgtccctgcagcagaggctgaaccagttccagcacgagctgcagaagaacaaggagcaggaggagcagctgggggagatgatccaggcctatgagaagctgtgtgtggagaagagtgacctggagacagagctgcgggagatgagggccctggtggagacccacctgcggcagatctgtggcctggagcagcagctgcggcagcagcagggcctgcaggatgctgccttcagcaacctgagccccccaccagccccagccccaccctgcacagacctggacctgcactacctggccctgcggggcggcagcggcctgagccacgccggctggccaggcagcacccccagcgtgtctgacctggagcggcggcggctggaggaggccctggaggccgcccagggcgaggcccggggggcccagctgcgggaggagcagctgcaggctgaatgtgagcggctgcagggcgagctgaagcagctgcaggagacccgggcccaggacctggccagcaaccagagcgagcgggacatggcctgggtgaagagggtgggagatgaccaggtgaacctggccctggcctacacagagctgacagaggagctgggccgcctgcgggagctgagcagcctgcagggccgcatcctgcggaccctgctgcaggagcaggcccggagcggcggccagaggcacagccccctgagccagaggcacagccctgccccccagtgccccagccccagccccccagcccgggccgccccaccctgccccccctgccagagccctgtgccccagaggaggagccctgtgcccccctgccccagcccccagcagaggaggagccctgccagccccagctgccccagccctgtgccccagaggaggagccctgtgccccccagctgccagagccccagcccccagaggaggagccctgtgccccccagctgcccagccccccagccccggcccccacctcctcctcctcctggagagaggaccctggccgagcgggcctatgccaagccacccagccaccacgtgaaggccggcttccagggcagaagaagctacagcgagctggccgagggcgccgcctatgctggggccagccccccctggctgcaggccgaggccgccaccctgcccaagccccgggcctacggcagcgagctgtatggccctggccggcccctgagcccccggcgggcctttgagggcatccggctgcgctttgagaagcagcccagtgaagaagatgagtgggccgtgcccaccagcccccccagccctgaggtgggcaccatccgctgtgccagcttctgtgccggcttccccatccctgagagccctgctgccacagcctatgcccatgctgagcacgcccagagctggcccagcatcaacctgctgatggagaccgtgggcagtgacatccgcagctgccccctgtgccagctgggcttccctgtgggctacccagatgatgccctgatcaagcacatcgacagccacctggagaacagcaagatctag

SEQ ID NO: 42583 - DNA, 672 bp, Artificial Sequence
  Description of Artificial Sequence: Synthetic coding sequence
atggagagcatgtttgaagatgacatcagcatcctgacccaggaggccctgggccccagcgaggtgtggctggacagccctggggaccccagcctgggcggggacatgtgcagcgccagccactttgccctgatcacagcctacggggacatcaaggagcggctgggcggcctggagagagaaaatgccaccctgcggcggcggctgaaggtgtatgagatcaagtaccccctcatcagtgactttggagaggagcacggcttcagcctgtatgagatcaaggatggcagcctgctggaggtggagaaggtgtccctgcagcagaggctgaaccagttccagcacgagctgcagaagaacaaggagcaggaggagcagctgggggagatgatccaggcctatgagaagctgtgtgtggagaagagtgacctggagacagagctgcgggagatgagggccctggtggagacccacctgcggcagatctgtggcctggagcagcagctgcggcagcagcagggcctgcaggatgctgccttcagcaacctgagccccccaagaagagcccgggctgtgctggccgtgcaccagctggctgatggagatggcggcctgcggcacccccagctgccccccctgcctgctggcttcccctgccgggtgcccggctag

SEQ ID NO: 42584 - DNA, 1062 bp, Artificial Sequence
  Description of Artificial Sequence: Synthetic coding sequence
atgctggagggccagctggaggcccgggagcccaaggagggcacccaccctgaggacccctgccctggggccggggccgccatggagaagaccccagctgctgctgaggtgccccgggaggacagcaatgctggggagatgcccagcctgcagcagcagatcaccagcctgcaccaggagctgggccggcagcagagcctgtgggccgacatccacaggaagctgcagagccacatggatgccctgaggaagcagaaccgggagctgcgggaggagctgcggggcctgcagaggcagcagtgggaggccggcaagaagccagctgccagcccccatgctggccgggagagccacaccctggccctggagcccgccttcggcaagatcagccccctgtctgcagatgaggagaccacccccaagtatgccggcaggaagagccagagcgccaccctgctgggccagcgctggagcagcaaccacctggccccacccaagcccatgagcctgaagacagagcgcatcaacagcggcaagaccccaccccaggaggaccgggagaagagccccccaggaagacggcaggacaggagccctgcccccaccggccggcccaccccaggagctgagcggcgggaggtgtctgaagatggcaagatcatgcaccccagcagccgcagcctgcagaacagcggcggcaggaagagccctgtgcaggccagccaggccgccaccctgcaggagcagacagctgctgctggggtggccgacaggagcagctctgtgctgggcagcagcgagggcggcttcctgagccgggtgcaggccgaggagtttgccagcagcagcccagacagcgctgagcggcagaacctgcctgtgaacccccccagcagcctggagatcgcccaggccatggacaccaagatgaagaaggaggaggtgcaggaggagaagaggcaccccaacgggaaggcagatgactgccgccgcagcggcttccccagcgagttccctggggccctgcacgccgcccccagccggcaggacatgggcccctag

SEQ ID NO: 42585 - DNA, 1125 bp, Artificial Sequence
  Description of Artificial Sequence: Synthetic coding sequence
atgaaggtggacatggccaactttgccatcagcagcatccggccccacctgatgcagcagagcgtggagtatgaaaggaagaagttccaggagatcctggagcggcagcccaacagcctggactttgtgacccagtggctggaggaggccagcgaggacctgatgacccagaagtacaagcacgccctgcctgtgggcggcatggccgccggcagcggggacatgccccggctgagccctgtggccgtgcagaactatgcctacctgaagctgctgaagtgggaccacctgcagaggcccttccctgagaccgtgctgatggaccagagccgcttccacgagctgcagctgcagctggagcagctgaccatcctgggcgctgtgctgctggtgaccttctccatggccgcccctggcatcagcagccaggccgactttgctgagaagctgaagatgattgtgaagatcctgctgacagacatgcacctgcccagcttccacctgaaggatgtgctgaccaccatcggggagaaggtgtgcctggaggtgagcagctgcctgagcctgtgtggcagcagccccttcaccacagacaaggagaccgtgctgaagggccagatccaggccgtggccagcccagatgaccccatccgccgcatcatggagagccgcatcctgaccttcctggagacctacctggccagcggccaccagaagcccctgcccaccgtgcctgggggcctgagccctgtgcagcgggagctggaggaggtggccatcaagtttgcccggctggtgaactacaacaagatggtgttctgcccctactatgatgccatcctgaggaagcgctggatcagctttggaaacttcttcggcagcagcaacacagacatgagcccctggaactgcaggacagactaccccatgagcctgcacatccgcttccccaagaaccacgtgattgaggcccccatgaccatccagctgtgcttccaggagccctgcaacaaggccctgagcctgctgaacatccccctggaggccaagggcatcctggacaggagcttcctgcagaggcggctgaagccctaccgcatccgcttctgctgccgggccctgtag

SEQ ID NO: 42586 - DNA, 1530 bp, Artificial Sequence
  Description of Artificial Sequence: Synthetic coding sequence
atgtctgagaacctggacaagagcaatgtgaatgaagctgggaagagcaagagcaatgattctgaggagggcctggaggatgctgtggagggcgcagatgaggccctgcagaaggccatcaagagtgacagcagcagcccccagagggtgcagaggccccacagcagccccccaagatttgtgacagtggaggagctgctggagacagcccggggcgtgaccaacatggccctggcccacgagatcgtggtgaatggagacttccagatcaagcctgtggagctgcctgagaacagcctgaagaagagggtgaaggagatcgtgcacaaggccttctgggactgcctgtctgtgcagctgtctgaggaccccccagcctatgaccacgccatcaagctggtgggggagatcaaggagaccctgctgtccttcctgctgcccggccacacccggctgaggaaccagatcacagaggtgctggacctggacctgatcaagcaggaggccgagaatggagccctggacatcagcaagctggccgagttcatcatcggcatgatgggcaccctgtgtgccccagccagagatgaggaggtgaagaagctgaaggacatcaaggagatcgtgcccctcttccgggagatcttctctgtgctggacctgatgaaggtggacatggccaactttgccatcagcagcatccggccccacctgatgcagcagagcgtggagtatgaaaggaagaagttccaggagatcctggagcggcagcccaacagcctggactttgtgacccagtggctggaggaggccagcgaggacctgatgacccagaagtacaagcacgccctgcctgtgggcggcatggctgctggcagcggggacatgccccggctgagccctgtggccgtgcagaactatgcctacctgaagctgctgaagtgggaccacctgcagaggcccttccctgagaccgtgctgatggaccagagccgcttccacgagctgcagctgcagctggagcagctgaccatcctgggcgctgtgctgctggtgaccttctccatggccgcccctggcatcagcagccaggccgactttgctgagaagctgaagatgattgtgaagatcctgctgacagacatgcacctgcccagcttccacctgaaggatgtgctgaccaccatcggggagaaggtgtgcctggaggtgagcagctgcctgagcctgtgtggcagcagccccttcaccacagacaaggagaccgtgctgaagggccagatccaggccgtggccagcccagatgaccccatccgccgcatcatggagagccgcatcctgaccttcctggagacctacctggccagcggccaccagaagcccctgcccaccgtgcctgggggcctgagccctgtgcagcgggagctggaggaggtggccatcaagtttgcccggctggtgaactacaacaagatggtgttctgcccctactatgatgccatcctgagcaagatcctggtgcgctcctag

SEQ ID NO: 42587 - DNA, 1530 bp, Artificial Sequence; identical to SEQ ID NO: 42586
  Description of Artificial Sequence: Synthetic coding sequence

SEQ ID NO: 42588 - DNA, 165 bp, Artificial Sequence
  Description of Artificial Sequence: Synthetic coding sequence
atgtctgagaacctggacaagagcaatgtgaatgaagctgggaagagcaagagcaatgattctgaggagggcctggaggatgctgtggagggcgcagatgaggccctgcagaaggccatcaagagtgacagcagcagcccccagagggtgcagaggccccactag

SEQ ID NO: 42589 - DNA, 435 bp, Artificial Sequence
  Description of Artificial Sequence: Synthetic coding sequence
atgtctgagaacctggacaagagcaatgtgaatgaagctgggaagagcaagagcaatgattctgaggagggcctggaggatgctgtggagggcgcagatgaggccctgcagaaggccatcaagagtgacagcagcagcccccagagggtgcagaggccccacagcagccccccaagatttgtgacagtggaggagctgctggagacagcccggggcgtgaccaacatggccctggcccacgagatcgtggtgaatggagacttccagatcaagcctgtggagctgcctgagaacagcctgaagaagagggtgaaggagatcgtgcacaaggccttctgggactgcctgtctgtgcagctgtctgaggaccccccagcctatgaccacgccatcaagctggtgggggagatcaaggagaccctgctgtccttctag

SEQ ID NO: 42590 - DNA, 1530 bp, Artificial Sequence; identical to SEQ ID NO: 42586
  Description of Artificial Sequence: Synthetic coding sequence

SEQ ID NO: 42591 - DNA, 1560 bp, Artificial Sequence
  Description of Artificial Sequence: Synthetic coding sequence
atgcccttcaacggggagaagcagtgtgtgggggaggaccagcccagcgacagcgacagcagccgcttcagcgagagcatggccagcctgagtgactatgagtgcagccggcagagctttgccagtgacagcagcagcaagagcagcagccctgccagcaccagccccccccgggtggtgacctttgatgaggtgatggccacagccaggaacctgagcaacctgaccctggcccatgaaattgctgtgaatgaaaacttccagctgaagcaggaggccctgcctgagaagagcctggccggccgggtgaagcacatcgtgcaccaggccttctgggatgtgctggacagcgagctgaatgctgaccccccagagtttgagcacgccatcaagctgtttgaggagatccgggagatcctgctgtccttcctgacccctgggggcaaccggctgaggaaccagatctgtgaggtgctggacacagacctgatccggcagcaggccgagcacagcgctgtggacatccagggcctggccaactacgtgatcagcaccatgggcaagctgtgtgcccctgtgcgggacaatgacatccgggagctgaaggccaccggcaacatcgtggaggtgctgcggcagatcttccacgtgctggacctgatgcagatggacatggccaacttcaccatcatgagcctgcggccccacctgcagaggcagctggtggagtatgaaagaaccaagttccaggagatcctggaggagacccccagcgccctggaccagaccacagagtggatcaaggagagcgtgaatgaggagctgttcagcctgtctgagagcgccctgaccccaggagctgagaacaccagcaagcccagcctgagccccaccctggtgctgaacaacagctacctgaagctgctgcagtgggactaccagaagaaggagctgcctgagaccctgatgacagatggagcccggctgcaggagctgacagagaagctgaaccagctgaagatcatcgcctgcctgagcctcatcaccaacaacatggtgggcgccatcactggaggcctgcctgagctggccagccggctgacccgcatctctgctgtgctgctggagggcatgaacaaggagaccttcaacctgaaggaggtgctgaacagcatcggcatccagacctgtgtggaggtgaacaagaccctgatggagcggggcctgcccaccctgaatgctgagatccaggccaacctgattggccagttcagcagcattgaggaggaggacaaccccatctggagcctgattgacaagaggatcaagctgtacatgaggcggctgctgtgcctgcccagcccccagaagtgcatgccacccatgcctgggggcctggccgtcatccagcaggagctggaggccctgggcagccagtatgccaacatcgtgaacctgaacaagcaggtgtatggccccttctacgccaacatcctgaggaagctgctcttcaatgaggaggccatgggcaaggtggatgccagcccccccaccaactag

SEQ ID NO: 42592 - DNA, 294 bp, Artificial Sequence
  Description of Artificial Sequence: Synthetic coding sequence
atgcccttcaacggggagaagcagtgtgtgggggaggaccagcccagcgacagcgacagcagccgcttcagcgagagcatggccagcctgagtgactatgagtgcagccggcagagctttgccagtgacagcagcagcaagagcagcagccctgccagcaccagccccccccgggtggtgacctttgatgaggtgatggccacagccaggaacctgagcaacctgaccctggcccatgaaattgctgtgaatgaaaacttccagctgaagcaggaggccctgcctgagaagtag

SEQ ID NO: 42593 - DNA, 57 bp, Artificial Sequence
  Description of Artificial Sequence: Synthetic coding sequence
atgcccttcaacggggagaagcagtgtgtgggggaggaccagcccagcgacagctag

SEQ ID NO: 42594 - DNA, 399 bp, Artificial Sequence
  Description of Artificial Sequence: Synthetic coding sequence
atgcccttcaacggggagaagcagtgtgtgggggaggaccagcccagcgacagcgacagcagccgcttcagcgagagcatggccagcctgagtgactatgagtgcagccggcagagctttgccagtgacagcagcagcaagagcagcagccctgccagcaccagccccccccgggtggtgacctttgatgaggtgatggccacagccaggaacctgagcaacctgaccctggcccatgaaattgctgtgaatgaaaacttccagctgaagcaggaggccctgcctgagaagagcctggccggccgggtgaagcacatcgtgcaccaggccttctgggatgtgctggacagcgagctgaatgctgaccccccagagtttgagcacgccatcaagctgtag

SEQ ID NO: 42595 - DNA, 705 bp, Artificial Sequence
  Description of Artificial Sequence: Synthetic coding sequence
atgcccttcaacggggagaagcagtgtgtgggggaggaccagcccagcgacagcgacagcagccgcttcagcgagagcatggccagcctgagtgactatgagtgcagccggcagagctttgccagtgacagcagcagcaagagcagcagccctgccagcaccagccccccccgggtggtgacctttgatgaggtgatggccacagccaggaacctgagcaacctgaccctggcccatgaaattgctgtgaatgaaaacttccagctgaagcaggaggccctgcctgagaagagcctggccggccgggtgaagcacatcgtgcaccaggccttctgggatgtgctggacagcgagctgaatgctgaccccccagagtttgagcacgccatcaagctgtttgaggagatccgggagatcctgctgtccttcctgacccctgggggcaaccggctgaggaaccagatctgtgaggtgctggacacagacctgatccggcagcaggccgagcacagcgctgtggacatccagggcctggccaactacgtgatcagcaccatgggcaagctgtgtgcccctgtgcgggacaatgacatccgggagctgaaggccaccggcaacatcgtggaggtgctgcggcagatcttccacgtgctggacctgatgcagatggacatggccaacttcaccatcatgagcctgaggtag

SEQ ID NO: 42596 - DNA, 57 bp, Artificial Sequence; identical to SEQ ID NO: 42593
  Description of Artificial Sequence: Synthetic coding sequence

SEQ ID NO: 42597 - DNA, 540 bp, Artificial Sequence
  Description of Artificial Sequence: Synthetic coding sequence
atgatgatgtctgacaatgccaagggccgggccgcccacagctggaagaagaggggcagcatcagcagcctgagcaaccacgagttctggaggaaggagatccacggccgcatcaaggacagcatgagcacagtgtcctacatggaggagcccagccagagagatgacatcagccggctgactgtgcagatggagaacacctaccagctgggcccccccaagcacttccctgtggtgacagtgaaccacatcctgaaggatgtggtgaccagctacctgcaggtggaggagtatgagcctgagctgtgccggcagatgaccaagaccatcagcgaggtgatcaaggcccaggtgaaggacctgatgatcccccgctacaagctgattgtgattgtgcacatcggccagctgaaccggcagagcatcctgattggcagccgctgcctgtgggaccccaagagtgacaccttcagcagctatgtgttcaggaacagcagcctgtttgccctggccaacgtgtatgctgtgtacctggagtag

SEQ ID NO: 42598 - DNA, 429 bp, Artificial Sequence
  Description of Artificial Sequence: Synthetic coding sequence
atggccaccagcattggagtgtccttctctgtgggagatggagtgcctgaggccgagaagaatgctggggagcctgagaacacctacatcctgcggcctgtgttccagcagcgcttccggcccagcgtggtgaaggactgcatccatgctgtgctgaaggaggagctggccaatgctgagtacagccctgaggagatgccccagctgaccaagcacctgtctgagaacatcaaggacaagctgaaggagatgggctttgaccgctacaagatggtggtgcaggtggtgattggagagcagagaggagagggcgtcttcatggccagccgctgcttctgggatgctgacacagacaactacacccatgatgtgttcatgaatgacagcctcttctgtgtggtggccgccttcggctgcttctactactag

SEQ ID NO: 42599 - DNA, 255 bp, Artificial Sequence
  Description of Artificial Sequence: Synthetic coding sequence
atggccaccagcattggagtgtccttctctgtgggagatggagtgcctgaggccgagaagaatgctggggagcctgagaacacctacatcctgcggcctgtgttccagcagcgcttccggcccagcgtggtgaaggactgcatccatgctgtgctgaaggaggagctggccaatgctgagtacagccctgaggagatgccccagctgaccaagcacctgtctgagaacatcaaggacaagaagaagaagaagtag

SEQ ID NO: 42600 - DNA, 1053 bp, Artificial Sequence
  Description of Artificial Sequence: Synthetic coding sequence
atgtctgctgcctgctgggaggagccctggggcctgcccggcggctttgccaagagggtgctggtgactggaggagctggcttcatcgccagccacatgattgtgtccctggtggaggactaccccaactacatgatcatcaacctggacaagctggactactgtgccagcctgaagaacctggagaccatcagcaacaagcagaactacaagttcatccagggcgacatctgtgacagccactttgtgaagctgctgtttgaaacagagaagattgacatcgtgctgcactttgctgcccagacccacgtggacctgagctttgtgcgggcctttgagttcacctacgtgaatgtgtatggcacccacgtgctggtgtctgctgcccacgaggcccgggtggagaagttcatctacgtgtccacagatgaggtgtatggaggcagcctggacaaggagtttgatgagagcagccccaagcagcccaccaacccctatgccagcagcaaggctgctgctgagtgctttgtgcagagctactgggagcagtacaagtttcctgtggtgatcaccaggagcagcaatgtgtatggcccccaccagtacccagagaaggtgatccccaagttcatcagcctgctgcagcacaacaggaagtgctgcatccacggcagcggcctgcagaccaggaacttcctgtatgccacagatgtggtggaggccttcctgactgtgctgaagaagggcaagccaggagagatctacaacatcggcaccaactttgagatgtctgtggtgcagctggccaaggagctgatccagctgatcaaggagaccaacagcgagagcgagatggagaactgggtggactatgtgaatgaccggcccaccaatgacatgagataccccatgaagtctgagaagatccacggcctgggctggaggcccaaggtgccctggaaggagggcatcaagaagaccatcgagtggtaccgggagaacttccacaactggaagaatgtggagaaggccctggagcccttccctgtgtag

SEQ ID NO: 42601 - DNA, 4236 bp, Artificial Sequence
  Description of Artificial Sequence: Synthetic coding sequence
atggccagcatcagcgagcctgtgaccttccgggagttctgccccctgtactacctgctgaatgccatccccaccaagatccagaagggcttccgcagcatcgtggtgtacctgacagccctggacaccaacggggactacatcgctgtgggcagcagcatcggcatgctgtacctgtactgccgccacctgaaccagatgaggaagtacaactttgagggcaagacagagagcatcaccgtggtgaagctgctgagctgctttgatgacctggtggccgccggcacagccagcggccgggtggccgtgttccagctggtgagcagcctgcctggaagaaacaagcagctgcggagatttgatgtgacaggcatccacaagaacagcatcacagccctggcctggagccccaacggcatgaagctgttctctggagatgacaagggcaagatcgtgtacagcagcctggacctggaccagggcctgtgcaacagccagctggtgctggaggagcccagcagcatcgtgcagctggactacagccagaaggtgctgctggtgtccaccctgcagaggagcctgctcttctacacagaggagaagtctgtgcggcagatcggcacccagcccaggaagagcacaggcaagtttggagcctgcttcatccctggcctgtgcaagcagagcgacctgaccctgtatgccagccggcccggcctgcggctgtggaaggcagatgtgcacggcaccgtgcaggccaccttcatcctgaaggatgcctttgctgggggcgtgaagccctttgagctgcacccccggctggagagccccaacagcggcagctgcagcctgcctgagcggcacctgggcctggtgtcctgcttcttccaggagggctgggtgctgtcctggaatgagtacagcatctacctgctggacacagtgaaccaggccaccgtggccggcctggagggcagcggggacatcgtgtctgtgtcctgcacagaaaatgagatcttcttcctgaagggggacaggaacatcatccgcatcagcagcaggcctgagggcctgaccagcacagtgagagatggcctggagatgagcggctgcagcgagcgggtgcacgtgcagcaggccgagaagctgcccggggccaccgtgtctgagacccggctgcggggcagctccatggccagctctgtggccagcgagcccaggagccgcagcagcagcctgaacagcacagacagcggcagcggcctgctgcccccaggcctgcaggccaccccagagctgggcaagggcagccagcccctgagccagcgcttcaatgccatcagcagcgaggactttgaccaggagctggtggtgaagcccatcaaggtgaagaggaagaagaagaagaagaagacagagggcggcagccgcagcacctgccacagcagcctggagagcaccccctgcagcgagttccctggggacagcccccagagcctgaacacagacctgctgtccatgaccagctctgtgctgggcagctctgtggaccagctgtctgctgagagcccagaccaggagagcagcttcaatggagaggtgaatggagtgccccaggagaacacagatcctgagaccttcaacgtgctggaggtgtctggctccatgccagacagcctggccgaggaggatgacatcagaacagagatgccccactgccaccacgcccacggccgggagctgctgaatggagccagagaagatgtgggcggcagtgatgtgacaggcctgggagatgagccctgcccagcagatgatggccccaacagcacccagctgcccttccaggagcaggacagcagccctggggcccatgatggagaggacatccagcccatcggcccccagagcaccttctgtgaggtgcccctgctgaacagcctgactgtgcccagcagcctgtcctgggcccccagcgctgagcagtggctgcccggcaccagggcagatgagggcagccctgtggagcccagccaggagcaggacatcctgacctccatggaggccagcggccacctgagcaccaacctgtggcatgctgtgacagatgatgacaccggccagaaggagatccccatcagcgagcgggtgctgggctctgtgggcggccagctgacccctgtgtctgccctggccgccagcacccacaagccctggctggagcagcccccccgggaccagaccctgaccagcagtgatgaggaggacatctatgcccacggcctgcccagcagcagcagcgagacctctgtgacagagctgggccccagctgcagccagcaggacctgagccggctgggcgcagaagatgctggcctgctgaagccagaccagtttgctgagagctggatgggctacagcggccctggctacggcatcctgagcctggtggtgtctgagaagtacatctggtgcctggactacaagggcggcctcttctgcagcgccctgcccggggccggcctgcgctggcagaagtttgaagatgctgtgcagcaggtggccgtgagccccagcggggccctgctgtggaagattgagcagaagagcaacagagcctttgcctgtgggaaggtgaccatcaagggcaagaggcactggtatgaggccctgccccaggccgtgtttgtggccctgagtgatgacacagcctggatcatccgcaccagcggggacctgtacctgcagacaggcctgtctgtggaccggccctgtgcccgggctgtgaaggtggactgcccctaccccctgagccagatcacagccagaaataatgtggtgtgggccctgacagagcagagggccctgctgtaccgggagggcgtgagcagcttctgcccagagggggagcagtggaagtgtgacatcgtgtctgagcggcaggccctggagcctgtgtgcatcaccctgggggaccagcagaccctgtgggccctggacatccacggcaacctgtggttcagaacaggcatcatcagcaagaagccccagggagatgatgaccactggtggcaggtgtccatcacagattatgtggtgtttgaccagtgcagcctcttccagaccatcatccacgccacccacagcgtggccacagctgcccaggcccctgtggagaaggtggccgacaagctgaggatggccttctggagccagcagctgcagtgccagcccagcctgctgggcgtgaacaacagcggcgtgtggatcagcagcggcaagaatgagttccacgtggccaagggcagcctgattggcacctactggaaccacgtggtgccccggggcacagccagcgccaccaagtgggcctttgtgctggccagcgctgcccccaccaaggagggcagcttcctgtggctgtgccagagcagcaaggacctgtgcagcgtgtctgcccagagcgcccagagccggcccagcacagtgcagctgcccccagaggccgagatgagggcctatgctgcctgccaggatgccctgtgggccctggacagcctgggccaggtgttcatccgcaccctgagcaagagctgccccaccggcatgcactggacccggctggacctgagccagctgggcgctgtgaagctgaccagcctggcctgtggcaaccagcacatctgggcctgtgacagcagaggaggagtgtacttccgggtgggcacccagcccctgaaccccagcctgatgctgcctgcctggatcatgattgagccccctgtgcagcctgctggggtgtccctggtgtctgtgcacagcagccccaatgaccagatgctgtgggtgctggacagccgctggaatgtgcacgtgaggacaggcatcacagaggagatgcctgtgggcacagcctgggagcacgtgcccggcctgcaggcctgccagctggccctgagcaccaggacagtgtgggcccgctgccccaacggggacctggccaggagatatggagtgacagacaagaacccagctggggactactggaagaagatccctggctctgtgtcctgcttcaccgtgacagccagtgatgagctgtgggccgtgggccccccaggctacctgctgcagaggctgaccaagaccttcagccacagccacggcacccagaagagcagccaggccgccatgccccaccctgaggacctggaggatgagtgggaggtgatctag

SEQ ID NO: 42602 - DNA, 2202 bp, Artificial Sequence
  Description of Artificial Sequence: Synthetic coding sequence
atggccagcatcagcgagcctgtgaccttccgggagttctgccccctgtactacctgctgaatgccatccccaccaagatccagaagggcttccgcagcatcgtggtgtacctgacagccctggacaccaacggggactacatcgctgtgggcagcagcatcggcatgctgtacctgtactgccgccacctgaaccagatgaggaagtacaactttgagggcaagacagagagcatcaccgtggtgaagctgctgagctgctttgatgacctggtggccgccggcacagccagcggccgggtggccgtgttccagctggtgagcagcctgcctggaagaaacaagcagctgcggagatttgatgtgacaggcatccacaagaacagcatcacagccctggcctggagccccaacggcatgaagctgttctctggagatgacaagggcaagatcgtgtacagcagcctggacctggaccagggcctgtgcaacagccagctggtgctggaggagcccagcagcatcgtgcagctggactacagccagaaggtgctgctggtgtccaccctgcagaggagcctgctcttctacacagaggagaagtctgtgcggcagatcggcacccagcccaggaagagcacaggcaagtttggagcctgcttcatccctggcctgtgcaagcagagcgacctgaccctgtatgccagccggcccggcctgcggctgtggaaggcagatgtgcacggcaccgtgcaggccaccttcatcctgaaggatgcctttgctgggggcgtgaagccctttgagctgcacccccggctggagagccccaacagcggcagctgcagcctgcctgagcggcacctgggcctggtgtcctgcttcttccaggagggctgggtgctgtcctggaatgagtacagcatctacctgctggacacagtgaaccaggccaccgtggccggcctggagggcagcggggacatcgtgtctgtgtcctgcacagaaaatgagatcttcttcctgaagggggacaggaacatcatccgcatcagcagcaggcctgagggcctgaccagcacagtgagagatggcctggagatgagcggctgcagcgagcgggtgcacgtgcagcaggccgagaagctgcccggggccaccgtgtctgagacccggctgcggggcagctccatggccagctctgtggccagcgagcccaggagccgcagcagcagcctgaacagcacagacagcggcagcggcctgctgcccccaggcctgcaggccaccccagagctgggcaagggcagccagcccctgagccagcgcttcaatgccatcagcagcgaggactttgaccaggagctggtggtgaagcccatcaaggtgaagaggaagaagaagaagaagaagacagagggcggcagccgcagcacctgccacagcagcctggagagcaccccctgcagcgagttccctggggacagcccccagagcctgaacacagacctgctgtccatgaccagctctgtgctgggcagctctgtggaccagctgtctgctgagagcccagaccaggagagcagcttcaatggagaggtgaatggagtgccccaggagaacacagatcctgagaccttcaacgtgctggaggtgtctggctccatgccagacagcctggccgaggaggatgacatcagaacagagatgccccactgccaccacgcccacggccgggagctgctgaatggagccagagaagatgtgggcggcagtgatgtgacaggcctgggagatgagccctgcccagcagatgatggccccaacagcaccccccagcacaccacccacctgaccagccaccacagcaccccccaccacaccaccccccactgcaccatcccccaccacatcagcccccaccacagcaccccccaccacaccacccaccacaccccccacaggacagccccccacaggacagccccctacctggccaccagccaccacaccaccccccaccacaccagcctgcccacccatggagctggctgccccccacctggagagcacaccagcgctgagaccgtgaagccagatggctgcaagtggaacctggatgtgtgcacctgtgtgcccggcagagatggcaccggcggctgcatgggccggggcggcgctgagcagggcagcctgacctag

SEQ ID NO: 42603 - DNA, 3804 bp, Artificial Sequence
  Description of Artificial Sequence: Synthetic coding sequence
atggccagcatcagcgagcctgtgaccttccgggagttctgccccctgtactacctgctgaatgccatccccaccaagatccagaagggcttccgcagcatcgtggtgtacctgacagccctggacaccaacggggactacatcgctgtgggcagcagcatcggcatgctgtacctgtactgccgccacctgaaccagatgaggaagtacaactttgagggcaagacagagagcatcaccgtggtgaagctgctgagctgctttgatgacctggtggccgccggcacagccagcggccgggtggccgtgttccagctggtgagcagcctgcctggaagaaacaagcagctgcggagatttgatgtgacaggcatccacaagaacagcatcacagccctggcctggagccccaacggcatgaagctgttctctggagatgacaagggcaagatcgtgtacagcagcctggacctggaccagggcctgtgcaacagccagctggtgctggaggagcccagcagcatcgtgcagctggactacagccagaaggtgctgctggtgtccaccctgcagaggagcctgctcttctacacagaggagaagtctgtgcggcagatcggcacccagcccaggaagagcacaggcaagtttggagcctgcttcatccctggcctgtgcaagcagagcgacctgaccctgtatgccagccggcccggcctgcggctgtggaaggcagatgtgcacggcaccgtgcaggccaccttcatcctgaaggatgcctttgctgggggcgtgaagccctttgagctgcacccccggctggagagccccaacagcggcagctgcagcctgcctgagcggcacctgggcctggtgtcctgcttcttccaggagggctgggtgctgtcctggaatgagtacagcatctacctgctggacacagtgaaccaggccaccgtggccggcctggagggcagcggggacatcgtgtctgtgtcctgcacagaaaatgagatcttcttcctgaagggggacaggaacatcatccgcatcagcagcaggcctgagggcctgaccagcacagtgagagatggcctggagatgagcggctgcagcgagcgggtgcacgtgcagcaggccgagaagctgcccggggccaccgtgtctgagacccggctgcggggcagctccatggccagctctgtggccagcgagcccaggagccgcagcagcagcctgaacagcacagacagcggcagcggcctgctgcccccaggcctgcaggccaccccagagctgggcaagggcagccagcccctgagccagcgcttcaatgccatcagcagcgaggactttgaccaggagctggtggtgaagcccatcaaggtgaagaggaagaagaagaagaagaagacagagggcggcagccgcagcacctgccacagcagcctggagagcaccccctgcagcgagttccctggggacagcccccagagcctgaacacagacctgctgtccatgaccagctctgtgctgggcagctctgtggaccagctgtctgctgagagcccagaccaggagagcagcttcaatggagaggtgaatggagtgccccaggagaacacagatcctgagaccttcaacgtgctggaggtgtctggctccatgccagacagcctggccgaggaggatgacatcagaacagagatgccccactgccaccacgcccacggccgggagctgctgaatggagccagagaagatgtgggcggcagtgatgtgacaggcctgggagatgagccctgcccagcagatgatggccccaacagcacccagctgcccttccaggagcaggacagcagccctggggcccatgatggagaggacatccagcccatcggcccccagagcaccttctgtgaggtgcccctgctgaacagcctgactgtgcccagcagcctgtcctgggcccccagcgctgagcagtggctgcccggcaccagggcagatgagggcagccctgtggagcccagccaggagcaggacatcctgacctccatggaggccagcggccacctgagcaccaacctgtggcatgctgtgacagatgatgacaccggccagaaggagatccccatcagcgagcgggtgctgggctctgtgggcggccagctgacccctgtgtctgccctggccgccagcacccacaagccctggctggagcagcccccccgggaccagaccctgaccagcagtgatgaggaggacatctatgcccacggcctgcccagcagcagcagcgagacctctgtgacagagctgggccccagctgcagccagcaggacctgagccggctgggcgcagaagatgctggcctgctgaagccagaccagtttgctgagagctggatgggctacagcggccctggctacggcatcctgagcctggtggtgtctgagaagtacatctggtgcctggactacaagggcggcctcttctgcagcgccctgcccggggccggcctgcgctggcagaagtttgaagatgctgtgcagcaggtggccgtgagccccagcggggccctgctgtggaagattgagcagaagagcaacagagcctttgcctgtgggaaggtgaccatcaagggcaagaggcactggtatgaggccctgccccaggccgtgtttgtggccctgagtgatgacacagcctggatcatccgcaccagcggggacctgtacctgcagacaggcctgtctgtggaccggccctgtgcccgggctgtgaaggtggactgcccctaccccctgagccagatcacagccagaaataatgtggtgtgggccctgacagagcagagggccctgctgtaccgggagggcgtgagcagcttctgcccagagggggagcagtggaagtgtgacatcgtgtctgagcggcaggccctggagcctgtgtgcatcaccctgggggaccagcagaccctgtgggccctggacatccacggcaacctgtggttcagaacaggcatcatcagcaagaagccccagggagatgatgaccactggtggcaggtgtccatcacagattatgtggtgtttgaccagtgcagcctcttccagaccatcatccacgccacccacagcgtggccacagctgcccaggcccctgtggagaaggtggccgacaagctgaggatggccttctggagccagcagctgcagtgccagcccagcctgctgggcgtgaacaacagcggcgtgtggatcagcagcggcaagaatgagttccacgtggccaagggcagcctgattggcacctactggaaccacgtggtgccccggggcacagccagcgccaccaagtgggcctttgtgctggccagcgctgcccccaccaaggagggcagcttcctgtggctgtgccagagcagcaaggacctgtgcagcgtgtctgcccagagcgcccagagccggcccagcacagtgcagctgcccccagaggccgagatgagggcctatgctgcctgccaggatgccctgtgggccctggacagcctgggccaggtgttcatccgcaccctgagcaagagctgccccaccggcatgcactggacccggctggacctgagccagctgggcgctgtgaagctgaccagcctggcctgtggcaaccagcacatctgggcctgtgacagcagaggaggagtgtacttccgggtgggcacccagcccctgaaccccagcctgatgctgcctgcctggatcatgattgagccccctgtgcaggtgagccgctcctag

SEQ ID NO: 42604 - DNA, 453 bp, Artificial Sequence
  Description of Artificial Sequence: Synthetic coding sequence
atggacagcaggaagctgagcccccggggcaagaagctggagagccacctgagccaggagcaccggcggccccccctgggcctgattgctgcctggggccagcccagcatccagagctctgtgcagcagggcctgcagacccaggactgggtgtgtgagcccccagagcggcggcggcccggccgccgctggagcgtgtccattgatgaaagaagaaggctggccaccctgggcggccgggagaggcctggagctgctggcacccagctgcactgcagagatgtggtgcagatggtggcccagctggtgtctgaagatgtggacaaggatgtgctgctgccccaccccctgcggagcacagagagcaccaatgccttccaggccttcctggcccggagcgcccccttctggcacaatgccacctttgaggccagccgcagcccccccagctag

SEQ ID NO: 42605 - DNA, 621 bp, Artificial Sequence
  Description of Artificial Sequence: Synthetic coding sequence
atggacagccagcaggaggacctgcgcttccctggcatgtgggtgtccctgtacttcggcatcctgggcctgtgcagcgtcatcactggaggctgcatcatcttcctgcactggaggaagaacctgcggcgggaggagcacgcccagcagtgggtggaggtgatgagagctgccaccttcacctacagccccctgctgtactggatcaacaagagaagaagatatggcatgaatgctgccatcaacacaggccctgccccagctgtgaccaagacagaaacagaggtgcagaacccagatgtgctgtgggacctggacatccctgagggccgcagccacgccgaccaggacagcaaccccaaggccgaggccccagcccccctgcagcctgccctgcagctggccccccagcagccccaggcccggagccccttccccctgcccatcttccaggaggtgccctttgccccacccctgtgcaacctgccccccctgctgaaccacagcgtgtcctaccccctggccacctgcccagagagaaatgtgctcttccacagcctgctgaacctggcccaggaggaccacagcttcaatgccaagcccttccccagcgagctgtag

SEQ ID NO: 42606 - DNA, 1176 bp, Artificial Sequence
  Description of Artificial Sequence: Synthetic coding sequence
atggccggccgcagcctgtgcctgaccaggagctctgtgcccggcacccccttccccccacctgtgcagcagcccagcaccccaggccctgacctgctggccctggaggaggagtacaagaggctgaatgctgagctgcaggccaagacagcagatgtggtgcagcaggccaaggagatcatccgggaccggcaggaggtgcgcagcaggcctgtgtccacccagatgaagagctgtgatgatgaagatgactacagcctgcggggcctgctgcccagcgagggcatcgtgcacctgcacagcgagaccaagcccaagaccaagaacatcgaccctgtgaacaaggtgcagaacaagctgcacagcgccaacaagggcaggaagaccaacagctctgtgaagctgaagtacagtgatgtgcagacagcagatgatgtggccatccctgaggacttcagtgacttcagcctggccaagaccatcagcaagattgagggccagctggaggaggagggcctgcctgagtacattgatgacatcttcagcggcgtgtccaatgacatcggcacagaggcccagatccgcttcctgaaggccaagctgcacgtgatgcaggaggagctggacaacgtggtgtgtgagtgcaacaagaaggaggatgagatccagaacctgaagagccaggtgaagaactttgaggaggacttcatgaggcagcagaggaccatcaacatgcagcagagccaggtggagaagtacaagaccctgtttgaggaggccaacaagaagtatgatggcctgcagcagcagctgagctctgtggagcgggagctggagaacaagaggcggctgcagaagcaggccgccagcagccagagcgccacagaggtgcggctgaacagagccctggaggaggccgagaagtacaagctggagctgagcaagctgcggcagaacaacaaggacatcgccaatgaggagcacaagaagattgaggtgctgaagtctgagaacaagaagctggagaagcagaagggggagctgatgattggcttcaagaagcagctgaagctgattgatgtgctgaagaggcagaagatgcacattgaagctgccaagatgctgtccttcacagaggaggagttcatgaaggccctggagtggggcaacagctag

SEQ ID NO: 42607 - DNA, 951 bp, Artificial Sequence
  Description of Artificial Sequence: Synthetic coding sequence
atgaagagctgtgatgatgaagatgactacagcctgcggggcctgctgcccagcgagggcatcgtgcacctgcacagcgagaccaagcccaagaccaagaacattgatcctgtgaacaaggtgcagaacaagctgcacagcgccaacaagggcaggaagaccaacagctctgtgaagctgaagtacagtgatgtgcagacagcagatgatgtggccatccctgaggacttcagtgacttcagcctggccaagaccatcagcaagattgagggccagctggaggaggagggcctgcctgagtacattgatgacatcttctctggagtgtccaatgacattggaacagaggcccagatccgcttcctgaaggccaagctgcacgtgatgcaggaggagctggacaacgtggtgtgtgagtgcaacaagaaggaggatgagatccagaacctgaagagccaggtgaagaactttgaggaggacttcatgaggcagcagaggaccatcaacatgcagcagagccaggtggagaagtacaagaccctgtttgaggaggccaacaagaagtatgatggcctgcagcagcagctgagctctgtggagcgggagctggagaacaagaggcggctgcagaagcaggccgccagcagccagagcgccacagaggtgcggctgaacagagccctggaggaggccgagaagtacaagctggagctgagcaagctgcggcagaacaacaaggacatcgccaatgaggagcacaagaagattgaggtgctgaagtctgagaacaagaagctggagaagcagaagggggagctgatgattggcttcaagaagcagctgaagctgattgatgtgctgaagaggcagaagatgcacatcgaggccgccaagatgctgtccttcacagaggaggagttcatgaaggccctggagtggggcaacagctag

SEQ ID NO: 42608 - DNA, 828 bp, Artificial Sequence
  Description of Artificial Sequence: Synthetic coding sequence
atgagccagaagaggcagaccaagttccagaatggcaagagcaagaccagcgagaacagcagcgccaagcgggagaagggcatggtggtgaacagcaaggagatcagtgatgctgtgggccagagcaagtttgtgctggagaacctgcggcactacacagtgcaccccaacctggcccagtactacaagcccctgaaggccacagccctgcagaagttcctggcccagaacaggaagaacaccagcttcatgctgaaggtgacccagtatgaccaggacaagaccctgctgatcatgaccaacaaccccccaccctgcagcatcacccagcaggacaaggagagcgccagcaagtacttcagcaaggagctgctgctgaaggtgatggagagccaccaccagcacaagcccacagagaacctgtggctgcccaggatgccccagaagaagaagctgcggagcaagctgaagcccatcttccccctcatcctgagtgatgaccccaccagcaagcgggagcagtggttccgcttcagcacagacaatgacttcaagtctgagggcaagtacagcaaggtgtatgccctgcggacccagaagaagatgtacccccagctgacctttgcccctgtgcatgagcgggacatgaggaaggatgccagcaagaagagcgccagcgagcggcccatcagcaaggtgatccgggagcccctgaccctggccagcctgctggaggacatgcccaccaggacagcccctggagagagcgccttcagaaatggccgggccccccagtggatcatcaagaaggccaccgtcatcggctag

SEQ ID NO: 42609 - DNA, 927 bp, Artificial Sequence
  Description of Artificial Sequence: Synthetic coding sequence
atgaggcctgagggcagcctgacctacagagtgcctgagcggctgcggcagggcttctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggaggagggcctggtggagcggcgggaggaggcccagagggcccagcaggccgtgcccggccctggccccatgaccccagagagcgccctggaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcacagagtaccgggccagccacagcacccccatcgagtggtacccagactatgaggtggaggcctacagaagaagacaccacaacagcagcctgaacttcttcaactggttcagtgaccacaactttgctggcagcaacaagattgctgagatcctgtgcaaggacctgtggaggaaccccctgcagtactacaagaggatgaagcccccagaggagggcacagagaccagcggggacagccagctgctgtcctag

SEQ ID NO: 42610 - DNA, 441 bp, Artificial Sequence
  Description of Artificial Sequence: Synthetic coding sequence
atgaggcctgagggcagcctgacctacagagtgcctgagcggctgcggcagggcttctgtggggtgggccgggccgcccaggccctggtggagctggagcctgtgaatgcccaggccaggaaggccttcagccggcagcgggagaagatggagaggaggaggaagccccacctggacagaagaggagctgtgatccagagcgtgcccggcttctgggccaacgtcatcgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcacagagtaccgggccagccacagcacctag

SEQ ID NO: 42611 - DNA, 885 bp, Artificial Sequence
  Description of Artificial Sequence: Synthetic coding sequence
atgaggcctgagggcagcctgacctacagagtgcctgagcggctgcggcagggcttctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggaggagggcctggtggagcggcgggaggaggcccagagggcccagcaggccgtgcccggccctggccccatgaccccagagagcgccctggaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcacagagtaccgggccagccacagcacccccatcgagtggtacccagactatgaggtggaggcctacagaagaagacaccacaacagcagcctgaacttcttcaactggttcagtgaccacaactttgctggcagcaacaagattgctgagagcccagacaggagctatgtgaggacctgtggggccatcccctgcaacaccacccggggctag

SEQ ID NO: 42612 - DNA, 927 bp, Artificial Sequence
  Description of Artificial Sequence: Synthetic coding sequence
atgaggcctgagggcagcctgacctacagagtgcctgagcggctgcggcagggcagctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggaggagggcctggtggagcggcgggaggaggcccagagggcccagcaggccgtgcccggccctggccccatgaccccagagagcgccctggaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtggaggaggagaagcaccgggtgcacctgtgcaagatcatgctgttcttccgcagcaacccctacttccagaacaaggtgatcaccaaggagtacctggtgaacatcacagagtaccgggccagccacagcacccccatcgagtggtacccagactatgaggtggaggcctacagaagaagacaccacaacagcagcctgaacttcttcaactggttcagtgaccacaactttgctggcagcaacaagattgctgagatcctgtgcaaggacctgtggaggaaccccctgcagtactacaagaggatgaagcccccagaggagggcacagagaccagcggggacagccagctgctgtcctag

SEQ ID NO: 42613 - DNA, 795 bp, Artificial Sequence
  Description of Artificial Sequence: Synthetic coding sequence
atgaggcctgagggcagcctgacctacagagtgcctgagcggctgcggcagggcttctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggtggaggtggtggccgaggaggagggcctggtggagcggcgggaggaggcccagagggcccagcaggccgtgcccggccctggccccatgaccccagagagcgccctggaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcactggagaccgctggctgcccggctgggtggtggagggccgctggtgggtggaccactgccagagggaccctgcccccttcccccagaagctgctgagcctgtag

SEQ ID NO: 42614 - DNA, 516 bp, Artificial Sequence
  Description of Artificial Sequence: Synthetic coding sequence
atgaggcctgagggcagcctgacctacagagtgcctgagcggctgcggcagggcttctgtggggtgggccgggccgcccaggccctggtggagctggagcctgtgaatgcccaggccaggaaggccttcagccggcagcgggagaagatggagaggaggaggaagccccacctggacagaagaggagctgtgatccagagcgtgcccggcttctgggccaacgtcatcgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcaccggggaccgctggctgcccggctgggtggtggagggccgctggtgggtggaccactgccagagggaccctgcccccttcccccagaagctgctgagcctgtag

SEQ ID NO: 42615 - DNA, 927 bp, Artificial Sequence; identical to SEQ ID NO: 42609
  Description of Artificial Sequence: Synthetic coding sequence

SEQ ID NO: 42616 - DNA, 927 bp, Artificial Sequence; identical to SEQ ID NO: 42609
  Description of Artificial Sequence: Synthetic coding sequence

SEQ ID NO: 42617 - DNA, 903 bp, Artificial Sequence
  Description of Artificial Sequence: Synthetic coding sequence
atgaggcctgagggcagcctgacctacagagtgcctgagcggctgcggcagggcttctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggtggaggtggtggccgaggaggagggcctggtggagcggcgggaggaggcccagagggcccagcaggccgtgcccggccctggccccatgaccccagagagcgccctggaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcacagagtaccgggccagccacagcacccccatcgagtggtacccagactatgaggtggaggcctacagaagaagacaccacaacagcagcctgaacttcttcaactggttcagtgaccacaactttgctggcagcaacaagattgctgagagcccagacaggagctatgtgaggacctgtggggccatcccctgcaacaccacccggggctag

SEQ ID NO: 42618 - DNA, 945 bp, Artificial Sequence
  Description of Artificial Sequence: Synthetic coding sequence
atgaggcctgagggcagcctgacctacagagtgcctgagcggctgcggcagggcttctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggtggaggtggtggccgaggaggagggcctggtggagcggcgggaggaggcccagagggcccagcaggccgtgcccggccctggccccatgaccccagagagcgccctggaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcacagagtaccgggccagccacagcacccccatcgagtggtacccagactatgaggtggaggcctacagaagaagacaccacaacagcagcctgaacttcttcaactggttcagtgaccacaactttgctggcagcaacaagattgctgagatcctgtgcaaggacctgtggaggaaccccctgcagtactacaagaggatgaagcccccagaggagggcacagagaccagcggggacagccagctgctgtcctag

SEQ ID NO: 42619 - DNA, 927 bp, Artificial Sequence
  Description of Artificial Sequence: Synthetic coding sequence
atgaggcctgagggcagcctgacctactgggtgcctgagcggctgcggcagggcttctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggaggagggcctggtggagcggcgggaggaggcccagagggcccagcaggccgtgcccggccctggccccatgaccccagagagcgccctggaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcacagagtaccgggccagccacagcacccccatcgagtggtacctggactatgaggtggaggcctacagaagaagacaccacaacagcagcctgaacttcttcaactggttcagtgaccacaactttgctggcagcaacaagattgctgagatcctgtgcaaggacctgtggaggaaccccctgcagtactacaagaggatgaagcccccagaggagggcacagagaccagcggggacagccagctgctgtcctag

SEQ ID NO: 42620 - DNA, 942 bp, Artificial Sequence
  Description of Artificial Sequence: Synthetic coding sequence
atgaggcctgagggcagcctgacctactgggtgcctgagcggctgcggcagggcttctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggtggaggtggtggccgaggaggagggcctggtggagcggcgggaggaggcccagagggcccagcaggccgtgcccggccctggccccatgaccccagagagcgccctggaggagctgctggccgtgcaggtggagctggagcctgtgaatgcccaggccaggaaggccttcagccggcagcgggagaagatggagaggagcaagccccacctggacagaagaggagctgtgatccagagcgtgcccggcttctgggccaacgtcatcgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcacagagtaccgggccagccacagcacccccatcgagtggtacccagactatgaggtggaggcctacagaagaagacaccacaacagcagcctgaacttcttcaactggttcagtgaccacaactttgctggcagcaacaagattgctgagatcctgtgcaaggacctgtggaggaaccccctgcagtactacaagaggatgaagcccccagaggagggcacagagaccagcggggacagccagctgctgtcctag

SEQ ID NO: 42621 - DNA, 885 bp, Artificial Sequence
  Description of Artificial Sequence: Synthetic coding sequence
atgaggcctgagggcagcctgacctactgggtgcctgagcggctgcggcagggcttctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggaggagggcctggtggagcggcgggaggaggcccagagggcccagcaggccgtgcccggccctggccccatgaccccagagagcgccctggaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcacagagtaccgggccagccacagcacccccatcgagtggtacctggactatgaggtggaggcctacagaagaagacaccacaacagcagcctgaacttcttcaactggttcagtgaccacaactttgctggcagcaacaagattgctgagagcccagacaggagctatgtgaggacctgtggggccatcccctgcaacaccacccggggctag

SEQ ID NO: 42622 - DNA, 927 bp, Artificial Sequence
  Description of Artificial Sequence: Synthetic coding sequence
atgaggcctgagggcagcctgacctactgggtgcctgagcggctgcggcagggcttctgtggggtgggccgggccgcccaggccctggtgtgtgccagcgccaaggagggcacagccttcaggatggaggccgtgcaggagggcgccgccggcgtggagagcgagcaggccgccctgggggaggaggccgtgctgctgctggatgacatcatggccgaggtggaggtggtggccgaggaggagggcctggtggagcggcgggaggaggcccagagggcccagcaggccgtgcccggccctggccccatgaccccagagagcgccctggaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcacagagtaccgggccagccacagcacccccatcgagtggtacccagactatgaggtggaggcctacagaagaagacaccacaacagcagcctgaacttcttcaactggttcagtgaccacaactttgctggcagcaacaagattgctgagatcctgtgcaaggacctgtggaggaaccccctgcagtactacaagaggatgaagcccccagaggagggcacagagaccagcggggacagccagctgctgtcctag

SEQ ID NO: 42623 - DNA, 621 bp, Artificial Sequence
  Description of Artificial Sequence: Synthetic coding sequence
atgaccccagagagcgccctggaggagctgctggccgtgcaggtggagctggagcctgtgaatgcccaggccaggaaggccttcagccggcagcgggagaagatggagaggaggaggaagccccacctggacagaagaggagctgtgatccagagcgtgcccggcttctgggccaacgtgattgccaaccacccccagatgtctgccctgatcacagatgaagatgaggacatgctgagctacatggtgtccctggaggtggaggaggagaagcaccctgtgcacctgtgcaagatcatgctgttcttccgcagcaacccctacttccagaacaaggtgatcaccaaggagtacctggtgaacatcacagagtaccgggccagccacagcacccccatcgagtggtacctggactatgaggtggaggcctacagaagaagacaccacaacagcagcctgaacttcttcaactggttcagtgaccacaactttgctggcagcaacaagattgctgagatcctgtgcaaggacctgtggaggaaccccctgcagtactacaagaggatgaagcccccagaggagggcacagagaccagcggggagcccctggtgggcacctag

SEQ ID NO: 42624 - DNA, 828 bp, Artificial Sequence; identical to SEQ ID NO: 42608
  Description of Artificial Sequence: Synthetic coding sequence

SEQ ID NO: 42625 - DNA, 177 bp, Artificial Sequence
  Description of Artificial Sequence: Synthetic coding sequence
atgagccagaagaggcagaccaagttccagaatggcaagagcaagaccagcgagaacagcagcgccaagcgggagaagggcatggtggtgaacagcaaggagatcagtgatgctgtgggccagagcaagtttgtgctggagaacctgcggcactacacagtgcaccccaacctgtag

SEQ ID NO: 42626 - DNA, 231 bp, Artificial Sequence
  Description of Artificial Sequence: Synthetic coding sequence
atgagccagaagaggcagaccaagttccagaatggcaagagcaagaccagcgagaacagcagcgccaagcgggagaagggcatggtggtgaacagcaaggagatcagtgatgctgtgggccagagcaagtttgtgctggagaacctgcggcactacacagtgcaccccaacctggcccagtactacaagcccctgaaggccacagccctgcagaagttcctggcccagtag

SEQ ID NO: 42627 - DNA, 828 bp, Artificial Sequence; identical to SEQ ID NO: 42608
  Description of Artificial Sequence: Synthetic coding sequence

SEQ ID NO: 42628 - DNA, 1230 bp, Artificial Sequence
  Description of Artificial Sequence: Synthetic coding sequence
atggccctgcggcctgaggaccccagcagcggcttccgccacagcaatgtggtggccttcatcaatgagaagatggcccggcacaccaagggccctgagttctacctggagaacatcagcctgtcctgggagaaggtggaggacaagctgcgggccatcctggaggacagcgaggtgcccagcgaggtgaaggaggcctgcacctggggcagcctggccctgggcgtgcgctttgcccaccggcaggcccagctgcagaggcaccgggtgcgctggctgcacggctttgccaagctgcacaagtctgctgcccaggccctggccagtgacctgaagaagctgcgggagcagcaggagacagagaggaaggaggccgccagccggctgaggatggcccagaccagcctggtggaggtgcagaaggagcgggacaaggagctggtgagcccccatgagtgggagcagggcgccggctggccaggcctggccacagctggaggagtgtgcacagagggcgctgctgaggaggaggaggaggccgctgtggccgctgctggagctgctgggggcaaaggagctgaggaggagcagagagatgtggaggtggtggccgcccctgtggaggccatggcccctcctgtggaggccggggccgcccccatggagacccagttcccccacgtggaggcccgggccgcctccatggagaccacagagaagctggagcgcatcctgctgcagctgctgggagatgctgaccaggagaagtacacctactggggccagaaggagggggacctgcggtctgtggagacagccaccagctacttcagcggcaccaccaacccctggagccgggccagcagcgagcccctgcctgtgcagctgcctgccagctacagctacagctacagcagccccttcagcagcttcagtgacatccccaccatcagccccccccaggccaccgtgacagcccctgtgcccccccagctgcccagcgactgggaggcctttgacaccagcctgtggagcgatggcggcccccacagaattgaccaccaggagcacccccgggaccggcgctacagcgagccccaccagcagaggcctcctgtgtacagaagacctggggactgggactgcccctggtgcaatgctgtgaacttcagccggcgggacacctgctttgactgtgggaagggcatctggctgcagaagccccactag

SEQ ID NO: 42629 - DNA, 2637 bp, Artificial Sequence
  Description of Artificial Sequence: Synthetic coding sequence
atgtatgagggcaagcacatccacttcagcgaggtggacaacaagcccctgtgcagctacagccccaagctgtgcaagcagaggcggctgaatggctacgccttctgcatcagacatgtgctggaggacaagacagcccccttcaagcagtgtgaatatgtggccaagtacaacagccagcgctgcaccaaccccatccccaagtctgaggaccggcgctactgcaacagccacctgcaggtgctgggcttcatccccaagaaggagaggaagaagaagaatgaccccattgatgaggtgaaggtgcgccaccagatggacaccatggccttcagcctgactgtgcccaccctggccctgaagatgcccaacggcctggatggcatgagcctgagccccccaggggcccgggtgcccctgcactacctggagacagagctggaggacccctttgccttcaatgaggaggatgatgacctgaagaagggggccaccgtgaggaagaagctgcagagcaagctggcccagaaccggcagaggcagcgggagacagagatcctgaaggtgcggcaggagcacttcagccccccaccagcccccagccagcagcagcccccccagcagcacagccacctgagccccctgagcaccagcctgaagcccccagccccaccccagggctctgtgtgcaagagcccccagccccagaacaccagcctgcccatgcagggcgtggcccccaccacccacaccatcgcccaggcccggcagctgagccacaagaggcccctgcccctgctgcccagcagccgggcccccaccgtggacccccccaggacagaccgcatcctgatgaaggccacagccttcagcccccacttcagctgcatcagccggctgcagaggctggtgaagctgtgcacccagaagcaccagctggacacagacctcttcccccacctgggcctggactggagcgaggagagcggggaggagcctgaggacagcgagcaggccagcccctaccaggtggcctggagcatccgggagaccctgcgctaccagagacatgccagtgatgatgatgatgctgagagccgcagcagccgggtgacccagctgtgcacctacttccagcagaagtacaagcacctgtgccgcctggagagagctgagagccggcagaagaagtgccgccacaccttcaggaaggccctgctgcaggccgccagcaaggagccagaatgtacaggccagctgatccaggagctgcggcgggccgcctgcagcaggaccagcatcagcaggaccaagctgcgggaggtggagcctgctgcctgcagcggcaccgtgaagggggagcagtgtgccaacaaggccctgcccttcaccaggcactgcttccagcacatcctgctgaaccacagccagcagctgttcagcagctgcacagccaagtttgctgatggccagcagtgcagcgtgcctgtgtttgacatcacccaccagacccccctgtgtgaggagcacgccaagaagatggacaacttcctgcggggggacaacagcaggaaggtgcagcaccagcagcagaggaagcccaggaagaagaccaagcccccagccctgaccaagaagcacaagaagaagagaagaagaggcccccggcggccccagaagcccatccccccagctgtgccccagggcaacctgtccatgcctgcctctgtgtccctgcctgtggaggccagccacatccgcagccccagcaccccagagctgtctgcagatgagctgcctgatgacatcgccaatgagatcacagacatcccccatgacctggagctgaaccaggaggacttcagtgatgtgctgccccggctgcctgatgacctgcaggactttgacttctttgagggcaagaatggagacctgctgcccaccacagaggaggccgaggagctggagcgggccctgcaggccgtgaccagcctggagtgcctgagcaccatcggcgtgctggcccagagtgatggagtgcctgtgcaggagctgagtgaccggggcatcggggtcttcagcactggaactggagccagcggcatccagagcctgagccgggaggtgaacacagacctgggggagctgctgaatggaagaattgtgcatgacaacttcagcagcctggagctggatgagaacctgctgcggagcgccaccctgagcaacccccccacccccctggccggccagatccagggccagttcagcgccccagccaacgtgggcctgaccagcgccaccctcatcagccagagcgccctgggggagcgggccttccctggccagttccacggcctgcatgatggcagccacgccagccagaggccccacccagcccagctgctgagcaaggcagatgacctgatcaccagccggcagcagtacagcagtgaccacagccacagcagcccccacggcagccactatgacagcgagcacgtgcccagcccctacagcgaccacatcaccagcccccacaccaccagctacagcggggacaacatggccgcccctgtgtgcttccggggctaccacaggcctgcctctgtggcctggggcctgctgctgaactag

SEQ ID NO: 42630 - DNA, 4983 bp, Artificial Sequence
  Description of Artificial Sequence: Synthetic coding sequence
atggattctggccctgtgtaccacggggacagccggcagctgagcgccagcggcgtgcctgtgaatggagcccgggagcccgccggccccagcctgctgggcactggaggcccctggagggtggaccagaagccagactgggaggccgcccctggccctgcccacacagcccggctggaggatgcccatgacctggtggccttctctgctgtggccgaggccgtgtcctcctatggagccctgagcacccggctgtatgagaccttcaaccgggagatgagccgggaggccggcaacaacagccggggcccccggcccggccctgagggctgcagcgctggcagcgaggacctggacaccctgcagacagccctggccctggcccggcacggcatgaagccacccaactgcaactgtgatggcccagaatgtcctgactacctggagtggctggagggcaagatcaagtctgtggtgatggagggcggggaggagcggccccggctgcccggccccctgcccccaggagaggccggcctgcctgcccccagcacccggcccctgctgagcagcgaggtgccccagatcagcccccaggagggcctgcccctgagccagagcgccctgagcatcgccaaggagaagaacatcagcctgcagacagccatcgccatcgaggccctgacccagctgagcagcgccctgccccagcccagccacagcaccccccaggccagctgccccctgcctgaggccctgagccccccagcccccttccgcagcccccagagctacctgcgggcccccagctggcctgtggtgcccccagaggagcacagcagctttgccccagacagcagcgccttccccccagccacccccaggacagagttccctgaggcctggggcacagacaccccaccagccacccccaggagctcctggcccatgccccggcccagcccagaccccatggccgagctggagcagctgctgggcagcgccagtgactacatccagagcgtcttcaagaggcctgaggccctgcccaccaagcccaaggtgaaggtggaggcccccagcagcagccctgccccagcccccagccctgtgctgcagcgggaggcccccacccccagcagcgagccagacacccaccagaaggcccagacagccctgcagcagcacctgcaccacaagaggagcctcttcctggagcaggtgcatgacaccagcttccctgcccccagcgagcccagcgcccctggctggtggcccccacccagcagccctgtgccccggctgcctgacaggcctcccaaggagaagaagaagaagctgcccaccccagctgggggccctgtgggcacagagaaggccgcccctggcatcaagcccagcgtgaggaagcccatccagatcaagaagagccggccccgggaggcccagcccctcttcccccctgtgcggcagatcgtgctggagggcctgcggagccctgccagccaggaggtgcaggcccaccccccagcccccctgcctgccagccagggcagcgctgtgcccctgcccccagagcccagcctggccctgtttgcccccagccccagccgggacagcctgctgccccccacccaggagatgaggagccccagccccatgacagccctgcagcccggcagcacaggccccctgcccccagcagatgacaagctggaggagctgatccggcagtttgaagctgagtttggagacagctttggcctgcccggcccccccagcgtgcccatccaggaccctgagaaccagcagacctgcctgcctgcccctgagagcccctttgccaccaggagccccaagcagatcaagattgagagcagtggagctgtgacagtgctgagcaccacctgcttccacagcgaggagggcggccaggaggccacccccaccaaggccgagaaccccctgacccccaccctgagcggcttcctggagagccccctgaagtacctggacacccccaccaagagcctgctggacaccccagccaagagggcccaggccgagttccccacctgtgactgtgtggagcagatcgtggagaaggatgagggcccctactacacccacctgggcagcggccccaccgtggccagcatccgggagctgatggaggagcgctacggggagaagggcaaggccatcagaattgagaaggtgatctacacaggcaaggagggcaagagcagccggggctgccccatcgccaagtgggtgatcagaagacacaccctggaggagaagctgctgtgcctggtgcgccacagagctggccaccactgccagaatgctgtgattgtcatcctgatcctggcctgggagggcatccccaggagcctgggggacaccctgtaccaggagctgacagacaccctgaggaaatatggcaaccccaccagcagaagatgtggcctgaatgatgacaggacctgtgcctgccagggcaaggaccccaacacctgtggggccagcttctcctttggctgctcctggagcatgtacttcaacggctgcaagtatgcccggagcaagacccccaggaagttccggctggccggggacaaccccaaggaggaggaggtgctgaggaagagcttccaggacctggccacagaggtggcccccctgtacaagaggctggccccccaggcctaccagaaccaggtgaccaatgaggagatcgccatcgactgccgcctgggcctgaaggagggccggccctttgctggggtgacagcctgcatggacttctgtgcccacgcccacaaggaccagcacaacctgtacaacggctgcaccgtggtgtgcaccctgaccaaggaggacaacagatgtgtgggcaagatcccagaagatgagcagctgcacgtgctgcccctgtacaagatggccaacacagatgaatttggaagtgaggagaaccagaatgccaaggtgggcagcggggccatccaggtgctgacagccttcccccgggaggtgcggcggctgcctgagcccgccaagagctgccggcagaggcagctggaggccaggaaggctgctgctgagaagaagaagatccagaaggagaagctgagcaccccagagaagatcaagcaggaggccctggagctggccggcatcaccagtgaccccggcctgagcctgaagggcggcctgagccagcagggcctgaagcccagcctgaaggtggagccccagaaccacttcagcagcttcaagtacagcggaaatgctgtggtggagagctacagcgtgctgggcaactgccggcccagcgacccctacagcatgaacagcgtgtacagctaccacagctactatgcccagcccagcctgacctctgtgaatggcttccacagcaaatatgccctgcccagcttctcctactacggcttccccagcagcaaccctgtgttccccagccagttcctgggccctggggcctggggccacagcggcagcagcggcagctttgagaagaagccagacctgcacgccctgcacaacagcctgagccctgcctatggaggagctgagtttgctgagctgcccagccaggccgtgcccacagatgcccaccaccccaccccccaccaccagcagcctgcctacccaggccccaaggagtacctgctgcccaaggcccccctgctgcacagcgtgtcccgggaccccagcccctttgcccagagcagcaactgctacaacagaagcatcaagcaggagcctgtggaccccctgacccaggccgagcctgtgcccagagatgctgggaagatgggcaagacccccctgtctgaggtgtcccagaatggaggccccagccacctgtggggccagtacagcggcggccccagcatgagccccaagaggaccaatggagtgggcggctcctggggcgtcttcagcagcggggagagccctgccatcgtgcctgacaagctgagcagctttggagccagctgcctggcccccagccacttcacagatggccagtggggcctcttccctggagagggccagcaggccgccagccacagcggcggccgcctgcggggcaagccctggagcccctgcaagtttggaaacagcaccagcgccctggccggccccagcctgacagagaagccctgggccctgggcgctggggacttcaacagcgccctgaagggcagccctggcttccaggacaagctgtggaaccccatgaagggggaggagggccgcatcccagctgctggggccagccagctggaccgggcctggcagagctttggcctgcccctgggcagcagcgagaagctgtttggagccctgaagtctgaggagaagctgtgggaccccttcagcctggaggagggccctgctgaggagccccccagcaaaggagctgtgaaggaggagaagggcggcggcggcgctgaggaggaggaggaggagctgtggagcgacagcgagcacaacttcctggatgagaacatcggcggcgtggccgtggccccagcccacggcagcatcctgattgaatgtgcccggcgggagctgcacgccaccacccccctgaagaagcccaaccgctgccaccccacccgcatcagcctggtgttctaccagcacaagaacctgaaccagcccaaccacggcctggccctgtgggaggccaagatgaagcagctggccgagcgggcccgggcccggcaggaggaggccgcccggctgggcctgggccagcaggaggccaagctgtatggcaagaagaggaagtggggcggcaccgtggtggccgagccccagcagaaggagaagaagggcgtggtgcccacccggcaggccctggccgtgcccacagacagcgctgtgacagtgagcagctatgcctacaccaaggtgacaggcccctacagccgctggatctag

SEQ ID NO: 42631 - DNA, 759 bp, Artificial Sequence
  Description of Artificial Sequence: Synthetic coding sequence
atgacccatgacaagtcctggaggcgctgcagcatcagcggcagcaccaagtgccgctgtggcagcagaattgctggccccaatgccctgggcagcggcggcagccgcagcagcagcagcagcagccgcagcatcctgagcagcagcatcctgagcagcagcatccccagcagcagcagcagcagcagcagccccagcagcagccccagcagcagcagccccagcagcagccacagcagcagcagccccagcagcagcagcagcaccagcagccccagcagcagcagcagcagcagcagcagcagccccagcagcagcaacagcagcagcagcagcagcagcagcagccccagcagcagcagcagcagcagcagcagcagccccagcagcagcagcagcagccccagcagcagcagcagcagcagcagcagcagccccagcagcagcagcagcagccccagcagcagcagcagcagcagcagcagcagcagcagcagccccagcagcagcagccccagcagcagcggcagcagccccagcagcagcaacagcagccccagcagcagcagcagcagccccagcagcagcagcagcagccccagccccaggagcagcagccccagcagcagcagcagcagcaccagcagccccagcagcagcagccccagcagcagcagccccagcagcagctgccccagcgctgccctgggccggcggccccagagcccccagagcagccactgtgcccccttcccctag

SEQ ID NO: 42632 - DNA, 759 bp, Artificial Sequence; identical to SEQ ID NO: 42631
  Description of Artificial Sequence: Synthetic coding sequence

SEQ ID NO: 42633 - DNA, 759 bp, Artificial Sequence; identical to SEQ ID NO: 42631
  Description of Artificial Sequence: Synthetic coding sequence

SEQ ID NO: 42634 - DNA, 156 bp, Artificial Sequence
  Description of Artificial Sequence: Synthetic coding sequence
atgacccatgacaagtcctggaggcgctgcagcatcagcggcagcaccaagtgccgctgtggcagcagaattgctggccccaatgccctgggcagcggcggcagccgcagcagcagcagcagcagccgcagcatcctgagcagcagcatcctgtag

SEQ ID NO: 42635 - DNA, 66 bp, Artificial Sequence
  Description of Artificial Sequence: Synthetic coding sequence
atgacccatgacaagtcctggaggcgctgcagcatcagcggcagcaccaagtgccgctgtggctag

SEQ ID NO: 42636 - DNA, 228 bp, Artificial Sequence
  Description of Artificial Sequence: Synthetic coding sequence
atgacccatgacaagtcctggaggcgctgcagcatcagcggcagcaccaagtgccgctgtggcagcagaattgctggccccaatgccctgggcagcggcggcagccgcagcagcagcagcagcagccgcagcatcctgagcagcagcatcctgagcagcagcatccccagcagcagcagcagcagcagcagccccagcagcagccccagcagcagcagccccagctag

SEQ ID NO: 42637 - DNA, 132 bp, Artificial Sequence
  Description of Artificial Sequence: Synthetic coding sequence
atgacccatgacaagtcctggaggcgctgcagcatcagcggcagcaccaagtgccgctgtggcagcagaattgctggccccaatgccctgggcagcggcggcagccgcagcagcagcagcagcagcaggtag

SEQ ID NO: 42638 - DNA, 117 bp, Artificial Sequence
  Description of Artificial Sequence: Synthetic coding sequence
atgacccatgacaagtcctggaggcgctgcagcatcagcggcagcaccaagtgccgctgtggcagcagaattgctggccccaatgccctgggcagcggcggcagccgcagcagctag

SEQ ID NO: 42639 - DNA, 39 bp, Artificial Sequence
  Description of Artificial Sequence: Synthetic coding sequence
atgacccatgacaagtcctggaggcgctgcagcatctag

SEQ ID NO: 42640 - DNA, 63 bp, Artificial Sequence
  Description of Artificial Sequence: Synthetic coding sequence
atgacccatgacaagtcctggaggcgctgcagcatcagcggcagcaccaagtgccgctgctag

SEQ ID NO: 42641 - DNA, 453 bp, Artificial Sequence
  Description of Artificial Sequence: Synthetic coding sequence
atgacccatgacaagtcctggaggcgctgcagcatcagcggcagcaccaagtgccgctgtggcagcagaattgctggccccaatgccctgggcagcggcggcagccgcagcagcagcagcagcagccgcagcatcctgagcagcagcatcctgagcagcagcatccccagcagcagcagcagcagcagcagccccagcagcagccccagcagcagcagccccagcagcagccacagcagcagcagccccagcagcagcagcagcaccagcagccccagcagcagcagcagcagcagcagcagcagccccagcagcagcaacagcagcagcagcagcagcagcagcagccccagcagcagcagcagcagcagcagcagcagccccagcagcagcagcagcagccccagcagcagcagcagcagcagcagcagcagccccagcagcagcagctag

SEQ ID NO: 42642 - DNA, 747 bp, Artificial Sequence
  Description of Artificial Sequence: Synthetic coding sequence
atgctgaggaacaacaagaccatcatcatcaagtacttcctgaacctgatcaacggggccttcctggtgctgggcctgctcttcatgggctttggagcctggctgctgctggacaggaacaacttcctgacagcctttgatgagaacaaccacttcatcgtgcccatcagccagatcctgattggcatgggcagcagcacagtgctcttctgcctgctgggctacatcggcatccacaatgagatccgctggctgctgattgtgtatgctgtgctgatcacctggacctttgctgtgcaggtggtgctgagcgccttcatcatcaccaagaaggaggaggtgcagcagctgtggcatgacaagattgactttgtgatcagtgaatatggcagcaaggacaagccagaggacatcaccaagtggaccatcctgaatgccctgcagaagaccctgcagtgctgcggccagcacaactacacagactggatcaagaacaagaacaaggaaaattctggccaggtgccctgcagctgcaccaagagcaccctgaggaagtggttctgtgatgagcccctgaatgccacctacctggagggctgtgagaacaagatcagcgcctggtacaacgtgaatgtgctgaccctcatcggcatcaactttggcctgctgaccagcgaggtgttccaggtgtccctgactgtgtgcttcttcaagaacatcaagaacatcatccacgccgagatgtag

SEQ ID NO: 42643 - DNA, 267 bp, Artificial Sequence
  Description of Artificial Sequence: Synthetic coding sequence
atgctgaggaacaacaagaccatcatcatcaagtacttcctgaacctgatcaacggggccttcctggtgctgggcctgctcttcatgggctttggagcctggctgctgctggacaggaacaacttcctgacagcctttgatgagaacaaccacttcatcgtgcccatcagccagatcctgattggcatgggcagcagcacagtgctcttctgcctgctgggctacatcggcatccacaatgagatccgctggctgctgattgtgtag

SEQ ID NO: 42644 - DNA, 7128 bp, Artificial Sequence
  Description of Artificial Sequence: Synthetic coding sequence
atgcacatcctcttccagaagggcatgctgaagagggtgaagaagctgctggacctgctggtgaagtttgacatcaacttcaacctgaagaacaaggagggcaaggatgcccggcaccgcatcaagaagaatgacagcctgctgctggcctggaacaaggccctgatggagaacagaagaagaagccggcaggacagcgctgcccacctgggcaagctgagcaagagcacagcccctggccacaccagccagctgaagagccagggcagcttcaagtctgtgccctgtggggccacagcccggaccctgcctgagggcagcgctgtgcctgacagctgggagaccctgcccggcacccaggtgaccaggaaggagcccggggccctgcggccctgcagcctgcgggactgcctgatgcaggacatcaccgtgctgatccagcaggtggaggtggaccccagcttccctgaggactgcctgcagagcagcgagcccctggaggccggggccggcaaggagggcaagaaggatgacaagcccaccctgggcgctggggccccagactgcagcgaggtgggggagggccacgcccaggtgggcctgggcgccctgcagctggtgcctgatgacaacagaggcaaggagggcaatgatgaccaggatgactggagcacccaggagattgaggcctgcctgcaggactttgacaacatgacctgggagattgaatgtaccagcgagatgctgaagaagctgagcagcaaggtgatgaccaaggtgatcaagaagaagatcatcctggccatccagcagctgggcaatggagagtggacccagggcctgcagaagaggctgaagcacctgaagggcagcatccagctgtttgaggccaagctggacaagggggccaggatgctgtgggagctggccatcgacttcagcccccgctgcagtgaaaatcctgagaagatcatcgccacagagcagaacacctgtgccatggagaagagcggccgcatctacacagagatcatccgcatctgggacatcgtgctggaccactgcaagctggccgacagcatcaaggccatctgcaatgcctacaacagaggcctgagctgtgtgctgaggaagaagctgaagggcatcaacaagggccaggtgtctgccaacatgaagatccagaagaggatcccccgctgctacgtggaggacacagaggccgagaagggccgggagcacgtgaaccctgagtacttccccccagccagcgctgtggagacagagtacaacatcatgaagttccacagcttcagcaccaacatggccttcaacatcctgaatgacaccacagccaccgtggagtaccccttccgggtgggggagctggagtatgctgtgattgacctgaacccccggcccctggagcccatcatcctgattggccgcagcggcaccgggaagaccacctgctgcctgtaccgcctgtggaagaagttccacgtgtactgggagaaggccgagcaggccggcagccccctgctggccaagcaggtgtggctgaagaggcggctggaggtggagcccgggaaggagagccctggaggagaggaggaggaggaggaggaggatgaggaggaggaggacagcattgaggtggagaccgtggagagcattgatgagcaggagtatgaggcctgtgccggcggggccggcgtggagcctgctggagatggccaggccgctgaggtgtgtgcccctgagcacccccaccagctggagcacctgcaccagatctttgtgaccaagaaccacgtgctgtgccaggaggtgcagaggaacttcatcgagctgagcaagagcaccaaggccaccagccactacaagcccctggaccccaacatccacaagctgcaggacctgagagatgagaacttccccctgtttgtgaccagcaagcagctgctgctgctgctggatgccagcctgcccaagcccttcttcctgagaaatgaagatggcagcctgaagaggaccatcatcggctggagcgcccaggaggagagcaccatccccagctggcaggaggatgaggaggaggccgaggtggatggagactacagcgaggaggacaaggctgtggagatgaggactggagacagcgacccccgggtgtatgtgacctttgaggtgttcaagaatgagatctggcccaagatgaccaagggccgcacagcctacaacccagccctgatctggaaggagatcaagagcttcctgaagggcagctttgaggccctgagctgcccccacggccgcctgacagaggaggtgtacaagaagctgggcaggaagcgctgccccaacttcaaggaggacagaagtgagatctacagcctcttcagcctgtaccagcagatccgcagccagaagggctactttgatgaagaagatgtgctgtacaacatcagccggcggctgagcaagctgcgggtgctgccctggagcatccacgagctgtatggagatgagatccaggacttcacccaggccgagctggccctgctgatgaagtgcatcaatgaccccaacagcatgttcctgactggagacacagcccagagcatcatgaagggcgtggccttccgcttcagtgacctgcggagcctcttccactacgccagcaggaacaccatcgacaagcagtgtgctgtgaggaagcccaagaagatccaccagctgtaccagaactaccgcagccacagcggcatcctgaacctggccagcggcgtggtggacctgctgcagttctacttccctgagagctttgaccggctgccccgggacagcggcctgtttgatggccccaagcccaccgtgctggagagctgcagcgtgtctgacctggccatcctgctgcggggcaacaagaggaagacccagcccattgaatttggagcccaccaggtgatcctggtggccaatgaaacagccaaggagaagatccctgaggagctgggcctggccctggtgctgaccatctatgaggccaagggcctggagtttgatgatgtgctgctgtacaacttcttcacagacagcgaggcctacaaggagtggaagatcatcagcagcttcacccccaccagcacagacagccgggaggagaaccggcccctggtggaggtgcccctggacaagccaggcagcagccagggccgcagcctgatggtgaaccctgagatgtacaagctgctgaatggagagctgaagcagctgtacacagccatcacccgggcccgggtgaacctgtggatctttgatgaaaatcgggagaagagggccccagccttcaagtacttcatcagaagagactttgtgcaggtggtgaagacagatgagaacaaggactttgatgacagcatgtttgtgaagaccagcaccccagctgagtggatcgcccagggcgactactatgccaagcaccagtgctggaaggtggccgccaagtgctaccagaagggcggggcctttgagaaggagaagctggccctggcccatgacacagccctgtccatgaagagcaagaaggtgagccccaaggagaagcagctggagtacctggagctggccaagacctacctggagtgcaaggagcccaccctgagcctgaagtgcctgtcctatgccaaggagttccagctgagcgcccagctgtgtgagcggctgggcaagatcagagatgctgcctacttctacaagaggagccagtgctacaaggatgccttccgctgctttgagcagatccaggagtttgacctggccctgaagatgtactgccaggaggagctgtttgaggaggccgccatcgctgtggagaagtatgaggagatgctgaagaccaagaccctgcccatcagcaagctgagctacagcgccagccagttctacctggaggccgccgccaagtacctgagcgccaacaagatgaaggagatgatggctgtgctgagcaagctggacatcgaggaccagctggtgttcctgaagagcaggaagaggctggccgaggccgctgacctgctgaaccgggagggcagaagagaggaggccgccctgctgatgaagcagcacggctgcctgctggaggccgcccggctgacagctgacaaggacttccaggccagctgcctgctgggcgccgcccggctgaatgtggcccgggacagcgacatcgagcacaccaaggacatcctgcgggaggccctggacatctgctaccagacaggccagctgtctggaattgctgaggcccacttcctgcagggcgtcatcctgcgggacttccagaagctgagagatgccttcttcaagtttgacaccctgaaccacagcgctggggtggtggaggccctgtatgaagctgccagccagtgtgaggccgagcctgagaagatcctgggcctggcccctgggggcctggagatcctgctgagcctggtgcgggccctgaagagggtgaccaacaatgctgagaaggagatggtgaagagctgctttgagttcttcggcatcagccaggtggatgccaagtactgccagatcgcccagaatgaccccggccccatcctgcgcatcatctttgacctggacctgaacctgcgggagaagaagaccaaggaccacttcctgatcatgacagaccaggtgaagctggccctgaacaagcacctgctgggccgcctgtgccagatcaccaggagcctgctgggcaagacctaccggggcgtgtgcatgaggttcatcgtgggcctgaagtgtgaagatgagaactgtgagcacttccaccggcccctgcggcgctgtgaggccaagtgcctggtgcagagcaagatgaacctggtggccatcaatggcctgctgctggaggccaagaaggtgttccccaagatcctggccgaggagctgaaggagattgactacatcctgagcacagacatgtatggcctgtgcaagagcatcctggatgtgctcttccccaagcacttccaccagagggtgctgtctgagaaccccatggcctgcaaggagatcctgaagcccaactacaagagcttccgcttctacagatttgccctgaaggagtacatccacttcctgtttgaaaatgaaagtgccaggaacagaagagagagcacagacctgtggctgagcgccatgcaggccttcctgctgagcagcaactacccagaggagtttgagaagctgctgcaccaggaggaggacaactacaaccgggagctgaaggccctggagagcgagaaggatgagcggggccggggccggggcagccgcatcaagggcatcgagggcaagtttggcatgctggcccccaacagagatgatgagaacatggacaagacccacctgtgcttcatccggctgctggagaactgcatcgaccagttctacgtgtacagaaatcctgaggactacaagaggctcttcttccgcttcatgaatgtgctgatcaagcgctgcaaggagcccctcatccccagcatcggcaacacagtggccctgctggagttccagttcatccactgcggcgtggtgctggcccggctgtggaagaatgtcatcctgtgcctgcccaagagctacatcgccctgctgcactactgggagttcctgttcagcaagaaggacaaggagctgggagatgtgttcagcatcatccaggagtacaagcccaaggatgtgacccgggccatccaggacttccgcttccacctgagctacctggccaaggtgctgtgtggctatgaaaatgtgaacttcaacgtgctgctggatgccttcagcgagattgattatgtggtgtctggagaggccgagaggaccctggtgctgtgcctggtgatgctggtgaatgctgaggagatcctgcagccctactgcaagcccctgctgtaccgccacttccgggagattgagagccggctgcagctgatgtccatggactgccccggccaggtgcctgagcggctgctgaaggtggtgaagagggtgctggtggccgtgaatgtgaagtctgtggccgaggccctgcaggacctgctgtttgaaagagatgaggagtacctgatggactgtgactggcgctgggaccctgtgcacaccaagggcagcatcgtgcggggcctgtactatgaggaggtgcggctgaaccggctgctgtgcctggaccctgtggactactttgctgagccagaatgtgaatttggccaggatgagatggatgagctggccctggaggaccgggaccacgtgctggccaccatcctgagccagaagcagaggaaggccagcatccagaggaagctgcggcgggcctgcctggtggtgtccctgtgcatctcctggaggcggcgggtgggcacccagatggagcgggtgcgggaggaggcccgggagccccgggccggcaacttcaagaaggcagatgtggacaggacccagtgtgacctgtgtggggtgaagttcacccggggccctgagaactacttcagccccagcaaggcctttgagggcgccgccagcgaggtggccgtgctgagcagagctgagctggagcgggaggagtgccaggagagaaattctgagagctatgagcagcacatccacctggagcaccaccagaggcagcaggtggcctaccagaagtacagcgagttcttccacgagaaggtggaccctgccattgatgagggcaagctggtggtgcaggacatcgagcagagcgtgtggatccacagccacgtgggcagcaaggagcacagccacatgctgcagaaggtgcaggagcacatcaagagggtgtctgacatggtggaggacctgtacagaaggaaggcctgggccggggctgaggaggccatgacccggctggtgaacatcctgatcctgtctgtgagagatgcccgggactggctgatgaagacagagacccggctgaagaaggagggcatcgtgcaggaggatgattatgaaaatgaggtggaggactttggagagctgcggccccggcggcgcagcaggaaatgtgggaagcagaggaagtactag

SEQ ID NO: 42645 - DNA, 7128 bp, Artificial Sequence; identical to SEQ ID NO: 42644
  Description of Artificial Sequence: Synthetic coding sequence

SEQ ID NO: 42646 - DNA, 8778 bp, Artificial Sequence
  Description of Artificial Sequence: Synthetic coding sequence
atgtgggacccccgggccgcccgggtgcccccccgggacctggccgtgctgctgtgcaacaagagcaatgccttcttcagcctgggcaagtggaatgaggcctttgtggccgccaaggagtgcctgcagtgggaccccacctacgtgaagggctactacagagctggctacagcctgctgcggctgcaccagccctatgaggccgccaggatgttctttgagggcctgcggctggtgcagaggagccaggaccaggcccctgtggccgacttcctggtgggcgtcttcaccaccatgagcagtgacagcatcgtgctgcagagcttcctgccctgctttgaccacatcttcaccaccggcttccccacagaggtgtggcagagcgtcatcgagaagctggccaagaagggcctgtggcacagcttcctgctgctgagcgccaagaaggaccggctgcccaggaacatccacgtgcctgagctgagcctgaagagcctgtttgagaagtatgtgttcatcggcctgtatgagaagatggagcaggtgcccaagctggtgcagtggctgatcagcatcggggcctctgtggagaccatcggcccctaccccctgcacgccctgatgaggctgtgcatccaggcccgggagaaccacctgttccgctggctgatggaccacaagccagagtggaagggccgcatcaaccagaaggatggagatggctgcaccgtgctgcacgtggtggccgcccacagccctggctacctggtgaagaggcagacagaagatgtgcagatgctgctgcgctttggagctgaccccaccctgctggaccggcagagccgctctgtggtggatgtgctgaagaggaacaagaacttcaaggccatcgagaagatcaacagccacctggagaagctggccacctgcagcaaggacctgagcggcttcagcaatggagatggccccaccagtgaaaatgacatcttcaggaaggtgctggagcagctggtgaagtacatgaacagcggcaaccggctgctgcacaagaacttcctgaagcaggaggtggtgcagcgcttcctgcggctgctgagcaccctgcaggagatccccccagacctggtgtgtgacatcaaccaggactgtgccaccaccgtcttcaagttcctgctggagaagcagcgctggccagaggtgctgctgctgctgaccaggaaggtgtctggagagccccccctgggggactgcctgatcaaggactgcaacttcagtgacctggacatctgcaccatcatcccccacctgagcacctgggaccagaggaagaagcagctgctgggctgcctgattgattctggggccctgcctgatggcctgcaggagagccaggagaggcctgtggtgacctgcctgaagcatgaagattttgagctggccttcctgctgctgaccaagggagctgacccccgggccatcagcctgacagaaggagacacccccctgcacgccgccctgcacatcttcctggagatcaaggctgacatcggcttctccttcctgagccacctgctggacctcttctggagcaaccccacagaatttgactacctgaaccccaacgtgcaggacagcaatggaaacaccctgatgcacatcctcttccagaagggcatgctgaagagggtgaagaagctgctggacctgctggtgaagtttgacatcaacttcaacctgaagaacaaggagggcaaggatgcccggcaccgcatcaagaagaatgacagcctgctgctggcctggaacaaggccctgatggagaacagaagaagaagccggcaggacagcgctgcccacctgggcaagctgagcaagagcacagcccctggccacaccagccagctgaagagccagggcagcttcaagtctgtgccctgtggggccacagcccggaccctgcctgagggcagcgctgtgcctgacagctgggagaccctgcccggcacccaggtgaccaggaaggagcccggggccctgcggccctgcagcctgcgggactgcctgatgcaggacatcaccgtgctgatccagcaggtggaggtggaccccagcttccctgaggactgcctgcagagcagcgagcccctggaggccggggccggcaaggagggcaagaaggatgacaagcccaccctgggcgctggggccccagactgcagcgaggtgggggagggccacgcccaggtgggcctgggcgccctgcagctggtgcctgatgacaacagaggcaaggagggcaatgatgaccaggatgactggagcacccaggagattgaggcctgcctgcaggactttgacaacatgacctgggagattgaatgtaccagcgagatgctgaagaagctgagcagcaaggtgatgaccaaggtgatcaagaagaagatcatcctggccatccagcagctgggcaatggagagtggacccagggcctgcagaagaggctgaagcacctgaagggcagcatccagctgtttgaggccaagctggacaagggggccaggatgctgtgggagctggccatcgacttcagcccccgctgcagtgaaaatcctgagaagatcatcgccacagagcagaacacctgtgccatggagaagagcggccgcatctacacagagatcatccgcatctgggacatcgtgctggaccactgcaagctggccgacagcatcaaggccatctgcaatgcctacaacagaggcctgagctgtgtgctgaggaagaagctgaagggcatcaacaagggccaggtgtctgccaacatgaagatccagaagaggatcccccgctgctacgtggaggacacagaggccgagaagggccgggagcacgtgaaccctgagtacttccccccagccagcgctgtggagacagagtacaacatcatgaagttccacagcttcagcaccaacatggccttcaacatcctgaatgacaccacagccaccgtggagtaccccttccgggtgggggagctggagtatgctgtgattgacctgaacccccggcccctggagcccatcatcctgattggccgcagcggcaccgggaagaccacctgctgcctgtaccgcctgtggaagaagttccacgtgtactgggagaaggccgagcaggccggcagccccctgctggccaagcaggtgtggctgaagaggcggctggaggtggagcccgggaaggagagccctggaggagaggaggaggaggaggaggaggatgaggaggaggaggacagcattgaggtggagaccgtggagagcattgatgagcaggagtatgaggcctgtgccggcggggccggcgtggagcctgctggagatggccaggccgctgaggtgtgtgcccctgagcacccccaccagctggagcacctgcaccagatctttgtgaccaagaaccacgtgctgtgccaggaggtgcagaggaacttcatcgagctgagcaagagcaccaaggccaccagccactacaagcccctggaccccaacatccacaagctgcaggacctgagagatgagaacttccccctgtttgtgaccagcaagcagctgctgctgctgctggatgccagcctgcccaagcccttcttcctgagaaatgaagatggcagcctgaagaggaccatcatcggctggagcgcccaggaggagagcaccatccccagctggcaggaggatgaggaggaggccgaggtggatggagactacagcgaggaggacaaggctgtggagatgaggactggagacagcgacccccgggtgtatgtgacctttgaggtgttcaagaatgagatctggcccaagatgaccaagggccgcacagcctacaacccagccctgatctggaaggagatcaagagcttcctgaagggcagctttgaggccctgagctgcccccacggccgcctgacagaggaggtgtacaagaagctgggcaggaagcgctgccccaacttcaaggaggacagaagtgagatctacagcctcttcagcctgtaccagcagatccgcagccagaagggctactttgatgaagaagatgtgctgtacaacatcagccggcggctgagcaagctgcgggtgctgccctggagcatccacgagctgtatggagatgagatccaggacttcacccaggccgagctggccctgctgatgaagtgcatcaatgaccccaacagcatgttcctgactggagacacagcccagagcatcatgaagggcgtggccttccgcttcagtgacctgcggagcctcttccactacgccagcaggaacaccatcgacaagcagtgtgctgtgaggaagcccaagaagatccaccagctgtaccagaactaccgcagccacagcggcatcctgaacctggccagcggcgtggtggacctgctgcagttctacttccctgagagctttgaccggctgccccgggacagcggcctgtttgatggccccaagcccaccgtgctggagagctgcagcgtgtctgacctggccatcctgctgcggggcaacaagaggaagacccagcccattgaatttggagcccaccaggtgatcctggtggccaatgaaacagccaaggagaagatccctgaggagctgggcctggccctggtgctgaccatctatgaggccaagggcctggagtttgatgatgtgctgctgtacaacttcttcacagacagcgaggcctacaaggagtggaagatcatcagcagcttcacccccaccagcacagacagccgggaggagaaccggcccctggtggaggtgcccctggacaagccaggcagcagccagggccgcagcctgatggtgaaccctgagatgtacaagctgctgaatggagagctgaagcagctgtacacagccatcacccgggcccgggtgaacctgtggatctttgatgaaaatcgggagaagagggccccagccttcaagtacttcatcagaagagactttgtgcaggtggtgaagacagatgagaacaaggactttgatgacagcatgtttgtgaagaccagcaccccagctgagtggatcgcccagggcgactactatgccaagcaccagtgctggaaggtggccgccaagtgctaccagaagggcggggcctttgagaaggagaagctggccctggcccatgacacagccctgtccatgaagagcaagaaggtgagccccaaggagaagcagctggagtacctggagctggccaagacctacctggagtgcaaggagcccaccctgagcctgaagtgcctgtcctatgccaaggagttccagctgagcgcccagctgtgtgagcggctgggcaagatcagagatgctgcctacttctacaagaggagccagtgctacaaggatgccttccgctgctttgagcagatccaggagtttgacctggccctgaagatgtactgccaggaggagctgtttgaggaggccgccatcgctgtggagaagtatgaggagatgctgaagaccaagaccctgcccatcagcaagctgagctacagcgccagccagttctacctggaggccgccgccaagtacctgagcgccaacaagatgaaggagatgatggctgtgctgagcaagctggacatcgaggaccagctggtgttcctgaagagcaggaagaggctggccgaggccgctgacctgctgaaccgggagggcagaagagaggaggccgccctgctgatgaagcagcacggctgcctgctggaggccgcccggctgacagctgacaaggacttccaggccagctgcctgctgggcgccgcccggctgaatgtggcccgggacagcgacatcgagcacaccaaggacatcctgcgggaggccctggacatctgctaccagacaggccagctgtctggaattgctgaggcccacttcctgcagggcgtcatcctgcgggacttccagaagctgagagatgccttcttcaagtttgacaccctgaaccacagcgctggggtggtggaggccctgtatgaagctgccagccagtgtgaggccgagcctgagaagatcctgggcctggcccctgggggcctggagatcctgctgagcctggtgcgggccctgaagagggtgaccaacaatgctgagaaggagatggtgaagagctgctttgagttcttcggcatcagccaggtggatgccaagtactgccagatcgcccagaatgaccccggccccatcctgcgcatcatctttgacctggacctgaacctgcgggagaagaagaccaaggaccacttcctgatcatgacagaccaggtgaagctggccctgaacaagcacctgctgggccgcctgtgccagatcaccaggagcctgctgggcaagacctaccggggcgtgtgcatgaggttcatcgtgggcctgaagtgtgaagatgagaactgtgagcacttccaccggcccctgcggcgctgtgaggccaagtgcctggtgcagagcaagatgaacctggtggccatcaatggcctgctgctggaggccaagaaggtgttccccaagatcctggccgaggagctgaaggagattgactacatcctgagcacagacatgtatggcctgtgcaagagcatcctggatgtgctcttccccaagcacttccaccagagggtgctgtctgagaaccccatggcctgcaaggagatcctgaagcccaactacaagagcttccgcttctacagatttgccctgaaggagtacatccacttcctgtttgaaaatgaaagtgccaggaacagaagagagagcacagacctgtggctgagcgccatgcaggccttcctgctgagcagcaactacccagaggagtttgagaagctgctgcaccaggaggaggacaactacaaccgggagctgaaggccctggagagcgagaaggatgagcggggccggggccggggcagccgcatcaagggcatcgagggcaagtttggcatgctggcccccaacagagatgatgagaacatggacaagacccacctgtgcttcatccggctgctggagaactgcatcgaccagttctacgtgtacagaaatcctgaggactacaagaggctcttcttccgcttcatgaatgtgctgatcaagcgctgcaaggagcccctcatccccagcatcggcaacacagtggccctgctggagttccagttcatccactgcggcgtggtgctggcccggctgtggaagaatgtcatcctgtgcctgcccaagagctacatcgccctgctgcactactgggagttcctgttcagcaagaaggacaaggagctgggagatgtgttcagcatcatccaggagtacaagcccaaggatgtgacccgggccatccaggacttccgcttccacctgagctacctggccaaggtgctgtgtggctatgaaaatgtgaacttcaacgtgctgctggatgccttcagcgagattgattatgtggtgtctggagaggccgagaggaccctggtgctgtgcctggtgatgctggtgaatgctgaggagatcctgcagccctactgcaagcccctgctgtaccgccacttccgggagattgagagccggctgcagctgatgtccatggactgccccggccaggtgcctgagcggctgctgaaggtggtgaagagggtgctggtggccgtgaatgtgaagtctgtggccgaggccctgcaggacctgctgtttgaaagagatgaggagtacctgatggactgtgactggcgctgggaccctgtgcacaccaagggcagcatcgtgcggggcctgtactatgaggaggtgcggctgaaccggctgctgtgcctggaccctgtggactactttgctgagccagaatgtgaatttggccaggatgagatggatgagctggccctggaggaccgggaccacgtgctggccaccatcctgagccagaagcagaggaaggccagcatccagaggaagctgcggcgggcctgcctggtggtgtccctgtgcatctcctggaggcggcgggtgggcacccagatggagcgggtgcgggaggaggcccgggagccccgggccggcaacttcaagaaggcagatgtggacaggacccagtgtgacctgtgtggggtgaagttcacccggggccctgagaactacttcagccccagcaaggcctttgagggcgccgccagcgaggtggccgtgctgagcagagctgagctggagcgggaggagtgccaggagagaaattctgagagctatgagcagcacatccacctggagcaccaccagaggcagcaggtggcctaccagaagtacagcgagttcttccacgagaaggtggaccctgccattgatgagggcaagctggtggtgcaggacatcgagcagagcgtgtggatccacagccacgtgggcagcaaggagcacagccacatgctgcagaaggtgcaggagcacatcaagagggtgtctgacatggtggaggacctgtacagaaggaaggcctgggccggggctgaggaggccatgacccggctggtgaacatcctgatcctgtctgtgagagatgcccgggactggctgatgaagacagagacccggctgaagaaggagggcatcgtgcaggaggatgattatgaaaatgaggtggaggactttggagagctgcggccccggcggcgcagcaggaaatgtgggaagcagaggaagtactag

SEQ ID NO: 42647 - DNA, 2583 bp, Artificial Sequence
  Description of Artificial Sequence: Synthetic coding sequence
atggccccagctggctgctgctgctgctgctgcttctggggcggcgctgtggccgccgccggggccgcccggcgggtgctgctgctgctgctgctgggcgtgctgtctgctggcctgcggcctggggccctggccacagagcactacagccccctgagcctgctgaagcaggagctgcagcaccggcagcagcaggaggccccagctgggggcggcggctgcagcccccagagcggggactggggagaccagtacagcgcagaatgtggggagagcagcttcctgaacttccatgacagcgactgtgagcccaagggcagcagcccctgtgacagcctgctgagcctgaacacagagaagatcctgagccaggccaagagcattgctgagcagaagcgcttcccctttgccacagacaatgacagcaccaatgaggagctggccatcgcctacgtgctgattggcagcggcctgtatgatgaggccatccgccacttcagcaccatgctgcaggaggagccagacctggtgtctgccatctacggccggggcatcgcctacggcaagaagggcctgcatgacatcaagaatgctgagctggccctgtttgagctgagcagggtcatcaccctggagccagacaggcctgaggtgtttgagcagagagctgagatcctgagccccctgggccgcatcaatgaagctgtgaatgacctgaccaaggccatccagctgcagcccagcgcccggctgtaccgccaccggggcaccctgtacttcatcagtgaagattatgccacagcccacgaggacttccagcagagcctggagctgaacaagaaccagcccatcgccatgctgtacaagggcctgaccttcttccaccggggcctgctgaaggaggccatcgagagcttcaaggaggccctgaagcagaaggtggacttcattgatgcctacaagagcctgggccaggcctaccgggagctgggcaactttgaagctgccacagagagcttccagaaggccctgctgctgaaccagaaccacgtgcagaccctgcagctgcggggcatgatgctgtaccaccacggcagcctgcaggaggccctgaagaacttcaagcgctgcctgcagctggagccctacaatgaggtgtgccagtacatgaagggcctgagccacgtggccatgggccagttctatgagggcatcaaggcccagaccaaggtgatgctgaatgaccccctgcccggccagaaggccagccctgagtacctgaaggtgaagtacctgcgggagtacagccgctacctgcacgcccacctggacacccccctgacagagtacaacattgatgtggacctgcccggcagcttcaaggaccactgggccaagaacctgcccttcctgattgaagattatgaggagcagcccggcctgcagccccacatcaaggatgtgctgcaccagaactttgagagctacaagccagaggtgcaggagctgatctgtgtggccgaccggctgggcagcctgatgcagtatgagaccccaggcttcctgcccaacaagaggatccaccgggccatgggcctggccgccctggaggtgatgcaggccgtgcagaggacctggaccaacagcaaggtgaggatgaatggcaagacccggctgatgcagtggagggacatgtttgatattgctgtgaagtggaggagaattgctgaccctgaccagcctgtgctgtggctggaccagatgcctgcccggagcctgagccggggcttcaacaaccacatcaacctgatccggggccaggtgatcaacatgagatacctggagtactttgagaagatcctgcacttcatcaaggaccgcatcctggtgtaccacggggccaacaaccccaagggcctgctggaggtgcgggaggccctggagaaggtgcacaaggtggaggacctgctgcccatcatgaagcagttcaacaccaagaccaaggatggcttcaccgtgaacaccaaggtgcccagcctgaaggaccagggcaaggagtatgatggcttcaccatcaccatcactggagacaaggtgggcaacatcctcttctctgtggagacccagaccacagaggagaggacccagctgtaccacgccgagattgatgccctgtacaaggacctgacagccaagggcaaggtgctgatcctgagcagcgagtttggagaggctgatgctgtgtgcaacctgatcctgagcctggtgtactacttctacaacctgatgcccctgagccggggcagcagcgtcatcgcctacagcgtgattgtgggcgccctgatggccagcggcaaggaggtggccggcaagatccccaagggcaagctggtggactttgaggccatgacagcccctggcagcgaggccttcagcaaggtggccaagtcctggatgaacctgaagagcatcagccccagctacaagaccctgcccagcgtgtctgagaccttccccaccctgcgctccatgattgaggtgctgaacacagacagcagcccccgctgcctgaagaagctgtag

SEQ ID NO: 42648 - DNA, 2421 bp, Artificial Sequence
  Description of Artificial Sequence: Synthetic coding sequence
atggccccagctggctgctgctgctgctgctgcttctggggcggcgctgtggccgccgccggggccgcccggcgggtgctgctgctgctgctgctgggcgtgctgtctgctggcctgcggcctggggccctggccacagagcactacagccccctgagcctgctgaagcaggagctgcagcaccggcagcagcaggaggccccagctgggggcggcggctgcagcccccagagcggggactggggagaccagtacagcgcagaatgtggggagagcagcttcctgaacttccatgacagcgactgtgagcccaagggcagcagcccctgtgacagcctgctgagcctgaacacagagaagatcctgagccaggccaagagcattgctgagcagaagcgcttcccctttgccacagacaatgacagcaccaatgaggagctggccatcgcctacgtgctgattggcagcggcctgtatgatgaggccatccgccacttcagcaccatgctgcagatcctgagccccctgggccgcatcaatgaggccgtgaatgacctgaccaaggccatccagctgcagcccagcgcccggctgtaccgccaccggggcaccctgtacttcatcagcgaggactatgccacagcccacgaggacttccagcagagcctggagctgaacaagaaccagcccatcgccatgctgtacaagggcctgaccttcttccaccggggcctgctgaaggaggccatcgagagcttcaaggaggccctgaagcagaaggtggacttcattgatgcctacaagagcctgggccaggcctaccgggagctgggcaactttgaggccgccacagagagcttccagaaggccctgctgctgaaccagaaccacgtgcagaccctgcagctgcggggcatgatgctgtaccaccacggcagcctgcaggaggccctgaagaacttcaagcgctgcctgcagctggagccctacaatgaggtgtgccagtacatgaagggcctgagccacgtggccatgggccagttctatgagggcatcaaggcccagaccaaggtgatgctgaatgaccccctgcccggccagaaggccagccctgagtacctgaaggtgaagtacctgcgggagtacagccgctacctgcacgcccacctggacacccccctgacagagtacaacattgatgtggacctgcccggcagcttcaaggaccactgggccaagaacctgcccttcctgattgaggactatgaggagcagcccggcctgcagccccacatcaaggatgtgctgcaccagaactttgagagctacaagccagaggtgcaggagctgatctgtgtggccgaccggctgggcagcctgatgcagtatgagaccccaggcttcctgcccaacaagaggatccaccgggccatgggcctggccgccctggaggtgatgcaggccgtgcagaggacctggaccaacagcaaggtgaggatgaatggcaagacccggctgatgcagtggagggacatgtttgatattgctgtgaagtggaggagaattgctgaccctgaccagcctgtgctgtggctggaccagatgcctgcccggagcctgagccggggcttcaacaaccacatcaacctgatccggggccaggtgatcaacatgagatacctggagtactttgagaagatcctgcacttcatcaaggaccgcatcctggtgtaccatggagccaacaaccccaagggcctgctggaggtgcgggaggccctggagaaggtgcacaaggtggaggacctgctgcccatcatgaagttcaacaccaagaccaaggatggcttcaccgtgaacaccaaggtgcccagcctgaaggaccagggcaaggagtatgatggcttcaccatcaccatcactggagacaaggtgggcaacatcctcttctctgtggagacccagaccacagaggagaggacccagctgtaccacgccgagattgatgccctgtacaaggacctgacagccaagggcaaggtgctgatcctgagcagcgagtttggagaggctgatgctgtgtgcaacctgatcctgagcctggtgtactacttctacaacctgatgcccctgagccggggcagcagcgtcatcgcctacagcgtgattgtgggcgccctgatggccagcggcaaggaggtggccggcaagatccccaagggcaagctggtggactttgaggccatgacagcccctggcagcgaggccttcagcaaggtggccaagtcctggatgaacctgaagagcatcagccccagctacaagaccctgcccagcgtgtctgagaccttccccaccctgcgctccatgattgaggtgctgaacacagacagcagcccccgctgcctgaagaagctgtag

SEQ ID NO: 42649 - DNA, 2424 bp, Artificial Sequence
  Description of Artificial Sequence: Synthetic coding sequence
atggccccagctggctgctgctgctgctgctgcttctggggcggcgctgtggccgccgccggggccgcccggcgggtgctgctgctgctgctgctgggcgtgctgtctgctggcctgcggcctggggccctggccacagagcactacagccccctgagcctgctgaagcaggagctgcagcaccggcagcagcaggaggccccagctgggggcggcggctgcagcccccagagcggggactggggagaccagtacagcgcagaatgtggggagagcagcttcctgaacttccatgacagcgactgtgagcccaagggcagcagcccctgtgacagcctgctgagcctgaacacagagaagatcctgagccaggccaagagcattgctgagcagaagcgcttcccctttgccacagacaatgacagcaccaatgaggagctggccatcgcctacgtgctgattggcagcggcctgtatgatgaggccatccgccacttcagcaccatgctgcagatcctgagccccctgggccgcatcaatgaggccgtgaatgacctgaccaaggccatccagctgcagcccagcgcccggctgtaccgccaccggggcaccctgtacttcatcagcgaggactatgccacagcccacgaggacttccagcagagcctggagctgaacaagaaccagcccatcgccatgctgtacaagggcctgaccttcttccaccggggcctgctgaaggaggccatcgagagcttcaaggaggccctgaagcagaaggtggacttcattgatgcctacaagagcctgggccaggcctaccgggagctgggcaactttgaggccgccacagagagcttccagaaggccctgctgctgaaccagaaccacgtgcagaccctgcagctgcggggcatgatgctgtaccaccacggcagcctgcaggaggccctgaagaacttcaagcgctgcctgcagctggagccctacaatgaggtgtgccagtacatgaagggcctgagccacgtggccatgggccagttctatgagggcatcaaggcccagaccaaggtgatgctgaatgaccccctgcccggccagaaggccagccctgagtacctgaaggtgaagtacctgcgggagtacagccgctacctgcacgcccacctggacacccccctgacagagtacaacattgatgtggacctgcccggcagcttcaaggaccactgggccaagaacctgcccttcctgattgaggactatgaggagcagcccggcctgcagccccacatcaaggatgtgctgcaccagaactttgagagctacaagccagaggtgcaggagctgatctgtgtggccgaccggctgggcagcctgatgcagtatgagaccccaggcttcctgcccaacaagaggatccaccgggccatgggcctggccgccctggaggtgatgcaggccgtgcagaggacctggaccaacagcaaggtgaggatgaatggcaagacccggctgatgcagtggagggacatgtttgatattgctgtgaagtggaggagaattgctgaccctgaccagcctgtgctgtggctggaccagatgcctgcccggagcctgagccggggcttcaacaaccacatcaacctgatccggggccaggtgatcaacatgagatacctggagtactttgagaagatcctgcacttcatcaaggaccgcatcctggtgtaccatggagccaacaaccccaagggcctgctggaggtgcgggaggccctggagaaggtgcacaaggtggaggacctgctgcccatcatgaagcagttcaacaccaagaccaaggatggcttcaccgtgaacaccaaggtgcccagcctgaaggaccagggcaaggagtatgatggcttcaccatcaccatcaccggggacaaggtgggcaacatcctcttctctgtggagacccagaccacagaggagaggacccagctgtaccacgccgagattgatgccctgtacaaggacctgacagccaagggcaaggtgctgatcctgagcagcgagtttggagaggctgatgctgtgtgcaacctgatcctgagcctggtgtactacttctacaacctgatgcccctgagccggggcagctctgtgattgcctacagcgtcatcgtgggcgccctgatggccagcggcaaggaggtggccggcaagatccccaagggcaagctggtggactttgaggccatgacagcccctggcagcgaggccttcagcaaggtggccaagtcctggatgaacctgaagagcatcagccccagctacaagaccctgcccagcgtgtctgagaccttccccaccctgcgctccatgattgaggtgctgaacacagacagcagcccccgctgcctgaagaagctgtag

SEQ ID NO: 42650 - DNA, 2313 bp, Artificial Sequence
  Description of Artificial Sequence: Synthetic coding sequence
atggaccgggacctgctgcggcagagcctgaactgccacggcagcagcctgctgagcctgctgcggtctgagcagcaggacaacccccacttccgcagcctgctgggcagcgctgctgagcccgcccggggccccccaccccagcaccccctgcagggcaggaaggagaagagggtggacaacatcgagatccagaagttcatcagcaagaaggctgacctgctgtttgccctgtcctggaagagtgatgccccagccaccagcgagatcaatgaagattctgaggaccactacgccatcatgccacccctggagcagttcatggagatccccagcatggacagaagagagctgttcttccgggacatcgagcggggggacatcgtcatcggccgcatcagcagcatccgggagtttggcttcttcatggtgctgatctgcctgggcagcggcatcatgagggacatcgcccacctggagatcacagccctgtgccccctgagagatgtgcccagccacagcaaccacggggaccccctgagctactaccagacaggagacatcatccgggccggcatcaaggacatcgaccgctaccacgagaagctggccgtgtccctgtacagcagcagcctgcccccccacctgagcggcatcaagctgggcgtcatcagcagcgaggagctgcccctgtactaccgccgctctgtggagctgaacagcaacagcctggagagctatgaaaatgtgatgcagagcagcctgggctttgtgaaccctggggtggtggagttcctgctggagaagctgggcattgatgagagcaacccccccagcctgatgaggggcctgcagagcaagaacttctctgaagatgactttgccagcgccctgaggaagaagcagagcgcctcctgggccctgaagtgtgtgaagattggagtggactacttcaaggtgggcagacatgtggatgccatgaatgagtacaacaaggccctggagattgacaagcagaatgtggaggccctggtggcccggggggccctgtatgccaccaagggcagcctgaacaaggccatcgaggactttgagctggccctggagaactgccccacccacagaaatgccaggaagtacctgtgccagaccctggtggagcggggcggccagctggaggaggaggagaagttcctgaatgctgagagctactacaagaaggccctggccctggatgagaccttcaaggatgctgaagatgccctgcagaagctgcacaagtacatgcagaagagcctggagctgcgggagaagcaggccgagaaggaggagaagcagaagaccaagaagattgagaccagcgctgagaagctgaggaagctgctgaaggaggagaagaggctgaagaagaagaggaggaagagcaccagcagcagctctgtgtcctctgcagatgaatctgtgagcagcagcagcagcagcagcagcagcggccacaagaggcacaagaagcacaagaggaacagaagtgagagcagccgcagcagcagaagacacagcagccgggccagcagcaaccagattgaccagaacaggaaggatgagtgctaccctgtgcctgccaacaccagcgccagcttcctgaaccacaagcaggaggtggagaagctgctgggcaagcaggaccggctgcagtatgagaagacccagatcaaggagaaggaccgctgccccctgagcagcagcagcctggagatcccagatgactttggaggccgctctgaggacccccgggacttctacaacagctacaagacccaggccggcagcagcaagacagagaagccctacaagtctgagcggcacttcagcagcagaagaaacagcagtgacagcttctgcagaaattctgaggacaagatctacggctacagaagatttgagaaggacatcgagggcaggaaggagcactaccgccgctgggagcccggctctgtgcgccacagcaccagccctgccagcagcgagtacagctggaagtctgtggagaagtacaagaagtatgcccacagcggcagccgggacttcagcagacatgagcagcgctaccgcctgaacaccaaccagggcgagtatgaaagagaggacaactacggggaggacatcaagacagaggtgcctgaagaagatgccctgagcagcaaggagcacagcgagagctctgtgaagaagaacctgccccagaacctgctgaacatcttcaaccagattgctgagtttgagaaggagaagggcaacaagagcaagaactag

SEQ ID NO: 42651 - DNA, 1962 bp, Artificial Sequence
  Description of Artificial Sequence: Synthetic coding sequence
atggaccgggacctgctgcggcagagcctgaactgccacggcagcagcctgctgagcctgctgcggtctgagcagcaggacaacccccacttccgcagcctgctgggcagcgctgctgagcccgcccggggccccccaccccagcaccccctgcagggcaggaaggagaagagggtggacaacatcgagatccagaagttcatcagcaagaaggctgacctgctgtttgccctgtcctggaagagtgatgccccagccaccagcgagatcaatgaagattctgaggaccactacgccatcatgccacccctggagcagttcatggagatccccagcatggacagaagagagctgttcttccgggacatcgagcggggggacatcgtcatcggccgcatcagcagcatccgggagtttggcttcttcatggtgctgatctgcctgggcagcggcatcatgagggacatcgcccacctggagatcacagccctgtgccccctgagagatgtgcccagccacagcaaccacggggaccccctgagctactaccagacaggagacatcatccgggccggcatcaaggacatcgaccgctaccacgagaagctggccgtgtccctgtacagcagcagcctgcccccccacctgagcggcatcaagctgggcgtcatcagcagcgaggagctgcccctgtactaccgccgctctgtggagctgaacagcaacagcctggagagctatgaaaatgtgatgcagagcagcctgggctttgtgaaccctggggtggtggagttcctgctggagaagctgggcattgatgagagcaacccccccagcctgatgaggggcctgcagagcaagaacttctctgaagatgactttgccagcgccctgaggaagaagcagagcgcctcctgggccctgaagtgtgtgaagattggagtggactacttcaaggtgggcagacatgtggatgccatgaatgagtacaacaaggccctggagattgacaagcagaatgtggaggccctggtggcccggggggccctgtatgccaccaagggcagcctgaacaaggccatcgaggactttgagctggccctggagaactgccccacccacagaaatgccaggaagtacctgtgccagaccctggtggagcggggcggccagctggaggaggaggagaagttcctgaatgctgagagctactacaagaaggccctggccctggatgagaccttcaaggatgctgaagatgccctgcagaagctgcacaagtacatgcagaagagcctggagctgcgggagaagcaggccgagaaggaggagaagcagaagaccaagaagattgagaccagcgctgagaagctgaggaagctgctgaaggaggagaagaggctgaagaagaagaggaggaagagcaccagcagcagctctgtgtcctctgcagatgaatctgtgagcagcagcagcagcagcagcagcagcggccacaagaggcacaagaagcacaagaggaacagaagtgagagcagccgcagcagcagaagacacagcagccgggccagcagcaaccagattgaccagaacaggaaggatgagtgctaccctgtgcctgccaacaccagcgccagcttcctgaaccacaagcaggaggtggagaagctgctgggcaagcaggaccggctgcagtatgagaagacccagatcaaggagaaggaccgctgccccctgagcagcagcagcctggagatcccagatgactttggagtgtacagctacctgttcaagaagctgaccatcaagcagccccaggccggccccagcggggacatccctgaggagggcatcgtcatcattgatgacagcagcatccacgtgacagatcctgaggacctgcaggtgggccaggacatggaggtggaggacagcggcattgatgatcctgaccacggctag

SEQ ID NO: 42652 - DNA, 1320 bp, Artificial Sequence
  Description of Artificial Sequence: Synthetic coding sequence
atggaccgggacctgctgcggcagagcctgaactgccacggcagcagcctgctgagcctgctgcggtctgagcagcaggacaacccccacttccgcagcctgctgggcagcgctgctgagcccgcccggggccccccaccccagcaccccctgcagggcaggaaggagaagagggtggacaacatcgagatccagaagttcatcagcaagaaggctgacctgctgtttgccctgtcctggaagagtgatgccccagccaccagcgagatcaatgaagattctgaggaccactacgccatcatgccacccctggagcagttcatggagatccccagcatggacagaagagagctgttcttccgggacatcgagcggggggacatcgtcatcggccgcatcagcagcatccgggagtttggcttcttcatggtgctgatctgcctgggcagcggcatcatgagggacatcgcccacctggagatcacagccctgtgccccctgagagatgtgcccagccacagcaaccacggggaccccctgagctactaccagacaggagacatcatccgggccggcatcaaggacatcgaccgctaccacgagaagctggccgtgtccctgtacagcagcagcctgcccccccacctgagcggcatcaagctgggcgtcatcagcagcgaggagctgcccctgtactaccgccgctctgtggagctgaacagcaacagcctggagagctatgaaaatgtgatgcagagcagcctgggctttgtgaaccctggggtggtggagttcctgctggagaagctgggcattgatgagagcaacccccccagcctgatgaggggcctgcagagcaagaacttctctgaagatgactttgccagcgccctgaggaagaagcagagcgcctcctgggccctgaagtgtgtgaagattggagtggactacttcaaggtgggcagacatgtggatgccatgaatgagtacaacaaggccctggagattgacaagcagaatgtggaggccctggtggcccggggggccctgtatgccaccaagggcagcctgaacaaggccatcgaggactttgagctggccctggagaactgccccacccacagaaatgccaggaagtacctgtgccagaccctggtggagcggggcggccagctggaggaggaggagaagttcctgaatgctgagagctactacaagaaggccctggccctggatgagaccttcaaggatgctgaagatgccctgcagaagctgcacaagtacatgcaggtgatcccctacttcctgctggagatctag

SEQ ID NO: 42653 - DNA, 1125 bp, Artificial Sequence
  Description of Artificial Sequence: Synthetic coding sequence
atggcctggctggacagcaggaacaccagcctgcccagcctgggcttctgcctgctgctgctgcccctgcacccagcccccctgctgcccaccacccccaccccagccctgtgccccggcctggtgcacagccagggccaccccagcgcctgcccccacttcccccacagctacagccggggccagcagtgcctggagcaggccgactgggagacagctgtgctgctcttcagccgggccctgcacctggacccccagctgggccagtgcctgtttgagcagtgtgccttcctggatgccctgaatgtgttcagccatgctgctgagctgcagcctgagaagccctgcttccgctaccgctgcatggcctgcctgctggccctgaagcagcaccaggcctgcctgaccctcatcaccaatgagctgaagcaggacaccaccaatgctgatgtgtacatcttccgggcccggctgtacaacttcctgcagaagccccacctgtgctacagagacctgcacagcgccctgctgctgaaccccaagcacccccaggccaggatgctgctgcagaagatggtggcccaggcccagcaggcccggcaggatgctggcatcctggccgtgcagggcaagctggccaggacagctgctgaccagccctgccaccgggagcagcccagcggcccccagagcctgcccctgcccggccaccacgtgcccacagcccctggggtgcgctggggcagcggcggcctgcctgagggcgccggccacggggaccggggccctgggggccacggggctgctggaacagccccagctgtggccgacctgcagaggctgtgccgggccctgctgcaggccggccgcctgcccggcggccgggctgctgctgagcagggccccccaggccgggctgctggggagaggaccctgcaccagccccggcggcagttccagaaggccgagaaccacttcagcacagccatccgccacaacccccagaaggcccagtactacctgtaccgggccaagagccggcagctgctgcagaacatctttggagcccggcaggatgtggccaccgtgctgctgctgaaccccaagcagcccaaggatgcctag

SEQ ID NO: 42654 - DNA, 1230 bp, Artificial Sequence
  Description of Artificial Sequence: Synthetic coding sequence
atgcacggcctgagccctggcccccaggccgccagcggcctgccccacgcccaccaccagagagctgaggccggccaccaccagaggcgctgcctgcacctgcccggccagaccctgcagctgagccctgaggccccacccctgctgcccggccctgcccagaggctggccgtggagagccaggccccagctggccaggatgctgccccagaagatggcggccctggccctgctggggccccccgctgtggggaccccggctgtgccggccaggccgccgccaggacagctgctgaccagccctgccaccgggagcagcccagcggcccccagagcctgcccctgcccggccaccacgtgcccacagcccctggggtgcgctggggcagcggcggcctgcctgagggcgccggccatggagaccggggccctgggggccatggagctgctggaacagccccagctgtggccgacctgcagaggctgtgccgggccctgctgcaggccggccgcctgcccggcggccgggctgctgctgagcagggccccccaggccgggccgccggggagaggaccctgcaccagccccggcggcagttccagaaggccgagaaccacttcagcacagccatccgccacaacccccagaaggcccagtactacctgtaccgggccaagagccggcagctgctgcagaacatctttggagcccggcaggatgtggccaccgtgctgctgctgaaccccaagcagcccaagctgagcctgctgatgaccaacctcttccctggcatgtctgtggaggaggtgctgagcacccagatcgcccacctggcccggctgcagctggagcagatggtggagggcagcctgcaggccggcagcccccagggcatcgtgggcatgctgaagagacatgagctggagcggcagaaggccctggccctgcagcacagctggaagcagggcgagcccctgattgccaccagcgaggagctgaaggccaccccagagatcccccaggtgaagccaggcagcagcgagggggaggccgaggcccctgaggaggaggaggagaaggagaaggagaagaaggaggtgtctggagtgcaggcccgggcccggagcccctggggcctgggccacagcgtgccccagcccagggctgagggctgcaggcctgtggagagcggcttccaggcctggctgtgcaccccatctgctgtgtag

SEQ ID NO: 42655 - DNA, 2622 bp, Artificial Sequence
  Description of Artificial Sequence: Synthetic coding sequence
atgacagacagtgatgaagatgccctgaaggtggaccagggccccagccgggacatccccaagccctgggtgatcccagcccccaagggcatcctgcagcacatcttcggcaccagccacgtgttccagagcatctgtgatgtgaagcccaaggtgacaggcctgactgtgcccctgaaggtgcgggagtactacagccggggccagcagtgcctggagcaggccgactgggagacagctgtgctgctcttcagccgggccctgcacctggacccccagctggtggacttctacgccctgcgggcagaggcctacctgcagctgtgtgacttcagcagcgctgcccagaacctgcggcgggcctacagcctgcagcaggacaactgcaagcacctggagcggctgacctttgtgctgtacctgcagggccagtgcctgtttgagcagtgtgccttcctggatgccctgaatgtgttcagccacgccgctgagctgcagcctgagaagccctgcttccgctaccgctgcatggcctgcctgctggccctgaagcagcaccaggcctgcctgaccctcatcaccaatgagctgaagcaggacaccaccaatgctgatgtgtacatcttccgggcccggctgtacaacttcctgcagaagccccacctgtgctacagagacctgcacagcgccctgctgctgaaccccaagcacccccaggccaggatgctgctgcagaagatggtggcccaggcccagcaggcccggcaggatgctggcatcctggccgtgcagggcaagctgcagcacgccctgcagaggatcaacagagccatcgagaacaaccccctggaccccagcctcttcctgttccggggcaccatgtaccgccgcctgcaggagtttgatggagctgtggaggacttcctgaaggtgctggacatggtgacagaggaccaggaggacatggtgcggcaggcccagaggcagctgctgctgacctacaatgactttgctgtgcactgctaccggcagggcgcctaccaggagggcgtgctgctgctgaacaaggccctgagagatgagcagcaggagaagggcctgtacatcaacagaggagactgcttcttccagctgggcaacctggcctttgctgaggccgactaccagcaggccctggccctgagcccccaggatgagggcgccaacaccaggatgggcctgctgcaggagaagatgggcttctgtgagcagaggaggaagcagttccagaaggccgagaaccacttcagcacagccatccgccacaacccccagaaggcccagtactacctgtaccgggccaagagccggcagctgctgcagaacatctttggagcccggcaggatgtggccaccgtgctgctgctgaaccccaagcagcccaagctgagcctgctgatgaccaacctcttccctggcatgtctgtggaggaggtgctgagcacccagatcgcccacctggcccggctgcagctggagcagatggtggagggcagcctgcaggccggcagcccccagggcatcgtgggcatgctgaagagacatgagctggagcggcagaaggccctggccctgcagcacagctggaagcagggcgagcccctgattgccaccagcgaggagctgaaggccaccccagagatcccccaggtgaagccaggcagcagcgagggggaggccgaggcccctgaggaggaggaggagaaggagaaggagaagaaggaggagaagaagtctgagctgatccccagcaaggtggccagcctgagtgacagctacctggaccagaccagcagcgccagctccatgtccttccgcaccaccggcaccagcgagacagagatgtctgccatctgccaggagtaccgcagcaccagcgccacagctgtgaccttcagtgacagcagcctgctgaagacccagagcagtgacagcggcaacaaccgggaggccctgagccacggccccaggaagatcaaggccacccagggccagaggcagagcctgagcaagacagagcccacccagagccagaggaggaacagcagcaagaccaaggccaccatccacaagaggaacagcagcaagaccaaggccacccagagccagaggaggaacagcagcaagacccgggccacccagggccagggccagagcagcagcaagacagaggccacccagggccagaggcagagcagcagcgagattgaggccacccagggcccccggcaggagcccagcaagaccaagaccaccaggagcccccggcagaggcccaggaaggtgaaggccgcccggggccgctcctggaggcccagcaaggtggatgccacccagggccgcagccggggcctgctgcggagcagcaccaagacagaggccttctatgacagcaactggagcctgagcaagacagaatatgcccagggccagggccagaggagcagcaaggccgagggcgcccagggcaagagccagggcatgagcagcaccagcagcaaggccgagagcacctggggccccagccccagcctgagcaagacagaggtggaccaggacctgacctactatgaggccgtgtag

SEQ ID NO: 42656 - DNA, 726 bp, Artificial Sequence
  Description of Artificial Sequence: Synthetic coding sequence
atggcctgcctgctggccctgaagcagcaccaggcctgcctgaccctcatcaccaatgagctgaagcaggacaccaccaatgctgatgtgtacatcttccgggcccggctgtacaacttcctgcagaagccccacctgtgctacagagacctgcacagcgccctgctgctgaaccccaagcacccccaggccaggatgctgctgcagaagatggtggcccaggcccagcaggcccggcaggatgctggcatcctggccgtgcagggcaagctgcagcacgccctgcagaggatcaacagagccatcgagaacaaccccctggaccccagcctcttcctgttccggggcaccatgtaccgccgcctgcaggagtttgatggagctgtggaggacttcctgaaggtgctggacatggtgacagaggaccaggaggacatggtgcggcaggcccagaggcagctgctgctgacctacaatgactttgctgtgcactgctaccggcagggcgcctaccaggagggcgtgctgctgctgaacaaggccctgagagatgagcagcaggagaagggcctgtacatcaacagaggaggagcccagaggcctggccactggggcggcggcgtgcggggcagcctggccatcagcaaggcccccaccggccacctgcggcccctgggcggccgcaggaagggggagaggaaggaggcccgggaggaggagatgtag

SEQ ID NO: 42657 - DNA, 3426 bp, Artificial Sequence
  Description of Artificial Sequence: Synthetic coding sequence
atggctgctgctgtgggcgtgcggggccgctatgagctgcccccctgcagcggccctggctggctgctgagcctgagcgccctgctgtctgtggccgcccggggggcctttgccaccacccactgggtggtgacagaagatggcaagatccagcagcaggtggacagccccatgaacctgaagcacccccatgacctggtgatcctgatgaggcaggaggccaccgtgaactacctgaaggagctggagaagcagctggtggcccagaagatccacattgaagaaaatgaagatcgggacaccggcctggagcagaggcacaacaaggaggaccctgactgcatcaaggccaaggtgcccctgggggacctggacctgtatgatggcacctacatcaccctggagagcaaggacatcagccctgaggactacatcgacacagagagccctgtgcccccagaccctgagcagcctgactgcaccaagatcctggagctgccctacagcatccacgccttccagcacctgcggggcgtgcaggagcgggtgaacctgagcgcccccctgctgcccaaggaggaccccatcttcacctacctgagcaagaggctgggccgcagcattgatgacatcggccacctgatccacgagggcctgcagaagaacaccagctcctgggtgctgtacaacatggccagcttctactggaggatcaagaatgagccctaccaggtggtggagtgtgccatgagggccctgcacttcagcagccgccacaacaaggacatcgccctggtgaacctggccaacgtgctgcaccgggcccacttcagcgcagatgctgctgtggtggtgcatgctgccctggatgacagcgacttcttcaccagctactacaccctgggcaacatctatgccatgctgggggagtacaaccacagcgtgctgtgctatgaccacgccctgcaggcccggcccggctttgagcaggccatcaagaggaagcatgctgtgctgtgccagcagaagctggagcagaagctggaggcccagcacaggagcctgcagaggaccctgaatgagctgaaggagtaccagaagcagcacgaccactacctgcggcagcaggagatcctggagaagcacaagctgatccaggaggagcagatcctgaggaacatcatccacgagacccagatggccaaggaggcccagctgggcaaccaccagatctgccgcctggtgaaccagcagcacagcctgcactgccagtgggaccagcctgtgcgctaccacagaggagacatctttgaaaatgtggactatgtgcagtttggagaggacagcagcaccagctccatgatgtctgtgaactttgatgtgcagagcaaccagagcgacatcaatgattctgtgaagagcagccctgtggcccacagcatcctgtggatctggggccgggacagtgatgcctacagagacaagcagcacatcctgtggcccaagagagctgactgcacagagagctacccccgggtgcctgtgggcggggagctgcccacctacttcctgcccccagaaaataaaggcctgcgcatccacgagctgagcagtgatgactacagcacagaggaggaggcccagaccccagactgcagcatcacagacttcaggaagagccacaccctgagctacctggtgaaggagctggaggtgaggatggacctgaaggccaagatgccagatgaccacgccaggaagatcctgctgagccgcatcaacaactacaccatccctgaggaggagatcggcagcttcctgttccacgccatcaacaagcccaatgcccccatctggctgatcctgaatgaagctggcctgtactggagggctgtgggcaacagcacctttgccatcgcctgcctgcagagggccctgaacctggcccccctgcagtaccaggatgtgcccctggtgaacctggccaacctgctgatccactacggcctgcacctggatgccaccaagctgctgctgcaggccctggccatcaacagcagcgagcccctgaccttcctgagcctgggcaatgcctacctggccctgaagaacatcagcggggccctggaggccttccggcaggccctgaagctgaccaccaagtgcccagaatgtgagaacagcctgaagctgatccgctgcatgcagttctaccccttcctgtacaacatcaccagctctgtgtgcagcggcaccgtggtggaggagagcaatggaagtgatgagatggagaacagtgatgagaccaagatgtctgaggagatcctggccctggtggatgagttccagcaggcctggcccctggagggctttggaggagccctggagatgaagggccggcggctggacctgcagggcatccgggtgctgaagaagggcccccaggatggagtggcccggagcagctgctacggggactgccgctcagaagatgatgaggccacagagtggatcaccttccaggtgaagagggtgaagaagcccaagggggaccacaagaagacccctgggaagaaggtggagaccggccagattgaaaatggccaccgctaccaggccaacctggagatcaccggccccaaggtggccagccctggcccccagggcaagaagagggactaccagaggctgggctggcccagcccagatgagtgcctgaagctgcgctgggtggagctgacagccatcgtgtccacctggctggccgtgagcagcaagaacatcgacatcacagagcacatcgactttgccacccccatccagcagcctgccatggagcccctgtgcaatggaaacctgcccacctccatgcacaccctggaccacctgcacggcgtgagcaacagagccagcctgcactacacaggagagagccagctgacagaggtgctgcagaacctgggcaaggaccagtacccccagcagagcctggagcagatcggcacccgcatcgccaaggtgctggagaagaaccagacctcctgggtgctgagctccatggccgccctgtactggagggtgaagggccagggcaagaaggccatcgactgcctgcggcaggccctgcactacgccccccaccagatgaaggatgtgcccctcatcagcctggccaacatcctgcacaatgccaagctgtggaatgatgctgtgattgtggccaccatggctgtggagatcgccccccactttgctgtgaaccacttcaccctgggcaatgtgtatgtggccatggaggagtttgagaaggccctggtgtggtatgagagcaccctgaagctgcagcctgagtttgtgcctgccaagaaccgcatccagaccatccagtgccacctgatgctgaagaagggccgccgcagcccctag

SEQ ID NO: 42658 - DNA, 2871 bp, Artificial Sequence
  Description of Artificial Sequence: Synthetic coding sequence
atggctgctgctgtgggcgtgcggggccgctatgagctgcccccctgcagcggccctggctggctgctgagcctgagcgccctgctgtctgtggccgcccggggggcctttgccaccacccactgggtggtgacagaagatggcaagatccagcagcaggtggacagccccatgaacctgaagcacccccatgacctggtgatcctgatgaggcaggaggccaccgtgaactacctgaaggagctggagaagcagctggtggcccagaagatccacattgaagaaaatgaagatcgggacaccggcctggagcagaggcacaacaaggaggaccctgactgcatcaaggccaaggtgcccctgggggacctggacctgtatgatggcacctacatcaccctggagagcaaggacatcagccctgaggactacatcgacacagagagccctgtgcccccagaccctgagcagcctgactgcaccaagatcctggagctgccctacagcatccacgccttccagcacctgcggggcgtgcaggagcgggtgaacctgagcgcccccctgctgcccaaggaggaccccatcttcacctacctgagcaagaggctgggccgcagcattgatgacatcggccacctgatccacgagggcctgcagaagaacaccagctcctgggtgctgtacaacatggccagcttctactggaggatcaagaatgagccctaccaggtggtggagtgtgccatgagggccctgcacttcagcagccgccacaacaaggacatcgccctggtgaacctggccaacgtgctgcaccgggcccacttcagcgcagatgctgctgtggtggtgcatgctgccctggatgacagcgacttcttcaccagctactacaccctgggcaacatctatgccatgctgggggagtacaaccacagcgtgctgtgctatgaccacgccctgcaggcccggcccggctttgagcaggccatcaagaggaagcatgctgtgctgtgccagcagaagctggagcagaagctggaggcccagcacaggagcctgcagaggaccctgaatgagctgaaggagtaccagaagcagcacgaccactacctgcggcagcaggagatcctggagaagcacaagctgatccaggaggagcagatcctgaggaacatcatccacgagacccagatggccaaggaggcccagctgggcaaccaccagatctgccgcctggtgaaccagcagcacagcctgcactgccagtgggaccagcctgtgcgctaccacagaggagacatctttgaaaatgtggactatgtgcagtttggagaggacagcagcaccagctccatgatgtctgtgaactttgatgtgcagagcaaccagagcgacatcaatgattctgtgaagagcagccctgtggcccacagcatcctgtggatctggggccgggacagtgatgcctacagagacaagcagcacatcctgtggcccaagagagctgactgcacagagagctacccccgggtgcctgtgggcggggagctgcccacctacttcctgcccccagaaaataaaggcctgcgcatccacgagctgagcagtgatgactacagcacagaggaggaggcccagaccccagactgcagcatcacagacttcaggaagagccacaccctgagctacctggtgaaggagctggaggtgaggatggacctgaaggccaagatgccagatgaccacgccaggaagatcctgctgagccgcatcaacaactacaccatccctgaggaggagatcggcagcttcctgttccacgccatcaacaagcccaatgcccccatctggctgatcctgaatgaagctggcctgtactggagggctgtgggcaacagcacctttgccatcgcctgcctgcagagggccctgaacctggcccccctgcagtaccaggatgtgcccctggtgaacctggccaacctgctgatccactacggcctgcacctggatgccaccaagctgctgctgcaggccctggccatcaacagcagcgagcccctgaccttcctgagcctgggcaatgcctacctggccctgaagaacatcagcggggccctggaggccttccggcaggccctgaagctgaccaccaagtgcccagaatgtgagaacagcctgaagctgatccgctgcatgcagttctaccccttcctgtacaacatcaccagctctgtgtgcagcggcaactgccacgagaagaccctggacaacagccatgacaagcagaagtactttgacaacagccagagcctggatgctgctgaggaggagcccagcgagcggggcacagaggaggaccccgtcttctctgtggagaacagcggccgggacagtgatgccctgcggctggagagcacagtggtggaggagagcaatggaagtgatgagatggagaacagtgatgagaccaagatgtctgaggagatcctggccctggtggatgagttccagcaggcctggcccctggagggctttggaggagccctggagatgaagggccgccgcctggacctgcagggcatccgggtgctgaagaagggcccccaggatggagtggcccggagcagctgctatggagactgccgctcagaagatgatgaggccacagagtggatcaccttccaggtgaagagggtgaagaagcccaagggggaccacaagaagaccccaggcaagaaggtggagaccggccagattgaaaatggccaccgctaccaggccaacctggagatcaccggccccaaggtggccagccctggcccccagggcctgctggactggaagaccaggaaggtgccctag

SEQ ID NO: 42659 - DNA, 3366 bp, Artificial Sequence
  Description of Artificial Sequence: Synthetic coding sequence
atggagcaggtgcccagcgctggccgcctggtgcagatcaccgtgacagagggctatgacctgaagggcttcaagggggacacccctgtgaccttcatccgggcagagttcaaccaggtggtgctgggggacagcgccaagatcaccgtgtccccagagggcagcgccaagtacaacttcaccagcagctttgagttcaaccctgagggcggcatcaccagtgatgacctggcccacaagcctgtgttcctgactgtgacagaggtgctgcccaaggagaagaagcagaaggaggagaagaccctcatcctgggccaggccgtggtggacctgctgcccctgctggagggccagagcagcttccagaccaccgtgcccctgcaccctgtgcagggcagccccctggagacccccaggagcagcgccaagcagtgcagcctggaggtgaaggtgctggtggccgagcccctgctgaccacagcccagatcagcggcggcaacctgctgaaggtgaccctggaggccgcctacagcgtgcctgagagcttcatccccaccggccctggccagaactacatggtgggcctgcaggtgcccagcctgggggagaaggactaccccatcctcttcaagaatggcaccctgaagctgggcggggagcgggagcctgtgccccggcccaagaagtggcccatcgccaacatcctggcccctggggccaacaacatcccagatgccttcatcgtgggcggcccctatgaggaggaggagggggagctgaaccaccctgaggacagcgagttcaggaaccaggccgagtgcatcaagaagaggatcatctgggacctggagagccgctgctacctggaccccagcgctgtggtgtccttccagaagagaattgctgactgccgcctgtggcctgtggagatcaccagggtgcccctggtgaccatccccaagggcaaggccggcaagacagagaagacagatgaggaggcccagctgtccttccatggagtggcctacgtgaacatggtgcccctgctgtacccaggagtgaagaggatccggggggccttccacgtgtacccctacctggacagcgtggtgcatgagaagaccaagtgcctgctgagcctcttccgggacatcggccaccacctgatccacaacaacaagattggaggcatcaacagcctgctgagcaagcaggccgtgtccaagaacctgaaggaggacaagcctgtgaaggagaaggacattgatggccggcccaggcctggagatgtgcaggcccccagcatcaagagccagagcagtgacacccccctggagggggagccccccctgagccacaaccctgagggccagcagtatgtggaggccggcacctacatcgtgctggagatccagctggacaaggccctggtgcccaagaggatgcctgaggagctggcccggcgggtgaaggagatgatccccccccggccccccctgaccaggagaactggaggagcccagaaggccatgtctgactaccacatccagatcaagaacatcagccgggccatcctggatgagtactacaggatgtttgggaagcaggtggccaagctggagagtgacatggacagcgagaccctggaggagcagaagtgccagctgtcctatgagctgaactgcagcggcaagtactttgccttcaaggagcagctgaagcatgctgtggtgaagatcgtgcgggacaagtacctgaagaccaccagctttgagagccaggaggagctgcagaccttcatcagcgagctgtatgtgttcctggtggaccagatgcacgtggccctgaaccagaccatgccagatgatgtgcagggcaccgtggccaccatctacaccagcagcgagcagctgcagctgtttgcctttgaagctgaggtgaatgaaaattttgagatggctgctgcctactacaaggagcggctggtgcgggagccccagaacctggaccactggctggactatggagccttctgcctgctgacagaggacaacatcaaggcccaggagtgcttccagaaggccctgagcctgaaccagagccacatccacagcctgctgctgtgtggggtgctggccgtgctgctggagaactatgagcaggccgagatcttctttgaagatgccacctgcctggagcccaccaacgtggtggcctggaccctgctgggcctgtactatgagatccagaacaatgacatccgcatggagatggccttccacgaggccagcaagcagctgcaggccaggatgctgcaggcccaggtgaccaagcagaagagcactggagtggaggacacagaggagcggggcaagcgggagagcagcctgggcccctggggcatcaccaacggcagcgccacagccatcaaggtggaggccccagctggccctggggccgccctgagcatcctggacaagttcctggaggagagcagcaagctgcagagcgacagccaggagcccatcctgaccacccagacctgggaccccagcatcagccagaagcccagcaacaccttcatcaaggagatccccaccaagaaggaggccagcaagtgccaggacagcagcgccctgctgcaccctggcctgcactatggagtgtcccagaccaccaccatcttcatggagaccatccacttcctgatgaaggtgaaggctgtgcagtatgtgcaccgggtgctggcccacgagctgctgtgcccccagggcggccccagctgtgagtactacctggtgctggcccagacccacatcctgaagaagaactttgccaaggccgaggagtacctgcagcaggccgcccagatggactacctgaaccccaacgtgtggggcctgaagggccacctgtacttcctgagcggcaaccacagcgaggccaaggcctgctatgaaagaaccatcagctttgtggtggatgccagcgagatgcacttcatcttcctgcggctgggcctcatctacctggaggagaaggagtatgagaaggccaagaagacctacatgcaggcctgcaagaggagccccagctgcctgacctggctgggcctgggcatcgcctgctaccgcctggaggagctgacagaagcagaagatgccctgtctgaggccaatgccctgaacaactacaatgctgaggtgtgggcctacctggccctggtgtgcctgaaggtgggccggcagctggaggccgagcaggcctacaagtacatgatcaagctgaagctgaaggatgaggccctgctggccgagatccacaccctgcaggagaccgtgggcttcggcaaccccagcttctag

SEQ ID NO: 42660 - DNA, 1086 bp, Artificial Sequence
  Description of Artificial Sequence: Synthetic coding sequence
atggagcaggtgcccagcgctggccgcctggtgcagatcaccgtgacagagggctatgacctgaagggcttcaagggggacacccctgtgaccttcatccgggcagagttcaaccaggtggtgctgggggacagcgccaagatcaccgtgtccccagagggcagcgccaagtacaacttcaccagcagctttgagttcaaccctgagggcggcatcaccagtgatgacctggcccacaagcctgtgttcctgactgtgacagaggtgctgcccaaggagaagaagcagaaggaggagaagaccctcatcctgggccaggccgtggtggacctgctgcccctgctggagggccagagcagcttccagaccaccgtgcccctgcaccctgtgcagggcagccccctggagacccccaggagcagcgccaagcagtgcagcctggaggtgaaggtgctggtggccgagcccctgctgaccacagcccagatcagcggcggcaacctgctgaaggtgaccctggaggccgcctacagcgtgcctgagagcttcatccccaccggccctggccagaactacatggtgggcctgcaggtgcccagcctgggggagaaggactaccccatcctcttcaagaatggcaccctgaatggaaaccacagcgaggccaaggcctgctatgaaagaaccatcagctttgtggtggatgccagcgagatgcacttcatcttcctgcggctgggcctcatctacctggaggagaaggagtatgagaaggccaagaagacctacatgcaggcctgcaagaggagccccagctgcctgacctggctgggcctgggcatcgcctgctaccgcctggaggagctgacagaagcagaagatgccctgtctgaggccaatgccctgaacaactacaatgctgaggtgtgggcctacctggccctggtgtgcctgaaggtgggccggcagctggaggccgagcaggcctacaagtacatgatcaagctgaagctgaaggatgaggccctgctggccgagatccacaccctgcaggagaccgtgggcttcggcaaccccagcttctag

SEQ ID NO: 42661 - DNA, 3366 bp, Artificial Sequence; identical to SEQ ID NO: 42659
  Description of Artificial Sequence: Synthetic coding sequence

SEQ ID NO: 42662 - DNA, 1758 bp, Artificial Sequence
  Description of Artificial Sequence: Synthetic coding sequence
atggagcaggtgcccagcgctggccgcctggtgcagatcaccgtgacagagggctatgacctgaagggcttcaagggggacacccctgtgaccttcatccgggcagagttcaaccaggtggtgctgggggacagcgccaagatcaccgtgtccccagagggcagcgccaagtacaacttcaccagcagctttgagttcaaccctgagggcggcatcaccagtgatgacctggcccacaagcctgtgttcctgactgtgacagaggtgctgcccaaggagaagaagcagaaggaggagaagaccctcatcctgggccaggccgtggtggacctgctgcccctgctggagggccagagcagcttccagaccaccgtgcccctgcaccctgtgcagggcagccccctggagacccccaggagcagcgccaagcagtgcagcctggaggtgaaggtgctggtggccgagcccctgctgaccacagcccagatcagcggcggcaacctgctgaaggtgaccctggaggccgcctacagcgtgcctgagagcttcatccccaccggccctggccagaactacatggtgggcctgcaggtgcccagcctgggggagaaggactaccccatcctcttcaagaatggcaccctgaagctgggcggggagcgggagcctgtgccccggcccaagaagtggcccatcgccaacatcctggcccctggggccaacaacatcccagatgccttcatcgtgggcggcccctatgaggaggaggagggggagctgaaccaccctgaggacagcgagttcaggaaccaggccgagtgcatcaagaagaggatcatctgggacctggagagccgctgctacctggaccccagcgctgtggtgtccttccagaagagaattgctgactgccgcctgtggcctgtggagatcaccagggtgcccctggtgaccatccccaagggcaaggccggcaagacagagaagacagatgaggaggcccagctgtccttccatggagtggcctacgtgaacatggtgcccctgctgtacccaggagtgaagaggatccggggggccttccacgtgtacccctacctggacagcgtggtgcatgagaagaccaagtgcctgctgagcctcttccgggacatcggccaccacctgatccacaacaacaagattggaggcatcaacagcctgctgagcaagcaggccgtgtccaagaacctgaaggaggacaagcctgtgaaggagaaggacattgatggccggcccaggcctggagatgtgcaggcccccagcatcaagagccagagcagtgacacccccctggagggggagccccccctgagccacaaccctgagggccagcagtatgtggaggccggcacctacatcgtgctggagatccagctggacaaggccctggtgcccaagaggatgcctgaggagctggcccggcgggtgaaggagatgatccccccccggccccccctgaccaggagaactggaggagcccagaaggccatgtctgactaccacatccagatcaagaacatcagccgggccatcctggatgagtactacaggatgtttgggaagcaggtggccaagctggagagtgacatggacagcgagaccctggaggagcaggcctacaagtacatgatcaagctgaagctgaaggatgaggccctgctggccgagatccacaccctgcaggagaccgtgggcttcggcaaccccagcttctag

SEQ ID NO: 42663 - DNA, 360 bp, Artificial Sequence
  Description of Artificial Sequence: Synthetic coding sequence
atggagcaggtgcccagcgctggccgcctggtgcagatcaccgtgacagagggctatgacctgaagggcttcaagggggacacccctgtgaccttcatccgggcagagttcaaccaggtggtgctgggggacagcgccaagatcaccgtgtccccagagggcagcgccaagtacaacttcaccagcagctttgagttcaaccctgagggcggcatcaccagtgatgacctggcccacaagcctgtgttcctgactgtgacagaggtgctgcccaaggagaagaagcagaaggaggagaagaccctcatcctgggccaggccgtggtggacctgctgcccctgctggagggccagagctag

SEQ ID NO: 42664 - DNA, 3276 bp, Artificial Sequence
  Description of Artificial Sequence: Synthetic coding sequence
atggagcaggtgcccagcgctggccgcctggtgcagatcaccgtgacagagggctatgacctgaagggcttcaagggggacacccctgtgaccttcatccgggcagagttcaaccaggtggtgctgggggacagcgccaagatcaccgtgtccccagagggcagcgccaagtacaacttcaccagcagctttgagttcaaccctgagggcggcatcaccagtgatgacctggcccacaagcctgtgttcctgactgtgacagaggtgctgcccaaggagaagaagcagaaggaggagaagaccctcatcctgggccaggccgtggtggacctgctgcccctgctggagggccagagcagcttccagaccaccgtgcccctgcaccctgtgcagggcagccccctggagacccccaggagcagcgccaagcagtgcagcctggaggtgaaggtgctggtggccgagcccctgctgaccacagcccagatcagcggcggcaacctgctgaaggtgaccctggaggccgcctacagcgtgcctgagagcttcatccccaccggccctggccagaactacatggtgggcctgcaggtgcccagcctgggggagaaggactaccccatcctcttcaagaatggcaccctgaagctgggcggggagcgggagcctgtgccccggcccaagaagtggcccatcgccaacatcctggcccctggggccaacaacatcccagatgccttcatcgtgggcggcccctatgaggaggaggagggggagctgaaccaccctgaggacagcgagttcaggaaccaggccgagtgcatcaagaagaggatcatctgggacctggagagccgctgctacctggaccccagcgctgtggtgtccttccagaagagaattgctgactgccgcctgtggcctgtggagatcaccagggtgcccctggtgaccatccccaagggcaaggccggcaagacagagaagacagatgaggaggcccagctgtccttccatggagtggcctacgtgaacatggtgcccctgctgtacccaggagtgaagaggatccggggggccttccacgtgtacccctacctggacagcgtggtgcatgagaagaccaagtgcctgctgagcctcttccgggacatcggccaccacctgatccacaacaacaagattggaggcatcaacagcctgctgagcaagcaggccgtgtccaagaacctgaaggaggacaagcctgtgaaggagaaggacattgatggccggcccaggcctggagatgtgcaggcccccagcatcaagagccagagcagtgacacccccctggagggggagccccccctgagccacaaccctgagggccagcagtatgtggaggccggcacctacatcgtgctggagatccagctggacaaggccctggtgcccaagaggatgcctgaggagctggcccggcgggtgaaggagatgatccccccccggccccccctgaccaggagaactggaggagcccagaaggctgtgtctgactaccacatccagatcaagaacatcagccgggccatcctggatgagtactacaggatgtttgggaagcaggtggccaagctggagagtgacatggacagcgagaccctggaggagcagaagtgccagctgtcctatgagctgaactgcagcggcaagtactttgccttcaaggagcagctgaagcatgctgtggtgaagatcgtgcgggacaagtacctgaagaccaccagctttgagagccaggaggagctgcagaccttcatcagcgagctgtatgtgttcctggtggaccagatgcacgtggccctgaaccagaccatgccagatgatgtgcagggcaccgtggccaccatctacaccagcagcgagcagctgcagctgtttgcctttgaagctgaggtgaatgaaaattttgagatggctgctgcctactacaaggagcggctggtgcgggagccccagaacctggaccactggctggactatggagccttctgcctgctgacagaggacaacatcaaggcccaggagtgcttccagaaggccctgagcctgaaccagagccacatccacagcctgctgctgtgtggggtgctggccgtgctgctggagaactatgagcaggccgagatcttctttgaagatgccacctgcctggagcccaccaacgtggtggcctggaccctgctgggcctgtactatgagatccagaacaatgacatccgcatggagatggccttccacgaggccagcaagcagctgcaggccaggatgctgcaggcccaggtgaccaagcagaagagcactggagtggaggacacagaggagcggggcaagcgggagagcagcctgggcccctggggcatcaccaacggcagcgccacagccatcaaggtggaggccccagctggccctggggccgccctgagcatcctggacaagttcctggaggagagcagcaagctgcagagcgacagccaggagcccatcctgaccacccagacctgggaccccagcatcagccagaagcccagcaacaccttcatcaaggagatccccaccaagaaggaggccagcaagtgccaggacagcagcgccctgctgcaccctggcctgcactatggagtgtcccagaccaccaccatcttcatggagaccatccacttcctgatgaaggtgaaggctgtgcagtatgtgcaccgggtgctggcccacgagctgctgtgcccccagggcggccccagctgtgagtactacctggtgctggcccagacccacatcctgaagaagaactttgccaaggccgaggagtacctgcagcaggccgcccagatggactacctgaaccccaacgtgtggggcctgaagggccacctgtacttcctgagcggcaaccacagcgaggccaaggcctgctatgaaagaaccatcagctttgtggtggatgccagcgagatgcacttcatcttcctgcggctgggcctcatctacctggaggagaaggagctggaggagctgacagaagcagaagatgccctgtctgaggccaatgccctgaacaactacaatgctgaggtgtgggcctacctggccctggtgtgcctgaaggtgggccggcagctggaggccgagcaggcctacaagtacatgatcaagctgaagctgaaggatgaggccctgctggccgagatccacaccctgcaggagaccgtgggcttcggcaaccccagcttctag

SEQ ID NO: 42665 - DNA, 3366 bp, Artificial Sequence
  Description of Artificial Sequence: Synthetic coding sequence
atggagcaggtgcccagcgctggccgcctggtgcagatcaccgtgacagagggctatgacctgaagggcttcaagggggacacccctgtgaccttcatccgggcagagttcaaccaggtggtgctgggggacagcgccaagatcaccgtgtccccagagggcagcgccaagtacaacttcaccagcagctttgagttcaaccctgagggcggcatcaccagtgatgacctggcccacaagcctgtgttcctgactgtgacagaggtgctgcccaaggagaagaagcagaaggaggagaagaccctcatcctgggccaggccgtggtggacctgctgcccctgctggagggccagagcagcttccagaccaccgtgcccctgcaccctgtgcagggcagccccctggagacccccaggagcagcgccaagcagtgcagcctggaggtgaaggtgctggtggccgagcccctgctgaccacagcccagatcagcggcggcaacctgctgaaggtgaccctggaggccgcctacagcgtgcctgagagcttcatccccaccggccctggccagaactacatggtgggcctgcaggtgcccagcctgggggagaaggactaccccatcctcttcaagaatggcaccctgaagctgggcggggagcgggagcctgtgccccggcccaagaagtggcccatcgccaacatcctggcccctggggccaacaacatcccagatgccttcatcgtgggcggcccctatgaggaggaggagggggagctgaaccaccctgaggacagcgagttcaggaaccaggccgagtgcatcaagaagaggatcatctgggacctggagagccgctgctacctggaccccagcgctgtggtgtccttccagaagagaattgctgactgccgcctgtggcctgtggagatcaccagggtgcccctggtgaccatccccaagggcaaggccggcaagacagagaagacagatgaggaggcccagctgtccttccatggagtggcctacgtgaacatggtgcccctgctgtacccaggagtgaagaggatccggggggccttccacgtgtacccctacctggacagcgtggtgcatgagaagaccaagtgcctgctgagcctcttccgggacatcggccaccacctgatccacaacaacaagattggaggcatcaacagcctgctgagcaagcaggccgtgtccaagaacctgaaggaggacaagcctgtgaaggagaaggacattgatggccggcccaggcctggagatgtgcaggcccccagcatcaagagccagagcagtgacacccccctggagggggagccccccctgagccacaaccctgagggccagcagtatgtggaggccggcacctacatcgtgctggagatccagctggacaaggccctggtgcccaagaggatgcctgaggagctggcccggcgggtgaaggagatgatccccccccggccccccctgaccaggagaactggaggagcccagaaggctgtgtctgactaccacatccagatcaagaacatcagccgggccatcctggatgagtactacaggatgtttgggaagcaggtggccaagctggagagtgacatggacagcgagaccctggaggagcagaagtgccagctgtcctatgagctgaactgcagcggcaagtactttgccttcaaggagcagctgaagcatgctgtggtgaagatcgtgcgggacaagtacctgaagaccaccagctttgagagccaggaggagctgcagaccttcatcagcgagctgtatgtgttcctggtggaccagatgcacgtggccctgaaccagaccatgccagatgatgtgcagggcaccgtggccaccatctacaccagcagcgagcagctgcagctgtttgcctttgaagctgaggtgaatgaaaattttgagatggctgctgcctactacaaggagcggctggtgcgggagccccagaacctggaccactggctggactatggagccttctgcctgctgacagaggacaacatcaaggcccaggagtgcttccagaaggccctgagcctgaaccagagccacatccacagcctgctgctgtgtggggtgctggccgtgctgctggagaactatgagcaggccgagatcttctttgaagatgccacctgcctggagcccaccaacgtggtggcctggaccctgctgggcctgtactatgagatccagaacaatgacatccgcatggagatggccttccacgaggccagcaagcagctgcaggccaggatgctgcaggcccaggtgaccaagcagaagagcactggagtggaggacacagaggagcggggcaagcgggagagcagcctgggcccctggggcatcaccaacggcagcgccacagccatcaaggtggaggccccagctggccctggggccgccctgagcatcctggacaagttcctggaggagagcagcaagctgcagagcgacagccaggagcccatcctgaccacccagacctgggaccccagcatcagccagaagcccagcaacaccttcatcaaggagatccccaccaagaaggaggccagcaagtgccaggacagcagcgccctgctgcaccctggcctgcactatggagtgtcccagaccaccaccatcttcatggagaccatccacttcctgatgaaggtgaaggctgtgcagtatgtgcaccgggtgctggcccacgagctgctgtgcccccagggcggccccagctgtgagtactacctggtgctggcccagacccacatcctgaagaagaactttgccaaggccgaggagtacctgcagcaggccgcccagatggactacctgaaccccaacgtgtggggcctgaagggccacctgtacttcctgagcggcaaccacagcgaggccaaggcctgctatgaaagaaccatcagctttgtggtggatgccagcgagatgcacttcatcttcctgcggctgggcctcatctacctggaggagaaggagtatgagaaggccaagaagacctacatgcaggcctgcaagaggagccccagctgcctgacctggctgggcctgggcatcgcctgctaccgcctggaggagctgacagaagcagaagatgccctgtctgaggccaatgccctgaacaactacaatgctgaggtgtgggcctacctggccctggtgtgcctgaaggtgggccggcagctggaggccgagcaggcctacaagtacatgatcaagctgaagctgaaggatgaggccctgctggccgagatccacaccctgcaggagaccgtgggcttcggcaaccccagcttctag

SEQ ID NO: 42666 - DNA, 1497 bp, Artificial Sequence
  Description of Artificial Sequence: Synthetic coding sequence
caggaggagctgcagaccttcatcagcgagctgtatgtgttcctggtggaccagatgcacgtggccctgaaccagaccatgccagatgatgtgcagggcaccgtggccaccatctacaccagcagcgagcagctgcagctgtttgcctttgaggccgaggtgaatgaaaattttgagatggccgccgcctactacaaggagcggctggtgcgggagccccagaacctggaccactggctggactatggagccttctgcctgctgacagaggacaacatcaaggcccaggagtgcttccagaaggccctgagcctgaaccagagccacatccacagcctgctgctgtgtggggtgctggccgtgctgctggagaactatgagcaggccgagatcttctttgaagatgccacctgcctggagcccaccaacgtggtggcctggaccctgctgggcctgtactatgagatccagaacaatgacatccgcatggagatggccttccacgaggccagcaagcagctgcaggccaggatgctgcaggcccaggtgaccaagcagaagagcactggagtggaggacacagaggagcggggcaagcgggagagcagcctgggcccctggggcatcaccaatggaagtgccacagccatcaaggtggaggccccagctggccctggagctgccctgagcatcctggacaagttcctggaggagagcagcaagctgcagagcgacagccaggagcccatcctgaccacccagacctgggaccccagcatcagccagaagcccagcaacaccttcatcaaggagatccccaccaagaaggaggccagcaagtgccaggacagcagcgccctgctgcaccctggcctgcactacggcgtgtcccagaccaccaccatcttcatggagaccatccacttcctgatgaaggtgaaggctgtgcagtatgtgcaccgggtgctggcccacgagctgctgtgcccccagggcggccccagctgtgagtactacctggtgctggcccagacccacatcctgaagaagaactttgccaaggccgaggagtacctgcagcaggccgcccagatggactacctgaaccccaacgtgtggggcctgaagggccacctgtacttcctgagcggcaaccacagcgaggccaaggcctgctatgaaagaaccatcagctttgtggtggatgccagcgagatgcacttcatcttcctgcggctgggcctcatctacctggaggagaaggagctggaggagctgacagaagcagaagatgccctgtctgaggccaatgccctgaacaactacaatgctgaggtgtgggcctacctggccctggtgtgcctgaaggtgggccggcagctggaggccgagcaggcctacaagtacatgatcaagctgaagctgaaggatgaggccctgctggccgagatccacaccctgcaggagaccgtgggctttggaaaccccagcttctag

SEQ ID NO: 42667 - DNA, 3966 bp, Artificial Sequence
  Description of Artificial Sequence: Synthetic coding sequence
atgagcagcaatgacagcagcctgatggccggcatcatctactacagccaggagaagtacttccaccacgtgcagcaggccgctgctgtgggcctggagaagttcagcaatgaccctgtgctgaagttcttcaaggcctatggagtgctgaaggaggagcacatccaggatgccatcagtgacctggagagcatccgccaccacccagatgtgtccctgtgcagcaccatggccctgatctatgcccacaagagatgtgagatcatcgaccgggaggccatccaggagctggagtacagcctgaaggagatcaggaagacagtgtctggaacagccctgtactatgccggcctcttcctgtggctgattggaagacatgacaaggccaaggagtacatcgacaggatgctgaagatcagccggggcttccgggaggcctacgtgctgcggggctgggtggacctgaccagtgacaagccccacacagccaagaaggccatcgagtacctggagcagggcatccaggacaccaaggatgtgctgggcctgatgggcaaggccatgtacttcatgatgcagcagaactacagcgaggccctggaggtggtgaaccagatcaccgtgaccagcggcagcttcctgcctgccctggtgctgaagatgcagctgttcctggcccggcaggactgggagcagacagtggagatgggccaccgcatcctggagaaggatgagagcaacattgatgcctgccagatcctgactgtgcatgagctggcccgggagggcaacatgaccaccgtgagcagcctgaagacccagaaggccaccaaccacgtgaggaacctgatcaaggccctggagacccgggagcctgagaaccccagcctgcacctgaagaagatcatcgtggtgtcccggctgtgtggcagccaccaggtgatcctgggcctggtgtgcagcttcattgaaagaaccttcatggccacccccagctatgtgcacgtggccacagagctgggctacctgttcatcctgaagaaccaggtgaaggaggccctgctgtggtacagcgaggccatgaagctggacaaggatggcatggccggcctgaccggcatcatcctgtgccacatcctggagggccacctggaggaggccgagtaccgcctggagttcctgaaggaggtgcagaagagcctgggcaagtctgaggtgctgatcttcctgcaggccctgctgatgagcaggaagcacaagggggaggaggagaccacagccctgctgaaggaggccgtggagctgcacttcagctccatgcagggcatccccctgggcagcgagtactttgagaagctggacccctacttcctggtgtgcatcgccaaggagtacctgctcttctgccccaagcagccccggctgcccggccagatcgtgagccccctgctgaagcaggtggccgtcatcctgaaccctgtggtgaaggccgccccagccctgattgaccccctgtacctgatggcccaggtgcgctactacagcggggagctggagaatgcccagagcatcctgcagcgctgcctggagctggaccctgcctctgtggatgcccacctgctgatgtgccagatctacctggcccagggcaactttggcatgtgcttccactgcctggagctgggcgtgagccacaacttccaggtgcgggaccaccccctgtaccacctgatcaaggcccgggccctgaacaaggccggggactacccagaggccatcaagaccctgaagatggtgatcaagctgcctgccctgaagaaggaggagggcaggaagttcctgcggcccagcgtgcagcccagccagagggccagcatcctgctggagctggtggaggccctgcggctgaatggagagctgcacgaggccaccaaggtgatgcaggacaccatcaatgaatttggaggcaccccagaggagaaccgcatcaccatcgccaacgtggacctggtgctgagcaaaggaaatgtggatgtggccctgaacatgctgaggaacatcctgcccaagcagagctgctacatggaggcccgggagaagatggccaacatctacctgcagaccctgcgggaccggcggctgtacatccgctgctaccgggagctgtgtgagcacctgcccggcccccacaccagcctgctgctgggagatgccctgatgagcatcctggagcctgagaaggccctggaggtgtatgatgaggcctaccggcagaacccccatgatgccagcctggccagcagaattggacatgcctacgtgaaggcccaccagtacacagaggccatcgagtactatgaggccgcccagaagatcaatggccaggacttcctgtgctgtgacctgggcaagctgctgctgaagctgaagaaggtgaacaaggccgagaaggtgctgaagcaggccctggagcatgacatcgtgcaggacatccccagcatgatgaatgatgtgaagtgcctgctgctgctggccaaggtgtacaagagccacaagaaggaggccgtgattgagaccctgaacaaggccctggacctgcagagccgcatcctgaagagggtgcccctggagcagcctgagatgatccccagccagaagcagctggccgccagcatctgcatccagtttgctgagcactacctggccgagaaggagtatgacaaggctgtgcagagctacaaggatgtgttctcctacctgcccacagacaacaaggtgatgctggagctggcccagctgtacctgctgcagggccacctggacctgtgtgagcagcactgtgccatcctgctgcagacagagcagaaccatgaaacagcctctgtgctgatggctgacctgatgttcaggaagcagaagcatgaggccgccatcaacctgtaccaccaggtgctggagaaggccccagacaacttcctggtgctgcacaagctgattgacctgctgcggcgcagcggcaagctggaggacatcccagccttctttgagctggccaagaaggtgagcagccgggtgcccctggagcccggcttcaactactgccggggcatctactgctggcacatcggccagcccaatgaggccctgaagttcctgaacaaggccaggaaggacagcacctggggccagagcgccatctaccacatggtgcagatctgcctgaacccagacaatgaggtggtgggcggggaggcctttgagaaccagggcgctgagagcaactacatggagaagaaggagctggagcagcagggcgtgtccacagctgagaagctgctgcgggagttctacccccacagcgacagcagccagacccagctgcggctgctgcagggcctgtgccgcctggccacccgggagaaggccaacatggaggccgccctgggcagcttcatccagatcgcccaggccgagaaggacagcgtgcctgccctgctggccctggcccaggcctacgtgttcctgaagcagatccccaaggccaggatgcagctgaagaggctggccaagaccccctgggtgctgtctgaggccgaggacctggagaagtcctggctgctgctggccgacatctactgccagggcagcaagtttgacctggccctggagctgctgcggcgctgtgtgcagtacaacaagagctgctacaaggcctatgagtacatgggcttcatcatggagaaggagcagagctacaaggatgctgtgaccaactacaagctggcctggaagtacagccaccacgccaacccagccatcggcttcaagctggccttcaactacctgaaggacaagaagtttgtggaggccatcgagatctgcaatgatgtgctgcgggagcacccagactaccccaagatccgggaggagatcctggagaaggcccggcgcagcctgcggccctag

SEQ ID NO: 42668 - DNA, 3912 bp, Artificial Sequence
  Description of Artificial Sequence: Synthetic coding sequence
atgagcagcaatgacagcagcctgatggccggcatcatctactacagccaggagaagtacttccaccacgtgcagcaggccgctgctgtgggcctggagaagttcagcaatgaccctgtgctgaagttcttcaaggcctatggagtgctgaaggaggagcacatccaggatgccatcagtgacctggagagcatccgccaccacccagatgtgtccctgtgcagcaccatggccctgatctatgcccacaagagatgtgagatcatcgaccgggaggccatccaggagctggagtacagcctgaaggagatcaggaagacagtgtctggaacagccctgtactatgccggcctcttcctgtggctgattggaagacatgacaaggccaaggagtacatcgacaggatgctgaagatcagccggggcttccgggaggcctacgtgctgcggggctgggtggacctgaccagtgacaagccccacacagccaagaaggccatcgagtacctggagcagggcatccaggacaccaaggatgtgctgggcctgatgggcaaggccatgtacttcatgatgcagcagaactacagcgaggccctggaggtggtgaaccagatcaccgtgaccagcggcagcttcctgcctgccctggtgctgaagatgcagctgttcctggcccggcaggactgggagcagacagtggagatgggccaccgcatcctggagaaggatgagagcaacattgatgcctgccagatcctgactgtgcatgagctggcccgggagggcaacatgaccacagccaccaaccacgtgaggaacctgatcaaggccctggagacccgggagcctgagaaccccagcctgcacctgaagaagatcatcgtggtgtcccggctgtgtggcagccaccaggtgatcctgggcctggtgtgcagcttcattgaaagaaccttcatggccacccccagctatgtgcacgtggccacagagctgggctacctgttcatcctgaagaaccaggtgaaggaggccctgctgtggtacagcgaggccatgaagctggacaaggatggcatggccggcctgaccggcatcatcctgtgccacatcctggagggccacctggaggaggtgcagaagagcctgggcaagtctgaggtgctgatcttcctgcaggccctgctgatgagcaggaagcacaagggggaggaggagaccacagccctgctgaaggaggccgtggagctgcacttcagctccatgcagggcatccccctgggcagcgagtactttgagaagctggacccctacttcctggtgtgcatcgccaaggagtacctgctcttctgccccaagcagccccggctgcccggccagatcgtgagccccctgctgaagcaggtggccgtcatcctgaaccctgtggtgaaggccgccccagccctgattgaccccctgtacctgatggcccaggtgcgctactacagcggggagctggagaatgcccagagcatcctgcagcgctgcctggagctggaccctgcctctgtggatgcccacctgctgatgtgccagatctacctggcccagggcaactttggcatgtgcttccactgcctggagctgggcgtgagccacaacttccaggtgcgggaccaccccctgtaccacctgatcaaggcccgggccctgaacaaggccggggactacccagaggccatcaagaccctgaagatggtgatcaagctgcctgccctgaagaaggaggagggcaggaagttcctgcggcccagcgtgcagcccagccagagggccagcatcctgctggagctggtggaggccctgcggctgaatggagagctgcacgaggccaccaaggtgatgcaggacaccatcaatgaatttggaggcaccccagaggagaaccgcatcaccatcgccaacgtggacctggtgctgagcaaaggaaatgtggatgtggccctgaacatgctgaggaacatcctgcccaagcagagctgctacatggaggcccgggagaagatggccaacatctacctgcagaccctgcgggaccggcggctgtacatccgctgctaccgggagctgtgtgagcacctgcccggcccccacaccagcctgctgctgggagatgccctgatgagcatcctggagcctgagaaggccctggaggtgtatgatgaggcctaccggcagaacccccatgatgccagcctggccagcagaattggacatgcctacgtgaaggcccaccagtacacagaggccatcgagtactatgaggccgcccagaagatcaatggccaggacttcctgtgctgtgacctgggcaagctgctgctgaagctgaagaaggtgaacaaggccgagaaggtgctgaagcaggccctggagcatgacatcgtgcaggacatccccagcatgatgaatgatgtgaagtgcctgctgctgctggccaaggtgtacaagagccacaagaaggaggccgtgattgagaccctgaacaaggccctggacctgcagagccgcatcctgaagagggtgcccctggagcagcctgagatgatccccagccagaagcagctggccgccagcatctgcatccagtttgctgagcactacctggccgagaaggagtatgacaaggctgtgcagagctacaaggatgtgttctcctacctgcccacagacaacaaggtgatgctggagctggcccagctgtacctgctgcagggccacctggacctgtgtgagcagcactgtgccatcctgctgcagacagagcagaaccatgaaacagcctctgtgctgatggctgacctgatgttcaggaagcagaagcatgaggccgccatcaacctgtaccaccaggtgctggagaaggccccagacaacttcctggtgctgcacaagctgattgacctgctgcggcgcagcggcaagctggaggacatcccagccttctttgagctggccaagaaggtgagcagccgggtgcccctggagcccggcttcaactactgccggggcatctactgctggcacatcggccagcccaatgaggccctgaagttcctgaacaaggccaggaaggacagcacctggggccagagcgccatctaccacatggtgcagatctgcctgaacccagacaatgaggtggtgggcggggaggcctttgagaaccagggcgctgagagcaactacatggagaagaaggagctggagcagcagggcgtgtccacagctgagaagctgctgcgggagttctacccccacagcgacagcagccagacccagctgcggctgctgcagggcctgtgccgcctggccacccgggagaaggccaacatggaggccgccctgggcagcttcatccagatcgcccaggccgagaaggacagcgtgcctgccctgctggccctggcccaggcctacgtgttcctgaagcagatccccaaggccaggatgcagctgaagaggctggccaagaccccctgggtgctgtctgaggccgaggacctggagaagtcctggctgctgctggccgacatctactgccagggcagcaagtttgacctggccctggagctgctgcggcgctgtgtgcagtacaacaagagctgctacaaggcctatgagtacatgggcttcatcatggagaaggagcagagctacaaggatgctgtgaccaactacaagctggcctggaagtacagccaccacgccaacccagccatcggcttcaagctggccttcaactacctgaaggacaagaagtttgtggaggccatcgagatctgcaatgatgtgctgcgggagcacccagactaccccaagatccgggaggagatcctggagaaggcccggcgcagcctgcggccctag

SEQ ID NO: 42669 - DNA, 3963 bp, Artificial Sequence
  Description of Artificial Sequence: Synthetic coding sequence
atgagcagcaatgacagcagcctgatggccggcatcatctactacagccaggagaagtacttccaccacgtgcagcaggccgctgctgtgggcctggagaagttcagcaatgaccctgtgctgaagttcttcaaggcctatggagtgctgaaggaggagcacatccaggatgccatcagtgacctggagagcatccgccaccacccagatgtgtccctgtgcagcaccatggccctgatctatgcccacaagagatgtgagatcatcgaccgggaggccatccaggagctggagtacagcctgaaggagatcaggaagacagtgtctggaacagccctgtactatgccggcctcttcctgtggctgattggaagacatgacaaggccaaggagtacatcgacaggatgctgaagatcagccggggcttccgggaggcctacgtgctgcggggctgggtggacctgaccagtgacaagccccacacagccaagaaggccatcgagtacctggagcagggcatccaggacaccaaggatgtgctgggcctgatgggcaaggccatgtacttcatgatgcagcagaactacagcgaggccctggaggtggtgaaccagatcaccgtgaccagcggcagcttcctgcctgccctggtgctgaagatgcagctgttcctggcccggcaggactgggagcagacagtggagatgggccaccgcatcctggagaaggatgagagcaacattgatgcctgccagatcctgactgtgcatgagctggcccgggagggcaacatgaccaccgtgagcagcctgaagacccagaaggccaccaaccacgtgaggaacctgatcaaggccctggagacccgggagcctgagaaccccagcctgcacctgaagaagatcatcgtggtgtcccggctgtgtggcagccaccaggtgatcctgggcctggtgtgcagcttcattgaaagaaccttcatggccacccccagctatgtgcacgtggccacagagctgggctacctgttcatcctgaagaaccaggtgaaggaggccctgctgtggtacagcgaggccatgaagctggacaaggatggcatggccggcctgaccggcatcatcctgtgccacatcctggagggccacctggaggaggccgagtaccgcctggagttcctgaaggaggtgcagaagagcctgggcaagtctgaggtgctgatcttcctgcaggccctgctgatgagcaggaagcacaagggggaggaggagaccacagccctgctgaaggaggccgtggagctgcacttcagctccatgcagggcatccccctgggcagcgagtactttgagaagctggacccctacttcctggtgtgcatcgccaaggagtacctgctcttctgccccaagcagccccggctgcccggccagatcgtgagccccctgctgaagcaggtggccgtcatcctgaaccctgtggtgaaggccgccccagccctgattgaccccctgtacctgatggcccaggtgcgctactacagcgagctggagaatgcccagagcatcctgcagcgctgcctggagctggaccctgcctctgtggatgcccacctgctgatgtgccagatctacctggcccagggcaactttggcatgtgcttccactgcctggagctgggcgtgagccacaacttccaggtgcgggaccaccccctgtaccacctgatcaaggcccgggccctgaacaaggccggggactacccagaggccatcaagaccctgaagatggtgatcaagctgcctgccctgaagaaggaggagggcaggaagttcctgcggcccagcgtgcagcccagccagagggccagcatcctgctggagctggtggaggccctgcggctgaatggagagctgcacgaggccaccaaggtgatgcaggacaccatcaatgaatttggaggcaccccagaagaaaatcgcatcaccatcgccaacgtggacctggtgctgagcaaaggaaatgtggatgtggccctgaacatgctgaggaacatcctgcccaagcagagctgctacatggaggcccgggagaagatggccaacatctacctgcagaccctgcgggacagaagactctacatccgctgctaccgggagctgtgtgagcacctgcccggcccccacaccagcctgctgctgggagatgccctgatgagcatcctggagcctgagaaggccctggaggtgtatgatgaggcctaccggcagaacccccatgatgccagcctggccagccgcatcggccacgcctacgtgaaggcccaccagtacacagaggccatcgagtactatgaagctgcccagaagatcaatggccaggacttcctgtgctgtgacctgggcaagctgctgctgaagctgaagaaggtgaacaaggccgagaaggtgctgaagcaggccctggagcatgacatcgtgcaggacatccccagcatgatgaatgatgtgaagtgcctgctgctgctggccaaggtgtacaagagccacaagaaggaggccgtcatcgagaccctgaacaaggccctggacctgcagagccgcatcctgaagagggtgcccctggagcagcctgagatgatccccagccagaagcagctggccgccagcatctgcatccagtttgctgagcactacctggccgagaaggagtatgacaaggctgtgcagagctacaaggatgtgttctcctacctgcccacagacaacaaggtgatgctggagctggcccagctgtacctgctgcagggccacctggacctgtgtgagcagcactgtgccatcctgctgcagacagagcagaaccacgagacagcctctgtgctgatggctgacctgatgttcaggaagcagaagcatgaagctgccatcaacctgtaccaccaggtgctggagaaggccccagacaacttcctggtgctgcacaagctgattgacctgctgcggcgcagcggcaagctggaggacatcccagccttctttgagctggccaagaaggtgagcagccgggtgcccctggagcccggcttcaactactgccggggcatctactgctggcacatcggccagcccaatgaggccctgaagttcctgaacaaggccaggaaggacagcacctggggccagagcgccatctaccacatggtgcagatctgcctgaacccagacaatgaggtggtgggcggggaggcctttgagaaccagggcgctgagagcaactacatggagaagaaggagctggagcagcagggcgtgtccacagctgagaagctgctgcgggagttctacccccacagcgacagcagccagacccagctgcggctgctgcagggcctgtgccgcctggccacccgggagaaggccaacatggaggccgccctgggcagcttcatccagatcgcccaggccgagaaggacagcgtgcctgccctgctggccctggcccaggcctacgtgttcctgaagcagatccccaaggccaggatgcagctgaagaggctggccaagaccccctgggtgctgtctgaggccgaggacctggagaagtcctggctgctgctggccgacatctactgccagggcagcaagtttgacctggccctggagctgctgcggcgctgtgtgcagtacaacaagagctgctacaaggcctatgagtacatgggcttcatcatggagaaggagcagagctacaaggatgctgtgaccaactacaagctggcctggaagtacagccaccacgccaacccagccatcggcttcaagctggccttcaactacctgaaggacaagaagtttgtggaggccatcgagatctgcaatgatgtgctgcgggagcacccagactaccccaagatccgggaggagatcctggagaaggcccggcgcagcctgcggccctag

SEQ ID NO: 42670 - DNA, 3819 bp, Artificial Sequence
  Description of Artificial Sequence: Synthetic coding sequence
atgagcagcaatgacagcagcctgatggccggcatcatctactacagccaggagaagtacttccaccacgtgcagcaggccgctgctgtgggcctggagaagttcagcaatgaccctgtgctgaagttcttcaaggcctatggagtgctgaaggaggagcacatccaggatgccatcagtgacctggagagcatccgccaccacccagatgtgtccctgtgcagcaccatggccctgatctatgcccacaagagatgtgagatcatcgaccgggaggccatccaggagctggagtacagcctgaaggagatcaggaagacagtgtctggaacagccctgtactatgccggcctcttcctgtggctgattggaagacatgacaaggccaaggagtacatcgacaggatgctgaagatcagccggggcttccgggaggccatgtacttcatgatgcagcagaactacagcgaggccctggaggtggtgaaccagatcaccgtgaccagcggcagcttcctgcctgccctggtgctgaagatgcagctgttcctggcccggcaggactgggagcagacagtggagatgggccaccgcatcctggagaaggatgagagcaacattgatgcctgccagatcctgactgtgcatgagctggcccgggagggcaacatgaccacagccaccaaccacgtgaggaacctgatcaaggccctggagacccgggagcctgagaaccccagcctgcacctgaagaagatcatcgtggtgtcccggctgtgtggcagccaccaggtgatcctgggcctggtgtgcagcttcatcgagaggaccttcatggccacccccagctatgtgcacgtggccacagagctgggctacctgttcatcctgaagaaccaggtgaaggaggccctgctgtggtacagcgaggccatgaagctggacaaggatggcatggccggcctgaccggcatcatcctgtgccacatcctggagggccacctggaggaggccgagtaccgcctggagttcctgaaggaggtgcagaagagcctgggcaagtctgaggtgctgatcttcctgcaggccctgctgatgagcaggaagcacaagggggaggaggagaccacagccctgctgaaggaggccgtggagctgcacttcagctccatgcagggcatccccctgggcagcgagtactttgagaagctggacccctacttcctggtgtgcatcgccaaggagtacctgctcttctgccccaagcagccccggctgcccggccagatcgtgagccccctgctgaagcaggtggccgtcatcctgaaccctgtggtgaaggccgccccagccctgattgaccccctgtacctgatggcccaggtgcgctactacagcggggagctggagaatgcccagagcatcctgcagcgctgcctggagctggaccctgcctctgtggatgcccacctgctgatgtgccagatctacctggcccagggcaactttggcatgtgcttccactgcctggagctgggcgtgagccacaacttccaggtgcgggaccaccccctgtaccacctgatcaaggcccgggccctgaacaaggccggggactacccagaggccatcaagaccctgaagatggtgatcaagctgcctgccctgaagaaggaggagggcaggaagttcctgcggcccagcgtgcagcccagccagagggccagcatcctgctggagctggtggaggccctgcggctgaatggagagctgcacgaggccaccaaggtgatgcaggacaccatcaatgaatttggaggcaccccagaagaaaatcgcatcaccatcgccaacgtggacctggtgctgagcaaaggaaatgtggatgtggccctgaacatgctgaggaacatcctgcccaagcagagctgctacatggaggcccgggagaagatggccaacatctacctgcagaccctgcgggacagaagactctacatccgctgctaccgggagctgtgtgagcacctgcccggcccccacaccagcctgctgctgggagatgccctgatgagcatcctggagcctgagaaggccctggaggtgtatgatgaggcctaccggcagaacccccatgatgccagcctggccagccgcatcggccacgcctacgtgaaggcccaccagtacacagaggccatcgagtactatgaagctgcccagaagatcaatggccaggacttcctgtgctgtgacctgggcaagctgctgctgaagctgaagaaggtgaacaaggccgagaaggtgctgaagcaggccctggagcatgacatcgtgcaggacatccccagcatgatgaatgatgtgaagtgcctgctgctgctggccaaggtgtacaagagccacaagaaggaggccgtcatcgagaccctgaacaaggccctggacctgcagagccgcatcctgaagagggtgcccctggagcagcctgagatgatccccagccagaagcagctggccgccagcatctgcatccagtttgctgagcactacctggccgagaaggagtatgacaaggctgtgcagagctacaaggatgtgttctcctacctgcccacagacaacaaggtgatgctggagctggcccagctgtacctgctgcagggccacctggacctgtgtgagcagcactgtgccatcctgctgcagacagagcagaaccacgagacagcctctgtgctgatggctgacctgatgttcaggaagcagaagcatgaagctgccatcaacctgtaccaccaggtgctggagaaggccccagacaacttcctggtgctgcacaagctgattgacctgctgcggcgcagcggcaagctggaggacatcccagccttctttgagctggccaagaaggtgagcagccgggtgcccctggagcccggcttcaactactgccggggcatctactgctggcacatcggccagcccaatgaggccctgaagttcctgaacaaggccaggaaggacagcacctggggccagagcgccatctaccacatggtgcagatctgcctgaacccagacaatgaggtggtgggcggggaggcctttgagaaccagggcgctgagagcaactacatggagaagaaggagctggagcagcagggcgtgtccacagctgagaagctgctgcgggagttctacccccacagcgacagcagccagacccagctgcggctgctgcagggcctgtgccgcctggccacccgggagaaggccaacatggaggccgccctgggcagcttcatccagatcgcccaggccgagaaggacagcgtgcctgccctgctggccctggcccaggcctacgtgttcctgaagcagatccccaaggccaggatgcagctgaagaggctggccaagaccccctgggtgctgtctgaggccgaggacctggagaagtcctggctgctgctggccgacatctactgccagggcagcaagtttgacctggccctggagctgctgcggcgctgtgtgcagtacaacaagagctgctacaaggcctatgagtacatgggcttcatcatggagaaggagcagagctacaaggatgctgtgaccaactacaagctggcctggaagtacagccaccacgccaacccagccatcggcttcaagctggccttcaactacctgaaggacaagaagtttgtggaggccatcgagatctgcaatgatgtgctgcgggagcacccagactaccccaagatccgggaggagatcctggagaaggcccggcgcagcctgcggccctag

SEQ ID NO: 42671 - DNA, 1119 bp, Artificial Sequence
  Description of Artificial Sequence: Synthetic coding sequence
atggccgagctggaggccgtggctgatgacctggatgccctgattgatgacctggactacctgcccggccacttccacctggagatgcagctgaactttgagcccaggagccctgccccccagagggcccgggacctgaagctgcagcgggagggcctgcggcaggagctgcagctggccgccgccccccagaggcctgctgtgcgccacctgctgggcgcctttgccttctacctggaggagctggatgaggcccgggagtgcttcctggaggtggcccacgagcaccctggcaacctgaatgcctgggccaacctggcccacgtgtatggccgcctgggccaggaggaggaggaggaggcctgtgccgcccggctggccgacctgatgggcctggccgaggagcctgaggccgccggggacccccagctgcgggccgcccgctgcctggccgagcagggctacgcccacggctttgatgtgggctgtgccagccctgaggagcgggcccggggcctggccgccggcatcgccctgtatgacaaggccctgggctacggccagcagatccccatggaggagaagaggggctggtacttcaccatggccaccctgtacatccggctggatggcatcttcctggagctgggcagcgaggagcagaagaggctgcctgccttcaacagaaccctggccctgctgcggcaggtgctgaagtctgaggaccccaggcaccgggccctggcctggtgctacctgggcatgctgctggagaggaaggacaccttcagcaccacccccatgggcgtgcatgactgtggctacagcggcacagaccccctggactgcttcggcaaggccatcgagatcgccaagaaccagccccccatcctgaaccggctggccaagatcttctacttcctgggcaagcaggacatggccatcggcacctgcaacatggccctggatgtgctgcgggaccctgagctgaactggcaggcctactgcacccgggccaagagaagaggcctgaccatgctgccccggctggtgagcaacagctgggcccaggccgtgctgcccccccggccccccaaggtgctggagttccaggtgtag

SEQ ID NO: 42672 - DNA, 1710 bp, Artificial Sequence
  Description of Artificial Sequence: Synthetic coding sequence
atggccgagctggaggccgtggctgatgacctggatgccctgattgatgacctggactacctgcccggccacttccacctggagatgcagctgaactttgagcccaggagccctgccccccagagggcccgggacctgaagctgcagcgggagggcctgcggcaggagctgcagctggccgccgccccccagaggcctgctgtgcgccacctgctgggcgcctttgccttctacctggaggagctggatgaggcccgggagtgcttcctggaggtggcccacgagcaccctggcaacctgaatgcctgggccaacctggcccacgtgtatggccgcctgggccaggaggaggaggaggaggcctgtgccgcccggctggccgacctgatgggcctggccgaggagcctgaggccgccggggacccccagctgcgggccgcccgctgcctggccgagcagggctacgcccacggctttgatgtgggctgtgccagccctgaggagcgggcccggggcctggccgccggcatcgccctgtatgacaaggccctgggctacggccagcagatccccatggaggagaagaggggctggtacttcaccatggccaccctgtacatccggctggatggcatcttcctggagctgggcagcgaggagcagaagaggctgcctgccttcaacagaaccctggccctgctgcggcaggtgctgaagtctgaggaccccaggcaccgggccctggcctggtgctacctgggcatgctgctggagaggaaggacaccttcagcaccacccccatgggcgtgcatgactgtggctacagcggcacagaccccctggactgcttcggcaaggccatcgagatcgccaagaaccagccccccatcctgaaccggctggccaagatcttctacttcctgggcaagcaggacatggccatcggcacctgcaacatggccctggatgtgctgcgggaccctgagctgaactggcaggcctactgcacccgggccaagatccacatccgggcctacctgcatgacctgaagagggccaagatgggcctgggcggcatgccagacaggaaccacctggcctgtgccaaggctgacctggaggaggtggtgcgggtgtgccccggcttcaaggcctacctggacatcggccaggtgtactactacatgggcgtggatgctgtgcaggagctgctggccgtggatgaggccgccctgaaccaggccctggtgttcctggccaaggccggggagagcgagctgggcgccaccctgcctgagctgcagctgctgcggggcaagtgcctgcgcatcaagggagaagatgccaatgctgctgcctgcttcaagagagctgtggagctggatgatgctggcagcagccacacagatggcttcggctgcctgctggaggccctgctggcccagtggagccaggcccagctgagtgatggagagctgggccgggaggtggatgcctggctgcggcgggcccaggacaagtacccagctgcccggctgcggcaggagctgcagagggtgtggaggggccacacagatgaggtgctgggcctggcccgggccctggtggcccagggccgcccagccctggtgcggctgctgtttgagaccatggagcgggagggggagggcgccagcgccccccgggaccggcgggctgtgtccttctag

SEQ ID NO: 42673 - DNA, 1344 bp, Artificial Sequence
  Description of Artificial Sequence: Synthetic coding sequence
atgcaggagagccaggagacccacatcagcaaccacctggatgaggtggtggccgctgtgtccatcacccacaggaagaagttccagaacaagctgctgcagacagccctcttccagcccccccgggagaagctgcacctgtgtgaggagaaggccaagagctacagcaacagccatgagtacaagcaggccgtgcatgagctggtgcgctgtgtggccctgacccgcatctgctatggagacagccactggaagctggccgaggcccacgtgaacctggcccagggctacctgcagctgaagggcctgagcctgcaggccaagcagcacgccgagaaggcccggcagatcctggccaacagcatcgtgcccccctacagcgagaacacagatgtgttcaagttcagcattgagctgttccacaccatgggccgggccctgctgagcctgcagaagttcaaggaggccgctgagaacctgaccaaggccgagcggctgagcaaggagctgctgcagtgtggccgcatcatcaaggaggagtggattgaaattgaggcccgcatccggctgagctttgcccaggtgtaccagggccagaagaagagcaaggaggccctgagccactaccaggccgccctggagtatgtggagatcagcaagggggagaccagccgggagtgtgtgcccatcctgcgggagctggccggcgtggagcaggccctgggcctgcatgatgtgtccatcaaccacttcctgcaggcccacctgatcatcctgagccgcagccccagccaggtggaggccgctgacagcgcccacatcgtggcccacgccgctgtggccagcggcagacatgagcaccatgatgtggccgagcagtacttccaggagagcatggcccacctgaaggacagcgagggcatgggccgcaccaagttcctgagcatccaggatgagttctgccacttcctgcagatgacaggccagaaggagcgggccaccagcatcctgcgggagagcctggaggccaaggtggaggccttcggggacttcagccctgaggtggccgagacctaccgcctgctgggcggcgctgacctggcccagggcaaccacagcggggccaggaagaagctgaagaagtgcctgcagatccagaccctgctgtatggcccccaggacaagaggaccctggccacccagcaggccatgggcatgctgagcacagcccccaaggtggccagcaagccccggcaggccagcaaggccaaggtggccttctgcaccagcatcccccaggacaccctgctgggcaaggcccggcccggcaccacagctgactag

SEQ ID NO: 42674 - DNA, 1182 bp, Artificial Sequence
  Description of Artificial Sequence: Synthetic coding sequence
atgcaggagagccaggagacccacatcagcaaccacctggatgaggtggtggccgctgtgtccatcacccacaggaagaagttccagaacaagctgctgcagacagccctcttccagcccccccgggagaagctgcacctgtgtgaggagaaggccaagagctacagcaacagccatgagtacaagcaggccgtgcatgagctggtgcgctgtgtggccctgacccgcatctgctatggagacagccactggaagctggccgaggcccacgtgaacctggcccagggctacctgcagctgaagggcctgagcctgcaggccaagcagcacgccgagaaggcccggcagatcctggccaacagcatcgtgcccccctacagcgagaacacagatgtgttcaagttcagcattgagctgttccacaccatgggccgggccctgctgagcctgcagaagttcaaggaggccgctgagaacctgaccaaggccgagcggctgagcaaggagctgctgcagtgtggccgcatcatcaaggaggagtggattgaaattgaggcccgcatccggctgagctttgcccaggtgtaccagggccagaagaagagcaaggaggccctgagccactaccaggccgccctggagtatgtggagatcagcaagggggagaccagccgggagtgtgtgcccatcctgcgggagctggccggcgtggagcaggccctgggcctgcatgatgtgtccatcaaccacttcctgcaggcccacctgatcatcctgagccgcagccccagccaggtggaggccgctgacagcgcccacatcgtggcccacgccgctgtggccagcggcagacatgagcaccatgatgtggccgagcagtacttccaggagagcatggcccacctgaaggacagcgagggcatgggccgcaccaagttcctgagcatccaggatgagttctgccacttcctgcagatgacaggccagaaggagcgggccaccagcatcctgcgggagagcctggaggccaaggtggaggccttcggggacttcagccctgaggtggccgagacctaccgcctgctgggcggcgctgacctggcccagggcaaccacagcggggccaggaagaagctgaagaagggggacctgtccttcctgctgagcgccaccctgccctag

SEQ ID NO: 42675 - DNA, 1344 bp, Artificial Sequence; identical to SEQ ID NO: 42673
  Description of Artificial Sequence: Synthetic coding sequence

SEQ ID NO: 42676 - DNA, 1344 bp, Artificial Sequence; identical to SEQ ID NO: 42673
  Description of Artificial Sequence: Synthetic coding sequence

SEQ ID NO: 42677 - DNA, 1344 bp, Artificial Sequence; identical to SEQ ID NO: 42673
  Description of Artificial Sequence: Synthetic coding sequence

SEQ ID NO: 42678 - DNA, 171 bp, Artificial Sequence
  Description of Artificial Sequence: Synthetic coding sequence
atgcaggagagccaggagacccacatcagcaaccacctggatgaggtggtggccgctgtgtccatcacccacaggaagaagttccagaacaagctgctgcagacagccctcttccagcccccccgggagaagctgcacctgtgtgaggagaaggccaagagctacagctag

SEQ ID NO: 42679 - DNA, 1344 bp, Artificial Sequence; identical to SEQ ID NO: 42673
  Description of Artificial Sequence: Synthetic coding sequence

SEQ ID NO: 42680 - DNA, 1344 bp, Artificial Sequence; identical to SEQ ID NO: 42673
  Description of Artificial Sequence: Synthetic coding sequence

SEQ ID NO: 42681 - DNA, 162 bp, Artificial Sequence
  Description of Artificial Sequence: Synthetic coding sequence
atgcaggagagccaggagacccacatcagcaaccacctggatgaggtggtggccgctgtgtccatcacccacaggaagaagttccagaacaagctgctgcagacagccctcttccagcccccccgggagaagctgcacctgtgtgaggagaaggccaagtag

SEQ ID NO: 42682 - DNA, 456 bp, Artificial Sequence
  Description of Artificial Sequence: Synthetic coding sequence
atgcaggagagccaggagacccacatcagcaaccacctggatgaggtggtggccgctgtgtccatcacccacaggaagaagttccagaacaagctgctgcagacagccctcttccagcccccccgggagaagctgcacctgtgtgaggagaaggccaagagctacagcaacagccatgagtacaagcaggccgtgcatgagctggtgcgctgtgtggccctgacccgcatctgctatggagacagccactggaagctggccgaggcccacgtgaacctggcccagggctacctgcagctgaagggcctgagcctgcaggccaagcagcacgccgagaaggcccggcagatcctggccaacagcatcgtgcccccctacagcgagaacacagatgtgttcaagttcagcattgagctgttccacaccatgggccgggccctgctgagcctgcagtag

SEQ ID NO: 42683 - DNA, 252 bp, Artificial Sequence
  Description of Artificial Sequence: Synthetic coding sequence
atgcaggagagccaggagacccacatcagcaaccacctggatgaggtggtggccgctgtgtccatcacccacaggaagaagttccagaacaagctgctgcagacagccctcttccagcccccccgggagaagctgcacctgtgtgaggagaaggccaagagctacagcaacagccatgagtacaagcaggccgtgcatgagctggtgcgctgtgtggccctgacccgcatctgctatggagacagccactag

SEQ ID NO: 42684 - DNA, 348 bp, Artificial Sequence
  Description of Artificial Sequence: Synthetic coding sequence
atgcaggagagccaggagacccacatcagcaaccacctggatgaggtggtggccgctgtgtccatcacccacaggaagaagttccagaacaagctgctgcagacagccctcttccagcccccccgggagaagctgcacctgtgtgaggagaaggccaagagctacagcaacagccatgagtacaagcaggccgtgcatgagctggtgcgctgtgtggccctgacccgcatctgctatggagacagccactggaagctggccgaggcccacgtgaacctggcccagggctacctgcagctgaagggcctgagcctgcaggccaagcagcacgccgagaaggccaggtag

SEQ ID NO: 42685 - DNA, 474 bp, Artificial Sequence
  Description of Artificial Sequence: Synthetic coding sequence
atgcaggagagccaggagacccacatcagcaaccacctggatgaggtggtggccgctgtgtccatcacccacaggaagaagttccagaacaagctgctgcagacagccctcttccagcccccccgggagaagctgcacctgtgtgaggagaaggccaagagctacagcaacagccatgagtacaagcaggccgtgcatgagctggtgcgctgtgtggccctgacccgcatctgctatggagacagccactggaagctggccgaggcccacgtgaacctggcccagggctacctgcagctgaagggcctgagcctgcaggccaagcagcacgccgagaaggcccggcagatcctggccaacagcatcgtgcccccctacagcgagaacacagatgtgttcaagttcagcattgagctgttccacaccatgggccgggccctgctgagcctgcagaagttcaaggaggccgcctag

SEQ ID NO: 42686 - DNA, 1344 bp, Artificial Sequence; identical to SEQ ID NO: 42673
  Description of Artificial Sequence: Synthetic coding sequence

SEQ ID NO: 42687 - DNA, 1344 bp, Artificial Sequence; identical to SEQ ID NO: 42673
  Description of Artificial Sequence: Synthetic coding sequence

SEQ ID NO: 42688 - DNA, 1344 bp, Artificial Sequence; identical to SEQ ID NO: 42673
  Description of Artificial Sequence: Synthetic coding sequence

SEQ ID NO: 42689 - DNA, 1344 bp, Artificial Sequence; identical to SEQ ID NO: 42673
  Description of Artificial Sequence: Synthetic coding sequence

SEQ ID NO: 42690 - DNA, 1086 bp, Artificial Sequence
  Description of Artificial Sequence: Synthetic coding sequence
atgcaggccagccccatccgcatccccaccgtgtccaatgacatcgactgggacttctgcttccacatgagccagcagacagagatcccagcccaccagcagacagatgagctgtaccccactggaggctgtggggagagcgaggaggagaccaaggccaaggagaaggagaaggccatcgactgcatgagccaccccaaggagaagctggcccagagccagaagaaggtggcccagctgatcaaggagaagatgaacacccaggccaacaaggagctgatccgctgcgtcatcctgagccgcatcatctttggagaccaccactggaagtgtgcccgggccctggccaacctggcctacggctacctgaccctgcggggcctgcctgtgcaggccaagaagcacgccaccagcgccaagaacaccctgctgacctggaaggccaacaccaccagcaacaaggagaaggaggagatcctggaggccctggtgaagctgtactacaccctgggcgtggcctggctgctgcagaacagaggccgggaggcctacttcaacctgcagaaggccgagaggaacatgaaggagctgaaggagctgtacaagggcggcgtgtgtgagctgcaggtgtctgaaaatgacctgaccctggccctgggccgggccagcctggccatccaccggctgaacctggccctggcctactttgagaaggccatcggagatgtgattgctgccaagggggacaggaccagtgacctgatcagcctgtatgaggaggccgcccagatcgagcagctgcggaggaaccacaaccaggccatccagtacctgcagcaggcccacagcgtgtgtgtgtccctcttcacagaggtgagccccaagacagctgagatgtctgccctgctggccaaggcctatgccatgtctggagaggcccagcacagagatgctgtggagatctacttcatccgcagcatcaatgcctaccgggccaccctgggctctgaagattttgagaccctgagcaccacagaggagttctgcaagtggctggtgcagaatggagagaagcaggacaagtag

SEQ ID NO: 42691 - DNA, 1086 bp, Artificial Sequence
  Description of Artificial Sequence: Synthetic coding sequence
atgcaggccagccccatccgcatccccaccgtgtccaatgacatcgactgggacttctgcttccacatgagccagcagacagagatcccagcccaccagcagacagatgagctgtaccccactggaggctgtggggagagcgaggaggagaccaaggccaaggagaaggagaaggccatcgactgcatgagccaccccaaggagaagctggcccagagccagaagaaggtggcccagctgatcaaggagaagatgaacacccaggccaacaaggagctgatccgctgcgtcatcctgagccgcatcatctttggagaccaccactggaagtgtgcccgggccctggccaacctggcctacggctacctgaccctgcggggcctgcctgtgcaggccaagaagcacgccaccagcgccaagaacaccctgctgacctggaaggccaacaccaccagcaacaaggagaaggaggagatcctggaggccctggtgaagctgtactacaccctgggcgtggcctggctgctgcagaaccgctgccgggaggcctacttcaacctgcagaaggccgagaggaacatgaaggagctgaaggagctgtacaagggcggcgtgtgtgagctgcaggtgtctgaaaatgacctgaccctggccctgggccgggccagcctggccatccaccggctgaacctggccctggcctactttgagaaggccatcggagatgtgattgctgccaagggggacaggaccagtgacctgatcagcctgtatgaggaggccgcccagatcgagcagctgcggaggaaccacaaccaggccatccagtacctgcagcaggcccacagcgtgtgtgtgtccctcttcacagaggtgagccccaagacagctgagatgtctgccctgctggccaaggcctatgccatgtctggagaggcccagcacagagatgctgtggagatctacttcatccgcagcatcaatgcctaccgggccaccctgggctctgaagattttgagaccctgagcaccacagaggagttctgcaagtggctggtgcagaatggagagaagcaggacagatag

SEQ ID NO: 42692 - DNA, 1068 bp, Artificial Sequence
  Description of Artificial Sequence: Synthetic coding sequence
tgaagcacagaaagaaggctgctgggccacctgtacaatgacctgggcctgggctacagccagctgcagctgttccccctggccgtggaggccttcctgcaggccctgcccctgtgctgggtgcctggagagcaggccaccgtgctgaggaacctgggcatggcccacaatgccctgggcaactaccaggaggcccgggagttccaccagaaggctgctgacctgcacggctctgtgggccagcgctgggagcagggccgcagctttggcagcctggcctttgccctgagccagctgggggaccacaaggccgcccgggacaactacctgcacgccctgcaggccgcccgggacagcggggacatgaagggccagtggcaggcctgtgagggcctgggcgctgctgctgcccggctgggccagtatgaccaggccctgaagtactacaaggaggccctggcccagtgccagaaggagccagacagcgtgcgggagcggctggtggccaagctggccgacacagtgaggacccggctggcccaggtgggcctggtgcagacccacaccctgaccagcgcccctggccgcctgcaggcccctgggggcgccagccaggccgagggcaccccagccaaggccggcagcagcacagctggggtgcagcacaggagcagcagcggctgggaggatgaggagtttgaggagggccaccagaagaagaaggaggagaggtctgccaacgtgcctgtgcgggccggccctggccggcctgagctgtgcttcctgcccggcaccgtgaaccacagccaccacctggccagcagctgccccaccttcaccaagcacaccccctgccggggcaccgtgctgggcaaggccagcatctacagccctggcccccgggcccacctgccctttgtgggccctggcccccccagggctgagtaccccagcatcctggtgcccaacggcccccaggccaacagaagcagccgctggccccgggagagcctgagccgcagccggcagaggcggcccatggagagcggcatctgcaccatcgtgtag

SEQ ID NO: 42693 - DNA, 1749 bp, Artificial Sequence
  Description of Artificial Sequence: Synthetic coding sequence
atgagcagccccaacccagaagatgtgcccaggaggcctgagcctgagcccagcagcagcaacaagaagaagaagaagaggaagtggctgcggcaggaggccagcatccaggccctgacccgggccggccacggggccctgcaggccggccagaaccacgaggccctgaacaacttccagagggccttcctgctggccagcaaggccccccagacccgggacacccctgtgctgcaggcctgtgccttcaacctgggcgccgcctacgtggagaccggggaccctgcccggggcctggagctgctgctgcgggcccaccctgaggagaaggcccagggccgccgccacggggaccagtgcttcaacgtggccctggcctaccacgccctgggggagctgccccaggccctggcctggtaccaccgggccctgggccactaccagccccagggcgaccagggcgaggcctgggccaagatgggcgcctgctaccaggccctgggccagcctgagctggccgcccactgcctgcaggaggccagccaggcctatgcccaggagcggcagctgcgggctgctgccctggccctgggcgctgctgctggctgcatgctgaagagcggccgccaccgggtgggggaggtggtgcaggtgctggagaagagccggcggctggccgagaggagcacagagcggcggctgctgggccacctgtacaatgacctgggcctgggctacagccagctgcagctgttccccctggccgtggaggccttcctgcaggccctgcccctgtgctgggtgcctggagagcaggccaccgtgctgaggaacctgggcatggcccacaatgccctgggcaactaccaggaggcccgggagttccaccagaaggctgctgacctgcacggctctgtgggccagcgctgggagcagggccgcagctttggcagcctggcctttgccctgagccagctgggggaccacaaggccgcccgggacaactacctgcacgccctgcaggccgcccgggacagcggggacatgaagggccagtggcaggcctgtgagggcctgggcgctgctgctgcccggctgggccagtatgaccaggccctgaagtactacaaggaggccctggcccagtgccagaaggagccagattctgtgcgggagcggctggtggccaagctggccgacacagtgaggacccggctggcccaggtgggcctggtgcagacccacaccctgaccagcgcccctggccgcctgcaggcccctggaggagccagccaggccgagggcaccccagccaaggccggcagcagcacagctggggtgcagcacaggagcagcagcggctgggaggatgaggagtttgaggagggccaccagaagaagaaggaggagaggtctgccaacgtgcctgtgcgggccggccctggccggcctgagctgtgcttcctgcccggcaccgtgaaccacagccaccacctggccagcagctgccccaccttcaccaagcacaccccctgccggggcaccgtgctgggcaaggccagcatctacagccctggcccccgggcccacctgccctttgtgggccctggcccccccagggctgagtaccccagcatcctggtgcccaacggcccccaggccaacagaagcagccgctggccccgggagagcctgagccgcagccggcagaggcggcccatggagagcggcatctgcaccatcgtgtag

SEQ ID NO: 42694 - DNA, 1749 bp, Artificial Sequence; identical to SEQ ID NO: 42693
  Description of Artificial Sequence: Synthetic coding sequence

SEQ ID NO: 42695 - DNA, 552 bp, Artificial Sequence
  Description of Artificial Sequence: Synthetic coding sequence
tgacatctctacaatgacctgggcctgggctacagccagctgcagctgttccccctggccgtggaggccttcctgcaggccctgcccctgtgctgggtgcctggagagcaggccaccgtgctgaggaacctgggcatggcccacaatgccctgggcaactaccaggaggcccgggagttccaccagaaggctgctgacctgcacggctctgtgggccagcgctgggagcagggccgcagctttggcagcctggcctttgccctgagccagctgggggaccacaaggccgcccgggacaactacctgcacgccctgcaggccgcccgggacagcggggcccgcttctgtgccaggacagctgggggccaggccggccgccacagagaagatgccctgggccctgggggcgccggccctgacagccacccagactttggaagtggcaagaccccaggcagccgctggggccagcccggcggcggggaccccagcaaaggaaggaagcagcacagccgctgcccagcccagatcttccagtgggtgggccgctag

SEQ ID NO: 42696 - DNA, 2019 bp, Artificial Sequence
  Description of Artificial Sequence: Synthetic coding sequence
atgtctgaccctgagggggagaccctgcggagcaccttccccagctacatggccgagggggagcggctgtacctgtgtggggagttcagcaaggccgcccagagcttcagcaatgccctgtacctgcaggatggagacaagaactgcctggtggcccggagcaagtgcttcctgaagatgggagacctggagaggagcctgaaggatgctgaggccagcctgcagagcgaccctgccttctgcaagggcatcctgcagaaggccgagaccctgtacaccatgggagactttgaatttgccctggtgttctaccaccggggctacaagctgcggccagaccgggagttccgggtgggcatccagaaggcccaggaggccatcaacaacagcgtgggcagccccagcagcatcaagctggagaacaagggggacctgtccttcctgagcaagcaggccgagaacatcaaggcccagcagaagccccagcccatgaagcacctgctgcaccccaccaagggggagcccaagtggaaggccagcctgaagtctgagaagacagtgcggcagctgctgggggagctgtatgtggacaaggagtacctggagaagctgctgctggatgaggacctgatcaagggcaccatgaagggcggcctgactgtggaggacctgatcatgacaggcatcaactacctggacacccacagcaacttctggaggcagcagaagcccatctatgcccgggagcgggacaggaagctgatgcaggagaagtggctgcgggaccacaagagaagacccagccagacagcccactacatcctgaagagcctggaggacatcgacatgctgctgaccagcggcagcgctgagggcagcctgcagaaggccgagaaggtgctgaagaaggtgctggagtggaacaaggaggaggtgcccaacaaggatgagctggtgggcaacctgtacagctgcattggaaatgcccagatcgagctgggccagatggaggccgccctgcagagccacaggaaggacctggagatcgccaaggagtatgacctgcctgatgccaagagccgggccctggacaacatcggccgggtgtttgcccgggtgggcaagttccagcaggccatcgacacctgggaggagaagatccccctggccaagaccaccctggagaagacctggctgttccatgaaattggccgctgctacctggagctggaccaggcctggcaggcccagaactatggagagaagagccagcagtgtgccgaggaggagggggacatcgagtggcagctgaatgcctctgtgctggtggcccaggcccaggtgaagctgcgggactttgaatctgctgtgaacaactttgagaaggccctggagcgggccaagctggtgcacaacaatgaggcccagcaggccatcatcagcgccctggatgatgccaacaagggcatcatccgggagctgaggaagaccaactacgtggagaacctgaaggagaagtctgagggggaggccagcctgtatgaagatcgcatcatcacccgggagaaggacatgagaagagtgagagatgagcctgagaaggtggtgaagcagtgggaccacagtgaagatgagaaggagacagatgaagatgatgaggcctttggagaggccctgcagagccctgccagcggcaagcagagcgtggaggccggcaaggcccggagtgacctgggcgctgtggccaagggcctgagcggggagctgggcaccaggtctggagagaccggcaggaagctgctggaggccggcagaagagagagccgggagatctacagaagacccagcggggagctggagcagaggctgagcggggagttcagccggcaggagcctgaggagctgaagaagctgtctgaggtgggcagaagagagcctgaggagctgggcaagacccagtttggagaaattggagagaccaagaagacaggaaatgagatggagaaggagtatgaatag

SEQ ID NO: 42697 - DNA, 1464 bp, Artificial Sequence
  Description of Artificial Sequence: Synthetic coding sequence
atgatgctgagccgggccaagccagctgtgggccggggcgtgcagcacacagacaagaggaagaagaagggcaggaagatccccaagctggaggagctgctgagcaagagggacttcaccggggccatcaccctgctggagttcaagagacatgtgggggaggaggaggaggacaccaacctgtggattggctactgtgccttccacctgggggactacaagagggccctggaggagtatgaaaatgccaccaaggaggagaactgcaacagcgaggtgtgggtgaacctggcctgcacctacttcttcctgggcatgtacaagcaggccgaggccgccggcttcaaggccagcaagagccggctgcagaaccggctgctcttccacctggcccacaagttcaatgatgagaagaagctgatgtccttccaccagaacctgcaggatgtgacagaggaccagctgagcctggccagcatccactacatgaggagccactaccaggaggccatcgacatctacaagaggatcctgctggacaaccgggagtacctggccctgaatgtgtatgtggccctgtgctactacaagctggactactatgatgtgtcccaggaggtgctggccgtgtacctgcagcagatcccagacagcaccatcgccctgaacctgaaggcctgcaaccacttccggctgtacaacggccgggctgctgaggccgagctgaagagcctgatggacaatgccagcagcagctttgaatttgccaaggagctgatccgccacaacctggtggtgttccggggcggggagggcgccctgcaggtgctgccccccctggtggatgtgattcctgaggcccggctgaacctggtgatctactacctgcggcaggatgatgtgcaggaggcctacaacctgatcaaggacctggagcccaccaccccccaggagtacatcctgaagggcgtggtgaatgctgccctgggccaggagatgggcagccgggaccacatgaagatcgcccagcagttcttccagctggtgggcggcagcgcctctgaatgtgacaccatccctggccggcagtgcatggccagctgcttcttcctgctgaagcagtttgatgatgtgctgatctacctgaacagcttcaagagctacttctacaatgatgacatcttcaacttcaactatgcccaggccaaggccgccaccggcaacaccagcgagggggaggaggccttcctgctgatccagagcgagaagatgaagaatgactacatctacctgtcctggctggcccgctgctacatcatgaacaagaagccccggctggcctgggagctgtacctgaagatggagaccagcggggagagcttcagcctgctgcagctgattgccaatgactgctacaagagggaccccagccgcagcgcccccttcacagagaagcacaggtag

SEQ ID NO: 42698 - DNA, 1665 bp, Artificial Sequence
  Description of Artificial Sequence: Synthetic coding sequence
atgatgctgagccgggccaagccagctgtgggccggggcgtgcagcacacagacaagaggaagaagaagggcaggaagatccccaagctggaggagctgctgagcaagagggacttcaccggggccatcaccctgctggagttcaagagacatgtgggggaggaggaggaggacaccaacctgtggattggctactgtgccttccacctgggggactacaagagggccctggaggagtatgaaaatgccaccaaggaggagaactgcaacagcgaggtgtgggtgaacctggcctgcacctacttcttcctgggcatgtacaagcaggccgaggccgccggcttcaaggccagcaagagccggctgcagaaccggctgctcttccacctggcccacaagttcaatgatgagaagaagctgatgtccttccaccagaacctgcaggatgtgacagaggaccagctgagcctggccagcatccactacatgaggagccactaccaggaggccatcgacatctacaagaggatcctgctggacaaccgggagtacctggccctgaatgtgtatgtggccctgtgctactacaagctggactactatgatgtgtcccaggaggtgctggccgtgtacctgcagcagatcccagacagcaccatcgccctgaacctgaaggcctgcaaccacttccggctgtacaacggccgggctgctgaggccgagctgaagagcctgatggacaatgccagcagcagctttgaatttgccaaggagctgatccgccacaacctggtggtgttccggggcggggagggcgccctgcaggtgctgccccccctggtggatgtgattcctgaggcccggctgaacctggtgatctactacctgcggcaggatgatgtgcaggaggcctacaacctgatcaaggacctggagcccaccaccccccaggagtacatcctgaagggcgtggtgaatgctgccctgggccaggagatgggcagccgggaccacatgaagatcgcccagcagttcttccagctggtgggcggcagcgcctctgaatgtgacaccatccctggccggcagtgcatggccagctgcttcttcctgctgaagcagtttgatgatgtgctgatctacctgaacagcttcaagagctacttctacaatgatgacatcttcaacttcaactatgcccaggccaaggccgccaccggcaacaccagcgagggggaggaggccttcctgctgatccagagcgagaagatgaagaatgactacatctacctgtcctggctggcccgctgctacatcatgaacaagaagccccggctggcctgggagctgtacctgaagatggagaccagcggggagagcttcagcctgctgcagctgattgccaatgactgctacaagatgggccagttctactacagcgccaaggcctttgatgtgctggagcggctggaccccaaccctgagtactgggagggcaagagaggagcctgtgtgggcatcttccagatgatcatcgccggccgggagcccaaggagaccctgcgggaggtgctgcacctgctgcggagcactggaaacacccaggtggagtacatgatccgcatcatgaagaagtgggccaaggaaaatagagtgtccatctag

SEQ ID NO: 42699 - DNA, 1572 bp, Artificial Sequence
  Description of Artificial Sequence: Synthetic coding sequence
atgatgctgagccgggccaagccagctgtgggccggggcgtgcagcacacagacaagaggaagaagaagggcaggaagatccccaagctggaggagctgctgagcaagagggacttcaccggggccatcaccctgctggaggagtatgaaaatgccaccaaggaggagaactgcaacagcgaggtgtgggtgaacctggcctgcacctacttcttcctgggcatgtacaagcaggccgaggccgccggcttcaaggccagcaagagccggctgcagaaccggctgctcttccacctggcccacaagttcaatgatgagaagaagctgatgtccttccaccagaacctgcaggatgtgacagaggaccagctgagcctggccagcatccactacatgaggagccactaccaggaggccatcgacatctacaagaggatcctgctggacaaccgggagtacctggccctgaatgtgtatgtggccctgtgctactacaagctggactactatgatgtgtcccaggaggtgctggccgtgtacctgcagcagatcccagacagcaccatcgccctgaacctgaaggcctgcaaccacttccggctgtacaacggccgggctgctgaggccgagctgaagagcctgatggacaatgccagcagcagctttgaatttgccaaggagctgatccgccacaacctggtggtgttccggggcggggagggcgccctgcaggtgctgccccccctggtggatgtgattcctgaggcccggctgaacctggtgatctactacctgcggcaggatgatgtgcaggaggcctacaacctgatcaaggacctggagcccaccaccccccaggagtacatcctgaagggcgtggtgaatgctgccctgggccaggagatgggcagccgggaccacatgaagatcgcccagcagttcttccagctggtgggcggcagcgcctctgaatgtgacaccatccctggccggcagtgcatggccagctgcttcttcctgctgaagcagtttgatgatgtgctgatctacctgaacagcttcaagagctacttctacaatgatgacatcttcaacttcaactatgcccaggccaaggccgccactggaaacaccagcgagggggaggaggccttcctgctgatccagagcgagaagatgaagaatgactacatctacctgtcctggctggcccgctgctacatcatgaacaagaagccccggctggcctgggagctgtacctgaagatggagaccagcggggagagcttcagcctgctgcagctgattgccaatgactgctacaagatgggccagttctactacagcgccaaggcctttgatgtgctggagcggctggaccccaaccctgagtactgggagggcaagagaggagcctgtgtgggcatcttccagatgatcatcgccggccgggagcccaaggagaccctgcgggaggtgctgcacctgctgcggagcacaggcaacacccaggtggagtacatgatccgcatcatgaagaagtgggccaaggagaacagagtgtccatctag

SEQ ID NO: 42700 - DNA, 2532 bp, Artificial Sequence
  Description of Artificial Sequence: Synthetic coding sequence
atgtggaccccagagctggccatcctgcggggcttccccacagaggccgagcggcagcagtggaagcaggagggcgtggtgggcagcgagagcggcagcttcctgcagctgctgctggagggcaactatgaggccatcttcctgaacagcatgacccagaacatcttcaacagcaccaccacagctgaggagaagattgacagctacctggagaagcaggtggtgaccttcctggactacagcacagacctggacaccacagagcggcagcagctgatcttcctgctgggcgtgagcagcctgcagctgtttgtgcagagcaactggacaggcccccctgtggacctgcacccccaggacttcctgagctctgtgctcttccagcagttcagcgaggtgaagggcctggatgcctttgtgctgagcctgctgaccctggatggagagagcatctacagcctgaccagcaagcccatcctgctgctgctggcccgcatcatcctggtgaatgtgcgccacaagctgacagccatccagagcctgccctggtggaccctgcgctgtgtgaacatccaccagcacctgctggaggagaggagccccctgctcttcaccctggccgagaactgcatcgaccaggtgatgaagctgcagaacctgtttgtggatgattctggccgctacctggccatccagttccacctggagtgtgcctacgtgttcctgtactactatgagtacaggaaggccaaggaccagctggacatcgccaaggacatcagccagctgcagattgacctgaccggggccctgggcaagaggacccgcttccaggagaactacgtggcccagctgatcctggatgtgcggcgggagggagatgtgctgagcaactgtgagttcaccccagcccccaccccccaggagcacctgaccaagaacctggagctgaatgatgacaccatcctgaatgacatcaagctggccgactgtgagcagttccagatgccagacctgtgtgccgaggagatcgccatcatcctgggcatctgcaccaacttccagaagaacaaccctgtgcacaccctgacagaggtggagctgctggccttcaccagctgcctgctgagccagcccaagttctgggccatccagaccagcgccctgatcctgcggaccaagctggagaagggcagcaccaggagagtggagcgggccatgaggcagacccaggccctggccgaccagtttgaggacaagaccacctctgtgctggagcggctgaagatcttctactgctgccaggtgcccccccactgggccatccagaggcagctggccagcctgctgtttgagctgggctgcaccagcagcgccctgcagatctttgagaagctggagatgtgggaggatgtggtgatctgctatgaaagagctggccagcacggcaaggccgaggagatcctgcggcaggagctggagaagaaggagacccccagcctgtactgcctgctgggagatgtgctgggggaccacagctgctatgacaaggcctgggagctgagccgctaccgcagcgcccgggcccagaggagcaaggccctgctgcacctgaggaacaaggagttccaggagtgtgtggagtgctttgagaggtctgtgaagatcaaccccatgcagctgggcgtgtggttcagcctgggctgtgcctacctggccctggaggactaccagggcagcgccaaggccttccagagatgtgtgaccctggagccagacaatgctgaggcctggaacaacctgagcaccagctacatccggctgaagcagaaggtgaaggccttccgcaccctgcaggaggccctgaagtgcaactatgagcactggcagatctgggagaactacatcctgaccagcacagatgtgggggagttcagcgaggccatcaaggcctaccaccggctgctggacctgcgggacaagtacaaggatgtgcaggtgctgaagatcctggtgcgggctgtgattgatggcatgacagacagaagtggagatgtggccaccggcctgaagggcaagctgcaggagctgtttggccgggtgaccagccgggtgaccaatgatggagagatctggaggctgtatgcccacgtgtatggaaatggccagagcgagaagccagatgaaaatgagaaggccttccagtgcctgagcaaggcctacaagtgtgacacccagagcaactgctgggagaaggacatcaccagcttcaaggaggtggtgcagagggccctgggcctggcccacgtggccatcaagtgcagcaagaacaagagcagcagccaggaggccgtgcagatgctgagctctgtgcggctgaacctgcggggcctgctgagcaaggccaagcagctgttcacagatgtggccactggagagatgagccgggagctggctgatgacatcacagccatggacaccctggtgacagagctgcaggacctgagcaaccagttcaggaaccagtactag

SEQ ID NO: 42701 - DNA, 7446 bp, Artificial Sequence
  Description of Artificial Sequence: Synthetic coding sequence
atggagcagagccccccaccagcccctgagcccacccagggccccaccccagcccggagcagaagaagaagagagcctgagagccccccagccagcgcccccatccccctgtttggagctgacaccatcggccagaggagcccagatggccctgtgctgagcaaggccgagtttgtggagaaggtgcggcagagcaaccaggcctgccatgatggagacttccacacagccatcgtgctgtacaatgaggccctggccgtggacccccagaactgcatcctgtacagcaacagatctgctgcctacatgaagatccagcagtatgacaaggccctggatgatgccatcaaggcccggctgctgaaccccaagtggcccaaggcctacttccggcagggcgtggccctgcagtacctgggcagacatgctgatgccctggccgcctttgccagcggcctggcccaggaccccaagagcctgcagctgctggtgggcatggtggaggccgccatgaagagccccatgagggacagcctggagcccacctaccagcagctgcagaagatgaagctggacaagagcccctttgtggtggtgtctgtggtgggccaggagctgctgacagctggccaccacggggcctctgtggtggtgctggaggccgccctgaagattggcacctgcagcctgaagctgcggggctctgtgttcagcgccctgagcagcgcctactggagcctgggcaacacagagaagagcacaggctacatgcagcaggacctggatgtggccaagaccctgggggaccagacaggagaatgtcgggcccacggcaacctgggcagcgccttcttcagcaaaggaaactaccgggaggccctgaccaaccaccgccaccagctggtgctggccatgaagctgaaggaccgggaggccgccagcagcgccctgagcagcctgggccacgtgtacacagccatcggggactacccaaatgccctggccagccacaagcagtgtgtgctgctggccaagcagagcaaggatgagctgtctgaggcccgggagctgggcaacatgggcgctgtgtacatcgccatgggagactttgaaaatgctgtgcagtgccacgagcagcacctgaagatcgccaaggacctgggcaacaagcgggaggaggcccgggcctacagcaacctgggcagcgcctaccactacagaagaaactttgacaaggccatgagctaccacaactacgtgctggagctggcccaggagctgatggagaaggccatcgagatgagggcctatgccggcctgggccatgctgcccgctgcatgcaggacctggagcgggccaagcagtaccacgagcagcagctgggcattgctgaggacctgaaggacagagctgctgagggccgggccagcagcaacctgggcatcatccaccagatgaagggggactatgacacagccctgaagctgcacaagacccacctgtgcatcgcccaggagctgagtgactatgctgcccagggccgggcctacggcaacatgggaaatgcctacaatgccctgggcatgtatgaccaggccgtgaagtaccaccggcaggagctgcagatctccatggaggtgaatgaccgggccagccaggccagcacccacggcaacctggccgtggcctaccaggccctgggcgcccatgaccgggccctgcagcactaccagaaccacctgaacatcgcccgggagctgcgggacatccagagcgaggcccgggccctgagcaacctgggcaacttccactgcagcagaggagaatatgtgcaggccgccccctactatgagcagtacctgcggctggccccagacctgcaggacatggagggggagggcaaggtgtgccacaacctgggctacgcccactactgcctgggcaactaccaggaggccgtgaagtactatgagcaggacctggccctggccaaggacctgcatgacaagctgagccaggccaaggcctactgcaacctgggcctggccttcaaggccctgctgaacttcagcaaggccgaggagtgccagaagtacctgctgagcctggcccagagcctgaacaacagccaggccaagttccgggccctgggcaacctgggggacatcttcatctgcaagaaggacatcaatggagccatcaagttctatgagcagcagctgggcctggcccaccaggtgaaggaccggcggctggaggccagcgcctatgctgccctgggcacagcctacaggatgatccagaagtatgacaaggccctgggctaccacacccaggagctggaggtgtaccaggagctgagtgacctgcctggagaatgtcgggcccacggccacctggccgctgtgtacatggccctgggcaagtacaccatggccttcaagtgctatgaggagcagctggacctgggccagaagctgaaggaccccagcctggaggcccaggtgtatggcaacatgggcatcaccaagatgaacatgaatgtgatggaggaggccatcggctactttgagcagcagctggccatgctgcagcagctgtctggaaatgaatctgtgctggaccggggccgggcctacggcaacctgggggactgctatgaggccctgggggactatgaggaggccatcaagtactatgagcagtacctgtctgtggcccagagcctgaacaggatgcaggaccaggccaaggcctaccggggcctgggcaatggccaccgggccatgggcagcctgcagcaggccctggtgtgctttgagaagaggctggtggtggcccacgagctgggggaggccttcaacaaggcccaggcctacggggagctgggcagcctgcacagccagctgggcaactatgagcaggccatcagctgcctggagcggcagctgaacatcgcccgggacatgaaggaccgggccctggagagtgatgctgcctgtggcctgggcggcgtgtaccagcagatgggagaatatgacacagccctgcagtaccaccagctggacctgcagattgctgaggagaccaacaaccccacctgccagggccgggcctacggcaacctgggcctgacctatgagagcctgggcacctttgaaagagctgtggtgtaccaggagcagcacctgagcattgctgcccagatgaatgacctggccgccaagacagtgtcctacagcagcctgggccgcacccaccacgccctgcagaactacagccaggccgtgatgtacctgcaggagggcctgcggctggccgagcagctgggccggcgggaggatgaggccaagatcagacatggcctgggcctgagcctgtgggccagcggcaacctggaggaggcccagcaccagctgtaccgggccagcgccctgtttgagaccatcagacatgaggcccagctgagcacagactacaagctgagcctgtttgacctgcagaccagcagctaccaggccctgcagagggtgctggtgtccctgggccaccatgatgaggccctggccgtggccgagcggggccgcacccgggcctttgctgacctgctggtggagcggcagacaggccagcaggacagcgacccctacagccctgtgaccatcgaccagatcctggagatggtgaatggccagaggggcctggtgctgtactacagcctggccgccggctacctgtacagctggctgctggcccctggagctggcatcgtgaagttccacgagcactacctgggagaaaatacagtggagaacagcagtgacttccaggccagcagctctgtgaccctgcccacagccaccggcagcgccctggagcagcacatcgcctctgtgcgggaggccctgggcgtggagagccactacagccgggcctgtgccagcagcgagacagagagcgaggccggggacatcatggaccagcagtttgaggagatgaacaacaagctgaacagcgtgacagaccccaccggcttcctgaggatggtgagaagaaacaacctcttcaacagaagctgccagagcatgaccagcctcttcagcaacacagtgagccccacccaggacggcaccagcagcctgccccggcggcagagcagctttgccaagccacccctgcgggccctgtatgacctgctgattgcccccatggagggcggcctgatgcacagcagcggccctgtgggccgccaccggcagctgatcctggtgctggagggggagctgtacctgatcccctttgccctgctgaagggcagcagcagcaatgagtacctgtatgagcgcttcggcctgctggccgtgcccagcatccgcagcctgtctgtgcagagcaagagccacctgaggaagaacccccccacctacagcagcagcacctccatggccgccgtcatcggcaaccccaagctgcccagcgctgtgatggaccgctggctgtggggccccatgcccagcgctgaggaggaggcctacatggtgtctgagctgctgggctgccagcccctggtgggctctgtggccaccaaggagcgggtgatgtctgccctgacccaggctgaatgtgtgcactttgccacccacatctcctggaagctgagcgccctggtgctgacccccagcatggatggcaacccagccagcagcaagagcagctttggccacccctacaccatccctgagagcctgcgggtgcaggatgatgccagtgatggagagagcatcagtgactgcccccccctgcaggagctgctgctgacagctgctgatgtgctggacctgcagctgcctgtgaagctggtggtgctgggcagcagccaggagagcaacagcaaggtgacagcagatggagtgattgccctgacccgggccttcctggccgccggggcccagtgtgtgctggtgtccctgtggcctgtgcctgtggccgccagcaagatgttcatccacgccttctacagcagcctgctgaatggcctgaaggccagcgctgccctgggggaggccatgaaggtggtgcagagcagcaaggccttcagccaccccagcaactgggccggcttcatgctgattggaagtgatgtgaagctgaacagccccagcagcctcatcggccaggccctgacagagatcctgcagcaccctgagcgggccagagatgccctgcgggtgctgctgcacctggtggagaagagcctgcagaggatccagaatggccagagaaatgccatgtacaccagccagcagagcgtggagaacaaggtgggcggcatccctggctggcaggccctgctgacagctgtgggcttccggctggacccccccaccagcggcctgcctgctgctgtgttcttccccaccagtgaccccggggaccggctgcagcagtgcagcagcaccctgcagagcctgctgggcctgcccaacccagccctgcaggccctgtgcaagctgatcacagccagcgagaccggggagcagctgatcagcagagctgtgaagaacatggtgggcatgctgcaccaggtgctggtgcagctgcaggccggggagaaggagcaggacctggccagcgcccccatccaggtgtccatctctgtgcagctgtggaggctgcccggctgccacgagttcctggccgccctgggctttgacctgtgtgaggtgggccaggaggaggtgatcctgaagacaggcaagcaggccaacagaagaacagtgcactttgccctgcagagcctgctgagcctgtttgacagcacagagctgcccaagaggctgagcctggacagcagcagcagcctggagagcctggccagcgcccagagcgtgtccaatgccctgcccctgggctaccagcagccccccttcagccccaccggggctgacagcatcgccagtgatgccatctctgtgtacagcctgagcagcatcgccagctccatgagctttgtgtccaagccagagggcggcagcgagggcggcggccctgggggccggcaggaccatgacaggagcaagaatgcctacctgcagaggagcaccctgcccaggagccagctgcccccccagaccaggcctgctggcaacaaggatgaggaggagtatgagggcttcagcatcatcagcaatgagcccctggccacctaccaggagaacagaaacacctgcttctccccagaccacaagcagccccagcctggaacagctgggggcatgagggtgtctgtgagcagcaagggcagcatcagcacccccaacagccctgtgaagatgaccctcatccccagccccaacagccccttccagaaggtgggcaagctggccagcagtgacacaggagagagtgaccagagcagcacagaaacagacagcacagtgaagagccaggaggagagcaaccccaagctggacccccaggagctggcccagaagatcctggaggagacccagagccacctgattgctgtggagcggctgcagaggtctgggggccaggtgtccaagagcaacaacccagaagatggagtgcaggcccccagcagcacagctgtgttccgggccagcgagaccagcgccttcagcaggcctgtgctgagccaccagaagagccagcccagccctgtgacagtgaagcccaagcccccagcccggagcagcagcctgcccaaggtgagcagcggctacagcagccccaccaccagcgagatgagcatcaaggacagccccagccagcacagcggccggcccagccctggctgtgacagccagaccagccagctggaccagcccctcttcaagctgaagtaccccagcagcccctacagcgcccacatcagcaagagccccaggaacatgagccccagcagcggccaccagagccctgctggcagcgcccccagccctgccctgagctacagcagcgctggcagcgcccggagcagccctgcagatgccccagacatcgacaagctgaagatggccgccattgatgagaaggtgcaggccgtgcacaacctgaagatgttctggcagagcaccccccagcacagcacaggccccatgaagatcttccggggggcccctggcaccatgaccagcaagagagatgtgctgagcctgctgaacctgagccccaggcacaacaagaaggaggagggcgtggacaagctggagctgaaggagctgagcctgcagcagcatgatggagccccacccaaggcccccccaaatggccactggaggacagagaccaccagcctgggcagcctgcccctgcctgctggccccccagccacagccccagcccggcccctgcggctgcccagcggaaatggctacaagttcctgagccctggccgcttcttccccagcagcaagtgctag

SEQ ID NO: 42702 - DNA, 1428 bp, Artificial Sequence
  Description of Artificial Sequence: Synthetic coding sequence
atgaccaccctgccccccctgcccatgacccggcccaagctgacagccctggcccggcagaagctgccctgcagcagcaggaagatccccaggagccagctgatcaaggagaaggatgacatcgaccactacctggaggtgaacttcaagggcctgagcaaggaggaggtggccgcctacagaaattcctacaagaagaacatctgtgtggacatgctgagagatggctaccacaagagcttcacagagctgtttgccctgatggagcgctgggatgccctgcgggaggccgcccgggtgcgcagcctcttctggctgcagaagcccctggaggagcagcctgacaagctggactacctgtaccactacctgaccagggcagaagatgctgagaggaaggagagctttgaagatgtgcacaacaacctgtatgccctggcctgctacttcaacaacagcgaggacaagtgggtgaggaaccacttctatgagcgctgcttcaagatcgcccagctgatcaagattgactgtgggaagaaggaggccgaggcccacatgcacatgggcctgctgtatgaggaggatggccagctgctggaggccgctgagcactatgaggccttccaccagctgacccagggccgcatctggaaggatgaaacaggccgcagcctgaacctgctggcctgtgagagcctgctgcggacctaccgcctgctgagtgacaagatgctggagaacaaggagtacaagcaggccatcaagatcctgatcaaggccagcgagatcgccaaggagggcagtgacaagaagatggaggccgaggccagctactacctgggcctggcccacctggccgctgaggagtatgaaacagccctgactgtgctggacacctactgcaagatcagcacagacctggatgatgacctgagcctgggccggggctatgaggccatcgccaaggtgctgcagagccagggcgagatgacagaggccatcaagtacctgaagaagtttgtgaagatcgccaggaacaacttccagagcctggacctggtgcgggccagcaccatgctgggggacatctacaatgagaagggctactacaacaaggccagcgagtgcttccagcaggcctttgacaccaccgtggagctgatgtccatgcccctgatggatgagaccaaggtgcactacggcatcgccaaggcccaccagatgatgctgactgtgaacaactacatcgagagcgctgacctgaccagcctgaactacctgctgtcctggaaggagagccggggcaacattgaaccagaccctgtgacagaggagttccggggcagcacagtggaggccgtgtcccagaacagcgagcggctggaggagctgagccgcttccctggggaccagaagaatgagacctag

SEQ ID NO: 42703 - DNA, 960 bp, Artificial Sequence
  Description of Artificial Sequence: Synthetic coding sequence
atgaccaccctgccccccctgcccatgacccggcccaagctgacagccctggcccggcagaagctgccctgcagcagcaggaagatccccaggagccagctgatcaaggagaaggatgacatcgaccactacctggaggtgaacttcaagggcctgagcaaggaggaggtggccgcctacagaaattcctacaagaagaacatctgtgtggacatgctgagagatggctaccacaagagcttcacagagctgtttgccctgatggagcgctgggatgccctgcgggaggccgcccgggtgcgcagcctcttctggctgcagaagcccctggaggagcagcctgacaagctggactacctgtaccactacctgaccagggcagaagatgctgagaggaaggagagctttgaagatgtgcacaacaacctgtatgccctggcctgctacttcaacaacagcgaggacaagtgggtgaggaaccacttctatgagcgctgcttcaagatcgcccagctgatcaagattgactgtgggaagaaggaggccgaggcccacatgcacatgggcctgctgtatgaggaggatggccagctgctggaggccgctgagcactatgaggccttccaccagctgacccagggccgcatctggaaggatgaaacaggccgcagcctgaacctgctggcctgtgagagcctgctgcggacctaccgcctgctgagtgacaagatgctggagaacaaggagtacaagcaggccatcaagatcctgatcaaggccagcgagatcgccaaggagggcagtgacaagaagatggaggccgaggccagctactacctgggcctggcccacctggccgctgaggagtatgaaacagccctgactgtgctggacacctactgcaagagcccccagacctggatgatgatctctgtgtggggcgaggccatgaagccctag

SEQ ID NO: 42704 - DNA, 1506 bp, Artificial Sequence
  Description of Artificial Sequence: Synthetic coding sequence
atgatccccatgttcaccgtgaccctggaggacagcggcaccctgtggaagagcctgcacagcagcagcgagagcgagatgaccaccctgccccccctgcccatgacccggcccaagctgacagccctggcccggcagaagctgccctgcagcagcaggaagatccccaggagccagctgatcaaggagaaggatgacatcgaccactacctggaggtgaacttcaagggcctgagcaaggaggaggtggccgcctacagaaattcctacaagaagaacatctgtgtggacatgctgagagatggctaccacaagagcttcacagagctgtttgccctgatggagcgctgggatgccctgcgggaggccgcccgggtgcgcagcctcttctggctgcagaagcccctggaggagcagcctgacaagctggactacctgtaccactacctgaccagggcagaagatgctgagaggaaggagagctttgaagatgtgcacaacaacctgtatgccctggcctgctacttcaacaacagcgaggacaagtgggtgaggaaccacttctatgagcgctgcttcaagatcgcccagctgatcaagattgactgtgggaagaaggaggccgaggcccacatgcacatgggcctgctgtatgaggaggatggccagctgctggaggccgctgagcactatgaggccttccaccagctgacccagggccgcatctggaaggatgaaacaggccgcagcctgaacctgctggcctgtgagagcctgctgcggacctaccgcctgctgagtgacaagatgctggagaacaaggagtacaagcaggccatcaagatcctgatcaaggccagcgagatcgccaaggagggcagtgacaagaagatggaggccgaggccagctactacctgggcctggcccacctggccgctgaggagtatgaaacagccctgactgtgctggacacctactgcaagatcagcacagacctggatgatgacctgagcctgggccggggctatgaggccatcgccaaggtgctgcagagccagggcgagatgacagaggccatcaagtacctgaagaagtttgtgaagatcgccaggaacaacttccagagcctggacctggtgcgggccagcaccatgctgggggacatctacaatgagaagggctactacaacaaggccagcgagtgcttccagcaggcctttgacaccaccgtggagctgatgtccatgcccctgatggatgagaccaaggtgcactacggcatcgccaaggcccaccagatgatgctgactgtgaacaactacatcgagagcgctgacctgaccagcctgaactacctgctgtcctggaaggagagccggggcaacattgaaccagaccctgtgacagaggagttccggggcagcacagtggaggccgtgtcccagaacagcgagcggctggaggagctgagccgcttccctggggaccagaagaatgagacctag

SEQ ID NO: 42705 - DNA, 81 bp, Artificial Sequence
  Description of Artificial Sequence: Synthetic coding sequence
atgaccaccctgccccccctgcccatgacccggcccaagctgacagccctggcccggcagaagctgccctgcagcagctag

SEQ ID NO: 42706 - DNA, 1425 bp, Artificial Sequence
  Description of Artificial Sequence: Synthetic coding sequence
atgaccaccctgccccccctgcccatgacccggcccaagctgacagccctggcccggcagaagctgccctgcagcagcaggaagatccccaggagccagctgatcaaggagaaggatgacatcgaccactacctggaggtgaacttcaagggcctgagcaaggaggaggtggccgcctacagaaattcctacaagaagaacatctgtgtggacatgctgagagatggctaccacaagagcttcacagagctgtttgccctgatggagcgctgggatgccctgcgggaggccgcccgggtgcgcagcctcttctggctgcagaagcccctggaggagcagcctgacaagctggactacctgtaccactacctgaccagggcagaagatgctgagaggaaggagagctttgaagatgtgcacaacaacctgtatgccctggcctgctacttcaacaacagcgaggacaagtgggtgaggaaccacttctatgagcgctgcttcaagatcgcccagctgatcaagattgactgtgggaagaaggaggccgaggcccacatgcacatgggcctgctgtatgaggaggatggccagctgctggaggccgctgagcactatgaggccttccaccagctgacccagggccgcatctggaaggatgaaacaggccgcagcctgaacctgctggcctgtgagagcctgctgcggacctaccgcctgctgagtgacaagatgctggagaacaaggagtacaagcaggccatcaagatcctgatcaaggccagcgagatcgccaaggagggcagtgacaagaagatggaggccgaggccagctactacctgggcctggcccacctggccgctgaggagtatgaaacagccctgactgtgctggacacctactgcaagatcagcacagacctggatgatgacctgagcctgggccggggctatgaggccatcgccaaggtgctgcagagccagggcgagatgacagaggccatcaagtacctgaagaagtttgtgaagatcgccaggaacaacttccagagcctggacctggtgcgggccagcaccatgctgggggacatctacaatgagaagggctactacaacaaggccagcgagtgcttccagcaggcctttgacaccaccgtggagctgatgtccatgcccctgatggatgagaccaaggtgcactacggcatcgccaaggcccaccagatgatgctgactgtgaacaactacatcgagagcgctgacctgaccagcctgaactacctgctgtcctggaaggagagccggggcaacattgaaccagaccctgtgacagagttccggggcagcacagtggaggccgtgtcccagaacagcgagcggctggaggagctgagccgcttccctggggaccagaagaatgagacctag

SEQ ID NO: 42707 - DNA, 1506 bp, Artificial Sequence; identical to SEQ ID NO: 42704
  Description of Artificial Sequence: Synthetic coding sequence

SEQ ID NO: 42708 - DNA, 282 bp, Artificial Sequence
  Description of Artificial Sequence: Synthetic coding sequence
atgatccccatgttcaccgtgaccctggaggacagcggcaccctgtggaagagcctgcacagcagcagcgagagcgagatgaccaccctgccccccctgcccatgacccggcccaagctgacagccctggcccggcagaagctgccctgcagcagcaggaagatccccaggagccagctgatcaaggagaaggatgacatcgaccactacctggaggtgaacttcaagggcctgagcaaggaggaggtggccgcctacagaaattcctacaagaagaactag

SEQ ID NO: 42709 - DNA, 1998 bp, Artificial Sequence
  Description of Artificial Sequence: Synthetic coding sequence
atggccggcctgagcggggcccagatcccagatggagagttcaccgccctggtgtaccgcctcatcagagatgcccgctatgcagaggccgtgcagctgctgggccgggagctgcagaggagccccaggagccgggccggcctgagcctgctgggctactgctactaccgcctgcaggagtttgccctggccgctgagtgctatgagcagctgggccagctgcaccctgagctggagcagtaccgcctgtaccaggcccaggccctgtacaaggcctgcctgtacccagaggccaccagggtggccttcctgctgctggacaacccagcctaccacagccgggtgctgcggctgcaggccgccatcaagtacagcgagggggacctgcccggcagccgcagcctggtggagcagctgctgtctggagagggcggggaggagagcggcggggacaatgaaacagatggccaggtgaacctgggctgcctgctgtacaaggagggccagtatgaggccgcctgcagcaagttcagcgccaccctgcaggccagcggctaccagcctgacctgagctacaacctggccctggcctactacagcagccggcagtatgccagcgccctgaagcacatcgccgagatcatcgagcggggcatccggcagcaccctgagctgggcgtgggcatgaccacagagggctttgatgtgcgctctgtgggcaacaccctggtgctgcaccagacagccctggtggaggccttcaacctgaaggccgccatcgagtaccagctgagaaattatgaggtggcccaggagaccctgacagacatgccacccagggctgaggaggagctggaccctgtgaccctgcacaaccaggccctgatgaacatggatgcccggcccacagagggctttgagaagctgcagttcctgctgcagcagaaccccttccccccagagacctttggaaacctgctgctgctgtactgcaagtatgagtactttgacctggccgcagatgtgctggctgaaaatgcccacctgacctacaagttcctgaccccctacctgtatgacttcctggatgccctgatcacctgccagacagcccctgaggaggccttcatcaagctggatggcctggccggcatgctgacagagcagctgcggcggctgaccaagcaggtgcaggaggcccggcacaacagagatgatgaggccatcaagaaggctgtgaatgaatatgatgagaccatggagaagtacatccctgtgctgatggcccaggccaagatctactggaacctggagaactaccccatggtggagaaggtgttcaggaagtctgtggagttctgcaatgaccatgatgtgtggaagctgaatgtggcccacgtgctcttcatgcaggagaacaagtacaaggaggccatcggcttctatgagcccatcgtgaagaagcactatgacaacatcctgaatgtgtctgccatcgtgctggccaacctgtgtgtgtcctacatcatgaccagccagaatgaggaggccgaggagctgatgaggaagattgagaaggaggaggagcagctgtcctatgatgaccccaacaggaagatgtaccacctgtgcatcgtgaacctggtgattggcaccctgtactgtgccaagggcaactatgaatttggcatcagcagggtcatcaagagcctggagccctacaacaagaagctgggcacagacacctggtactatgccaagcgctgcttcctgagcctgctggagaacatgagcaagcacatgatcgtcatccatgattctgtcatccaggagtgtgtgcagttcctgggccactgtgagctgtatggcaccaacatcccagctgtgattgagcagcccctggaggaggagaggatgcacgtgggcaagaacacagtgacagatgagagccggcagctgaaggccctgatctatgagatcatcggctggaacaagtag

SEQ ID NO: 42710 - DNA, 381 bp, Artificial Sequence
  Description of Artificial Sequence: Synthetic coding sequence
atgtaccacctgtgcatcgtgaacctggtgattggcaccctgtactgtgccaagggcaactatgaatttggcatcagcagggtcatcaagagcctggagccctacaacaagaagctgggcacagacacctggtactatgccaagcgctgcttcctgagcctgctggagaacatgagcaagcacatgatcgtcatccatgacagcgtcatccaggagtgtgtgcagttcctgggccactgtgagctgtatggcaccaacatcccagctgtgattgagcagcccctggaggaggagaggatgcacgtgggcaagaacacagtgacagatgagagccggcagctgaaggccctgatctatgagatcatcggctggaacaagtag

SEQ ID NO: 42711 - DNA, 1998 bp, Artificial Sequence
  Description of Artificial Sequence: Synthetic coding sequence
atggccggcctgagcggggcccagatcccagatggagagttcaccgctgtggtgtaccgcctcatcagaaatgcccgctatgcagaggccgtgcagctgctgggcggggagctgcagaggagccccaggagccgggccggcctgagcctgctgggctactgctactaccgcctgcaggagtttgccctggccgctgagtgctatgagcagctgggccagctgcaccctgagctggagcagtaccgcctgtaccaggcccaggccctgtacaaggcctgcctgtatgcagaggccaccagggtggccttcctgctgctggacaacccagcctaccacagccgggtgctgcggctgcaggccgccatcaagtacagcgagggggacctgcccggcagccgcagcctggtggagcagctgcccagccgggagggcggggaggagagcggaggagaaaatgaaacagatggccagatcaacctgggctgcctgctgtacaaggagggccagtatgaggccgcctgcagcaagttctttgctgccctgcaggccagcggctaccagcctgacctgagctacaacctggccctggcctactacagcagccggcagtatgccagcgccctgaagcacatcgccgagatcatcgagcggggcatccggcagcaccctgagctgggcgtgggcatgaccacagagggcattgatgtgcgctctgtgggcaacaccctggtgctgcaccagacagccctggtggaggccttcaacctgaaggccgccatcgagtaccagctgagaaattatgaagctgcccaggaggccctgacagacatgccacccagggctgaggaggagctggaccctgtgaccctgcacaaccaggccctgatgaacatggatgcccggcccacagagggctttgagaagctgcagttcctgctgcagcagaaccccttccccccagagacctttggaaacctgctgctgctgtactgcaagtatgagtactttgacctggccgcagatgtgctggctgaaaatgcccacctgatctacaagttcctgaccccctacctgtatgacttcctggatgctgtgatcacctgccagacagcccctgaggaggccttcatcaagctggatggcctggccggcatgctgacagaggtgctgaggaagctgaccatccaggtgcaggaggcccggcacaacagagatgatgaggccatcaagaaggctgtgaatgaatatgatgagaccatggagaagtacatccctgtgctgatggcccaggccaagatctactggaacctggagaactaccccatggtggagaagatcttcaggaagtctgtggagttctgcaatgaccatgatgtgtggaagctgaatgtggcccacgtgctcttcatgcaggagaacaagtacaaggaggccatcggcttctatgagcccatcgtgaagaagcactatgacaacatcctgaatgtgtctgccatcgtgctggccaacctgtgtgtgtcctacatcatgaccagccagaatgaggaggccgaggagctgatgaggaagattgagaaggaggaggagcagctgtcctatgatgatcctgacaagaagatgtaccacctgtgcatcgtgaacctggtgattggcaccctgtactgtgccaagggcaactatgactttggcatcagcagggtcatcaagagcctggagccctacaacaagaagctgggcacagacacctggtactatgccaagcgctgcttcctgagcctgctggagaacatgagcaagcacaccatcatgctgcgggacagcgtcatccaggagtgtgtgcagttcctggagcactgtgagctgcacggcaggaacatcccagctgtgattgagcagcccctggaggaggagaggatgcacgtgggcaagaacacagtgacctatgagagccggcagctgaaggccctgatctatgagatcatcggctggaacatctag

SEQ ID NO: 42712 - DNA, 1857 bp, Artificial Sequence
  Description of Artificial Sequence: Synthetic coding sequence
atggccggcctgagcggggcccagatcccagatggagaatttgccctggccgcagaatgttatgagcagctgggccagctgcaccctgagctggagcagtaccgcctgtaccaggcccaggccctgtacaaggcctgcctgtatgcagaggccaccagggtggccttcctgctgctggacaacccagcctaccacagccgggtgctgcggctgcaggccgccatcaagtacagcgagggggacctgcccggcagccgcagcctggtggagcagctgcccagccgggagggcggggaggagagcggcggggagaatgaaacagatggccagatcaacctgggctgcctgctgtacaaggagggccagtatgaagctgcctgcagcaagttctttgctgccctgcaggccagcggctaccagcctgacctgagctacaacctggccctggcctactacagcagccggcagtatgccagcgccctgaagcacatcgccgagatcatcgagcggggcatccggcagcaccctgagctgggcgtgggcatgaccacagagggcattgatgtgcgctctgtgggcaacaccctggtgctgcaccagacagccctggtggaggccttcaacctgaaggccgccatcgagtaccagctgaggaactatgaggccgcccaggaggccctgacagacatgccacccagggctgaggaggagctggaccctgtgaccctgcacaaccaggccctgatgaacatggatgcccggcccacagagggctttgagaagctgcagttcctgctgcagcagaaccccttccccccagagaccttcggcaacctgctgctgctgtactgcaagtatgagtactttgacctggccgcagatgtgctggccgagaatgcccacctgatctacaagttcctgaccccctacctgtatgacttcctggatgctgtgatcacctgccagacagcccctgaggaggccttcatcaagctggatggcctggccggcatgctgacagaggtgctgaggaagctgaccatccaggtgcaggaggcccggcacaacagagatgatgaggccatcaagaaggctgtgaatgaatatgatgagaccatggagaagtacatccctgtgctgatggcccaggccaagatctactggaacctggagaactaccccatggtggagaagatcttcaggaagtctgtggagttctgcaatgaccatgatgtgtggaagctgaatgtggcccacgtgctcttcatgcaggagaacaagtacaaggaggccatcggcttctatgagcccatcgtgaagaagcactatgacaacatcctgaatgtgtctgccatcgtgctggccaacctgtgtgtgtcctacatcatgaccagccagaatgaggaggccgaggagctgatgaggaagattgagaaggaggaggagcagctgtcctatgatgatcctgacaagaagatgtaccacctgtgcatcgtgaacctggtgattggcaccctgtactgtgccaagggcaactatgactttggcatcagcagggtcatcaagagcctggagccctacaacaagaagctgggcacagacacctggtactatgccaagcgctgcttcctgagcctgctggagaacatgagcaagcacaccatcatgctgcgggacagcgtcatccaggagtgtgtgcagttcctggagcactgtgagctgcatggaagaaacatcccagctgtgattgagcagcccctggaggaggagaggatgcacgtgggcaagaacacagtgacctatgagagccggcagctgaaggccctgatctatgagatcatcggctggaacatctag

SEQ ID NO: 42713 - DNA, 468 bp, Artificial Sequence
  Description of Artificial Sequence: Synthetic coding sequence
atggcccccatccccaagacagtgggccgcatcaagctggactgcagcctgcggcccagctgccccctggaggtggccgccgcccccaagctgtgcaaggagtttggacctgaggactatggagaagaagatattgtggacttcctgcggcggctggtggagagtgacccccagggcctgcaccgcatccacgtggatggcagcagcggccgcctgcagctgtggcaccacgactacctgctgggccacctggatgatgagggcaagagcacaggccagagcgaccggggcaaaggagctgagggcctgggcacctactgcggcctgaggaagagcttcctgtacccacccttcccccaggtgcccagcaagcactgctttgaggtgccctggcctgtgtccaccctggccctgtccttcatgagccccaagccaccccagcctgcccccctgcctgacagcgagtag

SEQ ID NO: 42714 - DNA, 858 bp, Artificial Sequence
  Description of Artificial Sequence: Synthetic coding sequence
atggcccccatccccaagacagtgggccgcatcaagctggactgcagcctgcggcccagctgccccctggaggtggccgccgcccccaagctgtgcaaggagtttggacctgaggactatggagaagaagatattgtggacttcctgcggcggctggtggagagtgacccccagggcctgcaccgcatccacgtggatggcagcagcggccgcctgcagctgtggcaccacgactacctgctgggccacctggatgatgagggcaagagcacaggccagagcgaccggggcaaaggagctgagggcctgggcacctactgcggcctgaggaagagcttcctgtacccaccccaggagagcgagccctgcccccagagccccagcgccagcgccaccttccccagcgtgtctgacagcctgctgcaggtggccatgccccagaagctgctggtgacagaggaggaggccaaccggctggccgaggagctggtggccgaggaggagaggatgaagcagaaggccgagaagaagaggctgaagaagaagaggcagaaggagaggaagaggcaggagcggctggagcagtactgtggggagcccaaggccagcaccaccagtgatggagatgagagcccccccagcagccctggcaaccctgtgcagggccagtgtggggaggaggaggacagcctggacctgagcagcacctttgtgtccctggccctgaggaaggtgggggactggcccctgagcgcccggcgggagaagggcctgaaccaggagccccagggccggggcctggccctgcagaagatgggccaggaggaggagagcccccccaccaccagcccctgctag

SEQ ID NO: 42715 - DNA, 603 bp, Artificial Sequence
  Description of Artificial Sequence: Synthetic coding sequence
atgccccagaagctgctggtgacagaggaggaggccaaccggctggccgaggagctggtggccgaggaggagaggatgaagcagaaggccgagaagaagaggctgaagaagaagaggcagaaggagaggaagaggcaggagcggctggagcagtactgtggggagcccaaggccagcaccaccagtgatggagatgagagcccccccagcagccctggcaaccctgtgcagggccagtgtggggaggaggaggacagcctggacctgagcagcacctttgtgtccctggccctgaggaaggtgggggactggcccctgagcgcccggcgggagaagggcctgaaccaggagccccagggccggggccccctggcctgcctgcacagctgcatcatcctgcacgtgacagaggccacccccaccagccccagcccccggctgcgggtggagggccccatcctgagcagccccaggaccctgcagagagctggcacctcctgggacctgggcagcagcatctgcctgcggccagatgagggcgcccctgtgccccacagagctggcccctgcatctaccccctggtgggggacatcgtgtggtag

SEQ ID NO: 42716 - DNA, 741 bp, Artificial Sequence
  Description of Artificial Sequence: Synthetic coding sequence
atgcccctgcgcatcctggactacctgctgggccacctggatgatgagggcaagagcacaggccagagcgaccggggcaaaggagctgagggcctgggcacctactgcggcctgaggaagagcttcctgtacccaccccaggagagcgagccctgcccccagagccccagcgccagcgccaccttccccagcgtgtctgacagcctgctgcaggtggccatgccccagaagctgctggtgacagaggaggaggccaaccggctggccgaggagctggtggccgaggaggagaggatgaagcagaaggccgagaagaagaggctgaagaagaagaggcagaaggagaggaagaggcaggagcggctggagcagtactgtggggagcccaaggccagcaccaccagtgatggagatgagagcccccccagcagccctggcaaccctgtgcagggccagtgtggggaggaggaggacagcctggacctgagcagcacctttgtgtccctggccctgaggaaggtgggggactggcccctgagcgcccggcgggagaagggcctgaaccaggagccccagggccggggcctggccctgcagaagatgggccaggaggaggagagccccccccgggaggagcggccccagcagagccccaaggtgcaggtgcgctggctgaagaacctgatccagctggagccctggaagggccacaaggagctgctgggccgccaccgggtgtag

SEQ ID NO: 42717 - DNA, 2514 bp, Artificial Sequence
  Description of Artificial Sequence: Synthetic coding sequence
atggcccggggggagaggagaagaagagctgtgcctgctgagggcgtgaggacagctgagcgggccgcccggggcggccctggaagaagagatggccggggcggcggccccaggagcacagctggaggagtggccctggccgtggtggtgctgagcctggccctgggcatgagcggccgctgggtgctggcctggtaccgggccaggagagctgtgaccctgcacagcgcccctcctgtgctgcctgctgacagcagcagccctgctgtggccccagacctcttctggggcacctaccggccccacgtgtacttcggcatgaagaccaggagccccaagcccctgctgaccggcctgatgtgggcccagcagggcaccaccccaggcacccccaagctgcggcacacctgtgagcagggagatggagtgggcccctacggctgggagttccatgatggcctgagctttggccggcagcacatccaggatggagccctgcggctgaccacagaatttgtgaagaggcctgggggccagcacggcggggactggagctggagggtgacagtggagccccaggacagcggcaccagcgccctgcccctggtgtccctcttcttctacgtggtgacagatggcaaggaggtgctgctgcctgaggtgggcgccaagggccagctgaagttcatcagcggccacaccagcgagctgggggacttccgcttcaccctgctgccccccaccagccctggggacacagcccccaagtatggcagctacaacgtgttctggaccagcaaccctggcctgcccctgctgacagagatggtgaagagccggctgaacagctggttccagcacaggcctcctggggcccctcctgagcgctacctgggcctgcccggcagcctgaagtgggaggaccggggccccagcggccagggccagggccagttcctgatccagcaggtgaccctgaagatccccatcagcattgaatttgtgtttgagagcggcagcgcccaggccggcggcaaccaggccctgccccggctggccggcagcctgctgacccaggccctggagagccatgctgagggcttccgggagagatttgagaagaccttccagctgaaggagaagggcctgagcagtggagagcaggtgctgggccaggccgccctgagcggcctgctgggcggcatcggctacttctacggccagggcctggtgctgcctgacattggagtggagggcagcgagcagaaggtggaccctgccctcttcccccctgtgcccctcttcaccgctgtgcccagccgctccttcttcccccggggcttcctgtgggatgagggcttccaccagctggtggtgcagcgctgggaccccagcctgacccgggaggccctgggccactggctgggcctgctgaatgctgatggctggattggccgggagcagatcctgggagatgaggcccgggcccgggtgcccccagagttcctggtgcagagagctgtgcacgccaacccccccaccctgctgctgcctgtggcccacatgctggaggtgggggaccctgatgacctggccttcctgaggaaggccctgccccggctgcacgcctggttctcctggctgcaccagagccaggccggccccctgcccctgagctaccgctggaggggccgggaccctgccctgcccaccctgctgaaccccaagaccctgcccagcggcctggatgactacccccgggccagccaccccagcgtgacagagcggcacctggacctgcgctgctgggtggccctgggcgcccgggtgctgacccggctggccgagcacctgggggaggccgaggtggccgctgagctgggccccctggccgccagcctggaggccgctgagagcctggatgagctgcactgggcccctgagctgggcgtgtttgctgactttggaaaccacaccaaggctgtgcagctgaagccccggcccccccagggcctggtgcgggtggtgggccggccccagccccagctgcagtatgtggatgccctgggctacgtgtccctcttccccctgctgctgcggctgctggaccccaccagcagccggctgggccccctgctggacatcctggccgacagccgccacctgtggagccccttcggcctgcggagcctggccgccagcagcagcttctacggccagagaaattctgaacatgaccccccctactggagaggagctgtgtggctgaatgtgaactacctggccctgggcgccctgcaccactacggccacctggagggcccccaccaggcccgggccgccaagctgcacggggagctgcgggccaacgtggtgggcaatgtgtggaggcagtaccaggccaccggcttcctgtgggagcagtacagcgacagagatggccggggcatgggctgccggcccttccacggctggaccagcctggtgctgctggccatggccgaggactactag

SEQ ID NO: 42718 - DNA, 456 bp, Artificial Sequence
  Description of Artificial Sequence: Synthetic coding sequence
atggagggccagaggcaggagagccacgccaccctgaccctggcccaggcccacttcaacaatggagaatatgcagaggccgaggccctgtacagcgcctacatccgccgctgtgcctgtgccgccagcagtgatgagagccctggcagcaagtgcagccctgaggacctggccacagcctacaacaacagaggccagatcaagtacttccgggtggacttctatgaggccatggatgactacaccagcgccatcgaggtgcagcccaactttgaggtgccctactacaacagaggcctcatcctgtaccgcctgggctactttgatgatgccctggaggacttcaagaaggtgctggacctgaaccctggcttccaggatgccaccctgagcctgaagcagaccatcctggacaaggaggagaagcagaggagaaatgtggccaagaactactag

SEQ ID NO: 42719 - DNA, 789 bp, Artificial Sequence
  Description of Artificial Sequence: Synthetic coding sequence
atggccagctttggctggaagaggaagatcggggagaaggtgtccaaggtgaccagccagcagtttgaggccgaggccgcagatgagaaggatgtggtggacaatgatgagggcaactggctgcacgccatcaagaggaggaaggagatcctgctggagggctgtgccgagaagagcaagcagctgaaggatgagggcgccagcctggccgagaacaagcgctaccgggaggccatccagaagtgggatgaggccctgcagctgaccccaaatgatgccaccctgtatgagatgaagagccaggtgctgatgagcctgcacgagatgtttcctgctgtgcatgctgctgagatggctgtgcagcagaacccccacagctgggagagctggcagaccctgggccgggcccagctgggcctgggggagatcatcctggccatccgctccttccaggtggccctgcacatctaccccatgaaccctgagatctggaaggaggacctgtcctgggcccggaccctgcaggagcagcagaaggtggcccagaggatcaagaagtctgaggccccagctgaggtgacccacttcagccccaagagcatcccagactatgactttgaaagtgatgaaattgtggccgtgtgtgccgccatcgccgagaaggagaagacagtgtctgccaacaagaccatggtgattgtgtctgccagcggggccatcgagaccgtgacagagaaggaggatggagccaccccaccagatggcagcgtcttcatcaaggccaggtag

SEQ ID NO: 42720 - DNA, 1701 bp, Artificial Sequence
  Description of Artificial Sequence: Synthetic coding sequence
atgctgcagaggagcccccgggccggccccagccgggcccagggccggcgggaggccgctgagaccggcggccccaccacccaggagggcgtggcctgtggggtgcaccagctggccaccctgctgatggagctggacagtgaagatgaggccagccggctgctggccgcagatgccctgtaccgcctgggccgcctggaggagacccacaaggccctgctggtggccctgagcagaagaccccaggccgcccctgtgctggcccggctggccctgctgcagctgcggcggggcttcttctatgatgccaaccagctggtgaagaagctggtgcagagcggggacacagcctgcctgcagcccaccctggatgtgttctgccatgaagatcggcagctgctgcagggccactgccacgcccgggccctggccatcctgcgggcccggcctgggggcgcagatggccgggtgcacaccaaggaggccatcgcctacctgagcctggccatctttgctgctggcagccaggccagcgagagcctgctggcccgggcccgctgctacggcttcctgggccagaagaagacagccatgtttgacttcaacacagtgctgcgggcagagcctggaaatgtgcaggccctgtgtggccgggccctggtgcacctggccctggaccagctgcaggaggccgtggatgacatcgtgtctgccctgaagctgggccctggcaccgtggtgcctgagctgcggagcctgaagccagaggcccaggccctgatcacccagggcctgtacagccactgccgggccctgctgagccagctgcctgacacaggagcccccctggaggacaaggacacccagggcctgctggccgtgggggaggccctgatcaagattgattctggccagccccactggcacctgctgctggccgacatcctgatggcccagggcagctatgaggaggccggcacccacctggagaaggccctgcaccgggcccccaccagcgaggccgcccgggcccggctgggcctgctgcagctgaagaagggagatgtgcctggagctgcccgggacctgcagagcctggccgaggtggatgccccagacctgagctgcctgctgcacctgctggaggccagcgagcggcagagcctggcccaggccgccgcccaggaggccggcaccctgctggatgctggccagccccggcaggccctgggctactgcagcctgtctgtgctggccagcggcagcagcgcctgccacctgcggctgcgggccacctgcctggccgagctgcaggagtttggccgggccctgcgggacctggaccacgtgctgcaggaggccctgggagatggagacctgccccggcgggcagaggacttctgccggcagggccgcctgctgctgagcctgggagatgaagctgctgctgctggggcctttgcccaggccctgaagctggcccccagcctggcccagaacagcctgtgccggcagcccggccgggcccccacagccaggatgttcctgctgcggggccagtgctgcctggaggagcagagacatgctgaggcctggacagctgtggagagcggcctgctggtggaccctgaccaccggggcctgaagaggctgaaggcccgcatccggcgggaggccagcagcggctgctggctgcagtag

SEQ ID NO: 42721 - DNA, 570 bp, Artificial Sequence
  Description of Artificial Sequence: Synthetic coding sequence
atgggcaccccaaatgaccaggccgtgctgcaggccatcttcaacccagacaccccatttggagacatcgtgggcctggacctgggggaggaggccgagaaggaggagcgggaggaggatgaggtgttcccccaggcccagctggagcagagcaaggccctggagctgcagggcgtgatggctgctgaggccggggacctgagcacagccctggagcgcttcggccaggccatctgcctgctgcctgagcgggccagcgcctacaacaacagagcccaggcccggcggctgcagggagatgtggccggggccctggaggacctggagagagctgtggagctgagcggcggccggggccgggccgcccggcagagctttgtgcagaggggcctgctggcccggctgcagggcagagatgatgatgcccggcgggactttgaaagagctgcccggctgggcagcccctttgcccggcggcagctggtgctgctgaacccctatgctgccctgtgcaacaggatgctggccgacatgatgggccagctgcggcggccccgggacagcaggtag

SEQ ID NO: 42722 - DNA, 393 bp, Artificial Sequence
  Description of Artificial Sequence: Synthetic coding sequence
atggctgctgaggccggggacctgagcacagccctggagagatttggccaggccatctgcctgctgcctgagcgggccagcgcctacaacaacagagcccaggcccggcggctgcagggagatgtggccggggccctggaggacctggagagagctgtggagctgagcggcggccggggccgggccgcccggcagagctttgtgcagaggggcctgctggcccggctgcagggcagagatgatgatgcccggcgggactttgagcgggccgcccggctgggcagcccctttgcccggcggcagctggtgctgctgaacccctatgctgccctgtgcaacaggatgctggccgacatgatgggccagctgcggcggccccgggacagcaggtag

SEQ ID NO: 42723 - DNA, 4695 bp, Artificial Sequence
  Description of Artificial Sequence: Synthetic coding sequence
atgagcagcaaggaggtgaagacagccctgaagagcgccagagatgccatccggaacaaggagtacaaggaggccctgaagcactgcaagacagtgctgaagcaggagaagaacaactacaatgcctgggtgttcatcggcgtggccgctgctgagctggagcagcctgaccaggcccagagcgcctacaagaaggctgctgagctggagccagaccagctgctggcctggcagggcctggccaacctgtatgagaagtacaaccacatcaatgccaaggatgacctgcccggggtgtaccagaagctgctggacctgtatgaatctgtggacaagcagaagtggtgtgatgtgtgcaagaagctggtggacctgtactaccaggagaagaagcacctggaggtggcccggacctggcacaagctgatcaagacccggcaggagcagggcgcagaaaatgaggagctgcaccagctgtggaggaagctgacccagttcctggccgagagcacagaggaccagaacaatgagacccagcagctgctcttcaccgcctttgaaaatgccctgggcctgagtgacaagatccccagcgaggaccaccaggtgctgtaccgccacttcatccagagcctgagcaagttcccccatgaaagtgcccggctgaagaaggcctgtgagggcatgatcaacatctaccccaccgtgcagtaccccctggaggtgctgtgcctgcacctgattgagagcggcaacctgacagatgagggccagcagtactgctgccgcctggtggagatggacagcaagagcggccctggcctcatcggcctgggcatcaaggccctgcaggacaagaagtatgaagatgctgtgaggaacctgacagagggcctgaaggagagccctgtgtgcaccagcggctggtaccacctggccgaggcccaggtgaagatgcaccggcccaaggaggccgtgctgagctgcagccaggccctgaagatcgtggacaacctgggcgccagcggcaacagcctgtaccagaggaacctgtgcctgcacctgaaggccgaggccctgatcaagctgagtgactatgacagcagcgaggaggccatccgcaccctggaccagatcagtgatgctgacaacatccctggcctgctggtgctgaagagcctggcctacagaaataaaggcagctttgatgaagctgccaagatcatggaggacctgctgagcagctacccagacctggccgaggtgcacgccctggaggccctgatccacttcaccaagaaggactacctgcaggccgagaagtgcttccagagggccctggagaaggacacagaggtggccgagtaccactaccagctgggcctgacctactggttcatgggagaggagaccaggaaggacaagaccaaggccctgacccacttcctgaaggccgcccggctggacacctacatgggcaaggtgttctgctacctgggccactactacagagatgtggtgggggacaagaacagagcccggggctgctacaggaaggcctttgagctggatgacacagatgctgagagcggggctgctgctgtggacctgtctgtggagctggaggacatggagatggccctggccatcctgaccaccgtgacccagaaggccagcgctggaacagccaagtgggcctggctgcggcggggcctgtactacctgaaggccggccagcacagccaggccgtggccgacctgcaggccgccctgcgggctgaccccaaggacttcaactgctgggagagcctgggggaggcctacctgagccggggcggctacaccacagccctgaagagcttcaccaaggccagcgagctgaaccctgagagcatctacagcgtcttcaaggtggccgccatccagcagatcctgggcaagtacaaggaggccgtggcccagtaccagatgatcatcaagaagaaggaggactatgtgcctgccctgaagggcctgggggagtgccacctgatgatggccaaggccgccctggtggactacctggatggcaaggctgtggactacatcgagaaggccctggagtacttcacctgtgccctgcagcacagagcagatgtgtcctgcctgtggaagctggccggagatgcctgcacctgcctgtatgctgtggcccccagcaaggtgaatgtgcacgtgctgggcgtgctgctgggccagaaggagggcaagcaggtgctgaagaagaatgagctgctgcacctgggcggccgctgctacggccgggccctgaagctgatgagcaccagcaacacctggtgtgacctgggcatcaactactaccggcaggcccagcacctggccgagaccggcagcaacatgaatgacctgaaggagctgctggagaagagcctgcactgcctgaagaaggctgtgcggctggacagcaacaaccacctgtactggaatgccctgggcgtggtggcctgctacagcggcatcggcaactatgccctggcccagcactgcttcatcaagagcatccagagcgagcagatcaatgctgtggcctggaccaacctgggcgtgctgtacctgaccaatgaaaatattgagcaggcccacgaggccttcaagatggcccagagcctggaccccagctacctgatgtgctggattggccaggccctgattgctgaggccgtgggcagctatgacaccatggacctcttccgccacaccacagagctgaacatgcacacagaaggagccctgggctacgcctactgggtgtgcaccaccctgcaggacaagagcaaccgggagacagagctgtaccagtacaacatcctgcagatgaatgccatcccagctgcccaggtgatcctgaacaagtatgtggagcgcatccagaactatgccccagccttcaccatgctgggctacctgaatgagcacctgcagctgaagaaggaggccgccaatgcctaccagagggccatcctgctgctgcagacagctgaggaccaggacacctacaacgtggccatccggaactacggccgcctgctgtgcagcactggagaatatgacaaggccatccaggccttcaagagcacccccctggaggtgctggaggacatcattggatttgccctggccctcttcatgaagggcctgtacaaggagagcagcaaggcctatgaaagagccctgagcatcgtggagagcgagcaggacaaggcccacatcctgacagccctggccatcacagagtacaagcagggcaagacagatgtggccaagaccctgctcttcaagtgcagcatcctgaaggagcccaccacagagagcctgcaggccctgtgtgccctgggcctggccatgcaggatgccaccctgagcaaggccgccctgaatgagctgctgaagcacatcaagcacaaggacagcaactaccagcgctgcctgctgaccagcgccatctatgccctgcagggccgctctgtggccgtgcagaagcagatcagcaaggctgtgcacagcaaccctggggaccctgccctgtggagcctgctgagccgggtggtggcccagtatgcccagagaaatgccaagggcggcgtggtggccggaaatgtggcccacatcctggacagcaaccacggcaagaaggccctgctgtacacagctgtgaaccagctggccatgggcagcagcagcgcagaagatgagaagaacacagccctgaagaccatccagaaggccgccctgctgagccctggggaccctgccatctgggccggcctgatggccgcctgccacgcagatgacaagctggccctggtgaacaacacccagcccaagagaattgacctgtacctggccctgctgtctgctgtgtctgccagcatcaaggatgagaagttctttgagaactacaaccagagcctggagaagtggagcctgagccaggccgtgacaggcctgattgacaccggccgcatcagcgaggccgagaccctgtgcaccaagaacctgaagagcaacccagaccagcctgctgtgatcctgctgctgcggcaggtgcagtgcaagcccctgctggagagccagaagcccctgcctgatgctgtgctggaggagctgcagaagacagtgatgagcaacagcacctctgtgcctgcctggcagtggctggcccacgtgtaccagagccagggcatgatgagagctgctgagatgtgctacaggaagagcctgcagctggccagccagaggggctcctggagcggcaagctgagcagcctgctgcggctggccctgctggccctgaaggtgtgcatggccaacatcagcaatgaccactggcccagcctggtgcaggaggccaccacagaggccctgaagctgtgcttctgccccctggccgtgctgctgcaggccctgctgcagttcaagaggaagatgggcgcccgggagacccggcggctgctggagcgggtggtgtaccagcccggctaccccaagagcatcgccagcacagcccgctggtacctgctgcggcacctgtatgccaaggatgattatgagctgattgatgtgctggtgaacaatgccaagacccatggagacacccgggccctggagctgaaccagaggctgagcagccagtag

SEQ ID NO: 42724 - DNA, 288 bp, Artificial Sequence
  Description of Artificial Sequence: Synthetic coding sequence
atgagcagcaaggaggtgaagacagccctgaagagcgccagagatgccatccggaacaaggagtacaaggaggccctgaagcactgcaagacagtgctgaagcaggagaagaacaactacaatgcctgggtgttcatcggcgtggccgctgctgagctggagcagcctgaccaggcccagagcgcctacaagaaggctgctgagctggagccagaccagctgctggcctggcagggcctggccaacctgtatgagaagtacaaccacatcaatgccaaggatgactag

SEQ ID NO: 42725 - DNA, 1236 bp, Artificial Sequence
  Description of Artificial Sequence: Synthetic coding sequence
atggctgctgccagccccctgcgggactgccaggcctggaaggatgcccggctgcccctgagcaccaccagcaatgaggcctgcaagctgtttgatgccaccctgacccagtatgtgaagtggaccaatgacaagagcctgggcggcatcgagggctgcctgagcaagctgaaggctgctgaccccacctttgtgatgggccacgccatggccaccggcctggtgctgattggaacaggcagctctgtgaagctggacaaggagctggacctggccgtgaagaccatggtggagatcagcaggacccagcccctgacccggcgggagcagctgcacgtgtctgctgtggagacctttgccaacggctacgtgaagggcatctacagctttggcctgatggagaccaacttctatgaccaggccgagaagctggccaaggaggccctgagcatcaaccccacagatgcctggagcgtgcacacagtggcccacatccacgagatgaaggccgagatcaaggatggcctggagttcatgcagcacagcgagaccttctggaaggacagcgacatgctggcctgccacaactactggcactgggccctgtacctgattgaaaaaggagaatatgaggccgccctgaccatctatgacacccacatcctgcccagcctgcaggccaatgatgccatgctggatgtggtggacagctgcagcatgctgtaccgcctgcagatggagggcgtgtctgtgggccagcgctggcaggatgtgctgcctgtggccaggaagcacagccgggaccacatcctgctcttcaatgatgcccacttcctgatggccagcctgggcgcccatgacccccagaccacccaggagctgctgaccaccctgagagatgccagcgagagccctggagagaactgccagcacctgctggccagagatgtgggcctgcccctgtgccaggccctggtggaggctgaagatggcaacccagacagagtgctggagctgctgctgcccatccgctacagaattgtgcagctgggcggcagcaatgcccagagagatgtgttcaaccagctgctgattcatgctgccctgaactgcaccagctctgtgcacaagaatgtggcccggagcctgctgatggagagagatgccctgaagcccaacagccccctgacagagcggctcatcaggaaggccgccaccgtgcacctgatgcagtag

SEQ ID NO: 42726 - DNA, 1410 bp, Artificial Sequence
  Description of Artificial Sequence: Synthetic coding sequence
atggctgctgccagccccctgcgggactgccaggcctggaaggatgcccggctgcccctgagcaccaccagcaatgaggcctgcaagctgtttgatgccaccctgacccagtatgtgaagtggaccaatgacaagagcctgggcggcatcgagggctgcctgagcaagctgaaggctgctgaccccacctttgtgatgggccacgccatggccaccggcctggtgctgattggaacaggcagctctgtgaagctggacaaggagctggacctggccgtgaagaccatggtggagatcagcaggacccagcccctgacccggcgggagcagctgcacgtgtctgctgtggagacctttgccaatggaaacttccccaaggcctgtgagctgtgggagcagatcctgcaggaccaccccacagacatgctggccctgaagttcagccatgatgcctacttctacctgggctaccaggagcagatgagggacagcgtggcccgcatctaccccttctggaccccagacatccccctgagcagctatgtgaagggcatctacagctttggcctgatggagaccaacttctatgaccaggccgagaagctggccaaggaggccctgagcatcaaccccacagatgcctggagcgtgcacacagtggcccacatccacgagatgaaggccgagatcaaggatggcctggagttcatgcagcacagcgagaccttctggaaggacagcgacatgctggcctgccacaactactggcactgggccctgtacctgattgaaaaaggagaatatgaggccgccctgaccatctatgacacccacatcctgcccagcctgcaggccaatgatgccatgctggatgtggtggacagctgcagcatgctgtaccgcctgcagatggagggcgtgtctgtgggccagcgctggcaggatgtgctgcctgtggccaggaagcacagccgggaccacatcctgctcttcaatgatgcccacttcctgatggccagcctgggcgcccatgacccccagaccacccaggagctgctgaccaccctgagagatgccagcgagagccctggagagaactgccagcacctgctggccagagatgtgggcctgcccctgtgccaggccctggtggaggctgaagatggcaacccagacagagtgctggagctgctgctgcccatccgctacagaattgtgcagctgggcggcagcaatgcccagagagatgtgttcaaccagctgctgattcatgctgccctgaactgcaccagctctgtgcacaagaatgtggcccggagcctgctgatggagagagatgccctgaagcccaacagccccctgacagagcggctcatcaggaaggccgccaccgtgcacctgatgcagtag

SEQ ID NO: 42727 - DNA, 1263 bp, Artificial Sequence
  Description of Artificial Sequence: Synthetic coding sequence
atggacagcagccccagcctgcccctcatccgcaccccagagagcagcctgcacgaggccctggaccagtgcatgacagccctggacctcttcctgaccaaccagttcagcgaggccctgagctacctgaagcccaggaccaaggagagcatgtaccacagcctgacctacgccaccatcctggagatgcaggccatgatgacctttgacccccaggacatcctgctggccggcaacatgatgaaggaggcccagatgctgtgccagaggcacaggaggaagagctctgtgacagacagcttcagcagcctggtgaaccggcccaccctgggccagttcacagaggaggagatccacgccgaggtgtgctacgccgagtgcctgctgcagagagctgccctgaccttcctgcagggcagcagccacggcggcgctgtgcggccccgggccctgcatgaccccagccacgcctgcagctgccccccaggccctggccggcagcacctgttcctgctgcaggatgagaacatggtgtccttcatcaagggcggcatcaaggtgaggaacagctaccagacctacaaggagctggacagcctggtgcagagcagccagtactgcaagggggagaaccacccccactttgaaggaggagtgaagctgggcgtgggcgccttcaacctgaccctgtccatgctgcccacccgcatcctgcggctgctggagtttgtgggcttcagcggcaacaaggactatggcctgctgcagctggaggagggcgccagcggccacagcttccgctctgtgctgtgtgtgatgctgctgctgtgctaccacaccttcctgacctttgtgctgggcactggaaatgtgaacatcgaggaggccgagaagctgctgaagccctacctgaaccgctaccccaagggggccatcttcctgttctttgctggccgcatcgaggtgatcaagggcaacattgatgctgtgtctgatggcggccctggccggggctggggcagcctgggcgtgtcccagaccagcaggaagagcggcacctgtgacatcctgcgggacagaattgactggggccggggcggcggccaggagaggaccaaccagagagctggggccggggaggccctgctggccgagcagcccgggaagacccgggaggaggaggcctttgtggtgcccggcatcctgaccggccgctacagaacagctgccctgcagtggagggaggtggagggcggggcctag

SEQ ID NO: 42728 - DNA, 1737 bp, Artificial Sequence
  Description of Artificial Sequence: Synthetic coding sequence
atgggccagaagggccacaaggacagcctgtacccctgtggcggcaccccagagagcagcctgcacgaggccctggaccagtgcatgacagccctggacctcttcctgaccaaccagttcagcgaggccctgagctacctgaagcccaggaccaaggagagcatgtaccacagcctgacctacgccaccatcctggagatgcaggccatgatgacctttgacccccaggacatcctgctggccggcaacatgatgaaggaggcccagatgctgtgccagaggcacaggaggaagagctctgtgacagacagcttcagcagcctggtgaaccggcccaccctgggccagttcacagaggaggagatccacgccgaggtgtgctacgccgagtgcctgctgcagagagctgccctgaccttcctgcaggatgagaacatggtgtccttcatcaagggcggcatcaaggtgagaaattcctaccagacctacaaggagctggacagcctggtgcagagcagccagtactgcaagggggagaaccacccccactttgagggcggcgtgaagctgggcgtgggcgccttcaacctgaccctgtccatgctgcccacccgcatcctgcggctgctggagtttgtgggcttcagcggcaacaaggactatggcctgctgcagctggaggagggcgccagcggccacagcttccgctctgtgctgtgtgtgatgctgctgctgtgctaccacaccttcctgacctttgtgctgggcactggaaatgtgaacatcgaggaggccgagaagctgctgaagccctacctgaaccgctaccccaagggggccatcttcctgttctttgctggaagaattgaagtcatcaagggcaacattgatgctgccatcagaagatttgaggagtgctgtgaggcccagcagcactggaagcagttccaccacatgtgctactgggagctgatgtggtgcttcacctacaagggccagtggaagatgagctacttctatgctgacctgctgagcaaagaaaactgctggagcaaggccacctacatctacatgaaggccgcctacctgtccatgtttgggaaggaggaccacaagccctttggagatgatgaggtggagctgttccgggctgtgcccggcctgaagctgaagattgctgggaagagcctgcccacagagaagtttgccatcaggaagagccgccgctacttcagcagcaaccccatcagcctgcctgtgcctgccctggagatgatgtacatctggaatggctatgctgtgattggcaagcagcccaagctgacagatggcatcctggagatcatcaccaaggccgaggagatgctggagaagggcccagaaaatgagtacagcgtggatgatgaatgtctggtgaagctgctgaagggcctgtgcctgaagtacctgggccgggtgcaggaggccgaggagaacttccgcagcatcagcgccaatgagaagaagatcaagtatgaccactacctgatccccaatgccctgctggagctggccctgctgctgatggagcaggacagaaatgaggaggccatcaagctgctggagagcgccaagcagaactacaagaactacagcatggagagcaggacccacttccgcatccaggccgccaccctgcaggccaagagcagcctggagaacagcagccgctccatggtgtcctctgtgtccctgtag

SEQ ID NO: 42729 - DNA, 1746 bp, Artificial Sequence
  Description of Artificial Sequence: Synthetic coding sequence
atggccttcctgaccacctggaaggaggccgccagcggcaagagtgacaggaggaccccagagagcagcctgcacgaggccctggaccagtgcatgacagccctggacctcttcctgaccaaccagttcagcgaggccctgagctacctgaagcccaggaccaaggagagcatgtaccacagcctgacctacgccaccatcctggagatgcaggccatgatgacctttgacccccaggacatcctgctggccggcaacatgatgaaggaggcccagatgctgtgccagaggcacaggaggaagagctctgtgacagacagcttcagcagcctggtgaaccggcccaccctgggccagttcacagaggaggagatccatgctgaggtgtgctacgcagaatgtctgctgcagagagctgccctgaccttcctgcaggatgagaacatggtgtccttcatcaagggcggcatcaaggtgaggaacagctaccagacctacaaggagctggacagcctggtgcagagcagccagtactgcaagggggagaaccacccccactttgaaggaggagtgaagctgggcgtgggcgccttcaacctgaccctgtccatgctgcccacccgcatcctgcggctgctggagtttgtgggcttcagcggcaacaaggactatggcctgctgcagctggaggagggcgccagcggccacagcttccgctctgtgctgtgtgtgatgctgctgctgtgctaccacaccttcctgacctttgtgctgggcactggaaatgtgaacatcgaggaggccgagaagctgctgaagccctacctgaaccgctaccccaagggggccatcttcctgttctttgctggccgcatcgaggtgatcaagggcaacattgatgctgccatccgccgctttgaggagtgctgtgaggcccagcagcactggaagcagttccaccacatgtgctactgggagctgatgtggtgcttcacctacaagggccagtggaagatgagctacttctacgccgacctgctgagcaaggagaactgctggagcaaggccacctacatctacatgaaggccgcctacctgtccatgtttgggaaggaggaccacaagccctttggagatgatgaggtggagctgttccgggctgtgcccggcctgaagctgaagattgctgggaagagcctgcccacagagaagtttgccatcaggaagagccgccgctacttcagcagcaaccccatcagcctgcctgtgcctgccctggagatgatgtacatctggaatggctacgccgtcatcggcaagcagcccaagctgacagatggcatcctggagatcatcaccaaggccgaggagatgctggagaagggcccagaaaatgagtacagcgtggatgatgagtgcctggtgaagctgctgaagggcctgtgcctgaagtacctgggccgggtgcaggaggccgaggagaacttccgcagcatcagcgccaatgagaagaagatcaagtatgaccactacctgatccccaatgccctgctggagctggccctgctgctgatggagcaggacagaaatgaggaggccatcaagctgctggagagcgccaagcagaactacaagaactacagcatggagagcaggacccacttccgcatccaggccgccaccctgcaggccaagagcagcctggagaacagcagccgctccatggtgtcctctgtgtccctgtag

SEQ ID NO: 42730 - DNA, 1842 bp, Artificial Sequence
  Description of Artificial Sequence: Synthetic coding sequence
atgggccagaagggccacaaggacagcctgtacccctgtggcggcaccccagagagcagcctgcacgaggccctggaccagtgcatgacagccctggacctcttcctgaccaaccagttcagcgaggccctgagctacctgaagcccaggaccaaggagagcatgtaccacagcctgacctacgccaccatcctggagatgcaggccatgatgacctttgacccccaggacatcctgctggccggcaacatgatgaaggaggcccagatgctgtgccagaggcacaggaggaagagctctgtgacagacagcttcagcagcctggtgaaccggcccaccctgggccagttcacagaggaggagatccacgccgaggtgtgctacgccgagtgcctgctgcagagagctgccctgaccttcctgcagggcagcagccacggcggcgctgtgcggccccgggccctgcatgaccccagccacgcctgcagctgccccccaggccctggccggcagcacctgttcctgctgcaggatgagaacatggtgtccttcatcaagggcggcatcaaggtgaggaacagctaccagacctacaaggagctggacagcctggtgcagagcagccagtactgcaagggggagaaccacccccactttgaaggaggagtgaagctgggcgtgggcgccttcaacctgaccctgtccatgctgcccacccgcatcctgcggctgctggagtttgtgggcttcagcggcaacaaggactatggcctgctgcagctggaggagggcgccagcggccacagcttccgctctgtgctgtgtgtgatgctgctgctgtgctaccacaccttcctgacctttgtgctgggcactggaaatgtgaacatcgaggaggccgagaagctgctgaagccctacctgaaccgctaccccaagggggccatcttcctgttctttgctggccgcatcgaggtgatcaagggcaacattgatgctgccatccgccgctttgaggagtgctgtgaggcccagcagcactggaagcagttccaccacatgtgctactgggagctgatgtggtgcttcacctacaagggccagtggaagatgagctacttctacgccgacctgctgagcaaggagaactgctggagcaaggccacctacatctacatgaaggccgcctacctgtccatgtttgggaaggaggaccacaagccctttggagatgatgaggtggagctgttccgggctgtgcccggcctgaagctgaagattgctgggaagagcctgcccacagagaagtttgccatcaggaagagccgccgctacttcagcagcaaccccatcagcctgcctgtgcctgccctggagatgatgtacatctggaatggctacgccgtcatcggcaagcagcccaagctgacagatggcatcctggagatcatcaccaaggccgaggagatgctggagaagggcccagaaaatgagtacagcgtggatgatgagtgcctggtgaagctgctgaagggcctgtgcctgaagtacctgggccgggtgcaggaggccgaggagaacttccgcagcatcagcgccaatgagaagaagatcaagtatgaccactacctgatccccaatgccctgctggagctggccctgctgctgatggagcaggacagaaatgaggaggccatcaagctgctggagagcgccaagcagaactacaagaactacagcatggagagcaggacccacttccgcatccaggccgccaccctgcaggccaagagcagcctggagaacagcagccgctccatggtgtcctctgtgtccctgtag

SEQ ID NO: 42731 - DNA, 1734 bp, Artificial Sequence
  Description of Artificial Sequence: Synthetic coding sequence
atgaccagcgctgggggcgcccctggggccctgcctgctggcaccccagagagcagcctgcacgaggccctggaccagtgcatgacagccctggacctcttcctgaccaaccagttcagcgaggccctgagctacctgaagcccaggaccaaggagagcatgtaccacagcctgacctacgccaccatcctggagatgcaggccatgatgacctttgacccccaggacatcctgctggccggcaacatgatgaaggaggcccagatgctgtgccagaggcacaggaggaagagctctgtgacagacagcttcagcagcctggtgaaccggcccaccctgggccagttcacagaggaggagatccatgctgaggtgtgctacgcagaatgtctgctgcagagagctgccctgaccttcctgcaggatgagaacatggtgtccttcatcaagggcggcatcaaggtgaggaacagctaccagacctacaaggagctggacagcctggtgcagagcagccagtactgcaagggggagaaccacccccactttgaaggaggagtgaagctgggcgtgggcgccttcaacctgaccctgtccatgctgcccacccgcatcctgcggctgctggagtttgtgggcttcagcggcaacaaggactatggcctgctgcagctggaggagggcgccagcggccacagcttccgctctgtgctgtgtgtgatgctgctgctgtgctaccacaccttcctgacctttgtgctgggcactggaaatgtgaacatcgaggaggccgagaagctgctgaagccctacctgaaccgctaccccaagggggccatcttcctgttctttgctggccgcatcgaggtgatcaagggcaacattgatgctgccatccgccgctttgaggagtgctgtgaggcccagcagcactggaagcagttccaccacatgtgctactgggagctgatgtggtgcttcacctacaagggccagtggaagatgagctacttctacgccgacctgctgagcaaggagaactgctggagcaaggccacctacatctacatgaaggccgcctacctgtccatgtttgggaaggaggaccacaagccctttggagatgatgaggtggagctgttccgggctgtgcccggcctgaagctgaagattgctgggaagagcctgcccacagagaagtttgccatcaggaagagccgccgctacttcagcagcaaccccatcagcctgcctgtgcctgccctggagatgatgtacatctggaatggctacgccgtcatcggcaagcagcccaagctgacagatggcatcctggagatcatcaccaaggccgaggagatgctggagaagggcccagaaaatgagtacagcgtggatgatgagtgcctggtgaagctgctgaagggcctgtgcctgaagtacctgggccgggtgcaggaggccgaggagaacttccgcagcatcagcgccaatgagaagaagatcaagtatgaccactacctgatccccaatgccctgctggagctggccctgctgctgatggagcaggacagaaatgaggaggccatcaagctgctggagagcgccaagcagaactacaagaactacagcatggagagcaggacccacttccgcatccaggccgccaccctgcaggccaagagcagcctggagaacagcagccgctccatggtgtcctctgtgtccctgtag

SEQ ID NO: 42732 - DNA, 339 bp, Artificial Sequence
  Description of Artificial Sequence: Synthetic coding sequence
atgaaggccgcctacctgtccatgtttgggaaggaggaccacaagccctttggagatgatgaggtggagctgttccgggctgtgcccggcctgaagctgaagattgctgggaagagcctgcccacagagaagtttgccatcaggaagagccgccgctacttcagcagcaaccccatcagcctgcctgtgcctgccctggagatgatgtacatctggaatggctacgccgtcatcggcaagcagcccaagctgacagatggcatcctggagatcatcaccaaggccgaggagatgctggagaagggcccagaaaatgagtacagcgtggatgatgaatag

SEQ ID NO: 42733 - DNA, 666 bp, Artificial Sequence
  Description of Artificial Sequence: Synthetic coding sequence
atgaaggccgcctacctgtccatgtttgggaaggaggaccacaagccctttggagatgatgaggtggagctgttccgggctgtgcccggcctgaagctgaagattgctgggaagagcctgcccacagagaagtttgccatcaggaagagccgccgctacttcagcagcaaccccatcagcctgcctgtgcctgccctggagatgatgtacatctggaatggctacgccgtcatcggcaagcagcccaagctgacagatggcatcctggagatcatcaccaaggccgaggagatgctggagaagggcccagaaaatgagtacagcgtggatgatgagtgcctggtgaagctgctgaagggcctgtgcctgaagtacctgggccgggtgcaggaggccgaggagaacttccgcagcatcagcgccaatgagaagaagatcaagtatgaccactacctgatccccaatgccctgctggagctggccctgctgctgatggagcaggacagaaatgaggaggccatcaagctgctggagagcgccaagcagaactacaagaactacagcatggagagcaggacccacttccgcatccaggccgccaccctgcaggccaagagcagcctggagaacagcagccgctccatggtgtcctctgtgtccctgtag

SEQ ID NO: 42734 - DNA, 1569 bp, Artificial Sequence
  Description of Artificial Sequence: Synthetic coding sequence
atgagctttggagccagctttgtgtccttcctgaatgccatgatgacctttgaggaggagaagatgcagctggcctgtgatgacctgaagaccacagagaagctgtgtgagagcgaggaggccggggtcatcgagaccatcaagaacaagatcaagaagaatgtggatgtgaggaagagcgcccccagcatggtggaccggctgcagaggcagatcatcatcgctgactgccaggtgtacctggccgtgctgagctttgtgaagcaggagctgagcgcctacatcaagggcggctggatcctgaggaaggcctggaagatctacaacaagtgctacctggacatcaatgccctgcaggagctgtaccagaagaagctgacagaggagagcctgaccagtgatgctgccaatgacaaccacatcgtggccgagggcgtgtctgaggagagcctgaaccggctgaagggagctgtgtcctttggctacggcctcttccacctgtgcatctccatggtgccccccaacctgctgaagatcatcaacctgctgggcttccctggggaccggctgcagggcctgagcagcctgatgtatgccagcgagagcaaggacatgaaggcccccctggccaccctggccctgctgtggtaccacacagtggtgcggcccttctttgccctggatggcagtgacaacaaggccggcctggatgaggccaaggagatcctgctgaagaaggaggccgcctaccccaacagcagcctcttcatgttcttcaagggccgcatccagaggctggagtgccagatcaacagcgccctgaccagcttccacacagccctggagctggccgtggaccagcgggagatccagcacgtgtgcctgtatgagatcggctggtgcagcatgattgagctgaacttcaaggatgcctttgacagctttgagcggctgaagaatgaaagccgctggagccagtgctactatgcctacctgacagctgtgtgccagggcgccactggagatgtggatggagcccagatcgtgttcaaggaggtgcagaagctgttcaagaggaagaacaaccagatcgagcagttctctgtgaagaaggccgagcgcttcaggaagcagacccccaccaaggccctgtgtgtgctggccagcattgaggtgctgtacctgtggaaggccctgcccaactgcagcttccccaacctgcagaggatgagccaggcctgccacgaggtggatgacagctctgtggtgggcctgaagtacctgctgctgggcgccatccacaagtgcctgggcaacagtgaagatgctgtgcagtacttccagagagctgtgaaggatgagctgtgccggcagaacaacctgtatgtgcagccctatgcctgctatgagctgggctgcctgctgctggacaagccagagaccgtgggccggggccgggccctgctgctgcaggccaaggaggacttcagcggctatgactttgagaaccggctgcacgtgcgcatccatgctgccctggccagcctgcgggagctggtgccccagtag

SEQ ID NO: 42735 - DNA, 1752 bp, Artificial Sequence
  Description of Artificial Sequence: Synthetic coding sequence
atggccggcagcgagcagcagaggcccaggagaagagatgatggagacagtgatgctgctgctgctgctgctgcccccctgcaggatgctgagctggccctggccggcatcaacatgctgctgaacaacggcttccgggagagtgaccagctgttcaagcagtacagaaaccacagccccctgatgagctttggagccagctttgtgtccttcctgaatgccatgatgacctttgaggaggagaagatgcagctggcctgtgatgacctgaagaccacagagaagctgtgtgagagcgaggaggccggcgtgattgagaccatcaagaacaagatcaagaagaatgtggatgtgaggaagagcgcccccagcatggtggaccggctgcagaggcagatcatcatcgctgactgccaggtgtacctggccgtgctgagctttgtgaagcaggagctgagcgcctacatcaagggcggctggatcctgaggaaggcctggaagatctacaacaagtgctacctggacatcaatgccctgcaggagctgtaccagaagaagctgacagaggagagcctgaccagtgatgctgccaatgacaaccacatcgtggccgagggcgtgtctgaggagagcctgaaccggctgaagggagctgtgtcctttggctacggcctcttccacctgtgcatctccatggtgccccccaacctgctgaagatcatcaacctgctgggcttccctggggaccggctgcagggcctgagcagcctgatgtatgccagcgagagcaaggacatgaaggcccccctggccaccctggccctgctgtggtaccacacagtggtgcggcccttctttgccctggatggcagtgacaacaaggccggcctggatgaggccaaggagatcctgctgaagaaggaggccgcctaccccaacagcagcctcttcatgttcttcaagggccgcatccagaggctggagtgccagatcaacagcgccctgaccagcttccacacagccctggagctggccgtggaccagcgggagatccagcacgtgtgcctgtatgaaattggctggtgcagcatgattgagctgaacttcaaggatgcctttgacagctttgagcggctgaagaatgaaagccgctggagccagtgctactatgcctacctgacagctgtgtgccagggcgccactggagatgtggatggagcccagatcgtgttcaaggaggtgcagaagctgttcaagaggaagaacaaccagatcgagcagttctctgtgaagaaggccgagcgcttcaggaagcagacccccaccaaggccctgtgtgtgctggccagcattgaggtgctgtacctgtggaaggccctgcccaactgcagcttccccaacctgcagaggatgagccaggcctgccacgaggtggatgacagctctgtggtgggcctgaagtacctgctgctgggcgccatccacaagtgcctgggcaacagtgaagatgctgtgcagtacttccagagagctgtgaaggatgagctgtgccggcagaacaacctgtatgtgcagccctatgcctgctatgagctgggctgcctgctgctggacaagccagagaccgtgggccggggccgggccctgctgctgcaggccaaggaggacttcagcggctatgactttgaaaatcggctgcacgtgcgcatccacgccgccctggccagcctgcgggagctggtgccccagtag

SEQ ID NO: 42736 - DNA, 831 bp, Artificial Sequence
  Description of Artificial Sequence: Synthetic coding sequence
atgcacgcccccttccgcatcagctgccaggtggtgtggctgttcaagatctacctgctgatgtgccagatcaacagcgccctgaccagcttccacacagccctggagctggccgtggaccagcgggagatccagcacgtgtgcctgtatgagatcggctggtgcagcatgattgagctgaacttcaaggatgcctttgacagctttgagcggctgaagaatgaaagccgctggagccagtgctactatgcctacctgacagctgtgtgccagggcgccactggagatgtggatggagcccagatcgtgttcaaggaggtgcagaagctgttcaagaggaagaacaaccagatcgagcagttctctgtgaagaaggccgagcgcttcaggaagcagacccccaccaaggccctgtgtgtgctggccagcattgaggtgctgtacctgtggaaggccctgcccaactgcagcttccccaacctgcagaggatgagccaggcctgccacgaggtggatgacagctctgtggtgggcctgaagtacctgctgctgggcgccatccacaagtgcctgggcaacagtgaagatgctgtgcagtacttccagagagctgtgaaggatgagctgtgccggcagaacaacctgtatgtgcagccctatgcctgctatgagctgggctgcctgctgctggacaagccagagaccgtgggccggggccgggccctgctgctgcaggccaaggaggacttcagcggctatgactttgagaaccggctgcacgtgcgcatccatgctgccctggccagcctgcgggagctggtgccccagtag

SEQ ID NO: 42737 - DNA, 231 bp, Artificial Sequence
  Description of Artificial Sequence: Synthetic coding sequence
atggccggcagcgagcagcagaggcccaggagaagagatgatggagacagtgatgctgctgctgctgctgctgcccccctgcaggatgctgagctggccctggccggcatcaacatgctgctgaacaacggcttccgggagagtgaccagctgttcaagcagtacaggaagagcttcctgaccagcgagaagaccagcgccctgcctggagagacccagaggcggctgtag

SEQ ID NO: 42738 - DNA, 2631 bp, Artificial Sequence
  Description of Artificial Sequence: Synthetic coding sequence
atggccgaggaggagggccgcctgcacagcgtgcagggcctgctgagcctgcaggacctgcagaatgtgaacacccccctgatgaggaagctggcccggctgaagctgggcctggtggagatggccctggacatgctgcagttcatctgggaggaggcccacggccagcagagcgagcagggcagcctggagaagctgctggccgactacctgcagaacaccagtgactacacctctgtgggcctgcagtggttcaccctgaagaggaccctggcccatggagccctggcccagctgggcagcctgcagcccctgtctgtgggctgtgtggagatccgggcccggctgctgggcctggccggccgggccctgcacctgctggccatgcaggccgaccctgtgcaccccacctgctactgggaggccggccccagcgtgggcgccaagctgagcggcctgaagagcctggagctggaggtggaggaggagggcgccaccaagagcagccgggaccccccagccagcagagctgcccctgaggagcactgcagaagaggagaggacctgaagaggaggatggtgctggcccagcagtacctggcccaggccagcgaggtgctgctgcagtgcctgcaggtggccctgggcagcggcctgctggatgtggccgctgctgccagcctggagatggtggagtgtgtgggcaccctggaccctgccaccacctgccagttcctggccctgagccagagctgcagcgccagcgagaccatgagagatgtgctgctggccgccacagccaacaccagcagcagccagctggccgccctgctgcagctgcagcaccagctgcgctgccaggacaggaccaccaccagcctgggcgcccgggtggagcagaggctggccgctgtgtccaaggcctggcagaacctgtgtgtgacagagcagcacttcaacctgctgaatgagatgccacccaccttctggatcctcttcctgcacctgagcggggacaggagccggctgtatggagctgcctatgagaagcccaagttcatcacagctgccaagggcaaggtgcaggccgtgggcggcagctgcaaggtgatgaggctggccatcagccccacagccttcagccacctgctggcctgtgcccagcagttcaggaagcagacccaggcccaggtgtacagcgaggacatggccctgaacatcggcagcgagcctgagggcctgcaggtggaggagaaggagaggcctgtgcagaggctgagctctgtgctgggccccctggaggagctgctgcagcccctcttccccctgctgagcctgagcaaggcccgggtgcagaccccagctgtggtggccgacagcggcaagagcaagggcaaggacaaggagaggaagaccagcacaggccagcacagcacagtgcagcctgaggtggccgacaagatcgtgctggtggccgacagacacctgctggagctgcccctggagggcctgtctgtgtttgatgagggcaccatcagctctgtgtcccgggagttcagcctgcagatgctgtggaaccggctgcacaaggaggagacagaaggaggagtgaagaaggagggccgcagccgggaccccaagaagaggagcctggccaagaagggcaggaagggcagcatccccaggaccatccccccagactgcatcatcgtggacagcgacaacttcaagtttgtggtggacccctatgaggaggcccagggccctgagatgctgacccctgtgtccatcacccaggacatcctggagcgcttccaggacaccttcaccagccgctgggccggccacctgggcagcaagcacttccccagccaggcccagtgggagcaggccctgggcagctgcagcggcttcttcttctacggcatggagagcttcctgagccacatcctggtggagcggctggtggccatgaacctgcaggagtgccaggtggccgtgctgctggacctggcccggagctaccagagcctgaagaggcacatggagagcgtggagcaccggcgctctgtgggccgctgggaggccaactggagaaattctgccagccccagtgaagatgagtggaggcggggcggggagccccggcggggcttcagtgacctggagggccaggccgccgccgcccccaagctgcgggcccccagccaccacgcccagctgggccctgtgtgggccgccgcccccagccaccgggtggtgcaggcctggacctgcctgcccagcgctgctggggccccagccctggccagcgccctgggcagcgcccccctgcccacccacccccacctgcctgcccccatccccagcagccagctggccctgcccttcctgggcctgagccctgccctgggcgccgccagcgcccgggaccccccaccagccaccagcaggaaggctgctgcctggaccagcagcagcgcctgcctgtgtgccccctggggcctgcggcggggctggagctgtgtgagcagccggggccaggacaagggcggcctgcccctggccgccctggtgctgagctgcctggaccagaagaccatccagacagtgtccctcttcctgatctag

SEQ ID NO: 42739 - DNA, 4593 bp, Artificial Sequence
  Description of Artificial Sequence: Synthetic coding sequence
atggacctggtgatcacccaggagctggcccgggcagagagccagcaggatgctgccagcctgaagaaggcctatgagctgatcaagagcgccaacctgggcaagtcagaatttgaccccagcgagagcttctccccagacctgtttgtgctgtgtgccgagcaggccctgaagatgaggcagcctgaggtgtctgaggactgcatccagatgtacttcaaggtgaaggcccccatcacccagttcctgggccgggcccacctgtgccgggcccagatgtgtgcccccaagtctgctgagaacctggaggagtttgagaactgtgtgacagagtacatgaaggccatcaactttgccaagggggagccccgctactacttcctggtgtacaatgcctctgtgctgtactggcagatggtgcggcccttcctgaagccaggctaccgccaccacctgatccccagcctgagccagatcatcaacgtgctgagccagacagaggaggaggacaaggagtggagggctgagctgatgctggagctgctggagtgctacctgcaggccggcaggaaggaggaggccgcccgcttctgcagcacagctgcccccttcatcaagagccacgtgccccagaagtaccggcagatcttctctgtgatggtgagacatgagctgatggatgagctgcagctgaaggaggagaagaagaacagcatcagcctgtctgtgaccttctacatcaacatgctgaaggccaaggccgagcagaatgacctgcccggggacatcagcgtcatcctgaggaaggcctaccgccacctgggccactacaaccaccagcgcttccccagcatcagcgaggagaagatgctgctgctgtttgagctggcccgcttcagcctgaccctgaagtgcatggagatcagcagcgcctgcctgagtgacctgaagaagatggagagcaaggaccccgggaagctgattgagatggagtgcctggagtgtgagagcgaggccctgcggctggagagcaagatgaaggtgtacaacagagctgctgtggaggcccagctggacatcatccagaggctggatgtggccctgcagagagctgtgcggctgggggaccccagggtcatccacgtggtgtgtgccacccagtggaacacctgcctgcccctgctgcagcacaacctgcggcaccacctgaggaagcccctggccggcgtggctgatgtgctggagaagctggacagcctgatgaccctgctgcgctgccaggtgcacatggagatggcccagattgaagaagatgaagatcggctggagcccgccacagagcacctgaggaaggccgcccggctggacagcctgggcctgtacagagaccgcatccagatggccagcacccggctgcggctgtgcaccaccctgtaccaggcccctgagagagctgaggacaaggccatcatggctgtggagcaggccaagaaggccacccccaaggacagcgtgaggaagaagagggccctgctggtgaatgccggcctggccctggccccagatgccttccagatcgtgctggacagtgaaaatgaggccaaggtgtccacaggcaagaacagaggccgcttcacctacctgtgtgccaaggcctggcaccacacagtgtctgtggacaaggctgctggccacctgcggcggctgggcaatgaaaatgacaaggagcgcatccagatctgggccgagctggccaaggtggccaggaagcagggcgtgtgggatgtgtgcaggacagccagccgcttctgcctgctgtatgacaacgtgaaggtgaagaagctgcggctgcggcggggcaagaagaagagaggaagagatggctctgtgcaggacacctggagccagcctgaggtggtgctgcagaggcaggtgtgcccagacctgctgaggaagtttgctgaggtgggcttcatccatgctgaggccaccgtgcacctgctgcggtctgagggcgtggagctgaatgaccgggccatccccccagaggacctgagccagcaccctgctggctacgtgcctgagcccccagaggtgaatgctgagtggatcacctaccgcacctggattgagagcctgagccgctgtgccatgaacaactggctgcggtctgctgagatcggccaggagatccaggaggcctggatcgtgcagaatgctgtggtgtatgtgctgaaccacaaccaccacctgatcctggccggccggcagaaggagctggtggatgccctgtaccacctgctgagcatcgtgaaggccaccggccacagcggggaccctgtgatgctggtgaccctgtgcaacaccctggcccggggcctcatcatctcctggatccctgtgcaggccgctgagaagagcaggaagttcatgaggcccaatgccttccacagccccctggatgctggggccaccagcgagatcaagacagctgtggaggtgtgtgaatttgccctgaacctgaccaatggaagtgcccctgaggagaccgtgcccaccggcacccggcagcagctgattgccacctgggtgaaggccaagcagctgctgcagcagcagatcggcccccggctgggcacagaggagcagggcaccaatgaagatgtgtcctctgtgaccagggtgctggtggccctggagatgtacagctgcaatggcctgggcctgatggacttcaccgtgcccagcctggcccagctggtgaagatggccagcgagtgcaactggagcgaccccctggtggagctgcagaccctgacccggctgacccactttgcccacgccgcccgggaccacgagaccaccatggcctgtgcccaccgggccctggagatgggcatcaagtacctgaagaagtttggacctgaggagagccggctggtggccgagatgctgtgcacagccacagccatccagggccgcagcatcatggagaacctgaagggcaggaagcagctgcggctggtggccgccaaggccttcacagaaagtgccaggtttggaggcattgctggcagcagcgccctggtgatgctggccgcccggcactactggaatgcctggctgcccctgctgagcagcgctgtgtacaggaagaaggccaagggggccctgaagaggctcatcggcatcatcaacaagacagaggccaggaagcaggagaagggcaagaccctgctgctgcaccagtggcccacagctgacttccagggcggcggcaccacagagggctacttcctgcctggagcagaagatgacctggccctgcgggccgccctgtatggcctgctcttccacagccacgccgaccaggatgactgggagggcggcctgaaggtgctggatgaagctgtgcaggtgctgcccaggacagcccaccggctgctgatcttcaagcacatggtgattgtgaaggccaagctgggccagaacttctccatggagatccagaagttcaaggccgagagcgaggactacctggccaggatgtggcaccggctggccctgaacagccccagcgtgtctggagagctggcctgctacaacaatgccatccaggccctgcagaagccagagatggagtggcagaaggtggagtacctgatggagtttggccagtggctgcaccaccgccacttccccctggaggatgtggtgttccacctgcgctgggccgtggagatcctgctggccatgaagcccccaggagatgtgcctgagccccagcccaccccagatggagaatatgtggccgtggagatgccacccaggagccctgtgtctgaggccgaggaggccgtgtccctggagcagctgcggtctgtgcggcagctggaggccctggcccgggtgcacatcctgctggccctggtgctgagccctggagctgagggctatgaggactgctgcctggccgcctatgccttcttccgccacatctggcaggtgtccctgatgacagctgggaagtctgtgctggagaaccggcccctggccgccaccagcagccacctgctgctgcccaagaaggagaaggaaaatgaaagaagcaaggagaaggagaaggagaggagcaaggagaaggaaaatgaaagaagcaaggagaaggacaaggagaagggcaaggaggagaaggtgaaggagcccaagcagagccagagccctgcccccatcaagcagctggaggacctgcccatgagcattgaggagtgggccagctacagctgcccagaggaggtgctgtctgtgctgaagcaggacagaagtgacagcacagtgaaccccagcagcatccagaagcccacctacagcctgtacttcctggaccacctggtgaaggccctgcagaagatgtgcctgcacgagctgactgtgcctgtgctgcagctgggcgtgctgatcagtgacagcgtggtgggcagcaagggcctgagtgacctgtaccacctgcgctgggtgcagctgctcttccgcagcgtcatcagccccaagcagaacaagaacaagcagcacgtgaaggtgctgatcctgtag

SEQ ID NO: 42740 - DNA, 1218 bp, Artificial Sequence
  Description of Artificial Sequence: Synthetic coding sequence
atggacctggtgatcacccaggagctggcccgggcagagagccagcaggatgctgccagcctgaagaaggcctatgagctgatcaagagcgccaacctgggcaagtcagaatttgaccccagcgagagcttctccccagacctgtttgtgctgtgtgccgagcaggccctgaagatgaggcagcctgaggtgtctgaggactgcatccagatgtacttcaaggtgaaggcccccatcacccagttcctgggccgggcccacctgtgccgggcccagatgtgtgcccccaagtctgctgagaacctggaggagtttgagaactgtgtgacagagtacatgaaggccatcaactttgccaagggggagccccgctactacttcctggtgtacaatgcctctgtgctgtactggcagatggtgcggcccttcctgaagccaggctaccgccaccacctgatccccagcctgagccagatcatcaacgtgctgagccagacagaggaggaggacaaggagtggagggctgagctgatgctggagctgctggagtgctacctgcaggccggcaggaaggaggaggccgcccgcttctgcagcacagctgcccccttcatcaagagccacgtgccccagaagtaccggcagatcttctctgtgatggtgagacatgagctgatggatgagctgcagctgaaggaggagaagaagaacagcatcagcctgtctgtgaccttctacatcaacatgctgaaggccaaggccgagcagaatgacctgcccggggacatcagcgtcatcctgaggaaggcctaccgccacctgggccactacaaccaccagcgcttccccagcatcagcgaggagaagatgctgctgctgtttgagctggcccgcttcagcctgaccctgaagtgcatggagatcagcagcgcctgcctgagtgacctgaagaagatggagagcaaggtgtctggcttcatgaccctgctgcctggagatgaggccctgctgactgtgcagctggacaagaggcagaggaaggaggagcagttcacccggccccggcccccaggcctgcggtctgtggtgggcaccctgcccagcttcctgcctgtgttctgcaccgtggccgtgcgctggtgcctgcagttctacacctgccccttcctgttcaccttcctggtggccaccggcccccagcaccacagctgcttctag

SEQ ID NO: 42741 - DNA, 8148 bp, Artificial Sequence
  Description of Artificial Sequence: Synthetic coding sequence
atggacctggtgatcacccaggagctggcccgggcagagagccagcaggatgctgccagcctgaagaaggcctatgagctgatcaagagcgccaacctgggcaagtcagaatttgaccccagcgagagcttctccccagacctgtttgtgctgtgtgccgagcaggccctgaagatgaggcagcctgaggtgtctgaggactgcatccagatgtacttcaaggtgaaggcccccatcacccagttcctgggccgggcccacctgtgccgggcccagatgtgtgcccccaagtctgctgagaacctggaggagtttgagaactgtgtgacagagtacatgaaggccatcaactttgccaagggggagccccgctactacttcctggtgtacaatgcctctgtgctgtactggcagatggtgcggcccttcctgaagccaggctaccgccaccacctgatccccagcctgagccagatcatcaacgtgctgagccagacagaggaggaggacaaggagtggagggctgagctgatgctggagctgctggagtgctacctgcaggccggcaggaaggaggaggccgcccgcttctgcagcacagctgcccccttcatcaagagccacgtgccccagaagtaccggcagatcttctctgtgatggtgagacatgagctgatggatgagctgcagctgaaggaggagaagaagaacagcatcagcctgtctgtgaccttctacatcaacatgctgaaggccaaggccgagcagaatgacctgcccggggacatcagcgtcatcctgaggaaggcctaccgccacctgggccactacaaccaccagcgcttccccagcatcagcgaggagaagatgctgctgctgtttgagctggcccgcttcagcctgaccctgaagtgcatggagatcagcagcgcctgcctgagtgacctgaagaagatggagagcaaggaccccgggaagctgattgagatggagtgcctggagtgtgagagcgaggccctgcggctggagagcaagatgaaggtgtacaacagagctgctgtggaggcccagctggacatcatccagaggctggatgtggccctgcagagagctgtgcggctgggggaccccagggtcatccacgtggtgtgtgccacccagtggaacacctgcctgcccctgctgcagcacaacctgcggcaccacctgaggaagcccctggccggcgtggctgatgtgctggagaagctggacagcctgatgaccctgctgcgctgccaggtgcacatggagatggcccagattgaagaagatgaagatcggctggagcccgccacagagcacctgaggaaggccgcccggctggacagcctgggcctgtacagagaccgcatccagatggccagcacccggctgcggctgtgcaccaccctgtaccaggcccctgagagagctgaggacaaggccatcatggctgtggagcaggccaagaaggccacccccaaggacagcgtgaggaagaagagggccctgctggtgaatgccggcctggccctggccccagatgccttccagatcgtgctggacagtgaaaatgaggccaaggtgtccacaggcaagaacagaggccgcttcacctacctgtgtgccaaggcctggcaccacacagtgtctgtggacaaggctgctggccacctgcggcggctgggcaatgaaaatgacaaggagcgcatccagatctgggccgagctggccaaggtggccaggaagcagggcgtgtgggatgtgtgcaggacagccagccgcttctgcctgctgtatgacaacgtgaaggtgaagaagctgcggctgcggcggggcaagaagaagagaggaagagatggctctgtgcaggacacctggagccagcctgaggtggtgctgcagaggcaggtgtgcccagacctgctgaggaagtttgctgaggtgggcttcatccatgctgaggccaccgtgcacctgctgcggtctgagggcgtggagctgaatgaccgggccatccccccagaggacctgagccagcaccctgctggctacgtgcctgagcccccagaggtgaatgctgagtggatcacctaccgcacctggattgagagcctgagccgctgtgccatgaacaactggctgcggtctgctgagatcggccaggagatccaggaggcctggatcgtgcagaatgctgtggtgtatgtgctgaaccacaaccaccacctgatcctggccggccggcagaaggagctggtggatgccctgtaccacctgctgagcatcgtgaaggccaccggccacagcggggaccctgtgatgctggtgaccctgtgcaacaccctggcccggggcctcatcatctcctggatccctgtgcaggccgctgagaagagcaggaagttcatgaggcccaatgccttccacagccccctggatgctggggccaccagcgagatcaagacagctgtggaggtgtgtgaatttgccctgaacctgaccaatggaagtgcccctgaggagaccgtgcccaccggcacccggcagcagctgattgccacctgggtgaaggccaagcagctgctgcagcagcagatcggcccccggctgggcacagaggagcagggcaccaatgaagatgtgtcctctgtgaccagggtgctggtggccctggagatgtacagctgcaatggcctgggcctgatggacttcaccgtgcccagcctggcccagctggtgaagatggccagcgagtgcaactggagcgaccccctggtggagctgcagaccctgacccggctgacccactttgcccacgccgcccgggaccacgagaccaccatggcctgtgcccaccgggccctggagatgggcatcaagtacctgaagaagtttggacctgaggagagccggctggtggccgagatgctgtgcacagccacagccatccagggccgcagcatcatggagaacctgaagggcaggaagcagctgcggctggtggccgccaaggccttcacagaaagtgccaggtttggaggcattgctggcagcagcgccctggtgatgctggccgcccggcactactggaatgcctggctgcccctgctgagcagcgctgtgtacaggaagaaggccaagggggccctgaagaggctcatcggcatcatcaacaagacagaggccaggaagcaggagaagggcaagaccctgctgctgcaccagtggcccacagctgacttccagggcggcggcaccacagagggctacttcctgcctggagcagaagatgacctggccctgcgggccgccctgtatggcctgctcttccacagccacgccgaccaggatgactgggagggcggcctgaaggtgctggatgaagctgtgcaggtgctgcccaggacagcccaccggctgctgatcttcaagcacatggtgattgtgaaggccaagctgggccagaacttctccatggagatccagaagttcaaggccgagagcgaggactacctggccaggatgtggcaccggctggccctgaacagccccagcgtgtctggagagctggcctgctacaacaatgccatccaggccctgcagaagccagagatggagtggcagaaggtggagtacctgatggagtttggccagtggctgcaccaccgccacttccccctggaggatgtggtgttccacctgcgctgggccgtggagatcctgctggccatgaagcccccaggagatgtgcctgagccccagcccaccccagatggagaatatgtggccgtggagatgccacccaggagccctgtgtctgaggccgaggaggccgtgtccctggagcagctgcggtctgtgcggcagctggaggccctggcccgggtgcacatcctgctggccctggtgctgagccctggagctgagggctatgaggactgctgcctggccgcctatgccttcttccgccacatctggcaggtgtccctgatgacagctgggaagtctgtgctggagaaccggcccctggccgccaccagcagccacctgctgctgcccaagaaggagaaggaaaatgaaagaagcaaggagaaggagaaggagaggagcaaggagaaggaaaatgaaagaagcaaggagaaggacaaggagaagggcaaggaggagaaggtgaaggagcccaagcagagccagagccctgcccccatcaagcagctggaggacctgcccatgagcattgaggagtgggccagctacagctgcccagaggaggtgctgtctgtgctgaagcaggacagaagtgacagcacagtgaaccccagcagcatccagaagcccacctacagcctgtacttcctggaccacctggtgaaggccctgcagaagatgtgcctgcacgagctgactgtgcctgtgctgcagctgggcgtgctgatcagtgacagcgtggtgggcagcaagggcctgagtgacctgtaccacctgcggctggcccacgcctgcagcgagctgaagctgcgggaggccgccgcccggcatgaggaggccgtgggccaggtgtgtgtgtctgagctggagcaggccagctgcaggaaggagatcgccctgaagaaggagaagaacaaggagcccctgctggaggagagcctgcctgccctgaatgagcagaccctgcctgtgcagcccggggagatcaagcccctggatgccaaggacaagatcctgaagatgaatggagaaacaggccgggacctggatggcaccagcttcccccacctgtggatgctgaaggccgaggtgctgctggagatgaacctgtaccagcctgcccggctgctgctgtctgaggcctacctggccttccaggagctggatgagccctgtgccgaggcccagtgcctgctgctgctggcccagctggccaacaaggagaagaactacggccaggccaagaagatgattgcccaggcccagcacctgggcggcagcgaggagttctggtacaacagcaccctgaccctggccgaggccctgctgtccatggagcacagcggccgggaggccaccgtgtgccacatcttccagaagctgatcaatgccttcaagatcctgaagaaggagcggcccaaccggctgcccctgctggagttcatgatcacagacctggaggcccgctgcctgagcctgcgggtgcgggtggcccagcacagcgctgtgacagagcccacagagtgcagcctgctgctgaaggagatggatgatggcctgctggagattgaaaggaagttcatcgactgtggctgcaaggagaactgtgtggatgtgaagctggagcgggccaagatcaagaggctgcgggcccagaatgagaaggatgaggagcagaagacagcctactacctggaggcctacggcctggcccagggcgctgtggccgaggaggagggccgcctgcacagcatccagggcctgtatggcctggcccagggcgccatggccgaggaggagggccgcctgcacagcgtgcagggcctgctgagcctgcaggacctgcagaatgtgaacacccccctgatgaggaagctggcccggctgaagctgggcctggtggagatggccctggacatgctgcagttcatctgggaggaggcccacggccagcagagcgagcagggcagcctggagaagctgctggccgactacctgcagaacaccagtgactacacctctgtgggcctgcagtggttcaccctgaagaggaccctggcccacggggccctggcccagctgggcagcctgcagcccctgtctgtgggctgtgtggagatccgggcccggctgctgggcctggccggccgggccctgcacctgctggccatgcaggccgaccctgtgcaccccacctgctactgggaggccggccccagcgtgggcgccaagctgagcggcctgaagagcctggagctggaggtggaggaggagggcgccaccaagagcagccgggaccccccagccagccgggccgcccctgaggagcactgcagaagaggagaggacctgaagaggaggatggtgctggcccagcagtacctggcccaggccagcgaggtgctgctgcagtgcctgcaggtggccctgggcagcggcctgctggatgtggccgccgccgccagcctggagatggtggagtgtgtgggcaccctggaccctgccaccacctgccagttcctggccctgagccagagctgcagcgccagcgagaccatgagagatgtgctgctggccgccacagccaacaccagcagcagccagctggccgccctgctgcagctgcagcaccagctgcgctgccaggacaggaccaccaccagcctgggcgcccgggtggagcagaggctggccgctgtgtccaaggcctggcagaacctgtgtgtgacagagcagcacttcaacctgctgaatgagatgccacccaccttctggatcctcttcctgcacctgagcggggacaggagccggctgtatggagctgcctatgagaagcccaagttcatcacagctgccaagggcaaggtgcaggccgtgggcggcagctgcaaggtgatgaggctggccatcagccccacagccttcagccacctgctggcctgtgcccagcagttcaggaagcagacccaggcccaggtgtacagcgaggacatggccctgaacatcggcagcgagcctgagggcctgcaggtggaggagaaggagaggcctgtgcagaggctgagctctgtgctgggccccctggaggagctgctgcagcccctcttccccctgctgagcctgagcaaggcccgggtgcagaccccagctgtggtggccgacagcggcaagagcaagggcaaggacaaggagaggaagaccagcacaggccagcacagcacagtgcagcctgaggtggccgacaagatcgtgctggtggccgacagacacctgctggagctgcccctggagggcctgtctgtgtttgatgagggcaccatcagctctgtgtcccgggagttcagcctgcagatgctgtggaaccggctgcacaaggaggagacagagggcggcgtgaagaaggagggccgcagccgggaccccaagaagaggagcctggccaagaagggcaggaagggcagcatccccaggaccatccccccagactgcatcatcgtggacagcgacaacttcaagtttgtggtggacccctatgaggaggcccagggccctgagatgctgacccctgtgtccatcacccaggacatcctggagcgcttccaggacaccttcaccagccgctgggccggccacctgggcagcaagcacttccccagccaggcccagtgggagcaggccctgggcagctgcagcggcttcttcttctacggcatggagagcttcctgagccacatcctggtggagcggctggtggccatgaacctgcaggagtgccaggtggccgtgctgctggacctggcccggagctaccagagcctgaagaggcacatggagagcgtggagcacagaagatctgtgggccgctgggaggccaactggaggaacagcgccagccccagtgaagatgagtggaggagaggaggagagccccggcggggcttcagtgacctggagggccaggccgctgctgcccccaagctgcgggcccccagccaccacgcccagctgggccctgtgtgggccgccgcccccagccaccgggtggtgcaggcctggacctgcctgcccagcgctgctggggccccagccctggccagcgccctgggcagcgcccccctgcccacccacccccacctgcctgcccccatccccagcagccagctggccctgcccttcctgggcctgagccctgccctgggcgccgccagcgcccgggaccccccaccagccaccagcaggaaggccgccgcctggaccagcagcagcgcctgcctgtgtgccccctggggcctgcggcggggctggagctgtgtgagcagccggggccaggacaagggcggcctgcccctggccgccctggtgctgagctgcctggaccagaagaccatccagacagtgtccctcttcctgatctag

SEQ ID NO: 42742 - DNA, 1563 bp, Artificial Sequence
  Description of Artificial Sequence: Synthetic coding sequence
atgatgaagtactatgacctggccaagttcaccatctaccagattgctgagatggacaagggcctgtctgagctgagccccatgcagcaggccctgatctacagcttctgtgagaaccacgacaaggccatcgaggtgctggatggcatctcctggaacagagctgagatgaccatgtgtgccctgctggccaaggtgcagatgaaggccaagaggaccaaggaggccgtggaggtgctgaagaaggccctggatgccatcagccacagcgacaagggcccagatgccacagccatctctgctgactgcctgtacaacctgggcctgtgctacatggaggagggcaacctgcagatgacctacaagctggccatcacagacctgaccacagccatctccatggacaagaacagctacacagccttctacaacagagccctgtgctacaccaagatccgggagctgcagatggccctgacagattatggcatcgtgctgctgctggatgccacagaaacagtgaagctgaacaccttcctgaacagaggcctcatctacgtggagctgggccagtatggctttgccctggaggacttcaagcaggccgccctgatcagcaggaccaacggcagcctgtgccacgccacagccatgtgccaccaccgcatcaatgaatttgaggaggccgtgaacttcttcacctgggccctgaagatcaacccctgcttcctggatgcctacgtgggccggggcaacagctacatggagtatggccatgatgaggccaccaagcaggcccagaaggacttcctgaaggccctgcacatcaacccagcctacatcaaggcccgcatcagctttggctacaacctgcaggcccagggcaagttccagaaggcctggaaccacttcaccatcgccatcgacacagaccccaagaactacctggcctatgagggccgggctgtggtgtgcctgcagatgggcaacaactttgctgccatgcaggacatcaatgctgccatgaagatcagcaccacagctgagttcctgaccaacagaggagtcatccacgagttcatgggccacaagcagaatgccatgaaggactaccaggatgccatcaccctgaaccccaagtacagcctggcctacttcaatgccggcaacatctacttccaccaccggcagttcagccaggccagtgactacttcagcaaggccctgaagtttgatcctgaaaatgaatatgtgctgatgaacagagccatcaccaacaccatcctgaagaagtatgaggaggccaaggaggactttgccaacgtgattgagagctgccccttctgggccgctgtgtacttcaacagagcccacttctactactgcctgaagcagtatgagctggccgaggaggacctgaacaaggccctgagcctgaagcccaatgatgccctggtgtacaacttccgggccaaggtgcggggcaagattggcctcatcgaggaggccatggctgactacaaccaggccctggacctggaggactatgccagcgtcatctag

SEQ ID NO: 42743 - DNA, 1611 bp, Artificial Sequence
  Description of Artificial Sequence: Synthetic coding sequence
atggacaagggcctgtctgagctgagccccatgcagcaggccctgatctacagcttctgtgaaaatcatgacaaggccatcgaggtgctggatggcatctcctggaacagagctgagatgaccatgtgtgccctgctggccaaggtgcagatgaaggccaagaggaccaaggaggccgtggaggtgctgaagaaggccctggatgccatcagccacagcgacaagggcccagatgccacagccatctctgctgactgcctgtacaacctgggcctgtgctacatggaggagggcaacctgcagatggcctttgacagcttcaccaaggctgtgaaggccaacccagactttgctgagagcttctaccagaggggcctgtgcaaggtgaagctgcacaaggacagcagcatcctggacttcaacagagccatcaccctgaaccccaagcactaccaggcctacctgagccgggtggccttctacggcctgaagggccgctacagcaaggccatcctgaactgcaacaaggccatcaagatctacccagagagcgtgcgggcctacctgtaccggggcgtgctgaagtactacaacaagacctacaagctggccatcacagacctgaccacagccatctccatggacaagaacagctacacagccttctacaacagagccctgtgctacaccaagatccgggagctgcagatggccctgacagattatggcatcgtgctgctgctggatgccacagaaacagtgaagctgaacaccttcctgaacagaggcctcatctacgtggagctgggccagtatggctttgccctggaggacttcaagcaggccgccctgatcagcaggaccaacggcagcctgtgccacgccacagccatgtgccaccaccgcatcaatgaatttgaggaggccgtgaacttcttcacctgggccctgaagatcaacccctgcttcctggatgcctacgtgggccggggcaacagctacatggagtatggccatgatgaggccaccaagcaggcccagaaggacttcctgaaggccctgcacatcaacccagcctacatcaaggcccgcatcagctttggctacaacctgcaggcccagggcaagttccagaaggcctggaaccacttcaccatcgccatcgacacagaccccaagaactacctggcctatgagggccgggctgtggtgtgcctgcagatgggcaacaactttgctgccatgcaggacatcaatgctgccatgaagatcagcaccacagctgagttcctgaccaacagaggagtcatccacgagttcatgggccacaagcagaatgccatgaaggactaccaggatgccatcaccctgaaccccaagtacagcctggcctacttcaatgccggcaacatctacttccaccaccggcagttcagccaggaggagagcctgggcctggcctggagcctgagcctggacagcttcctgaggactggaggagccaccttcagcagtggagtgaaccccctgcagaccctgcacaggaggatgagcatcctgagccccctgccccccacctgccccagagatgagatggacttcaccagctag

SEQ ID NO: 42744 - DNA, 1563 bp, Artificial Sequence; identical to SEQ ID NO: 42742
  Description of Artificial Sequence: Synthetic coding sequence

SEQ ID NO: 42745 - DNA, 2532 bp, Artificial Sequence
  Description of Artificial Sequence: Synthetic coding sequence
atggccaccaagaaggccggcagccggctggagacagaaattgagcgctgccgctctgagtgccagtgggagcgcatccctgagctggtgaagcagctgagcgccaagctgattgccaatgatgacatggccgagctgctgctgggggagagcaagctggagcagtacctgaaggagcaccccctgcggcagggcgccagcccccggggccccaagccccagctgacagaggtgaggaagcacctgacagctgccctggaccggggcaacctgaagtctgagttcctgcaggagagcaacctgatcatggccaagctgaactacgtggagggggactacaaggaggccctgaacatctatgcccgggtgggcctggatgacctgcccctgacagctgtgcccccctaccgcctgcgggtgattgctgaggcctatgccaccaagggcctgtgcctggagaagctgcccatcagcagcagcaccagcaacctgcacgtggaccgggagcaggatgtgatcacctgctatgagaaggccggggacatcgccctgctgtacctgcaggagattgaaagagtcatcctgagcaacatccagaacagaagccccaagccaggccctgcccctcatgaccaggagctgggcttcttcctggagaccggcctgcagagggcccacgtgctgtacttcaagaatggaaacctgacccggggcgtgggccgcttccgggagctgctgcgggctgtggagaccaggaccacccagaacctgaggatgaccatcgcccggcagctggccgagatcctgctgcggggcatgtgtgagcagagctactggaaccccctggaggaccccccctgccagagccccctggatgaccccctgaggaaaggagccaacaccaagacctacaccctgacccggcgggcccgggtgtacagcggggagaacatcttctgcccccaggagaacacagaggaggccctgctgctgctgctgatcagcgagagcatggccaacagagatgctgtgctgagccgcatccctgagcacaagagtgacaggctcatcagcctgcagagcgcctctgtggtgtatgacctgctgaccatcgccctgggcagaagaggccagtatgagatgctgtctgagtgcctggagcgggccatgaagtttgcctttgaggagttccacctgtggtaccagtttgccctgagcctgatggccgccggcaagagcgcccgggctgtgaaggtgctgaaggagtgcatccggctgaagccagatgatgccaccatccccctgctggccgccaagctgtgcatgggcagcctgcactggctggaggaggccgagaagtttgccaagacagtggtggatgtgggggagaagaccagcgagttcaaggccaagggctacctggccctgggcctgacctacagcctgcaggccacagatgccagcctgcggggcatgcaggaggtgctgcagaggaaggccctgctggccttccagagggcccacagcctgagccccacagaccaccaggccgccttctacctggccctgcagctggccatcagccggcagatccctgaggccctgggctacgtgcggcaggccctgcagctgcagggagatgatgccaacagcctgcacctgctggccctgctgctgagcgcccagaagcactaccatgatgccctgaacatcatcgacatggccctgtctgagtacccagagaacttcatcctgctcttcagcaaggtgaagctgcagagcctgtgccggggcccagatgaggccctgctgacctgcaagcacatgctgcagatctggaagagctgctacaacctgaccaaccccagcgacagcggccggggcagcagcctgctggacaggaccatcgctgaccggcggcagctgaacaccatcaccctgcctgacttcagtgaccctgagactggatctgtgcacgccacctctgtggccgccagccgggtggagcaggccctgtctgaggtggccagcagcctgcagagcagcgcccccaagcagggccccctgcacccctggatgaccctggcccagatctggctgcacgccgctgaggtgtacatcggcatcggcaagccagctgaggccacagcctgcacccaggaggccgccaacctcttccccatgagccacaacgtgctgtacatgaggggccagattgctgagctgcggggctccatggatgaggcccggcgctggtatgaggaggccctggccatcagccccacccacgtgaagtccatgcagaggctggccctgatcctgcaccagctgggccgctacagcctggccgagaagatcctgagagatgctgtgcaggtgaacagcacagcccacgaggtgtggaatggcctgggggaggtgctgcaggcccagggcaatgatgctgctgccacagagtgcttcctgacagccctggagctggaggccagcagccctgctgtgcccttcaccatcatcccccgggtgctgtag

SEQ ID NO: 42746 - DNA, 2583 bp, Artificial Sequence
  Description of Artificial Sequence: Synthetic coding sequence
atggccaccaagaaggccggcagccggctggagacagaaattgagcgctgccgctctgagtgccagtgggagcgcatccctgagctggtgaagcagctgagcgccaagctgattgccaatgatgacatggccgagctgctgctgggggagagcaagctggagcagtacctgaaggagcaccccctgcggcagggcgccagcccccggggccccaagccccagctgacagaggtgaggaagcacctgacagctgccctggaccggggcaacctgaagtctgagttcctgcaggagagcaacctgatcatggccaagctgaactacgtggagggggactacaaggaggccctgaacatctatgcccgggtgggcctggatgacctgcccctgacagctgtgcccccctaccgcctgcgggtgattgctgaggcctatgccaccaagggcctgtgcctggagaagctgcccatcagcagcagcaccagcaacctgcacgtggaccgggagcaggatgtgatcacctgctatgagaaggccggggacatcgccctgctgtacctgcaggagattgaaagagtcatcctgagcaacatccagaacagaagccccaagccaggccctgcccctcatgaccaggagctgggcttcttcctggagaccggcctgcagagggcccacgtgctgtacttcaagaatggaaacctgacccggggcgtgggccgcttccgggagctgctgcgggctgtggagaccaggaccacccagaacctgaggatgaccatcgcccggcagctggccgagatcctgctgcggggcatgtgtgagcagagctactggaaccccctggaggaccccccctgccagagccccctggatgaccccctgaggaaaggagccaacaccaagacctacaccctgacccggcgggcccgggtgtacagcggggagaacatcttctgcccccaggagaacacagaggaggccctgctgctgctgctgatcagcgagagcatggccaacagagatgctgtgctgagccgcatccctgagcacaagagtgacaggctcatcagcctgcagagcgcctctgtggtgtatgacctgctgaccatcgccctgggcagaagaggccagtatgagatgctgtctgagtgcctggagcgggccatgaagtttgcctttgaggagttccacctgtggtaccagtttgccctgagcctgatggccgccggcaagagcgcccgggctgtgaaggtgctgaaggagtgcatccggctgaagccagatgatgccaccatccccctgctggccgccaagctgtgcatgggcagcctgcactggctggaggaggccgagaagtttgccaagacagtggtggatgtgggggagaagaccagcgagttcaaggccaagggctacctggccctgggcctgacctacagcctgcaggccacagatgccagcctgcggggcatgcaggaggtgctgcagaggaaggccctgctggccttccagagggcccacagcctgagccccacagaccaccaggccgccttctacctggccctgcagctggccatcagccggcagatccctgaggccctgggctacgtgcggcaggccctgcagctgcagggagatgatgccaacagcctgcacctgctggccctgctgctgagcgcccagaagcactaccatgatgccctgaacatcatcgacatggccctgtctgagtacccagagaacttcatcctgctcttcagcaaggtgaagctgcagagcctgtgccggggcccagatgaggccctgctgacctgcaagcacatgctgcagatctggaagagctgctacaacctgaccaaccccagcgacagcggccggggcagcagcctgctggacaggaccatcgctgaccggcggcagctgaacaccatcaccctgcctgacttcagtgaccctgagactggaaacagccctgaggcctacttccacggcttccccagcctcttctctgtgtcctctgtgcacgccacctctgtggccgccagccgggtggagcaggccctgtctgaggtggccagcagcctgcagagcagcgcccccaagcagggccccctgcacccctggatgaccctggcccagatctggctgcatgctgctgaggtgtacatcggcatcggcaagccagctgaggccacagcctgcacccaggaggccgccaacctcttccccatgagccacaacgtgctgtacatgaggggccagattgctgagctgcggggctccatggatgaggcccggcgctggtatgaggaggccctggccatcagccccacccacgtgaagtccatgcagaggctggccctgatcctgcaccagctgggccgctacagcctggccgagaagatcctgagagatgctgtgcaggtgaacagcacagcccacgaggtgtggaatggcctgggggaggtgctgcaggcccagggcaatgatgctgctgccacagagtgcttcctgacagccctggagctggaggccagcagccctgctgtgcccttcaccatcatcccccgggtgctgtag

SEQ ID NO: 42747 - DNA, 1257 bp, Artificial Sequence
  Description of Artificial Sequence: Synthetic coding sequence
atgaccatcgcccggcagctggccgagatcctgctgcggggcatgtgtgagcagagctactggaaccccctggaggaccccccctgccagagccccctggatgaccccctgaggaaaggagccaacaccaagacctacaccctgacccggcgggcccgggtgtacagcggggagaacatcttctgcccccaggagaacacagaggaggccctgctgctgctgctgatcagcgagagcatggccaacagagatgctgtgctgagccgcatccctgagcacaagagtgacaggctcatcagcctgcagagcgcctctgtggtgtatgacctgctgaccatcgccctgggcagaagaggccagtatgagatgctgtctgagtgcctggagcgggccatgaagtttgcctttgaggagttccacctgtggtaccagtttgccctgagcctgatggccgccggcaagagcgcccgggctgtgaaggtgctgaaggagtgcatccggctgaagccagatgatgccaccatccccctgctggccgccaagctgtgcatgggcagcctgcactggctggaggaggccgagaagtttgccaagacagtggtggatgtgggggagaagaccagcgagttcaaggccaagggctacctggccctgggcctgacctacagcctgcaggccacagatgccagcctgcggggcatgcaggaggtgctgcagaggaaggccctgctggccttccagagggcccacagcctgagccccacagaccaccaggccgccttctacctggccctgcagctggccatcagccggcagatccctgaggccctgggctacgtgcggcaggccctgcagctgcagggagatgatgccaacagcctgcacctgctggccctgctgctgagcgcccagaagcactaccatgatgccctgaacatcatcgacatggccctgtctgagtacccagagaacttcatcctgctcttcagcaaggtgaagctgcagagcctgtgccggggcccagatgaggccctgctgacctgcaagcacatgctgcagatctggaagagctgctacaacctgaccaaccccagcgacagcggccggggcagcagcctgctggacaggaccatcgctgaccggcggcagctgaacaccatcaccctgcctgacttcagtgaccctgagactggaaaccagtgctcctggatcgccttcggggagatgctggtggacatgggcatccagtgcatctag

SEQ ID NO: 42748 - DNA, 993 bp, Artificial Sequence
  Description of Artificial Sequence: Synthetic coding sequence
atccctgaggccctgggctacgtgcggcaggccctgcagctgcagggagatgatgccaacagcctgcacctgctggccctgctgctgagcgcccagaagcactaccatgatgccctgaacatcatcgacatggccctgtctgagtacccagagaacttcatcctgctcttcagcaaggtgaagctgcagagcctgtgccggggcccagatgaggccctgctgacctgcaagcacatgctgcagatctggaagagctgctacaacctgaccaaccccagcgacagcggccggggcagcagcctgctggacaggaccatcgctgaccggcggcagctgaacaccatcaccctgcctgacttcagtgaccctgagactggaaacagccctgaggcctacttccacggcttccccagcctcttctctgtgtcctctgtgcacgccacctctgtggccgccagccgggtggagcaggccctgtctgaggtggccagcagcctgcagagcagcgcccccaagcagggccccctgcacccctggatgaccctggcccagatctggctgcatgctgctgaggtgtacatcggcatcggcaagccagctgaggccacagcctgcacccaggaggccgccaacctcttccccatgagccacaacgtgctgtacatgaggggccagattgctgagctgcggggctccatggatgaggcccggcgctggtatgaggaggccctggccatcagccccacccacgtgaagtccatgcagaggctggccctgatcctgcaccagctgggccgctacagcctggccgagaagatcctgagagatgctgtgcaggtgaacagcacagcccacgaggtgtggaatggcctgggggaggtgctgcaggcccagggcaatgatgctgctgccacagagtgcttcctgacagccctggagctggaggccagcagccctgctgtgcccttcaccatcatcccccgggtgctgtag

SEQ ID NO: 42749 - DNA, 720 bp, Artificial Sequence
  Description of Artificial Sequence: Synthetic coding sequence
atgcagagaggagccctgagccctgtgctgatgctgtctgctgcccctgagcccccaccccggcccccaccagccctgagccccccaggcagcggccctggcagcggcagcagacatggcagcgcccggcccggccccaccccagagcccagcggcagcctgggcgccgccctggacagcagcctgcgggctgctgtggccttcaaggccgagggccagcgctgctaccgggagaagaagttccgggaggccatcggcaagtaccaccgggccctgctgcagctgaaggccgcccagggcgcccggcccagcggcctgcctgccccagcccctggccccaccagcagccctggccctgcccggctgtctgaggagcagaggcggctggtggagagcacagaggtggagtgctatgacagcctgacagcctgcctgctgcagagcgagctggtgaactatgagcgggtgcgggagtactgcctgaaggtgctggagaagcagcagggcaacttcaaggccacctacagagctggcatcgccttctaccacctgggggactatgcccgggccctgcgctacctgcaggaggcccggagccgggagcccacagacaccaacgtgctgcgctacatccagctgacccagctgaagatgaaccgctgcagcctgcagcgggaggacagcggggccggcagccagaccagagatgtgattggatag

SEQ ID NO: 42750 - DNA, 516 bp, Artificial Sequence
  Description of Artificial Sequence: Synthetic coding sequence
atggagaagaggctgcaggaggcccagctgtacaaggaggagggcaaccagcgctaccgggagggcaagtacagagatgctgtgagccgctaccaccgggccctgctgcagctgcggggcctggaccccagcctgcccagccccctgcccaacctgggcccccagggccctgccctgaccccagagcaggagaacatcctgcacaccacccagacagactgctacaacaacctggccgcctgcctgctgcagatggagcctgtgaactatgaaagagtgcgggagtacagccagaaggtgctggagcggcagcctgacaatgccaaggccctgtaccgggccggcgtggccttcttccacctgcaggactatgaccaggcccggcactacctgctggccgctgtgaaccggcagcccaaggatgccaacgtgcggcgctacctgcagctgacccagagcgagctgagcagctaccacaggaaggagaagcagctgtacctgggcatgtttggatag

SEQ ID NO: 42751 - DNA, 648 bp, Artificial Sequence
  Description of Artificial Sequence: Synthetic coding sequence
atgctgaacaaggaggaggagctggagctgctggaggccctgtggagcttcagcaccagccctgcccacagcctgctgctgcccggccggggcggggccggccccatcgagaggaggaagcctgtgtcccaggccttcagccggccccagcagttcctgagccgggccctgctggagttcttcggcaagagccaccccccaccccacaggctcttcaggaagagcctgaatgtgggcctgcactacagccacatccccttcctgaccacctgcctgcacttcctgaggaagaggctgcagaagggggaggtgggcctgtctgtggagaccagcaagccccaggtgcctgtgggcggcctgagcaggaagaaggtgccccaggagccctgggccaccgtgatggagaagaggctgcaggaggcccagctgtacaaggaggagggcaaccagcgctaccgggagggcaagtacagagatgctgtgagccgctaccaccgggccctgctgcagctgcggggcctggaccccagcctgcccagccccctgcccaacctgggcccccagggccctgccctgaccccagagcaggagaacatcctgcacaccacccagacagactgctacaacaacctggccgtggtgaagtag

SEQ ID NO: 42752 - DNA, 423 bp, Artificial Sequence
  Description of Artificial Sequence: Synthetic coding sequence
atggagaagaggctgcaggaggcccagctgtacaaggaggagggcaaccagcgctaccgggagggcaagtacagagatgctgtgagccgctaccaccgggccctgctgcagctgcggggcctggaccccagcctgcccagccccctgcccaacctgggcccccagggccctgccctgaccccagagcaggagaacatcctgcacaccacccagacagactgctacaacaacctggccgcctgcctgctgcagatggagcctgtgaactatgaaagagtgcgggagtacagccagaaggtgctggagcggcagcctgacaatgccaaggccctgtaccgggccggcgtggccttcttccacctgcaggactatgaccaggcccggcactacctgctggccgctgtgaaccggcagcccaagtag

SEQ ID NO: 42753 - DNA, 516 bp, Artificial Sequence; identical to SEQ ID NO: 42750
  Description of Artificial Sequence: Synthetic coding sequence

SEQ ID NO: 42754 - DNA, 6003 bp, Artificial Sequence
  Description of Artificial Sequence: Synthetic coding sequence
atgttcaggaacagcctgaagatgctgctgactggaggcaagagcagcaggaagaacagaagcagtgatggcggcagcgaggagcccccagaccggcggcagagctctgtggacagccggcagagccgcagcggccagggcggcatcagcacagaaagtgactgtgcctttgagccagactatgctgtgccccccctgcctgtgtctgaaggagatgctgagcaggagctgggccccccacccagcgtggatgaggccgccaacaccctgatgacccggctgggcttcctgctgggggagaaggtgacagaggtgcagcccggggaccagtacagcatggaggtgcaggatgagaaccagaccagcgccatcacccagaggatcagcccctgcagcaccctgaccagcagcacagccagccccccagccagcagcccctgcagcaccctgccccccatcagcaccaatgccacagccaaggactgcagctatggagctgtgaccagccccaccagcaccctggagagccgggacagcggcatcatcgccaccctgaccagctacagtgaaaatgtggagaggaccaagtatgctggggagagcagcaaggagctgggcagcggcggcaacatcaagccctggcagagccagaagagctccatggacagctgcctgtacagagtggatgagaacatgacagccagcacctacagcctgaacaagatccctgagaggaacctggagaccgtgctgagccagagcgtgcagagcatccccctgtacctgatgccccggcccaacagcgtggccgccaccagcagcgcccacctggaggacctggcctacctggatgagcagaggcacacccccctgcggaccagcctgaggatgccccggcagagcatgggcggggcccggacccagcaggacctgcgggtgcgctttgccccctaccggcccccagacatcagcctgaagcccctgctgtttgaggtgcccagcatcaccacagaatctgtgtttgtgggccgggactgggtgttccatgaaattgatgcccagctgcagagcagcaatgcctctgtgaaccagggcgtggtgattgtgggcaacatcggctttgggaagacagccatcatcagccggctggtggccctgagctgccacggcaccaggatgaggcagatcgccagtgacagcccccacgccagccccaagcacgtggatgccaaccgggagctgcccctgacccagcccccatctgcccacagcagcatcaccagcggcagctgccccggcaccccagagatgagaagacggcaggaggaggccatgaggcggctggccagccaggtggtggcctaccactactgccaggccgacaatgcctacacctgcctggtgcctgagtttgtgcacaacgtggccgccctgctgtgccgcagcccccagctgacagcctaccgggagcagctgctgcgggagccccacctgcagagcatgctgagcctgcggagctgtgtgcaggaccccatggccagcttccggcggggcgtgctggagcccctggagaacctgcacaaggagaggaagatcccagatgaggacttcatcatcctgattgatggcctgaatgaagctgagttccacaagccagactatggagacaccatcgtgtccttcctgagcaagatgattggcaagttccccagctggctgaagctgattgtgacagtgaggaccagcctgcaggagatcaccaagctgctgcccttccaccgcatcttcctggaccggctggaggagaatgaggccatcgaccaggacctgcaggcctacatcctgcaccgcatccacagcagcagcgagatccagaacaacatcagcctgaatggcaagatggacaacaccaccttcggcaagctgagcagccacctgaagaccctgagccagggcagctacctgtacctgaagctgacctttgacctgattgagaagggctacctggtgctgaagagcagcagctacaaggtggtgcctgtgtccctgtctgaggtgtacctgctgcagtgcaacatgaagttccccacccagagcagctttgacagagtgatgcccctgctgaatgtggccgtggccagcctgcaccccctgacagatgagcacatcttccaggccatcaatgccggcagcattgagggcaccctggagtgggaggacttccagcagaggatggagaacctgtccatgttcctgatcaagagaagagacatgaccaggatgtttgtgcaccccagcttccgggagtggctgatctggagggaggagggggagaagaccaagttcctgtgtgaccccaggagcggccacaccctgctggccttctggttcagccggcaggagggcaagctgaaccggcagcagaccatcgagctgggccaccacatcctgaaggcccacatcttcaagggcctgagcaagaaggtgggcgtgagcagcagcatcctgcagggcctgtggatctcctacagcacagagggcctgtccatggccctggccagcctgaggaacctgtacacccccaacatcaaggtgtcccggctgctgatcctgggcggggccaacatcaactacagaacagaggtgctgaacaatgcccccatcctgtgtgtgcagagccacctgggctacacagagatggtggccctgctgctggagtttggagccaacgtggatgccagcagcgagagcggcctgacccccctgggctatgctgctgctgctggctacctgagcatcgtggtgctgctgtgcaagaagagggccaaggtggaccacctggacaagaatggccagtgtgccctggtgcacgccgccctgcggggccacctggaggtggtgaagttcctgatccagtgtgactggaccatggccggccagcagcagggcgtcttcaagaagagccacgccatccagcaggccctgattgctgctgcctccatgggctacacagagatcgtgtcctacctgctggacctgcctgagaaggatgaggaggaggtggagcgggcccagatcaacagctttgacagcctgtggggcgagacagccctgacagctgctgctggccggggcaagctggaggtgtgccgcctgctgctggagcagggcgctgctgtggcccagcccaacagaagaggagctgtgcccctcttcagcacagtgcggcagggccactggcagatcgtggacctgctgctgacccatggagcagatgtgaacatggctgacaagcagggccgcacccccctgatgatggccgccagcgagggccacctgggcaccgtggacttcctgctggcccagggcgccagcatcgccctgatggacaaggagggcctgacagccctgtcctgggcctgcctgaagggccacctgtctgtggtgcgcagcctggtggacaatggagctgccacagaccacgccgacaagaatggaagaacacccctggacctggccgccttctatggagatgctgaggtggtgcagttcctggtggaccacggggccatgattgagcacgtggactacagcggcatgaggcccctggacagagctgtgggctgcaggaacacctctgtggtggtgaccctgctgaagaagggggccaagattggctgccagaccctgcccagccggccccggggccctgccacctgggccatggccaccagcaagccagacatcatgatcatcctgctgagcaagctgatggaggagggggacatgttctacaagaagggcaaggtgaaggaggccgcccagcgctaccagtatgccctgaagaagttcccccgggagggctttggagaggacctgaagaccttccgggagctgaaggtgtccctgctgctgaacctgagccgctgcaggaggaagatgaatgactttggcatggccgaggagtttgccaccaaggccctggagctgaagcccaagagctatgaggcctactatgcccgggcccgggccaagaggagcagccggcagtttgctgctgccctggaggacctgaatgaggccatcaagctgtgccccaacaaccgggagatccagaggctgctgctgcgggtggaggaggagtgccggcagatgcagcagccccagcagcccccacctccaccccagccccagcagcagctgcctgaggaggccgagcctgagccccagcacgaggacatctacagcgtgcaggacatctttgaggaggagtacctggagcaggatgtggagaatgtgtccatcggcctgcagacagaggcccggcccagccagggcctgcccgtcatccagagcccccccagcagccccccccaccgggacagcgcctacatcagcagcagccccctgggcagccaccaggtgtttgacttccgcagcagcagctctgtgggcagccccacccggcagacctaccagagcaccagccctgccctgagccccacccaccagaacagccactaccggcccagccccccccacaccagccctgcccaccagggcggcagctaccgcttcagccccccacctgtgggcggccagggcaaggagtaccccagccccccacccagccccctgcggcggggcccccagtaccgggccagccccccagctgagagcatgtctgtgtaccgcagccagagcggcagccctgtgcgctaccagcaggagacctctgtgtcccagctgcccggccggcccaagagccccctgagcaagatggcccagaggccctaccagatgccccagctgcctgtggccgtgccccagcagggcctgcggctgcagcctgccaaggcccagatcgtgcgcagcaaccagcccagccctgctgtgcacagcagcaccgtcatccccaccggggcctacggccaggtggcccacagcatggccagcaagtaccagagcagccagggcgacattggagtgtcccagagccggctggtgtaccagggcagcatcggcggcatcgtgggagatggccggcctgtgcagcacgtgcaggccagcctgtctgctggggccatctgccagcacggcggcctgaccaaggaggacctgccccagaggcccagcagcgcctacagaggaggagtgcgctacagccagaccccccagatcggccgcagccagagcgccagctactaccctgtgtgccacagcaagctggacctggagaggagcagcagccagctgggcagcccagatgtgagccacctgatccggcggcccatctctgtgaaccccaatgagatcaagccccacccccccaccccccggcccctgctgcacagccagagcgtgggcctgcgcttcagccccagcagcaacagcatcagcagcaccagcaacctgacccccaccttccggcccagcagcagcatccagcagatggagatccccctgaagccagcctatgaaagaagctgtgatgagctgagccctgtgagccccacccagggcggctaccccagcgagcccaccaggagcaggaccacccccttcatgggcatcatcgacaagacagcccggacccagcagtacccccacctgcaccagcagaacagaacctgggccgtgtcctctgtggacacagtgctgagccccaccagccctggcaacctgccccagcctgagagcttcagcccccccagcagcatcagcaacatcgccttctacaacaagaccaacaatgcccagaatggccacctgctggaggatgactactacagcccccacggcatgctggccaacggcagcagaggagacctgctggagcgggtgtcccaggccagcagctacccagatgtgaaggtggcccggaccctgcctgtggcccaggcctaccaggacaacctgtaccggcagctgagccgggacagccggcagggccagaccagccccatcaagcccaagaggccctttgtggagagcaatgtgtag

SEQ ID NO: 42755 - DNA, 5973 bp, Artificial Sequence
  Description of Artificial Sequence: Synthetic coding sequence
atgttcaggaacagcctgaagatgctgctgactggaggcaagagcagcaggaagaacagaagcagtgatggcggcagcgaggagcccccagaccggcggcagagctctgtggacagccggcagagccgcagcggccagggcggcatcagcacagaaagtgactgtgcctttgagccagactatgctgtgccccccctgcctgtgtctgaaggagatgctgagcaggagctgggccccccacccagcgtggatgaggccgccaacaccctgatgacccggctgggcttcctgctgggggagaaggtgacagaggtgcagcccggggaccagtacagcatggaggtgcaggatgagaaccagaccagcgccatcacccagaggatcagcccctgcagcaccctgaccagcagcacagccagccccccagccagcagcccctgcagcaccctgccccccatcagcaccaatgccacagccaaggactgcagctatggagctgtgaccagccccaccagcaccctggagagccgggacagcggcatcatcgccaccctgaccagctacagtgaaaatgtggagaggaccaagtatgctggggagagcagcaaggagctgggcagcggcggcaacatcaagccctggcagagccagaagagctccatggacagctgcctgtacagagtggatgagaacatgacagccagcacctacagcctgaacaagatccctgagaggaacctggagaccgtgctgagccagagcgtgcagagcatccccctgtacctgatgccccggcccaacagcgtggccgccaccagcagcgcccacctggaggacctggcctacctggatgagcagaggcacacccccctgcggaccagcctgaggatgccccggcagagcatgggcggggcccggacccagcaggacctgcgggtgcgctttgccccctaccggcccccagacatcagcctgaagcccctgctgtttgaggtgcccagcatcaccacagaatctgtgtttgtgggccgggactgggtgttccatgaaattgatgcccagctgcagagcagcaatgcctctgtgaaccagggcgtggtgattgtgggcaacatcggctttgggaagacagccatcatcagccggctggtggccctgagctgccacggcaccaggatgaggcagatcgccagtgacagcccccacgccagccccaagcacgtggatgccaaccgggagctgcccctgacccagcccccatctgcccacagcagcatcaccagcggcagctgccccggcaccccagagatgagaagacggcaggaggaggccatgaggcggctggccagccaggtggtggcctaccactactgccaggccgacaatgcctacacctgcctggtgcctgagtttgtgcacaacgtggccgccctgctgtgccgcagcccccagctgacagcctaccgggagcagctgctgcgggagccccacctgcagagcatgctgagcctgcggagctgtgtgcaggaccccatggccagcttccggcggggcgtgctggagcccctggagaacctgcacaaggagaggaagatcccagatgaggacttcatcatcctgattgatggcctgaatgaagctgagttccacaagccagactatggagacaccatcgtgtccttcctgagcaagatgattggcaagttccccagctggctgaagctgattgtgacagtgaggaccagcctgcaggagatcaccaagctgctgcccttccaccgcatcttcctggaccggctggaggagaatgaggccatcgaccaggacctgcaggcctacatcctgcaccgcatccacagcagcagcgagatccagaacaacatcagcctgaatggcaagatggacaacaccaccttcggcaagctgagcagccacctgaagaccctgagccagggcagctacctgtacctgaagctgacctttgacctgattgagaagggctacctggtgctgaagagcagcagctacaaggtggtgcctgtgtccctgtctgaggtgtacctgctgcagtgcaacatgaagttccccacccagagcagctttgacagagtgatgcccctgctgaatgtggccgtggccagcctgcaccccctgacagatgagcacatcttccaggccatcaatgccggcagcattgagggcaccctggagtgggaggacttccagcagaggatggagaacctgtccatgttcctgatcaagagaagagacatgaccaggatgtttgtgcaccccagcttccgggagtggctgatctggagggaggagggggagaagaccaagttcctgtgtgaccccaggagcggccacaccctgctggccttctggttcagccggcaggagggcaagctgaaccggcagcagaccatcgagctgggccaccacatcctgaaggcccacatcttcaagggcctgagcaagaaggtgggcgtgagcagcagcatcctgcagggcctgtggatctcctacagcacagagggcctgtccatggccctggccagcctgaggaacctgtacacccccaacatcaaggtgtcccggctgctgatcctgggcggggccaacatcaactacagaacagaggtgctgaacaatgcccccatcctgtgtgtgcagagccacctgggctacacagagatggtggccctgctgctggagtttggagccaacgtggatgccagcagcgagagcggcctgacccccctgggctatgctgctgctgctggctacctgagcatcgtggtgctgctgtgcaagaagagggccaaggtggaccacctggacaagaatggccagtgtgccctggtgcacgccgccctgcggggccacctggaggtggtgaagttcctgatccagtgtgactggaccatggccggccagcagcagggcgtcttcaagaagagccacgccatccagcaggccctgattgctgctgcctccatgggctacacagagatcgtgtcctacctgctggacctgcctgagaaggatgaggaggaggtggagcgggcccagatcaacagctttgacagcctgtggggcgagacagccctgacagctgctgctggccggggcaagctggaggtgtgccgcctgctgctggagcagggcgctgctgtggcccagcccaacagaagaggagctgtgcccctcttcagcacagtgcggcagggccactggcagatcgtggacctgctgctgacccatggagcagatgtgaacatggctgacaagcagggccgcacccccctgatgatggccgccagcgagggccacctgggcaccgtggacttcctgctggcccagggcgccagcatcgccctgatggacaaggagggcctgacagccctgtcctgggcctgcctgaagggccacctgtctgtggtgcgcagcctggtggacaatggagctgccacagaccacgccgacaagaatggaagaacacccctggacctggccgccttctatggagatgctgaggtggtgcagttcctggtggaccacggggccatgattgagcacgtggactacagcggcatgaggcccctggacagagctgtgggctgcaggaacacctctgtggtggtgaccctgctgaagaagggggccaagattggccctgccacctgggccatggccaccagcaagccagacatcatgatcatcctgctgagcaagctgatggaggagggggacatgttctacaagaagggcaaggtgaaggaggccgcccagcgctaccagtatgccctgaagaagttcccccgggagggctttggagaggacctgaagaccttccgggagctgaaggtgtccctgctgctgaacctgagccgctgcaggaggaagatgaatgactttggcatggccgaggagtttgccaccaaggccctggagctgaagcccaagagctatgaggcctactatgcccgggcccgggccaagaggagcagccggcagtttgctgctgccctggaggacctgaatgaggccatcaagctgtgccccaacaaccgggagatccagaggctgctgctgcgggtggaggaggagtgccggcagatgcagcagccccagcagcccccacctccaccccagccccagcagcagctgcctgaggaggccgagcctgagccccagcacgaggacatctacagcgtgcaggacatctttgaggaggagtacctggagcaggatgtggagaatgtgtccatcggcctgcagacagaggcccggcccagccagggcctgcccgtcatccagagcccccccagcagccccccccaccgggacagcgcctacatcagcagcagccccctgggcagccaccaggtgtttgacttccgcagcagcagctctgtgggcagccccacccggcagacctaccagagcaccagccctgccctgagccccacccaccagaacagccactaccggcccagccccccccacaccagccctgcccaccagggcggcagctaccgcttcagccccccacctgtgggcggccagggcaaggagtaccccagccccccacccagccccctgcggcggggcccccagtaccgggccagccccccagctgagagcatgtctgtgtaccgcagccagagcggcagccctgtgcgctaccagcaggagacctctgtgtcccagctgcccggccggcccaagagccccctgagcaagatggcccagaggccctaccagatgccccagctgcctgtggccgtgccccagcagggcctgcggctgcagcctgccaaggcccagatcgtgcgcagcaaccagcccagccctgctgtgcacagcagcaccgtcatccccaccggggcctacggccaggtggcccacagcatggccagcaagtaccagagcagccagggcgacattggagtgtcccagagccggctggtgtaccagggcagcatcggcggcatcgtgggagatggccggcctgtgcagcacgtgcaggccagcctgtctgctggggccatctgccagcacggcggcctgaccaaggaggacctgccccagaggcccagcagcgcctacagaggaggagtgcgctacagccagaccccccagatcggccgcagccagagcgccagctactaccctgtgtgccacagcaagctggacctggagaggagcagcagccagctgggcagcccagatgtgagccacctgatccggcggcccatctctgtgaaccccaatgagatcaagccccacccccccaccccccggcccctgctgcacagccagagcgtgggcctgcgcttcagccccagcagcaacagcatcagcagcaccagcaacctgacccccaccttccggcccagcagcagcatccagcagatggagatccccctgaagccagcctatgaaagaagctgtgatgagctgagccctgtgagccccacccagggcggctaccccagcgagcccaccaggagcaggaccacccccttcatgggcatcatcgacaagacagcccggacccagcagtacccccacctgcaccagcagaacagaacctgggccgtgtcctctgtggacacagtgctgagccccaccagccctggcaacctgccccagcctgagagcttcagcccccccagcagcatcagcaacatcgccttctacaacaagaccaacaatgcccagaatggccacctgctggaggatgactactacagcccccacggcatgctggccaacggcagcagaggagacctgctggagcgggtgtcccaggccagcagctacccagatgtgaaggtggcccggaccctgcctgtggcccaggcctaccaggacaacctgtaccggcagctgagccgggacagccggcagggccagaccagccccatcaagcccaagaggccctttgtggagagcaatgtgtag

SEQ ID NO: 42756 - DNA, 468 bp, Artificial Sequence
  Description of Artificial Sequence: Synthetic coding sequence
atgtctgacagcgacctgggggaggatgagggcctgctgagcctggccggcaagaggaagagaagaggcaacctgcccaaggagagcgtgaagatcctgcgggactggctgtacctgcaccgctacaatgcctaccccagcgagcaggagaagctgagcctgagcggccagaccaacctgtctgtgctgcaggatgagttcctggatgtgatctactggttccggcagatcatcgctgtggtgctgggcgtcatctggggcgtgctgcccctgcggggcttcctgggcattgctggcttctgcctgatcaatgccggcgtgctgtacctgtacttcagcaactacctgcagattgatgaggaggagtatggaggcacctgggagctgaccaaggagggcttcatgaccagctttgccctcttcatggtgatctggatcatcttctacacagccatccactatgactag

SEQ ID NO: 42757 - DNA, 1398 bp, Artificial Sequence
  Description of Artificial Sequence: Synthetic coding sequence
atggagaaccaggagttcctgagcagcagcgcccccagcgaggtgacagatggccaggtgtccacagagatcagcacctgcagcgaggtgttccagaagcccatcgtgctgcgcatcctggacacccaccgggagctggaggagagcgaggaccctgagaagcatgagaaccctgaggagcctgaggaggtgcgggagcaggaccagagagatgaaagtgaagaatgtgatgagccccatgagagctatgagccccacgccccctatgccccccacaagccccgggacagctatgccccctatgagctgcacggcccccacgccgcccccaagctgctgaaggcccgggagccccggcagctgcggcacacccgggagcccaggaagagccgggaggccaaggagacagagctgctgcccagcgctgctgtgatgatcagccccagcctcatcacccgggccccaccccggccccagctgtccttcctgggcgccaaccctgtgtcctgtgactttgtgaggaagtgcttcagcagcaggaagaggacccccaacctgagcaagcccaagaagcagtggggcaccccagacaggaagctgttctggggcaaccaggaccccatccggcctgtgtcccagggcgccctgaaggcccagctgaccaagaggctggagaacctggcccagcccaaggaggtgtcctgccactacgtgcccaacagagcccagtactaccacagctgtggccgggagagcgtcatctgggagatcaccccaccagccctcttccggcagcccagcaagaggatccagaggctgagccagcccaacggcttcaagaggcagtgcctgctgaaccggcccttcagtgacaacagcgcccgggacagcctgcgcatcagtgaccccagcccccgcatcctgcagctgtctgtggccaagggcacagaccccaactaccaccccagcaagaagatgcagaccaagatcagcctgagcaccctgagcgccatcgccaccccccgcatcatcgagctggcccacccccgcatcaagctggagggcctgtgctatgaaaggcagaggtctgagctgcccatccggcctgtgcccccagctgccatgattgccaagcccagccccaggaccatcgccctggccaagagcaagtctgtgcaccaggactacctgcctgacagagatgcccactggcctgtgtcctatgccaccacccacagcaaggccagcccccgcatccaggagctggccaaccccaacaagagggcccctgtgagaattgtgtactatgaccctgatgtgttcaagaccaagccagctgccctgaaggcccagtgcagccagaggatctgggagctgagccagcccctgaccaggtag

SEQ ID NO: 42758 - DNA, 318 bp, Artificial Sequence
  Description of Artificial Sequence: Synthetic coding sequence
atggcccagggcctcatcgaggtggagaggaagttcctgcccggccctggaacagaggagcggctgcaggagctgggcggcaccctggagtacagagtgaccttccgggacacctactatgacaccccagagctgagcctgatgcaggccgaccactggctgcggcggcgggaggacagcggctgggagctgaagtgccctggagctgctggggtgctgggcccccacacagagtacaaggagctgacagctgagcccaccatcgtggcccagctgtgcaaggtgtgcctgcaccggcggcagcaccagcccagctag

SEQ ID NO: 42759 - DNA, 753 bp, Artificial Sequence
  Description of Artificial Sequence: Synthetic coding sequence
tgatatgccctgcccaatgcctcctggtgcagcgacatgctgagcctgtaccaggagttcctggagaagaccaagagcagcggctggatcaagctgcccagcttcaagagcaacagagaccacatccggggcctgaagctgcccagcggcctggccgtgtccagtgacaagggggactgccgcatcttcacccgctgcatccaggtggagggccagggctttgaatatgtgatcttcttccagcccacccagaagaagtctgtgtgcctcttccagcccggcagctacctggagggccccccaggctttgcccatggaggcagcctggccgccatgatggatgagaccttcagcaagacagccttcctggccggggagggcctcttcaccctgagcctgaacatccgcttcaagaacctgatccctgtggacagcctggtggtgatggatgtggagctggacaagattgaggaccagaagctgtacatgagctgcatcgcccacagctcctggaagaagagcctgcccagcaacagccactgtgcctgccggcgggccacagccagccctgcctgcctgctgcccccagccagccctgcctgcctgctgcccccagccagccctgcctgcctgctgccccccctgcctgccagctgcctgctgccccccctgcctgccagctgcctgctgccccccctgcctgcctgggaccccagcaagagccgggagggcagcagcagcagcaactggtag

SEQ ID NO: 42760 - DNA, 402 bp, Artificial Sequence
  Description of Artificial Sequence: Synthetic coding sequence
atgagggacctgtctgaaagaaggctgggccagcctgagctgaaggccgagcagcagatgcccctggagcctgtgcgggcccggctgtctgtgggcctggcctgctgctgcagccacaccacagctgaggccagcagcctggagcacggggacaaggtgtttggccagggcttccccagccccctggaggagatcaagaggctgctgaagatcagccgggccctgcaggcccggtctgtgcccagcacccaggagaaggccaagtgcctgtctggagagcccggccagcctgagggcaagggccaggagacctacccaggccctgggaaggtggagggcaaggccgagcccgccatgaggaaggatgatgtgtgccccggcatgaagtgcatcagcggctag

SEQ ID NO: 42761 - DNA, 402 bp, Artificial Sequence; identical to SEQ ID NO: 42760
  Description of Artificial Sequence: Synthetic coding sequence

SEQ ID NO: 42762 - DNA, 1551 bp, Artificial Sequence
  Description of Artificial Sequence: Synthetic coding sequence
atgcccagcagcaccagcccagaccagggagatgacctggagaactgcatcctgcgcttcagtgacctggacctgaaggacatgagcctcatcaaccccagcagcagcctgaaggccgagctggatggcagcaccaagaagaagtacagctttgccaagaagaaggcctttgccctgtttgtgaagaccaaggaggtgcccaccaagaggagctttgagtgcaaggagaagctgtggaagtgctgccggcagctgttcacagaccagaccagcatccacagacatgtggccacccagcacgcagatgagatctaccaccagacagccagcatcctgaagcagctggccgtgaccctgagcaccagcaagagcctgagcagcgcagatgagaagaaccccctgaaggagtgcctgccccacagccatgatgtgtctgcctggctgcctgacatcagctgcttcaacccagatgagctgatcagcggccagggcagcgaggagggggaggtgctgctgtactactgctaccatgacctggaggacccccagtggatctgtgcctggcagacagccctgtgccagcacctgcacctgaccgggaagatcagaattgctgctgagggcatcaatggcaccgtgggcggcagcaagctggccacccggctgtatgtggaggtgatgctgtccttccccctcttcaaggatgacctgtgcaaggatgacttcaagaccagcaagggcggggcccactgcttccctgagctgcgggtgggcgtgtttgaggagatcgtgcccatgggcatcagccccaagaagatctcctacaagaagccaggcatccacctgagccctggagagttccacaaggaggtggagaagttcctgagccaggccaaccaggagcagagcgacaccatcctgctggactgcaggaacttctatgagagcaagattggccgcttccagggctgcctggccccagacatcaggaagttctcctacttccccagctatgtggacaagaacctggagctgttccgggagaagagggtgctgatgtactgcaccggcggcatccgctgtgagcggggcagcgcctacctgaaggccaagggcgtgtgcaaggaggtgttccagctgaagggcggcatccacaagtacctggaggagttcccagatggcttctacaagggcaagctgtttgtgtttgatgaaagatatgccctgagctacaacagtgatgtggtgtctgagtgcagctactgtggggcccgctgggaccagtacaagctgtgcagcaccccccagtgccggcagctggtgctgacctgcccagcctgccagggccagggcttcaccgcctgctgcgtgacctgccaggacaagggcagcaggaaggtgtctggccccatgcaggacagcttcaaggaggagtgtgagtgcacagcccggcggccccgcatcccccgggagctgctgcagcacgtgcggcagcctgtgtccccagagcccggcccagatgctgatgaagatggccctgtgctgatgtag

SEQ ID NO: 42763 - DNA, 504 bp, Artificial Sequence
  Description of Artificial Sequence: Synthetic coding sequence
atggacctgtgcctggccgacagctctgtgtctgccccagccccccaccggcagggcatccacctgagccctggagagttccacaaggaggtggagaagttcctgagccaggccaaccaggagcagagcgacaccatcctgctggactgcaggaacttctatgagagcaagattggccgcttccagggctgcctggccccagacatcaggaagttctcctacttccccagctatgtggacaagaacctggagctgttccgggagaagagggtgctgatgtactgcaccggcggcatccgctgtgagcggggcagcgcctacctgaaggccaagggcgtgtgcaaggaggtgttccagctgaagggcggcatccacaagtacctggaggagttcccagatggcttctacaagggcaagctgtttgtgtttgatgaaagatatgccctgagctacaacagtgatgtggtgtctggccgcagcgcccaggcccagagccccaactag

SEQ ID NO: 42764 - DNA, 219 bp, Artificial Sequence
  Description of Artificial Sequence: Synthetic coding sequence
atgctgtccttccccctcttcaaggatgacctgtgcaaggatgacttcaagaccagcaagggcggggcccactgcttccctgagctgcgggtgggcgtgtttgaggagatcgtgcccatgggcatcagccccaagaagatctcctacaagaagccaggcatgctggccttccggcggctgtgcttcaacagccagggccagaacctgattgacaagtag

SEQ ID NO: 42765 - DNA, 504 bp, Artificial Sequence; identical to SEQ ID NO: 42763
  Description of Artificial Sequence: Synthetic coding sequence

SEQ ID NO: 42766 - DNA, 648 bp, Artificial Sequence
  Description of Artificial Sequence: Synthetic coding sequence
atgctgtccttccccctcttcaaggatgacctgtgcaaggatgacttcaagaccagcaagggcggggcccactgcttccctgagctgcgggtgggcgtgtttgaggagatcgtgcccatgggcatcagccccaagaagatctcctacaagaagccaggcatccacctgagccctggagagttccacaaggaggtggagaagttcctgagccaggccaaccaggagcagagcgacaccatcctgctggactgcaggaacttctatgagagcaagattggccgcttccagggctgcctggccccagacatcaggaagttctcctacttccccagctatgtggacaagaacctggagctgttccgggagaagagggtgctgatgtactgcaccggcggcatccgctgtgagcggggcagcgcctacctgaaggccaagggcgtgtgcaaggaggtgttccagctgaagggcggcatccacaagtacctggaggagttcccagatggcttctacaagggcaagctgtttgtgtttgatgaaagatatgccctgagctacaacagtgatgtggtgtctgagtgcagctactgtggggcccgctgggaccagtacaagctgtgcagcaccccccagctggacaccctgccctag

SEQ ID NO: 42767 - DNA, 339 bp, Artificial Sequence
  Description of Artificial Sequence: Synthetic coding sequence
atgtatgtgttcatcatgatggccttccccagcagccctgagtgcagctactgtggggcccgctgggaccagtacaagctgtgcagcaccccccagtgccggcagctggtgctgacctgcccagcctgccagggccagggcttcaccgcctgctgcgtgacctgccaggacaagggcagcaggaaggtgtctggccccatgcaggacagcttcaaggaggagtgtgagtgcacagcccggcggccccgcatcccccgggagctgctgcagcacgtgcggcagcctgtgtccccagagcccggcccagatgctgatgaagatggccctgtgctgatgtag

SEQ ID NO: 42768 - DNA, 711 bp, Artificial Sequence
  Description of Artificial Sequence: Synthetic coding sequence
atgtctgaggcccccagggctgagacctttgtgttcctggacctggaggccaccggcctgcccagcgtggagcctgagattgctgagctgagcctgtttgctgtgcacaggagcagcctggagaaccctgagcatgatgagagcggggccctggtgctgccccgggtgctggacaagctgaccctgtgcatgtgcccagagcggcccttcaccgccaaggccagcgagatcaccggcctgagcagcgagggcctggcccgctgcaggaaggccggctttgatggagctgtggtgaggaccctgcaggccttcctgagccggcaggccggccccatctgcctggtggcccacaacggctttgattatgacttccccctgctgtgtgccgagctgcggcggctgggcgcccggctgccccgggacacagtgtgcctggacaccctgcctgccctgcggggcctggaccgggcccacagccacggcacccgggcccggggccggcagggctacagcctgggcagcctcttccaccgctacttccgggcagagcccagcgctgcccacagcgcagaaggagatgtgcacaccctgctgctgatcttcctgcacagagctgctgagctgctggcctgggcagatgagcaggcccggggctgggcccacatcgagcccatgtacctgcccccagatgaccccagcctggaggcctag

SEQ ID NO: 42769 - DNA, 2232 bp, Artificial Sequence
  Description of Artificial Sequence: Synthetic coding sequence
atgctgcacttcaaccgctgccaccacctgaagaagatcacccagaagtgcttcagcagcatccacgtgaagacagacaagcacgcccagcgcttcctgagcaggacctttgccctggccgagctgaggaagtcctggtacagcacccacagcctggtgggggacaagaacatcatcctgatgggccccccaggggccggcaagaccaccgtgggccgcatcatcggccagaagctgggctgctgcgtgattgatgtggatgatgacatcctggagaagacctggaacatgtctgtgtctgagaagctgcaggatgtgggcaatgagcagttcctggaggaggagggcaaggctgtgctgaacttcagcgccagcggcagcgtcatcagcctgaccggcagcaaccccatgcatgatgcctccatgtggcacctgaagaagaatggcatcatcgtgtacctggatgtgcccctgctggacctgatctgccgcctgaagctgatgaagacagacagaattgtgggccagaacagcggcacctccatgaaggacctgctgaagttccggcggcagtactacaagaagtggtatgatgcccgggtcttctgtgagagcggggccagccctgaggaggtggccgacaaggtgctgaatgccatcaagcgctaccaggatgtggacagcgagaccttcatcagcaccaggcatgtgtggccagaggactgtgagcagaaggtgtctgccaagttcttcagcgaggccgtcatcgagggcctggccagtgatggcggcctgtttgtgcctgccaaggagttccccaagctgagctgtggggagtggaagagcctggtgggcgccacctacgtggagcgggcccagatcctgctggagcgctgcatccaccctgctgacatcccagctgcccggctgggggagatgattgaaacagcctacggggagaactttgcctgcagcaagatcgcccctgtgcgccacctgagcggcaaccagttcatcctggagctgttccacggccccaccggcagcttcaaggacctgagcctgcagctgatgccccacatctttgcccactgcatcccccccagctgcaactacatgatcctggtggccaccagcggggacaccggcagcgctgtgctgaatggcttcagccggctgaacaagaatgacaagcagagaattgctgtggtggccttcttcccagaaaatggagtgtctgacttccagaaggcccagatcatcggcagccagcgggagaatggctgggccgtgggcgtggagagtgactttgacttctgccagacagccatcaagaggatcttcaatgacagcgacttcaccggcttcctgactgtggagtatggcaccatcctgagcagcgccaacagcatcaactggggccgcctgctgccccaggtggtgtaccacgccagcgcctacctggacctggtgtcccagggcttcatcagctttggcagccctgtggatgtgtgcatccccaccggcaactttggaaacatcctggccgctgtgtatgccaagatgatgggcatccccatcaggaagttcatctgtgccagcaaccagaaccacgtgctgacagacttcatcaagacaggccactatgacctgcgggagaggaagctggcccagaccttcagccccagcattgacatcctgaagagcagcaacctggagcggcacctgcacctgatggccaacaaggatggccagctgatgacagagctgttcaaccggctggagagccagcaccacttccagatcgagaaggccctggtggagaagctgcagcaggactttgtggccgactggtgcagtgaaggagaatgtctggccgccatcaacagcacctacaacaccagcggctacatcctggacccccacacagctgtggccaaggtggtggccgacagagtgcaggacaagacctgccctgtgatcatcagcagcacagcccactacagcaagtttgccccagccatcatgcaggccctgaagatcaaggagatcaatgagaccagcagcagccagctgtacctgctgggcagctacaatgccctgccccccctgcacgaggccctgctggagaggaccaagcagcaggagaagatggagtaccaggtgtgtgccgctgacatgaatgtgctgaagagccacgtggagcagctggtgcagaaccagttcatctag

SEQ ID NO: 42770 - DNA, 2232 bp, Artificial Sequence; identical to SEQ ID NO: 42769
  Description of Artificial Sequence: Synthetic coding sequence

SEQ ID NO: 42771 - DNA, 2301 bp, Artificial Sequence
  Description of Artificial Sequence: Synthetic coding sequence
atggctgctgaggccctggccgctgaggccgtggccagccggctggagcggcaggaggaggacatccgctggctgtggagcgaggtggagcggctgagagatgagcagctgaatgccccctacagctgccaggccgagggcccctgcctgacccgggaggtggcccagctgcgggcagagaactgtgacctgcggcaccggctgtgcagcctgcggctgtgcctggccgaggagaggagccggcaggccaccctggagagcgctgagctggaggccgcccaggaggccggggcccagcccccacccagccagagccaggacaaggacatgaagaagaagaagatgaaggagagcgaggccgacagcgaggtgaagcaccagcccatcttcatcaaggagcggctgaagctgtttgagatcctgaagaaggaccaccagctgctgctggccatctacggcaagaagggggacaccagcaacatcatcaccgtgcgggtggctgatggccagacagtgcagggcgaggtgtggaagaccaccccctaccaggtggccgctgagatcagccaggagctggccgagagcaccgtcatcgccaaggtgaatggagagctgtgggacctggaccggcccctggagggggacagcagcctggagctgctgacctttgacaatgaggaggcccaggccgtgtactggcacagcagcgcccacatcctgggggaggccatggagctgtactacggcggccacctgtgctacggcccccccattgaaaatggcttctactatgacatgtttattgaagatagagctgtgagcagcacagagctgagcgccctggagaacatctgcaaggccatcatcaaggagaagcagccctttgagcggctggaggtgtccaaggagatcctgctggagatgttcaagtacaacaagttcaagtgccgcatcctgaatgagaaggtgaacacagccaccaccaccgtgtaccgctgtggccccctgattgacctgtgcaagggcccccacgtgcgccacacaggcaagatcaagaccatcaagatcttcaagaacagcagcacctactgggagggcaaccctgagatggagaccctgcagaggatctacggcatctccttcccagacaacaagatgatgagggactgggagaagttccaggaggaggccaagaacagagaccacaggaagattggcaaggagcaggagctgttcttcttccatgacctgagccctggcagctgcttcttcctgcccaggggggccttcatctacaacaccctgacagacttcatccgggaggagtaccacaagagggacttcacagaggtgctgagccccaacatgtacaacagcaagctgtgggaggccagcggccactggcagcactacagcgagaacatgttcacctttgaaattgagaaggacacctttgccctgaagcccatgaactgccccggccactgcctgatgtttgcccaccggcccaggtcctggagggagatgcccatccgctttgctgactttggagtgctgcacagaaatgagctgagcggcaccctgagcggcctgaccagggtgcggcgcttccagcaggatgatgcccacatcttctgcaccgtggagcagatcgaggaggagatcaagggctgcctgcagttcctgcagagcgtgtacagcaccttcggcttctccttccagctgaacctgagcaccaggcctgagaacttcctgggggagattgagatgtggaatgaggccgagaagcagctgcagaacagcctgatggactttggagagccctggaagatgaaccctggagatggagccttctacggccccaagattgacatcaagatcaaggatgccatcggccgctaccaccagtgtgccaccatccagctggacttccagctgcccatccgcttcaacctgacctacgtgtccaaggatggagatgacaagaagaggcctgtgatcatccaccgggccatcctgggctctgtggagaggatgattgccatcctgtctgaaaattatggaggcaagtggcccttctggctgagcccccggcaggtgatggtgattcctgtgggccccacctgtgagaagtatgccctgcaggtgagcagcgagttctttgaggagggcttcatggctgatgtggacctggaccacagctgcaccctgaacaagaagatcagaaatgcccagctggcccagtacaacttcatcctggaccgcttcctgcccagcgtgtggcaggaggcctggctgtag

SEQ ID NO: 42772 - DNA, 4830 bp, Artificial Sequence
  Description of Artificial Sequence: Synthetic coding sequence
atgttccccaagagcaacctgactgtgacctgctgggtgtggaggtccatgaggaagctgttcctgctgctgagcctgctgctgagccatgctgcccacctggagggcaagaaggacaaccagttcatctggaagccaggcccctggggccgctgcacaggagactgtggccctgggggcgtgcagagcagagctgtgtggtgcttccacgtggatggctggaccagccacctgagcaactgtggggagagcaacagaccacccaaggagaggagctgcttccgggtgtgtgactggcacagcgacctcttccagtgggaggtgtctgactggcaccactgtgtgctggtgccctatgcccggggggaggtgaagcccaggacagcagaatgtgtgacagcccagcacggcctgcagcacaggatggtgcgctgcatccagaagctgaacagaacagtggtggccaatgagatctgtgagcactttgccctgcagcccccaacagagcaggcctgcctgatcccctgcccccgggactgtgtggtgtctgagttcctgccctggagcaactgcagcaagggctgcggcaagaagctgcagcacaggaccagggctgtgattgccccacccctgtttggaggcctgcagtgccccaacctgacagagagccgggcctgtgatgcccccatcagctgccccctgggggaggaggagtacaccttcagcctgaaggtgggcccctggagcaagtgccgcctgccccacctgaaggagatcaaccccagcggccgcacagtgctggacttcaacagcgacagcaatgaaagagtgaccttcaagcaccagagctacaaggcccaccaccacagcaagtcctgggccattgaaattggctaccagacccggcaggtgtcctgcaccaggagtgatggccagaatgccatgctgagcctgtgcctgcaggacagcttccccctgactgtgcagagctgcatcatgcccaaggactgtgagaccagccagtggagctcctggagcccctgcagcaagacctgccgcagcggcagcctgctgcccggcttccgcagccgcagcagaaatgtgaagcacatggccatcggcggcggcaaggagtgcccagagctgctggagaaggaggcctgcatcgtggagggggagctgctgcagcagtgcccccgctacagctggaggaccagcgagtggaaggagtgccaggtgtccctgctgctggagcagcaggacccccactggcacgtgactggacctgtgtgtggcggcggcatccagacccgggaggtgtactgtgcccagagcgtgcctgctgctgctgccctgcgggccaaggaggtgtccaggcctgtggagaaggccctgtgtgtgggccctgcccccctgcccagccagctgtgcaacatcccctgcagcacagactgcatcgtgtcctcctggagcgcctggggcctgtgcatccacgagaactgccacgacccccagggcaagaagggcttccgcacccggcagagacatgtgctgatggagagcacaggccctgctggccactgcccccacctggtggagagcgtgccctgtgaggaccccatgtgctaccgctggctggccagcgagggcatctgcttcccagaccacggcaaatgtggcctgggccaccgcatcctgaaggctgtgtgccagaatgacagaggagaagatgtgtctggcagcctgtgccctgtgcccccacctcctgagaggaagagctgtgagatcccctgcaggatggactgtgtgctgtctgagtggacagagtggagcagctgcagccagagctgcagcaacaagaacagtgatggcaagcagaccaggagcaggaccatcctggccctggccggggagggcggcaagccctgcccccccagccaggccctgcaggagcaccggctgtgcaatgaccacagctgcatgcagctgcactgggagaccagcccctggggcccctgcagcgaggacaccctggtgacagccctgaatgccaccatcggctggaatggagaggccacctgtggggtgggcatccagaccaggagggtcttctgtgtgaagagccacgtgggccaggtgatgaccaagcgctgcccagacagcaccaggcctgagaccgtgcggccctgcttcctgccctgcaagaaggactgcatcgtgacagccttcagcgagtggaccccctgccccaggatgtgccaggccggaaatgccaccgtgaagcagagccgctaccgcatcatcatccaggaggccgccaacggcggccaggagtgcccagacaccctgtatgaggagcgggagtgtgaagatgtgtccctgtgccctgtgtaccgctggaagccccagaagtggagcccctgcatcctggtgcctgagagcgtgtggcagggcatcaccggcagcagcgaggcctgtgggaagggcctgcagaccagggctgtgtcctgcatcagtgatgacaacagatctgctgagatgatggagtgcctgaagcagaccaacggcatgcccctgctggtgcaggagtgcaccgtgccctgccgggaggactgcaccttcaccgcctggagcaagttcaccccctgcagcaccaactgtgaggccaccaagagcagaagacggcagctgaccgggaagagcaggaagaaggagaagtgccaggacagcgacctgtaccccctggtggagacagagctgtgcccctgtgatgagttcatcagccagccctacggcaactggagcgactgcatcctgcctgagggcagaagagagccccaccggggcctgcgggtgcaggccgacagcaaagaatgtggggagggcctgcgcttccgggctgtggcctgcagcgacaagaatggccggcctgtggaccccagcttctgcagcagcagcggctacatccaggagaagtgtgtgatcccctgcccctttgactgcaagctgagtgactggagctcctggggcagctgcagcagcagctgtggcatcggcgtgcgcatccgcagcaagtggctgaaggagaagccctacaatggaggccggccctgccccaagctggacctgaagaaccagaatgcccaggtgcatgaagctgtgccctgctacagcgagtgcaaccagtacagctgggtggtggagcactggagcagctgcaagatcaacaatgagctgcggagcctgcgctgtggcggcggcacccagagcaggaagatccgctgtgtgaacacagcagatggagagggcggcgctgtggacagcaacctgtgcaaccaggatgagatccccccagagacccagagctgcagcctgatgtgccccaatgaatgtgtgatgtctgagtggggcctgtggagcaaatgtccccagagctgtgacccccacaccatgcagaggaggaccaggcacctgctgcggcccagcctgaacagcaggacctgtgccgaggacagccaggtgcagccctgcctgctgaatgaaaactgcttccagttccagtacaacctgacagagtggagcacctgccagctgtctgaaaatgccccctgtggccagggcgtgaggacccggctgctgagctgtgtgtgcagtgatggcaagcctgtgtccatggaccagtgtgagcagcacaacctggagaagccccagaggatgagcatcccctgcctggtggagtgtgtggtgaactgccagctgagcggctggacagcctggacagaatgttcccagacctgtggccacggcggccgcatgagcaggacccgcttcatcatcatgcccacccagggcgagggccggccctgccccacagagctgacccaggagaagacctgccctgtgaccccctgctacagctgggtgctgggcaactggagcgcctgcaagctggagggcggggactgtggggagggcgtgcagatccgcagcctgagctgcatggtgcacagcggcagcatcagccatgctgctggccgggtggaggatgccctgtgtggggagatgcccttccaggacagcatcctgaagcagctgtgcagcgtgccctgccctggggactgccacctgacagagtggagcgagtggagcacctgtgagctgacctgcattgatggccgcagctttgaaacagtgggccggcagagccgcagcaggaccttcatcatccagagctttgagaaccaggacagctgcccccagcaggtgctggagacccggccctgcacaggaggcaagtgctaccactacacctggaaggccagcctgtggaacaacaatgaaagaacagtgtggtgccagaggagtgatggagtgaatgtgactggaggctgcagcccccaggcccggcctgctgccatccggcagtgcatcccagcctgcaggaagcccttctcctactgcacccagggcggcgtgtgtggctgtgagaagggctacacagagatcatgaagagcaatggcttcctggactactgcatgaaggtgcccggcagcgaggacaagaaggcagatgtgaagaacctgagcggcaagaacagacctgtgaacagcaagatccatgacatcttcaagggctggagcctgcagcccctggaccctgatggccgggtgaagatctgggtgtatggagtgtctggaggagccttcctgatcatgatcttcctgatcttcaccagctacctggtgtgcaagaagcccaagccccaccagagcaccccaccccagcagaagcccctgaccctggcctatgatggagacctggacatgtag

SEQ ID NO: 42773 - DNA, 4737 bp, Artificial Sequence
  Description of Artificial Sequence: Synthetic coding sequence
atgcacaacacagcagatgaggtggtgctgtaccacaagctggccggcccctggggccgctgcaccggggactgtggccctggaggagtgcagagcagagctgtgtggtgcttccacgtggatggctggaccagccacctgagcaactgtggggagagcaaccggccccccaaggagaggagctgcttccgggtgtgtgactggcacagcgacctcttccagtgggaggtgtctgactggcaccactgtgtgctggtgccctatgcccggggggaggtgaagcccaggacagcagaatgtgtgacagcccagcacggcctgcagcacaggatggtgcgctgcatccagaagctgaacagaacagtggtggccaatgagatctgtgagcactttgccctgcagcccccaacagagcaggcctgcctgatcccctgcccccgggactgtgtggtgtctgagttcctgccctggagcaactgcagcaagggctgtgggaagaagctgcagcacaggacccgggccgtcatcgccccacccctgtttggaggcctgcagtgccccaacctgacagagagccgggcctgtgatgcccccatcagctgccccctgggggaggaggagtacaccttcagcctgaaggtgggcccctggagcaaatgtcggctgccccacctgaaggagatcaaccccagcggccgcacagtgctggacttcaacagcgacagcaatgaaagagtgaccttcaagcaccagagctacaaggcccaccaccacagcaagtcctgggccatcgagatcggctaccagacccggcaggtgtcctgcaccaggagtgatggccagaatgccatgctgagcctgtgcctgcaggacagcttccccctgactgtgcagagctgcatcatgcccaaggactgtgagaccagccagtggagctcctggagcccctgcagcaagacctgccgcagcggcagcctgctgcccggcttccgcagccgcagcagaaatgtgaagcacatggccatcggcggcggcaaggaatgtcctgagctgctggagaaggaggcctgcatcgtggagggggagctgctgcagcagtgcccccgctacagctggaggaccagcgagtggaaggagtgccaggtgtccctgctgctggagcagcaggacccccactggcacgtgacaggccctgtgtgtggcggcggcatccagacccgggaggtgtactgtgcccagagcgtgcctgctgctgctgccctgcgggccaaggaggtgtccaggcctgtggagaaggccctgtgtgtgggccctgcccccctgcccagccagctgtgcaacatcccctgcagcacagactgcatcgtgtcctcctggagcgcctggggcctgtgcatccacgagaactgccacgacccccagggcaagaagggcttccgcacccggcagagacatgtgctgatggagagcactggacctgctggccactgcccccacctggtggagagcgtgccctgtgaggaccccatgtgctaccgctggctggccagcgagggcatctgcttcccagaccatggaaaatgtggcctgggccaccgcatcctgaaggctgtgtgccagaatgacagaggagaagatgtgtctggcagcctgtgccctgtgcccccacctcctgagaggaagagctgtgagatcccctgcaggatggactgtgtgctgtctgagtggacagagtggagcagctgcagccagagctgcagcaacaagaacagtgatggcaagcagaccaggagcaggaccatcctggccctggccggggagggcggcaagccctgcccccccagccaggccctgcaggagcaccggctgtgcaatgaccacagctgcatgcagctgcactgggagaccagcccctggggcccctgcagcgaggacaccctggtgacagccctgaatgccaccatcggctggaatggagaggccacctgtggggtgggcatccagacccggcgggtcttctgtgtgaagagccacgtgggccaggtgatgaccaagcgctgcccagacagcaccaggcctgagaccgtgcggccctgcttcctgccctgcaagaaggactgcatcgtgacagccttcagcgagtggaccccctgccccaggatgtgccaggccggaaatgccaccgtgaagcagagccgctaccgcatcatcatccaggaggccgccaatggaggccaggagtgcccagacaccctgtatgaggagagagaatgtgaagatgtgtccctgtgccctgtgtaccgctggaagccccagaagtggagcccctgcatcctggtgcctgagagcgtgtggcagggcatcaccggcagcagcgaggcctgtgggaagggcctgcagaccagggctgtgtcctgcatcagtgatgacaacagatctgctgagatgatggagtgcctgaagcagaccaacggcatgcccctgctggtgcaggagtgcaccgtgccctgccgggaggactgcaccttcaccgcctggagcaagttcaccccctgcagcaccaactgtgaggccaccaagagcagaagacggcagctgaccgggaagagcaggaagaaggagaagtgccaggacagcgacctgtaccccctggtggagacagagctgtgcccctgtgatgagttcatcagccagccctacggcaactggagcgactgcatcctgcctgagggccggcgggagccccaccggggcctgcgggtgcaggccgacagcaaagaatgtggggagggcctgcgcttccgggctgtggcctgcagcgacaagaatggccggcctgtggaccccagcttctgcagcagcagcggctacatccaggagaagtgtgtgatcccctgcccctttgactgcaagctgagtgactggagctcctggggcagctgcagcagcagctgtggcattggagtgcgcatccgcagcaagtggctgaaggagaagccctacaacggcggccggccctgccccaagctggacctgaagaaccagaatgcccaggtgcatgaggccgtgccctgctacagcgagtgcaaccagtacagctgggtggtggagcactggagcagctgcaagatcaacaatgagctgcggagcctgcgctgtggcggcggcacccagagcaggaagatccgctgtgtgaacacagcagatggagagggcggcgctgtggacagcaacctgtgcaaccaggatgagatccccccagagacccagagctgcagcctgatgtgccccaatgaatgtgtgatgtctgagtggggcctgtggagcaagtgcccccagagctgtgacccccacaccatgcagaggaggaccaggcacctgctgcggcccagcctgaacagcaggacctgtgccgaggacagccaggtgcagccctgcctgctgaatgaaaactgcttccagttccagtacaacctgacagagtggagcacctgccagctgtctgaaaatgccccctgtggccagggcgtgaggacccggctgctgagctgtgtgtgcagtgatggcaagcctgtgtccatggaccagtgtgagcagcacaacctggagaagccccagaggatgagcatcccctgcctggtggagtgtgtggtgaactgccagctgagcggctggacagcctggacagagtgcagccagacctgtggccatggaggccgcatgagcaggacccgcttcatcatcatgcccacccagggcgagggccggccctgccccacagagctgacccaggagaagacctgccctgtgaccccctgctacagctgggtgctgggcaactggagcgcctgcaagctggagggcggggactgtggggagggcgtgcagatccgcagcctgagctgcatggtgcacagcggcagcatcagccacgccgccggccgggtggaggatgccctgtgtggggagatgcccttccaggacagcatcctgaagcagctgtgcagcgtgccctgccctggggactgccacctgacagagtggagcgagtggagcacctgtgagctgacctgcattgatggccgcagctttgagaccgtgggccggcagagccgcagcaggaccttcatcatccagagctttgagaaccaggacagctgcccccagcaggtgctggagacccggccctgcaccggcggcaagtgctaccactacacctggaaggccagcctgtggaacaacaatgaaagaacagtgtggtgccagaggagtgatggagtgaatgtgactggaggctgcagcccccaggcccggcctgctgccatccggcagtgcatcccagcctgcaggaagcccttctcctactgcacccagggcggcgtgtgtggctgtgagaagggctacacagagatcatgaagagcaatggcttcctggactactgcatgaaggtgcccggcagcgaggacaagaaggcagatgtgaagaacctgagcggcaagaacagacctgtgaacagcaagatccatgacatcttcaagggctggagcctgcagcccctggaccctgatggccgggtgaagatctgggtgtatggagtgtctgggggcgccttcctgatcatgatcttcctgatcttcaccagctacctggtgtgcaagaagcccaagccccaccagagcaccccaccccagcagaagcccctgaccctggcctatgatggagacctggacatgtag

SEQ ID NO: 42774 - DNA, 1002 bp, Artificial Sequence
  Description of Artificial Sequence: Synthetic coding sequence
atggtgcgctgcatccagaagctgaacagaacagtggtggccaatgagatctgtgagcactttgccctgcagcccccaacagagcaggcctgcctgatcccctgcccccgggactgtgtggtgtctgagttcctgccctggagcaactgcagcaagggctgtgggaagaagctgcagcacaggacccgggccgtcatcgccccacccctgtttggaggcctgcagtgccccaacctgacagagagccgggcctgtgatgcccccatcagctgccccctgggggaggaggagtacaccttcagcctgaaggtgggcccctggagcaaatgtcggctgccccacctgaaggagatcaaccccagcggccgcacagtgctggacttcaacagcgacagcaatgaaagagtgaccttcaagcaccagagctacaaggcccaccaccacagcaagtcctgggccatcgagatcggctaccagacccggcaggtgtcctgcaccaggagtgatggccagaatgccatgctgagcctgtgcctgcaggacagcttccccctgactgtgcagagctgcatcatgcccaaggactgtgagaccagccagtggagctcctggagcccctgcagcaagacctgccgcagcggcagcctgctgcccggcttccgcagccgcagcagaaatgtgaagcacatggccatcggcggcggcaaggaatgtcctgagctgctggagaaggaggcctgcatcgtggagggggagctgctgcagcagtgcccccgctacagctggaggaccagcgagtggaaggagtgccagcaggtgtttggcaccatcaccaatgagctgtatggagcctctgtgcagatggccctgatgagccaggaggccgcccccctgcggcctgtgctgctgccctttggaagtgccttccagcctgctgagaacctgagccccaccgtgcaccgggtggagagcgtggtggtgcggcgggccatccagaggtag

SEQ ID NO: 42775 - DNA, 1062 bp, Artificial Sequence
  Description of Artificial Sequence: Synthetic coding sequence
atggccgccccagcccagcagaccacccagcccggcggcggcaagaggaagggcaaggcccagtatgtgctggccaagagggcccggcgctgtgatgctgggggcccccggcagctggagcccggcctgcagggcatcctgatcacctgcaacatgaatgaaagaaaatgtgtggaggaggcctacagcctgctgaatgaatatggagatgacatgtatggccctgagaagttcacagacaaggaccagcagcccagcggctctgaaggagaagatgatgatgctgaggccgccctgaagaaggaggtgggggacatcaaggccagcacagagatgaggctgcggcgcttccagagcgtggagagcggggccaacaacgtggtgttcatccgcaccctgggcatcgagcctgagaagctggtgcaccacatcctgcaggacatgtacaagaccaagaagaagaagaccagggtcatcctgaggatgctgcccatcagcggcacctgcaaggccttcctggaggacatgaagaagtatgcagagaccttcctggagccctggttcaaggcccccaacaagggcaccttccagatcgtgtacaagagcaggaacaacagccacgtgaaccgggaggaggtgatccgggagctggccggcatcgtgtgcaccctgaacagcgagaacaaggtggacctgaccaacccccagtacacagtggtggtggagatcatcaaggctgtgtgctgcctgtctgtggtgaaggactacatgctgttcaggaagtacaacctgcaggaggtggtgaagagccccaaggaccccagccagctgaacagcaagcagggcaatggcaaggaggccaagctggagagcgctgacaagagtgaccagaacaacacagctgagggcaagaacaaccagcaggtgcctgaaaatacagaggagctgggccagaccaagcccaccagcaacccccaggtggtgaatgaaggaggagccaagccagagctggccagccaggccacagagggcagcaagagcaatgaaaatgacttctcctag

SEQ ID NO: 42776 - DNA, 1062 bp, Artificial Sequence; identical to SEQ ID NO: 42775
  Description of Artificial Sequence: Synthetic coding sequence

SEQ ID NO: 42777 - DNA, 1320 bp, Artificial Sequence
  Description of Artificial Sequence: Synthetic coding sequence
atggccgccatgctgcccctgctggacagcggctgcagccgggaggccggccaggaggccggcctgggccgggtgtccctgcaccccttccatgactgcaggcctgccctgggccctggagctgccagaaatgaggccagcaggcctgcccggggcggccgccgcagctaccccaccagccctgtgcgggccggggacagaagaggccggcagcagcagaggagaaatgtgtccctgagcagccagtttgcccacaccatggccgccccagcccagcagaccacccagcccggcggcggcaagaggaagggcaaggcccagtatgtgctggccaagagggcccggcgctgtgatgctgggggcccccggcagctggagcccggcctgcagggcatcctgatcacctgcaacatgaatgaaagaaaatgtgtggaggaggcctacagcctgctgaatgaatatggagatgacatgtatggccctgagaagttcacagacaaggaccagcagcccagcggctctgaaggagaagatgatgatgctgaggccgccctgaagaaggaggtgggggacatcaaggccagcacagagatgaggctgcggcgcttccagagcgtggagagcggggccaacaacgtggtgttcatccgcaccctgggcatcgagcctgagaagctggtgcaccacatcctgcaggacatgtacaagaccaagaagaagaagaccagggtcatcctgaggatgctgcccatcagcggcacctgcaaggccttcctggaggacatgaagaagtatgcagagaccttcctggagccctggttcaaggcccccaacaagggcaccttccagatcgtgtacaagagcaggaacaacagccacgtgaaccgggaggaggtgatccgggagctggccggcatcgtgtgcaccctgaacagcgagaacaaggtggacctgaccaacccccagtacacagtggtggtggagatcatcaaggctgtgtgctgcctgtctgtggtgaaggactacatgctgttcaggaagtacaacctgcaggaggtggtgaagagccccaaggaccccagccagctgaacagcaagcagggcaatggcaaggaggccaagctggagagcgctgacaagagtgaccagaacaacacagctgagggcaagaacaaccagcaggtgcctgaaaatacagaggagctgggccagaccaagcccaccagcaacccccaggtggtgaatgaaggaggagccaagccagagctggccagccaggccacagagggcagcaagagcaatgaaaatgacttctcctag

SEQ ID NO: 42778 - DNA, 1524 bp, Artificial Sequence
  Description of Artificial Sequence: Synthetic coding sequence
atgtgtgacatcgaggaggccaccaaccagctgctggatgtgaacctgcacgagaaccagaagtctgtgcaggtgacagaaagtgacctgggcagcgagagcgagctgctggtgaccatcggggccaccgtgcccaccggctttgagcagacagctgctgatgaggtgcgggagaagctgggcagcagctgcaagatcagccgggaccggggcaagatctactttgtgatctctgtggagagcctggcccaggtgcactgcctgcggtctgtggacaacctgtttgtggtggtgcaggagttccaggactaccagttcaagcagaccaaggaggaggtgctgaaggactttgaggacctggccggcaagctgccctggagcaaccccctgaaggtgtggaagatcaatgccagcttcaagaagaagaaggccaagaggaagaagatcaaccagaacagcagcaaggagaagatcaacaacggccaggaggtgaagattgaccagagaaatgtgaagaaggagttcaccagccacgccctggacagccacatcctggactactatgaaaatcctgccatcaaggaggatgtgtccaccctgattggagatgacctggccagctgcaaggatgaaacagatgagagcagcaaggaggagacagagccccaggtgctgaagttccgggtgacctgcaacagagctggggagaagcactgcttcaccagcaatgaagctgcccgggactttggaggagctgtgcaggactacttcaagtggaaggctgacatgaccaactttgatgtggaggtgctgctgaacatccatgacaatgaagtcatcgtgggcatcgccctgacagaggagagcctgcacagaagaaacatcacccacttcggccccaccaccctgcggagcaccctggcctacggcatgctgcggctgtgtgaccccctgccctatgacatcatcgtggaccccatgtgtggcaccggggccatccccattgaaggagccacagagtggagcgactgcttccacatcgccggggacaacaaccccctggccgtgaacagagctgccaacaacatcgccagcctgctgaccaagagccagatcaaggagggcaagcccagctggggcctgcccattgatgctgtgcagtgggacatctgcaacctgcccctgaggactggatctgtggacatcatcgtgacagacctgccctttgggaagaggatgggcagcaagaagaggaactggaacctgtacccagcctgcctgcgggagatgagccgggtgtgcacccccaccaccggccgggctgtgctgctgacccaggacaccaagtgcttcaccaaggccctgagcggcatgagacatgtgtggaggaaggtggacacagtgtgggtgaatgtgggcggcctgcgggctgctgtgtatgtgctgatccgcaccccccaggcctttgtgcaccccagcgagcaggatggagagcggggcaccctgtggcagtgcaaggagtag

SEQ ID NO: 42779 - DNA, 126 bp, Artificial Sequence
  Description of Artificial Sequence: Synthetic coding sequence
atgtgtgacatcgaggaggccaccaaccagctgctggatgtgaacctgcacgagaaccagaagtctgtgcaggtgacagaaagtgacctgggcagcgagagcgagctgctggtgaccatcggctag

SEQ ID NO: 42780 - DNA, 372 bp, Artificial Sequence
  Description of Artificial Sequence: Synthetic coding sequence
atgtgtgacatcgaggaggccaccaaccagctgctggatgtgaacctgcacgagaaccagaagtctgtgcaggtgacagaaagtgacctgggcagcgagagcgagctgctggtgaccatcggggccaccgtgcccaccggctttgagcagacagctgctgatgaggtgcgggagaagctgggcagcagctgcaagatcagccgggaccggggcaagatctactttgtgatctctgtggagagcctggcccaggtgcactgcctgcggtctgtggacaacctgtttgtggtggtgcaggagttccaggactaccagttcaagcagaccaaggaggaggtgctgaaggactttgaggacctggccggcaagtag

SEQ ID NO: 42781 - DNA, 1524 bp, Artificial Sequence; identical to SEQ ID NO: 42778
  Description of Artificial Sequence: Synthetic coding sequence

SEQ ID NO: 42782 - DNA, 1524 bp, Artificial Sequence; identical to SEQ ID NO: 42778
  Description of Artificial Sequence: Synthetic coding sequence

SEQ ID NO: 42783 - DNA, 1566 bp, Artificial Sequence; identical to SEQ ID NO: 41131
  Description of Artificial Sequence: Synthetic coding sequence

SEQ ID NO: 42784 - DNA, 1152 bp, Artificial Sequence
  Description of Artificial Sequence: Synthetic coding sequence
atgactggaggcaccaacaagaccagcagcagcatcagcgagatcctggacaaggtgcaggaggatgctgaagatgtgctcttcagcctgggcttcggccaggaggaccacaaggacaccagccgcatcccagcccgcttcttcaccacccccagccaggccaagggcatcgacttccagctgttcctgaagagccaggtgcggcgcatcgagatggaggacccctgcctgatgctggccagccgcttcaagcaggtgcagaccctggccgtgacagcagatgccttcttctgcctgtacagctatgtgtccaagacccctgtgcagaagttcacccccagccacatgttctggaactgcaaccaccccacagatgtgcccagcatccgcatcctgagccgggagcctgagccccagagcccccgggaccggctgaggaaggccatcagcaagatgtgcctgtacacctgcccccgggaccggcccccaccaccccacaacacccccaagaggaacagcctggaccaggtggtgctggaggtgatggacaaggtgaaggaggagaagcagttcctgcagcaggacagcgacctgggccagttcagccaggaggaccctgtgcccccagctgagggcaagaagctgcccaccagcccctacccctgtgtgttctgctgtgaggaggagacccagcagaggatgagcacagtgctggcccccagccagaccctggacagcaaccccaaggtgccctgctgcacccacagcctgcccatcgaggacccccagtggagcacagatcctgcccagatccggcgggagctgtgcagcctgcctgccaccaacacagagacccacccagccaaggatgagaccttctggaagaggaagagccgggccaggaagagcctcttccagaagaacctgatgggcaggaaggtgaagagcctggacctgagcatcacccagcagaagtggaagcagagcgtggacaggcctgagctgcggcgcagcctgagccagcagccccaggacacctttgacctggaggaggtgcagagcaacagcgaggaggagcagagccagagccgctggcccagccggcccaggcacccccaccaccaccagacctttgctgggaaggacagctag

SEQ ID NO: 42785 - DNA, 249 bp, Artificial Sequence
  Description of Artificial Sequence: Synthetic coding sequence
atggaggcctctgtgctgagccccacctcctgggagaagaggcgggcctggctgcggcagagcaggaactggcagacccaggtgctggaggaggaggccgctgctgccctgcaggatgtgcctgaccctgagcccagcagcctggatgatgtgttccaggagggcaaccccatcaacaagattgaggactggctgcaggactgtggctacagcgaggagggcttcagcgaggaggccggccagttctag

SEQ ID NO: 42786 - DNA, 147 bp, Artificial Sequence
  Description of Artificial Sequence: Synthetic coding sequence
atggaggcctctgtgctgagccccacctcctgggagaagaggcgggcctggctgcggcagagcaggaactggcagacccaggtgctggaggaggaggccgctgctgccctgcaggatgtgcctgaccctgagcccagcagcctgtag

SEQ ID NO: 42787 - DNA, 138 bp, Artificial Sequence
  Description of Artificial Sequence: Synthetic coding sequence
atgtctgacaagccagacctgtctgaggtggagaagtttgacaggagcaagctgaagaagaccaacacagaggagaagaacaccctgcccagcaaggagaccatccagcaggagaaggaatgtgtgcagaccagctag

SEQ ID NO: 42788 - DNA, 588 bp, Artificial Sequence
  Description of Artificial Sequence: Synthetic coding sequence
atgcccaacttcctgggcctgcaccgggcccggagcttcaccgtgctgtgcttctggagcacagcagatgtgctgaatgccagcggcccccggcggcagtggcaccccctggccagctgcagctcctggagccggccccagagccagggcagcaccccaggagtgctgtgcaagacaggcatgggccgggagcccatccctgagacccagtgccactttgccaacagcatgtgcagcctgcacgtgtctgtgccctactttggaaacagccccaacatcagcaacttcttccgctggagcctggccctgagcccccggcagtggtgtgacctgggcagcctgcagccccccagcccccgcttcaagggcttcagctgcctgagcctgcccagctcctgggactaccgccgggcccccagccctgccaacttctgcatcctggtggagatgggcttccaccacgtgggccaggccgacctggagctgctgaccagcgctgacctgcccaccagcgccagccagagcgctggcatcactggagtgagccaccacgcctggccccagaccctgagcctgctgctgtactag

SEQ ID NO: 42789 - DNA, 795 bp, Artificial Sequence
  Description of Artificial Sequence: Synthetic coding sequence
atggcccccaccggcctgctggtggccggggccagcttcctggccttccggggcctgcactggggcctgcggcggctgcccaccccagagagcgctgcccgggaccgctggcagtggtggaacctgtgtgtgtccctggcccacagcctgctgagcggcaccggggccctgctgggcctgagcctgtacccccagatggctgctgaccccatccacggccacccccgctgggccctggtgctggtggccgtgtctgtgggctacttcctggctgatggagctgacctgctgtggaaccagaccctgggcaagacctgggacctgctgtgccaccacctggtggtggtgtcctgcctgagcacagctgtgctgagcggccactacgtgggcttctccatggtgtccctgctgctggagctgaacagcgcctgcctgcacctgaggaagctgctgctgctgagccggcaggcccccagcctggccttctctgtgacctcctgggccagcctggccaccctggccctcttccggctggtgcccctgggctggatgagcctgtggctgttccggcagcaccaccaggtgcccctggccctggtgaccctgggcggcatcggcctggtgacagtgggcatcatgagcatcatcctgggcatccgcatcctggtgaatgatgtgctgcagagccggccccacccccccagccctggccacgagaagacccggggcaccaggacccggcgggacaatggacctgtgaccagcaacagcagcaccctgagcctgaaggactag

SEQ ID NO: 42790 - DNA, 3561 bp, Artificial Sequence
  Description of Artificial Sequence: Synthetic coding sequence
tgatgtgccgccccagcccccctgaccagcgctgagcgggagctgcagcagatccgcatcaatgaggtgaagacagagatctctgtggagagcaagcaccagaccctgcagggcctggccttccccctgcagcctgaggcccagagggccctgcagcagctgaagcagaagatggtgaactacatccagatgaagctggacctggagcgggagaccatcgagctggtgcacacagagcccacagatgtggcccagctgcccagccgggtgcccagagatgctgcccgctaccacttcttcctgtacaagcacacccatgaaggagaccccctggagagcgtggtgttcatctacagcatgcctggctacaagtgcagcatcaaggagaggatgctgtacagcagctgcaagagccggctgctggacagcgtggagcaggacttccacctggagatcgccaagaagggcttctgccgcagcgccctgcaccccctgagcctgctggtgcaggccatcatgctggccatgaccctggccctgggcaccctgcctgccttcctgccctgtgagctgcagccccacggcctggtgaactgcaactggctgttcctgaagtctgtgccccacttctccatggccgcccccagaggaaatgtgaccagcctgagcctgagcagcaaccgcatccaccacctgcatgacagcgactttgcccacctgcccagcctgcggcacctgaacctgaagtggaactgcccccctgtgggcctgagccccatgcacttcccctgccacatgaccatcgagcccagcaccttcctggccgtgcccaccctggaggagctgaacctgagctacaacaacatcatgacagtgcctgccctgcccaagagcctcatcagcctgagcctgagccacaccaacatcctgatgctggacagcgccagcctggccggcctgcacgccctgcgcttcctgttcatggatggcaactgctactacaagaacccctgccggcaggccctggaggtggcccctggggccctgctgggcctgggcaacctgacccacctgagcctgaagtacaacaacctgactgtggtgcccaggaacctgcccagcagcctggagtacctgctgctgagctacaaccgcatcgtgaagctggcccctgaggacctggccaacctgacagccctgcgggtgctggatgtgggcggcaactgccgccgctgtgaccacgcccccaacccctgcatggagtgccccaggcacttcccccagctgcacccagacaccttcagccacctgagccggctggagggcctggtgctgaaggacagcagcctgtcctggctgaatgcctcctggttccggggcctgggcaacctgcgggtgctggacctgtctgagaacttcctgtacaagtgcatcaccaagaccaaggccttccagggcctgacccagctgaggaagctgaacctgtccttcaactaccagaagagggtgtcctttgcccacctgagcctggcccccagctttggcagcctggtggccctgaaggagctggacatgcacggcatcttcttccgcagcctggatgagaccaccctgcggcccctggcccggctgcccatgctgcagaccctgcggctgcagatgaacttcatcaaccaggcccagctgggcatcttccgggccttccctggcctgcgctacgtggacctgagtgacaaccgcatcagcggggccagcgagctgacagccaccatgggagaggctgatggaggagagaaggtgtggctgcagcccggggacctggccccagcccctgtggacacccccagcagcgaggacttccggcccaactgcagcaccctgaacttcaccctggacctgagcaggaacaacctggtgacagtgcagcctgagatgtttgcccagctgagccacctgcagtgcctgcggctgagccacaactgcatcagccaggccgtgaatggcagccagttcctgcccctgaccggcctgcaggtgctggacctgagccacaacaagctggacctgtaccacgagcacagcttcacagagctgccccggctggaggccctggacctgagctacaacagccagcccttcggcatgcagggcgtgggccacaacttctcctttgtggcccacctgcggaccctgcggcacctgagcctggcccacaacaacatccacagccaggtgtcccagcagctgtgcagcaccagcctgcgggccctggacttctctggaaatgccctgggccacatgtgggccgagggggacctgtacctgcacttcttccagggcctgagcggcctcatctggctggacctgagccagaaccggctgcacaccctgctgccccagaccctgaggaacctgcccaagagcctgcaggtgctgcggctgcgggacaactacctggccttcttcaagtggtggagcctgcacttcctgcccaagctggaggtgctggacctggccggcaaccagctgaaggccctgaccaacggcagcctgcctgctggcacccggctgcggcggctggatgtgtcctgcaacagcatcagctttgtggcccctggcttcttcagcaaggccaaggagctgcgggagctgaacctgagcgccaatgccctgaagacagtggaccacagctggtttggccccctggccagcgccctgcagatcctggatgtgtctgccaaccccctgcactgtgcctgtggggccgccttcatggacttcctgctggaggtgcaggccgctgtgcccggcctgcccagccgggtgaagtgtggcagccctggccagctgcagggcctgagcatctttgcccaggacctgcggctgtgcctggatgaggccctgtcctgggactgctttgccctgagcctgctggccgtggccctgggcctgggcgtgcccatgctgcaccacctgtgtggctgggacctgtggtactgcttccacctgtgcctggcctggctgccctggaggggccggcagagcggcagagatgaagatgccctgccctatgatgcctttgtggtgtttgacaagacccagagcgctgtggccgactgggtgtacaatgagctgcggggccagctggaggagtgccggggccgctgggccctgcggctgtgcctggaggagcgggactggctgcccgggaagaccctgtttgagaacctgtgggcctctgtgtatggcagcaggaagaccctgtttgtgctggcccacacagacagagtgtctggcctgctgcgggccagcttcctgctggcccagcagaggctgctggaggacaggaaggatgtggtggtgctggtgatcctgagcccagatggccgccgcagccgctacgtgcggctgcggcagaggctgtgccggcagagcgtgctgctgtggccccaccagcccagcggccagaggagcttctgggcccagctgggcatggccctgacccgggacaaccaccacttctacaacagaaacttctgccagggccccacagctgagtag

SEQ ID NO: 42791 - DNA, 1113 bp, Artificial Sequence
  Description of Artificial Sequence: Synthetic coding sequence
atggccggggctgagaactggccaggccagcagctggagctggatgaagatgaggccagctgctgccgctggggcgcccagcacgccggggcccgggagctggccgccctgtacagccctgggaagaggctgcaggagtggtgcagcgtcatcctgtgcttcagcctgattgcccacaacctggtgcacctgctgctgctggcccgctgggaggacacccccctggtgatcctgggcgtggtggccggggccctgattgctgacttcctgagcggcctggtgcactggggcgctgacacctggggctctgtggagctgcccatcgtgggcaaggccttcatccggcccttccgggagcaccacatcgaccccacagccatcaccaggcatgacttcatcgagaccaacggggacaactgcctggtgaccctgctgcccctgctgaacatggcctacaagttccgcacccacagccctgaggccctggagcagctgtacccctgggagtgctttgtgttctgcctgatcatcttcggcaccttcaccaaccagatccacaagtggagccacacctacttcggcctgccccgctgggtgaccctgctgcaggactggcacgtgatcctgcccaggaagcaccaccgcatccaccacgtgagcccccatgagacctacttctgcatcaccaccggggtgaaggtgcccaggaacttccggctgctggaggagctggaggagggccagaagggcgtgggagatggcaccgtgtcctggggcctggaggatgatgaggacatgaccctgacccgctggacaggcatgatcatcggcccccccaggaccatctatgagaaccgcatctacagcctgaagattgaatgtggccccaagtacccagaggcccccccatttgtgcgctttgtgaccaagatcaacatgaatggagtgaacagcagcaatggagtggtggacccccgggccatctctgtgctggccaagtggcagaacagctacagcatcaaggtggtgctgcaggagctgcggcggctgatgatgagcaaagaaaacatgaagctgccccagcccccagagggccagtgctacagcaactag

SEQ ID NO: 42792 - DNA, 978 bp, Artificial Sequence
  Description of Artificial Sequence: Synthetic coding sequence
atggcccactttgtgcagggcaccagcaggatgattgctgctgagagcagcacagagcacaaggaatgtgccgagcccagcaccaggaagaacctgatgaacagcctggagcagaagatccgctgcctggagaagcagaggaaggagctgctggaggtgaaccagcagtgggaccagcagttccgctccatgaaggagctgtatgaaaggaaggtggccgagctgaagaccaagctggatgctgctgagcgcttcctgagcacccgggagaaggacccccaccagaggcagaggaaggatgaccggcagagagaagatgaccggcagagggacctgacccgggaccggctgcagcgggaggagaaggagaaggagcggctgaatgaggagctgcacgagctgaaggaggagaacaagctgctgaagggcaagaacaccctggccaacaaggagaaggagcactatgaatgtgagatcaagaggctgaacaaggccctgcaggatgccctgaacatcaagtgcagcttcagcgaggactgcctgaggaagagccgggtggagttctgccacgaggagatgaggacagagatggaggtgctgaagcagcaggtgcagatctatgaggaggacttcaagaaggagaggagtgaccgggagcggctgaaccaggagaaggaggagctgcagcagatcaatgagaccagccagagccagctgaaccggctgaacagccagatcaaggcctgccagatggagaaggagaagctggagaagcagctgaagcagatgtactgccccccctgcaactgtggcctggtgttccacctgcaggacccctgggtgcccactggacctggagctgtgcagaagcagcgggagcaccccccagactaccagtggtacgccctggaccagctgcccccagatgtgcagcacaaggccaacggcctgagctctgtgaagaaggtgcacccctag

SEQ ID NO: 42793 - DNA, 978 bp, Artificial Sequence; identical to SEQ ID NO: 42792
  Description of Artificial Sequence: Synthetic coding sequence

SEQ ID NO: 42794 - DNA, 1110 bp, Artificial Sequence
  Description of Artificial Sequence: Synthetic coding sequence
atgaacaagaatgagaagcatgatgacaagctggtgatgttcaccaaccagagtgaagattctgagcgctgtgagagcatggagctggacaagaagatccaggacctgattgaaagaaatgccagcccccaccccaagcgcttcaccccagaggccatgcccacccacaggaacctgtgcagcctgaagaccccaggcaagacagcctccatggcccactttgtgcagggcaccagcaggatgattgctgctgagagcagcacagagcacaaggaatgtgccgagcccagcaccaggaagaacctgatgaacagcctggagcagaagatccgctgcctggagaagcagaggaaggagctgctggaggtgaaccagcagtgggaccagcagttccgctccatgaaggagctgtatgaaaggaaggtggccgagctgaagaccaagctggatgctgctgagcgcttcctgagcacccgggagaaggacccccaccagaggcagaggaaggatgaccggcagagagaagatgaccggcagagggacctgacccgggaccggctgcagcgggaggagaaggagaaggagcggctgaatgaggagctgcacgagctgaaggaggagaacaagctgctgaagggcaagaacaccctggccaacaaggagaaggagcactatgaatgtgagatcaagaggctgaacaaggccctgcaggatgccctgaacatcaagtgcagcttcagcgaggactgcctgaggaagagccgggtggagttctgccacgaggagatgaggacagagatggaggtgctgaagcagcaggtgcagatctatgaggaggacttcaagaaggagaggagtgaccgggagcggctgaaccaggagaaggaggagctgcagcagatcaatgagaccagccagagccagctgaaccggctgaacagccagatcaaggcctgccagatggagaaggagaagctggagaagcagctgaagcagatgtactgccccccctgcaactgtggcctggtgttccacctgcaggacccctgggtgcccactggacctggagctgtgcagaagcagcgggagcaccctgtgtacccccagtag

SEQ ID NO: 42795 - DNA, 1029 bp, Artificial Sequence
  Description of Artificial Sequence: Synthetic coding sequence
atgtctgaggagagtgacagcctgcggaccagccccagcgtggccagcctgtctgaaaatgagctgcccccacctcctgagcccccaggctacgtgtgcagcctgacagaggacctggtgaccaaggcccgggaggagctgcaggagaagccagagtggaggctgagagatgtgcaggccctgcgggacatggtgaggaaggagtaccccaacctgagcaccagcctggatgatgccttcctgctgcgcttcctgcgggccaggaagtttgattatgaccgggccctgcagctgctggtgaactaccacagctgccgccgctcctggccagaggtgttcaacaacctgaagcccagcgccctgaaggatgtgctggccagcggcttcctgactgtgctgccccacacagacccccggggctgccacgtggtgtgcatccggccagaccgctggatccccagcaactaccccatcacagagaacatccgggccatctacctgaccctggagaagctgatccagagcgaggagacccaggtgaatggaattgtcatcctggccgactacaagggcgtgtccctgagcaaggccagccacttcggccccttcatcgccaagaaggtgattggcatcctgcaggacggcttccccatccgcatcaaggctgtgcacgtggtgaatgagccccgcatcttcaagggcatctttgccatcatcaagcccttcctgaaggagaagatcgccaaccgcttcttcctgcacggcagtgacctgaacagcctgcacaccaacctgcccaggagcatcctgcccaaggagtatggaggaacagctggggagctggacacagccacctggaatgctgtgctgctggcctctgaagatgactttgtgaaggagttctgccagcctgtgcctgcctgtgacagcatcctgggccagaccctgctgcctgagggcctgaccagtgatgcccagtgtgatgacagcctgcgggctgtgaagagccagctgtacagctgctactag

SEQ ID NO: 42796 - DNA, 1029 bp, Artificial Sequence; identical to SEQ ID NO: 42795
  Description of Artificial Sequence: Synthetic coding sequence

SEQ ID NO: 42797 - DNA, 840 bp, Artificial Sequence
  Description of Artificial Sequence: Synthetic coding sequence
atgtctgaggagagtgacagcctgcggaccagccccagcgtggccagcctgtctgaaaatgagctgcccccacctcctgagcccccaggctacgtgtgcagcctgacagaggacctggtgaccaaggcccgggaggagctgcaggagaagccagagtggaggctgagagatgtgcaggccctgcgggacatggtgaggaaggagtaccccaacctgagcaccagcctggatgatgccttcctgctgcgcttcctgcgggccaggaagtttgattatgaccgggccctgcagctgctggtgaactaccacagctgccgccgctcctggccagaggtgttcaacaacctgaagcccagcgccctgaaggatgtgctggccagcggcttcctgactgtgctgccccacacagacccccggggctgccacgtggtgtgcatccggccagaccgctggatccccagcaactaccccatcacagagaacatccgggccatctacctgaccctggagaagctgatccagagcgaggagacccaggacggcttccccatccgcatcaaggctgtgcacgtggtgaatgagccccgcatcttcaagggcatctttgccatcatcaagcccttcctgaaggagaagatcgccaaccgcttcttcctgcacggcagtgacctgaacagcctgcacaccaacctgcccaggagcatcctgcccaaggagtatggaggaacagctggggagctggacacagccacctggaatgctgtgctgctggcctctgaagatgactttgtgaaggagttctgccagcctgtgcctgcctgtgacagcatcctgggctag

SEQ ID NO: 42798 - DNA, 309 bp, Artificial Sequence
  Description of Artificial Sequence: Synthetic coding sequence
atgagggccagcccctgcatcagccagcctgctgcctcctggcacccccggcccagcgccctgcggcccacagctggcagcggccctgacaccaggaccccaggcaccgtggaggatggcagcgccccctgcccagccttccgcagccctgctgtgagcccctgtggggaggagccctgctgcttccagatcagccctgctgaggagaccctggagctgggccgcctggtgtccccaggctgccacaagagcagcgccccccaggagcggcggctggacccccgggcccgctgtgtggtgcacatctag

SEQ ID NO: 42799 - DNA, 375 bp, Artificial Sequence
  Description of Artificial Sequence: Synthetic coding sequence
atgagggccagcccctgcatcagccagcctgctgcctcctggcacccccggcccagcgccctgcggcccacagctggcagcggccctgacaccaggaccccaggcaccgtggaggatggcagcgccccctgcccagccttccgcagccctgctgtgagcccctgtggggaggagccctgctgcttccagatcagccctgctgaggagaccctggagctgggccgcctggtgtccccaggcaactgtgacaccctgagccccagggctgctggcttctacgcctgccacgtgcgcagcctcatcccctgccgcagcaccaagggccgctggcccctgacagccagcgctgctggcctgagcagcttctctggatag

SEQ ID NO: 42800 - DNA, 1131 bp, Artificial Sequence
  Description of Artificial Sequence: Synthetic coding sequence
atggatggagaggagcagcagccccctcatgaggccaacgtggagcctgtggtgcccagcgaggccagcgagcctgtgccccgggtgctgagcggggacccccagaacctgagtgatgtggatgccttcaacctgctgctggagatgaagctgaagagaagacggcagaggcccaacctgcccaggacagtgacccagctggtggccgaggatggcagccgggtgtatgtggtgggcacagcccacttcagtgatgacagcaagagagatgtggtgaagaccatccgggaggtgcagccagatgtggtggtggtggagctgtgccagtacagagtgtccatgctgaagatggatgagagcaccctgctgcgggaggcccaggagctgagcctggagaagctgcagcaggccgtgcggcagaatggcctgatgagcggcctgatgcagatgctgctgctgaaggtgtctgcccacatcacagagcagctgggcatggcccctggaggagagttccgggaggccttcaaggaggccagcaaggtgcccttctgcaagttccacctgggggaccggcccatccctgtgaccttcaagagggccatcgccgccctgtccttctggcagaaggtgcggctggcctggggcctgtgcttcctgagtgaccccatcagcaaggatgatgtggagcgctgcaagcagaaggacctgctggagcagatgatggccgagatgattggagagttcccagacctgcacaggaccatcgtgtctgaaagagatgtgtacctgacctacatgctgcggcaggccgcccggcggctggagctgccccgggccagtgatgctgagcccaggaaatgtgtgcccagcgtggtggtgggcgtggtgggcatgggccacgtgcccggcatcgagaagaactggagcacagacctgaacatccaggagatcatgacagtgcccccacccagcgtgtctggccgggtgtcccggctggccgtgaaggccgccttcttcggcctgctgggctacagcctgtactggatgggcagaagaacagccagcctggtgctgagcctgcctgctgcccagtactgcctgcagagggtgacagaggcccggcacaagtag

SEQ ID NO: 42801 - DNA, 1131 bp, Artificial Sequence; identical to SEQ ID NO: 42800
  Description of Artificial Sequence: Synthetic coding sequence

SEQ ID NO: 42802 - DNA, 1131 bp, Artificial Sequence; identical to SEQ ID NO: 42800
  Description of Artificial Sequence: Synthetic coding sequence

SEQ ID NO: 42803 - DNA, 1554 bp, Artificial Sequence
  Description of Artificial Sequence: Synthetic coding sequence
atgcatgctgccctggccggccccctgctggccgccctgctggccacagcccgggcccggccccagcccccagatggcggccagtgcaggcctcctggcagccagagggacctgaacagcttcctgtggaccatccggcgggaccccccagcctacctgtttggcaccatccacgtgccctacaccagggtgtgggacttcatcccagacaacagcaaggccgccttccaggccagcaccagggtgtactttgagctggacctgacagacccctacaccatcagcgccctggccagctgccagctgctgccccatggagagaacctgcaggatgtgctgccccatgagctgtactggaggctgaagaggcacctggactatgtgaagctgatgatgcccagctggatgaccccagcccagaggggcaagggcctgtatgctgactacctgttcaatgccatcgccggcaactgggagaggaagaggcctgtgtgggtgatgctgatggtgaacagcctgacagaaagagatgtgcgcttccggggcgtgcctgtgctggacctgtacctggcccagcaggccgagaagatgaagaagaccactggagctgtggagcaggtggaggagcagtgccaccccctgaacaacggcctgaacttcagccaggtgctgtttgccctgaaccagaccctgctgcagcaggagagcgtgcgggccggcagcctgcaggccagctacaccacagaagatctcatcaagcactacaactgtggggacctgtctgctgtgatcttcaaccacgacaccagccagctgcccaacttcatcaacaccaccctgccccctcatgagcaggtgacagcccaggagattgacagctacttccggcaggagctgatctacaagagaaatgaaagaatgggcaagagggtgatggccctgctgagagaaaatgaagacaagatctgcttctttgcctttggagctggccacttcctgggcaacaacacagtgattgacatcctgcggcaggccggcctggaggtggaccacaccccagctggccaggccatccacagccctgccccccagagccctgcccccagccctgagggcaccagcaccagccctgcccctgtgaccccagctgctgctgtgcctgaggcccccagcgtgacccccacagcccccccagaagatgaagatcctgccctgagcccccacctgctgctgcctgacagcctgagccagctggaggagtttggccggcagaggaagtggcacaagaggcagagcacccaccagaggccccggcagttcaatgacctgtgggtgagaattgaggacagcaccacagccagccccccacccctgcccctgcagcccacccacagcagcggcacagccaagccacccttccagctgagtgaccagctgcagcagcaggaccccccaggccctgccagcagcagcgcccccaccctgggcctgctgcctgccatcgccaccaccatcgctgtgtgcttcctgctgcacagcctgggccccagctag

SEQ ID NO: 42804 - DNA, 555 bp, Artificial Sequence
  Description of Artificial Sequence: Synthetic coding sequence
atgaccagctttgaagatgctgacacagaggagaccgtgacctgcctgcagatgacagtgtaccaccctggccagctgcagtgtggcatcttccagagcatctccttcaaccgggagaagctgcccagcagcgaggtggtgaagtttggaagaaacagcaacatctgccactacaccttccaggacaagcaggtgtcccgggtgcagttcagcctgcagctgttcaagaagttcaacagctctgtgctgagctttgagatcaagaacatgagcaagaagaccaacctgattgtggacagccgggagctgggctacctgaacaagatggacctgccctaccgctgcatggtgcgctttggagagtaccagttcctgatggagaaggaggatggagagagcctggagttctttgagacccagttcatcctgagccccaggagcctgctgcaggagaacaactggccaccccaccggcccatcccagaatatggcacctacagcctgtgcagcagccagagcagcagccccacagagatggatgaaaatgaaagctag

SEQ ID NO: 42805 - DNA, 255 bp, Artificial Sequence
  Description of Artificial Sequence: Synthetic coding sequence
atgaccagctttgaagatgctgacacagaggagaccgtgacctgcctgcagatgacagtgtaccaccctggccagctgcagtgtggcatcttccagagcatctccttcaaccgggagaagctgcccagcagcgaggtggtgaagtttggaagaaacagcaacatctgccactacaccttccaggacaagcaggtgtcccgggtgcagttcagcctgcagctgttcaagatccagcagctgagcagcctgctgtag

SEQ ID NO: 42806 - DNA, 555 bp, Artificial Sequence; identical to SEQ ID NO: 42804
  Description of Artificial Sequence: Synthetic coding sequence

SEQ ID NO: 42807 - DNA, 552 bp, Artificial Sequence
  Description of Artificial Sequence: Synthetic coding sequence
atggagaagccctacaacaagaatgaaggcaacctggagaatgaaggcaagccagaagatgaggtggagccagatgatgagggcaagagtgatgaggaggagaagccagatgctgagggcaagacagaatgtgagggcaagaggaaggccgagggggagcctggagatgagggccagctggaggacaagggcagccaggagaagcagggcaagtctgagggggagggcaagccccagggcgagggcaagccagccagccaggccaagccagagggccagcccagggctgctgagaagaggcctgctggggactatgtgcccaggaaggccaagaggaagacagaccggggcacagatgacagccccaaggacagccaggaggacctgcaggagcggcacctgagcagcgaggagatgatgagagaatgtggagatgtgtcccgggcccaggaggagctgaggaagaagcagaagatgggcggcttccactggatgcagagagatgtgcaggacccctttgcccagggcgacaacggggtgtctggagagtag

SEQ ID NO: 42808 - DNA, 1641 bp, Artificial Sequence
  Description of Artificial Sequence: Synthetic coding sequence
atggctgctggcagcaccaccctgcgggctgtgggcaagctgcaggtgcggctggccaccaagacagagcccaagaagctggagaagtacctgcagaagctgagcgccctgcccatgacagctgacatcctggccgagaccggcatcaggaagacagtgaagaggctgaggaagcaccagcacgtgggggactttgcccgggacctggccgcccgctggaagaagctggtgctggtggacagaaatactggaccagacccccaggaccctgaggagagcgccagccggcagagatttggagaggccctgcaggagcgggagaaggcctggggcttcccagaaaatgccacagcccccaggagccccagccacagccctgagcacagaagaacagcccggaggaccccacctggccagcagaggccccaccccaggagccccagccgggagcccagggctgagaggaagaggcccaggatggccccagctgacagcggcccccaccgggacccccccaccaggacagcccccctgcccatgcctgagggccctgagcctgctgtgcctggagagcagcccggccggggccacgcccacgccgcccagggcggccccctgctgggccagggctgccagggccagccccagggcgaggccgtgggcagccacagcaagggccacaagagcagcagaggagccagcgcccagaagagcccccctgtgcaggagagccagagcgagcggctgcaggccgctgtggccgacagcgctggccccaagacagtgcccagccacgtgttcagcgagctgtgggaccccagcgaggcctggatgcaggccaactatgacctgctgagcgcctttgaggccatgaccagccaggccaaccctgaggccctgagcgcccccaccctgcaggaggaggccgccttccctggccggcgggtgaatgccaagatgcctgtgtacagcggcagcaggcctgcctgccagctgcaggtgcccaccctgcggcagcagtgcctgcgggtgcccaggaacaacccagatgccctgggagatgtggagggcgtgccctacagcgccctggagcctgtgctggagggctggaccccagaccagccctacagaacagagaaggacaatgctgccctggcccgggagacagatgagctgtggaggatccactgcctgcaggacttcaaggaggagaagccccaggagcacgagagctggagggagctgtacctgcggctgagagatgcccgggagcagaggctgcgggtggtgaccaccaagatccgcagcgcccgggagaacaagcccagcggccggcagaccaagatgatctgcttcaacagcgtggccaagaccccctatgatgccagccggcggcaggagaagtctgctggagctgctgaccctggaaatggagagatggagcccgcccccaagccagctggcagcagccaggcccccagcggcctgggagatggagatggcggctctgtgtctgggggcggcagcagcaacagacatgctgccccagctgacaagaccaggaagcaggccgccaagaaggtggcccccctgatggccaaggccatccgggactacaagggccgcttcagcagaagatag

SEQ ID NO: 42809 - DNA, 1761 bp, Artificial Sequence
  Description of Artificial Sequence: Synthetic coding sequence
atgcaggccggggcccgcttccagaggagaagacggcagctgcagcagcagcagccccggcggcggcagcccctgctgtggcccatggatgctgagcccccacctcctccaccctgggtgtggatggtgcccggcagcgctggcctgctgcggctgtctgctggggtggtggtgccccctgtgctgctggccagcgcccctcctcctgctgcccccctgctgcccggcctgcccggctggccagcccccagcgagcctgtgctgcccctgctgcccctgcccagcgccccagattctgctgctgctgctgctgcccaccccttccctgccctgcacggccagtggctgtttggaggccacagccccagcctgggcctgccccccagcagcacagtggagctggtgcctgtgttcccccacctgtgccccagcgccctggccacccccatcggcaagtcctggattgacaagaggatccccaactgcaagatcttcttcaacaacagctttgccctggacagcacctggatccaccctgaggagagccgcttcttccacggccacgagaagccccggctgctggccaaccaggtggccgtgtccctgagcaggcctgccccagccagccggcccctgcccaccgtggtgctggccccccagcccatccctgggggctgccacaacagcctgaaggtgaccagcagccctgccatcgccatcgccacagctgctgctgctgccatggtgtctgtggaccctgagaacctgcggggccccagccccagctctgtgcagcccaggcacttcctgaccctggcccccatcaagatccccctgcggaccagccctgtgtctgacaccaggacagagcggggccgggtggcccggcccccagccctgatgctgcgggcccagaagagcagagatggagacaaggaggacaaggagcccccacccatgctgggcggcggggaggacagcacagcccggggcaacagacctgtggccagcacccctgtgcccggcagcccctggtgtgtggtgtggacaggagatgacagagtcttcttcttcaaccccaccatgcacctgtctgtgtgggagaagcccatggacctgaaggacagaggagacctgaaccgcatcatcgaggaccccccccacaagaggaagctggaggccccagccacagacaacagtgatggcagcagcagcgaggacaaccgggaggaccaggatgtgaagaccaagaggaacagaacagagggctgcggcagccccaagccagaggaggccaagagagaagataaaggcaccaggaccccaccaccccagatcctgctgcccctggaggagcgggtgacccacttccgggacatgctgctggagcggggcgtgtctgccttcagcacctgggagaaggagctgcacaagatcgtgtttgacccccgctacctgctgctgaacagcgaggagaggaagcagatctttgagcagtttgtgaagacccgcatcaaggaggagtacaaggagaagaagagcaagctgctgctggccaaggaggagttcaagaagctgctggaggagagcaaggtgagccccaggaccaccttcaaggagtttgctgagaagtatggccgggaccagcgcttccggctggtgcagaagaggaaggaccaggagcacttcttcaaccagttcatcctgatcctgaagaagagggacaaggaaaatcggctgcggctgaggaagatgaggtag

SEQ ID NO: 42810 - DNA, 504 bp, Artificial Sequence
  Description of Artificial Sequence: Synthetic coding sequence
atggaccggggccggcctgctggcagccccctgagcgccagcgctgagcccgcccccctggccgccgccatccgggacagcaggcctggccgcacaggccctggccctgctggccctgggggcggcagccgcagcggcagcggccggcctgctgctgccaatgctgcccgggagaggagccgggtgcagaccctgcggcatgccttcctggagctgcagaggaccctgcccagcgtgcccccagacaccaagctgagcaagctggatgtgctgctgctggccaccacctacatcgcccacctgaccaggagcctgcaggatgatgctgaggccccagcagatgctggcctgggcgccctgcggggagatggctacctgcaccctgtgaagaagtggcccatgaggagccggctgtacatcggggccaccggccagttcctgaagcacagcgtgtctggagagaagaccaaccacgacaacacccccacagacagccagccctag

SEQ ID NO: 42811 - DNA, 11580 bp, Artificial Sequence
  Description of Artificial Sequence: Synthetic coding sequence
atggcctttgtggccacccagggcgccaccgtggtggaccagaccaccctgatgaagaagtacctgcagtttgtggccgccctgacagatgtgaacaccccagatgagaccaagctgaagatgatgcaggaggtgtctgaaaattttgaaaatgtgaccagcagcccccagtacagcaccttcctggagcacatcatcccccgcttcctgaccttcctgcaggatggagaggtgcagttcctgcaggagaagccagcccagcagctgaggaagctggtgctggagatcatccaccgcatccccaccaatgagcacctgcggccccacaccaagaatgtgctgtctgtgatgttccgcttcctggagacagaaaatgaagaaaatgtgctgatctgcctgcgcatcatcatcgagctgcacaagcagttccggccccccatcacccaggagatccaccacttcctggactttgtgaagcagatctacaaggagctgcccaaggtggtgaaccgctactttgagaacccccaggtgatcccagaaaatacagtgcccccacctgagatggtgggcatgatcaccaccatcgctgtgaaggtgaaccctgagagagaagattctgagaccaggacccacagcatcatcccccggggcagcctgagcctgaaggtgctggccgagctgcccatcatcgtggtgctgatgtaccagctgtacaagctgaacatccacaacgtggtggccgagtttgtgcccctcatcatgaacaccatcgccatccaggtgtctgcccaggcccggcagcacaagctgtacaacaaggagctgtatgctgacttcatcgccgcccagatcaagaccctgtccttcctggcctacatcatccgcatctaccaggagctggtgaccaagtacagccagcagatggtgaagggcatgctgcagctgctgagcaactgcccagctgagacagcccacctgaggaaggagctgctgattgctgccaagcacatcctgaccacagagctgaggaaccagttcatcccctgcatggacaagctgtttgatgagagcatcctgattggcagcggctacacagcccgggagaccctgcggcccctggcctacagcaccctggccgacctggtgcaccacgtgcggcagcacctgcccctgagtgacctgagcctggccgtgcagctgtttgccaagaacattgatgatgagagcctgcccagcagcatccagaccatgagctgcaagctgctgctgaacctggtggactgcatccgcagcaagtctgagcaggagagcggaaatggaagagatgtgctgatgaggatgctggaggtgtttgtgctgaagttccacaccatcgcccgctaccagctgagcgccatcttcaagaagtgcaagccccagagcgagctgggcgctgtggaggccgccctgcccggggtgcccacagccccagctgcccctggccctgcccccagccctgcccctgtgcctgcccctcctcctcctcctcctcctcctcctccagccacccctgtgaccccagcccctgtgcccccatttgagaagcagggcgagaaggacaaggaggacaagcagaccttccaggtgacagactgccgcagcctggtgaagaccctggtgtgtggggtgaagaccatcacctggggcatcaccagctgcaaggcccctggagaggcccagttcatccccaacaagcagctgcagcccaaggagacccagatctacatcaagctggtgaagtatgccatgcaggccctggacatctaccaggtgcagattgctggaaatggccagacctacatccgggtggccaactgccagacagtgaggatgaaggaggagaaggaggtgctggagcactttgctggggtcttcaccatgatgaaccccctgaccttcaaggagatcttccagaccaccgtgccctacatggtggagcgcatcagcaagaactatgccctgcagatcgtggccaacagcttcctggccaaccccaccaccagcgccctgtttgccaccatcctggtggagtacctgctggaccggctgcctgagatgggcagcaatgtggagctgagcaacctgtacctgaagctgttcaagctggtgtttggatctgtgtccctgtttgctgctgaaaatgagcagatgctgaagccccacctgcacaagatcgtgaacagctccatggagctggcccagacagccaaggagccctacaactacttcctgctgctgcgggccctcttccgcagcattggaggcggcagccatgacctgctgtaccaggagttcctgcccctgctgcccaacctgctgcagggcctgaacatgctgcagagcggcctgcacaagcagcacatgaaggacctgtttgtggagctgtgcctgactgtgcctgtgcggctgagcagcctgctgccctacctgcccatgctgatggaccccctggtgtctgccctgaatggcagccagaccctggtgtcccagggcctgcggaccctggagctgtgtgtggacaacctgcagcctgacttcctgtatgaccacatccagcctgtgcgggcagagctgatgcaggccctgtggaggaccctgagaaatcctgctgacagcatcagccacgtggcctacagagtgctgggcaagtttggaggcagcaacaggaagatgctgaaggagagccagaagctgcactacgtggtgacagaggtgcagggccccagcatcaccgtggagttcagtgactgcaaggccagcctgcagctgcccatggagaaggccattgaaacagccctggactgcctgaagagcgccaacacagagccctactaccgccggcaggcctgggaggtgatcaagtgcttcctggtggccatgatgagcctggaggacaacaagcacgccctgtaccagctgctggcccaccccaacttcacagagaagaccatccccaacgtcatcatcagccaccgctacaaggcccaggacaccccagccaggaagacctttgagcaggccctgactggagccttcatgtctgctgtgatcaaggacctgcggcccagcgccctgccctttgtggccagcctcatccgccactacaccatggtggccgtggcccagcagtgtggccccttcctgctgccctgctaccaggtgggcagccagcccagcacagccatgttccacagtgaagaaaatggcagcaagggcatggaccccctggtgctgattgatgccatcgccatctgcatggcctatgaggagaaggagctgtgcaagatcggggaggtggccctggccgtcatctttgatgtggccagcatcatcctgggcagcaaggagcgggcctgccagctgcccctcttctcctacatcgtggagcggctgtgtgcctgctgctatgagcaggcctggtacgccaagctgggcggcgtggtgtccatcaagttcctgatggagcggctgcccctgacctgggtgctgcagaaccagcagaccttcctgaaggccctgctgtttgtgatgatggacctgactggagaggtgtccaatggagctgtggccatggccaagaccaccctggagcagctgctgatgagatgtgccacccccctgaaggatgaggagagagctgaggagatcgtggccgcccaggagaagagcttccaccacgtgacccatgacctggtgcgggaggtgaccagccccaacagcacagtgaggaagcaggccatgcacagcctgcaggtgctggcccaggtgacaggcaagtctgtgaccgtcatcatggagccccacaaggaggtgctgcaggacatggtgccccccaagaagcacctgctgcggcaccagcctgccaatgcccagatcggcctgatggagggcaacaccttctgcaccaccctgcagcccaggctcttcaccatggacctgaatgtggtggagcacaaggtgttctacacagagctgctgaacctgtgtgaggccgaggacagcgccctgaccaagctgccctgctacaagagcctgcccagcctggtgcccctgagaattgctgccctgaatgccctggccgcctgcaactacctgccccagagccgggagaagatcatcgccgccctcttcaaggccctgaacagcaccaacagcgagctgcaggaggccggggaggcctgcatgaggaagttcctggagggcgccaccatcgaggtggaccagatccacacccacatgaggcccctgctgatgatgctgggggactaccgcagcctgaccctgaatgtggtgaaccggctgacctctgtgaccaggctcttccccaacagcttcaatgacaagttctgtgaccagatgatgcagcacctgaggaagtggatggaggtggtggtgatcacccacaagggcggccagaggagtgatggaaatgaaagcatcagtgaatgtggccgctgccccctgagccccttctgccagtttgaggagatgaagatctgcagcgccatcatcaacctcttccacctgatcccagctgccccccagaccctggtgaagcccctgctggaggtggtgatgaagacagagcgggccatgctgattgaggccggcagccccttccgggagcccctcatcaagttcctgaccaggcaccccagccagacagtggagctgttcatgatggaggccaccctgaatgacccccagtggagcaggatgttcatgtccttcctgaagcacaaggatgcccggcccctgagagatgtgctggccgccaaccccaaccgcttcatcaccctgctgctgcctggaggagcccagacagctgtgcggcccggcagccccagcaccagcaccatgaggctggacctgcagttccaggccatcaagatcatcagcatcatcgtgaagaatgatgacagctggctggccagccagcacagcctggtgtcccagctgcggcgggtgtgggtgtctgagaacttccaggagcggcacaggaaagaaaacatggccgccaccaactggaaggagcccaagctgctggcctactgcctgctgaactactgcaagaggaactacggggacatcgagctgctcttccagctgctgcgggccttcaccggccgcttcctgtgcaacatgaccttcctgaaggagtacatggaggaggagatccccaagaactacagcatcgcccagaagagggccctcttcttccgctttgtggacttcaatgaccccaactttggagatgagctgaaggccaaggtgctgcagcacatcctgaacccagccttcctgtacagctttgagaagggggagggggagcagctgctgggcccccccaaccctgagggggacaaccctgagagcatcacctctgtgttcatcaccaaggtgctggaccctgagaagcaggccgacatgctggacagcctgcgcatctacctgctgcagtatgccaccctgctggtggagcacgccccccaccacatccatgacaacaacaagaacagaaacagcaagctgcggcggctgatgacctttgcctggccctgcctgctgagcaaggcctgtgtggaccctgcctgcaagtacagcggccacctgctgctggcccacatcatcgccaagtttgccatccacaagaagatcgtgctgcaggtgttccacagcctgctgaaggcccacgccatggaggcccgggccatcgtgcggcaggccatggccatcctgaccccagctgtgcctgccaggatggaggatggccaccagatgctgacccactggaccaggaagatcatcgtggaggagggccacacagtgccccagctggtgcacatcctgcacctgattgtgcagcacttcaaggtgtactaccctgtgcgccaccacctggtgcagcacatggtgtctgccatgcagaggctgggcttcaccccatctgtgaccatcgagcagaggcggctggccgtggacctgtctgaggtggtgatcaagtgggagctgcagaggatcaaggaccagcagcctgacagcgacatggaccccaacagcagtggagagggcgtgaacagcgtgagcagcagcatcaagaggggcctgtctgtggacagcgcccaggaggtgaagcgcttcagaacagccactggagccatctctgctgtgtttggccgcagccagagcctgcctggagctgacagcctgctggccaagcccatcgacaagcagcacacagacacagtggtgaacttcctgatccgggtggcctgccaggtgaatgacaacaccaacacagctggcagccctggagaggtgctgagccgccgctgtgtgaacctgctgaagacagccctgcggccagacatgtggcccaagtctgagctgaagctgcagtggtttgacaagctgctgatgacagtggagcagcccaaccaggtgaactacggcaacatctgcaccggcctggaggtgctgtccttcctgctgactgtgctgcagagccctgccatcctgagcagcttcaagcccctgcagaggggcattgctgcctgcatgacctgtggcaacaccaaggtgctgcgggctgtgcacagcctgctgagccggctgatgagcatcttccccacagagcccagcaccagctctgtggccagcaaatatgaggagctggagtgcctgtatgctgctgtgggcaaggtgatctatgagggcctgaccaactatgagaaggccaccaatgccaaccccagccagctgtttggcaccctgatgatcctgaagagcgcctgcagcaacaaccccagctacatcgacaggctcatctctgtgttcatgaggagcctgcagaagatggtgcgggagcacctgaacccccaggccgccagcggcagcacagaggccaccagcggcaccagcgagctggtgatgctgagcctggagctggtgaagacccggctggccgtgatgtccatggagatgaggaagaacttcatccaggccatcctgaccagcctgattgagaagagcccagatgccaagatcctgcgggctgtggtgaagatcgtggaggagtgggtgaagaacaacagccccatggccgccaaccagacccccaccctgcgggagaagagcatcctgctggtgaagatgatgacctacatcgagaagcgcttccctgaggacctggagctgaatgcccagttcctggacctggtgaactacgtgtacagagatgagaccctgagcggcagcgagctgacagccaagctggagcccgccttcctgagcggcctgcgctgtgcccagcccctcatccgggccaagttctttgaggtgtttgacaacagcatgaagagaagagtgtatgagcggctgctgtatgtgacctgcagccagaactgggaggccatgggcaaccacttctggatcaagcagtgcatcgagctgctgctggccgtgtgtgagaagagcacccccatcggcaccagctgccagggcgccatgctgcccagcatcaccaacgtcatcaacctggccgacagccatgaccgggccgcctttgccatggtgacccacgtgaagcaggagccccgggagcgggagaacagcgagagcaaggaggaggatgtggagattgatattgagctggcccctggggaccagaccagcacccccaagaccaaggagctgtctgagaaggacatcggcaaccagctgcacatgctgaccaacagacatgacaagttcctggacaccctgcgggaggtgaagacaggagccctgctgagcgcctttgtgcagctgtgccacatcagcaccaccctggccgagaagacctgggtgcagctgttcccccggctgtggaagatcctgagtgaccggcagcagcacgccctggccggggagatcagccccttcctgtgcagcggcagccaccaggtgcagagggactgccagcccagcgccctgaactgctttgtggaggccatgagccagtgtgtgccccccatccccatccggccctgtgtgctgaagtacctgggcaagacccacaacctgtggttccgcagcaccctgatgctggagcaccaggcctttgagaagggcctgagcctgcagatcaagcccaagcagaccacagagttctatgagcaggagagcatcaccccaccccagcaggagatcctggacagcctggccgagctgtacagcctgctgcaggaggaggacatgtgggccggcctgtggcagaagcgctgcaagtacagcgagacagccacagccatcgcctatgagcagcacggcttctttgagcaggcccaggagagctatgagaaggccatggacaaggccaagaaggagcacgagaggagcaatgccagccctgccatcttccctgagtaccagctgtgggaggaccactggatccgctgcagcaaggagctgaaccagtgggaggccctgacagaatatggccagagcaagggccacatcaacccctacctggtgctggagtgtgcctggagggtgagcaactggacagccatgaaggaggccctggtgcaggtggaggtgtcctgccccaaggagatggcctggaaggtgaacatgtaccggggctacctggccatctgccaccctgaggagcagcagctgtccttcatcgagcggctggtggagatggccagcagcctggccatccgggagtggaggcggctgccccacgtggtgagccacgtgcacacccccctgctgcaggccgcccagcagatcatcgagctgcaggaggccgcccagatcaatgccggcctgcagcccaccaacctgggcaggaacaacagcctgcatgacatgaagacagtggtgaagacctggaggaaccggctgcccatcgtgtctgatgacctgagccactggagcagcatcttcatgtggaggcagcaccactaccagggcaagcccacctggagcggcatgcacagcagcagcatcgtgacagcctatgagaacagcagccagcacgaccccagcagcaacaatgccatgctgggcgtgcacgccagcgccagcgccatcatccagtatggcaagatcgccaggaagcagggcctggtgaatgtggccctggacatcctgagccgcatccacaccatccccaccgtgcccatcgtggactgcttccagaagatccggcagcaggtgaagtgctacctgcagctggccggcgtgatgggcaagaatgaatgcatgcagggcctggaggtgattgagagcaccaacctgaagtacttcaccaaggagatgacagctgagttctacgccctgaagggcatgttcctggcccagatcaacaagtctgaggaggccaacaaggccttctctgctgctgtgcagatgcatgatgtgctggtgaaggcctgggccatgtggggagactacctggagaacatctttgtgaaggagcggcagctgcacctgggcgtgtctgccatcacctgctacctgcacgcctgccgccaccagaatgaaagcaagagcaggaagtacctggccaaggtgctgtggctgctgagctttgatgatgacaagaacaccctggctgatgctgtggacaagtactgcatcggcgtgccccccatccagtggctggcctggatcccccagctgctgacctgcctggtgggcagcgagggcaagctgctgctgaacctgatcagccaggtgggccgggtgtacccccaggccgtgtacttccccatccgcaccctgtacctgaccctgaagattgagcagcgggagcgctacaagagtgaccccggccccatccgggccacagcccccatgtggcgctgcagccgcatcatgcacatgcagcgggagctgcaccccaccctgctgagcagcctggagggcatcgtggaccagatggtgtggttccgggagaactggcatgaggaggtgctgcggcagctgcagcagggcctggccaagtgctacagcgtggcctttgagaagtctggagctgtgtctgatgccaagatcaccccccacaccctgaactttgtgaagaagctggtgtccaccttcggcgtgggcctggagaatgtgtccaatgtgtccaccatgttcagcagcgctgccagcgagagcctggcccggcgggcccaggccacagcccaggaccctgtgttccagaagctgaagggccagttcaccacagactttgacttctctgtgcccggctccatgaagctgcacaacctgatcagcaagctgaagaagtggatcaagatcctggaggccaagaccaagcagctgcccaagttcttcctgattgaggagaagtgccgcttcctgagcaacttcagcgcccagacagctgaggtggagatccctggagagttcctgatgcccaagcccacccactactacatcaagatcgcccgcttcatgccccgggtggagatcgtgcagaagcacaacacagctgcccggcggctgtacatccggggccacaacgggaagatctacccctacctggtgatgaatgatgcctgcctgacagagagccggcgggaggagcgggtgctgcagctgctgcggctgctgaacccctgcctggagaagaggaaggagaccaccaagaggcacctgttcttcaccgtgccccgggtggtggccgtgagcccccagatgaggctggtggaggacaaccccagcagcctgagcctggtggagatctacaagcagagatgtgccaagaagggcatcgagcatgacaaccccatcagccgctactatgaccggctggccaccgtgcaggcccggggcacccaggccagccaccaggtgctgcgggacatcctgaaggaggtgcagagcaacatggtgcccaggtccatgctgaaggagtgggccctgcacaccttccccaatgccacagactactggaccttcaggaagatgttcaccatccagctggccctgattggatttgctgagtttgtgctgcacctgaaccggctgaaccctgagatgctgcagatcgcccaggacaccgggaagctgaatgtggcctacttccgctttgacatcaatgatgccaccggggacctggatgccaacagacctgtgcccttccggctgacccccaacatcagcgagttcctgaccaccatcggcgtgtctggccccctgacagcctccatgattgctgtggcccgctgctttgcccagcccaacttcaaggtggatggcatcctgaagacagtgctgagagatgagatcatcgcctggcacaagaagacccaggaggacaccagcagccccctgtctgctgctggccagcctgagaacatggacagccagcagctggtgtccctggtgcagaaggctgtgacagccatcatgacccggctgcacaacctggcccagtttgagggcggggagagcaaggtgaacaccctggtggccgccgccaacagcctggacaacctgtgcaggatggaccctgcctggcacccctggctgtag

SEQ ID NO: 42812 - DNA, 951 bp, Artificial Sequence
  Description of Artificial Sequence: Synthetic coding sequence
atgggagagagcgctgctgccacagccagcctcttccagaggagaagaagaggccggggcggccgggtgaccttccctgggggcctgaagggcagcgcccgcttcctgagctttggcccccccttccctgcccccccagccccacccttccctgctgcccctggcccctggctgcggcggcccctcttcagcctgaagctgagtgacacagaagatgtgttcccccggcgggccggccccctggaggtgcctgctgacagccgggtgtttgtgcaggccgccctggcccggcccagcccccgctggggcctggccctgcaccgctgcagcgtgacccccagcagcaggcctgcccctggccctgccctggccctgctgcgggagggctgcccagctgacacctctgtggccttccccccacctcctccacccagccctggggccgcccggcctgcccgcttctccttccggctgcggcctgtgttcaatgcctctgtgcagttcctgcactgccagctgagccgctgccggcggctgcggggcgtgagaagagccccagcccccctgaccccacctcctcctcctccacccagccgctgcctgccccaggatgaggcctgtgccgacaccggcagcggcagcgctgagggcctggccgcagatggcccccacctgcacaccctgacccagcccatcgtggtgacagtgccccggcccccacccaggcctcccaagtctgtgcccggccgggctgtgcggcctgagcccccagccccagccccagctgccctggagcccgcccctgtggtggccctggtgctggccgcctttgtgctgggcgccgccctggccgccggcctgggcctggtgtgtgcccacagcgcccctcatgcccctggccccccagcccgggccagccccagcggcccccagcccaggaggagccagtag

SEQ ID NO: 42813 - DNA, 600 bp, Artificial Sequence
  Description of Artificial Sequence: Synthetic coding sequence
atggccaacagaggccccagctatggcctgagccgggaggtgcaggagaagattgagcagaagtatgatgctgacctggagaacaagctggtggactggatcatcctgcagtgtgccgaggacatcgagcaccccccacctggccgggcccacttccagaagtggctgatggatggcaccgtgctgtgcaagctgatcaacagcctgtacccacctggccaggagcccatccccaagatcagcgagagcaagatggccttcaagcagatggagcagatcagccagttcctgaaggctgctgagacctatggagtgaggaccacagacatcttccagacagtggacctgtgggagggcaaggacatggctgctgtgcagaggaccctgatggccctgggctctgtggccgtgaccaaggatgatggctgctacagaggagagcccagctggttccacaggaaggcccagcagaacagaagaggcttcagcgaggagcagctgcggcagggccagaatgtcatcggcctgcagatgggcagcaacaagggggccagccaggccggcatgacaggctacggcatgccccggcagatcatgtag

SEQ ID NO: 42814 - DNA, 600 bp, Artificial Sequence; identical to SEQ ID NO: 42813
  Description of Artificial Sequence: Synthetic coding sequence

SEQ ID NO: 42815 - DNA, 600 bp, Artificial Sequence; identical to SEQ ID NO: 42813
  Description of Artificial Sequence: Synthetic coding sequence

SEQ ID NO: 42816 - DNA, 600 bp, Artificial Sequence; identical to SEQ ID NO: 42813
  Description of Artificial Sequence: Synthetic coding sequence

SEQ ID NO: 42817 - DNA, 666 bp, Artificial Sequence
  Description of Artificial Sequence: Synthetic coding sequence
atggccaacagaggccccagctatggcctgagccgggaggtgcaggagaagattgagcagaagtatgatgctgacctggagaacaagctggtggactggatcatcctgcagtgtgccgaggacatcgagcaccccccacctggccgggcccacttccagaagtggctgatggatggcaccgtgctgtgcaagctgatcaacagcctgtacccacctggccaggagcccatccccaagatcagcgagagcaagatggccttcaagcagatggagcagatcagccagttcctgaaggctgctgagacctatggagtgaggaccacagacatcttccagacagtggacctgtgggagggcaaggacatggctgctgtgcagaggaccctgatggccctgggctctgtggccgtgaccaaggatgatggctgctacagaggagagcccagctggttccacaggaaggcccagcagaacagaagaggcttcagcgaggagcagctgcggcagggccagaatgtcatcggcctgcagatgggcagcaacaagggggccagccaggccggcatgacaggctacggcatgcctggccgcagctgcaggaccaggcacctgcccctggtggagaggaccaacgtgccccaccacggcctgtatgagaagaagtag

SEQ ID NO: 42818 - DNA, 2520 bp, Artificial Sequence
  Description of Artificial Sequence: Synthetic coding sequence
atgaagaagtggagcagcacagacctgggcgctgctgctgaccccctgcagaaggacacctgcccagaccccctggatggagaccccaacagcaggcctcctccagccaagccccagctgagcacagccaagagcaggacccggctgtttgggaagggggacagcgaggaggccttccctgtggactgcccccatgaggagggggagctggacagctgccccaccatcaccgtgtcccctgtgatcaccatccagaggcctggagatggccccaccggggcccggctgctgagccaggacagcgtggccgccagcacagagaagaccctgcggctgtatgacagaagaagcatctttgaagctgtggcccagaacaactgccaggacctggagagcctgctgctcttcctgcagaagagcaagaagcacctgacagacaatgagttcaaggaccctgagaccgggaagacctgcctgctgaaggccatgctgaacctgcatgatggccagaacaccaccatccccctgctgctggagatcgcccggcagacagacagcctgaaggagctggtgaatgccagctacacagacagctactacaagggccagacagccctgcacatcgccatcgagaggaggaacatggccctggtgaccctgctggtggagaatggagcagatgtgcaggccgccgcccatggagacttcttcaagaagaccaagggccggcccggcttctactttggagagctgcccctgagcctggccgcctgcaccaaccagctgggcatcgtgaagttcctgctgcagaacagctggcagacagctgacatcagcgcccgggacagcgtgggcaacacagtgctgcacgccctggtggaggtggccgacaacacagctgacaacaccaagtttgtgacctccatgtacaatgagatcctgatgctgggcgccaagctgcaccccaccctgaagctggaggagctgaccaacaagaagggcatgacccccctggccctggccgccggcaccgggaagattggagtgctggcctacatcctgcagcgggagatccaggagcctgagtgccgccacctgagcaggaagttcacagagtgggcctacggccctgtgcacagcagcctgtatgacctgagctgcatcgacacctgtgagaagaacagcgtgctggaggtgattgcctacagcagcagcgagacccccaacagacatgacatgctgctggtggagcccctgaaccggctgctgcaggacaagtgggacagatttgtgaagaggatcttctacttcaacttcctggtgtactgcctgtacatgatcatcttcaccatggccgcctactacagacctgtggatggcctgccccccttcaagatggagaagacaggagactacttccgggtgactggagagatcctgtctgtgctgggcggcgtgtacttcttcttccggggcatccagtacttcctgcagaggcggcccagcatgaagaccctgtttgtggacagctacagcgagatgctgttcttcctgcagagcctcttcatgctggccaccgtggtgctgtacttcagccacctgaaggagtatgtggcctccatggtgttcagcctggccctgggctggaccaacatgctgtactacacccggggcttccagcagatgggcatctatgctgtgatgattgagaagatgatcctgcgggacctgtgccgcttcatgtttgtgtacatcgtgttcctgtttggcttcagcacagctgtggtgaccctgattgaagatggcaagaatgacagcctgcccagcgagagcaccagccaccgctggaggggccctgcctgccggcccccagacagcagctacaacagcctgtacagcacctgcctggagctgttcaagttcaccatcggcatgggagacctggagttcacagagaactatgacttcaaggctgtgttcatcatcctgctgctggcctacgtgatcctgacctacatcctgctgctgaacatgctgattgccctgatgggagagaccgtgaacaagatcgcccaggagagcaagaacatctggaagctgcagagggccatcaccatcctggacacagagaagagcttcctgaagtgcatgaggaaggccttccgcagcggcaagctgctgcaggtgggctacaccccagatggcaaggatgactaccgctggtgcttccgggtggatgaggtgaactggaccacctggaacaccaacgtgggcatcatcaatgaagaccccggcaactgtgaaggagtgaagaggaccctgtccttcagcctgcggagcagccgggtgtctggccgccactggaagaactttgccctggtgcccctgctgcgggaggccagcgcccgggaccggcagagcgcccagcctgaggaggtgtacctgcggcagttcagcggcagcctgaagccagaagatgctgaggtgttcaagagccctgctgccagcggggagaagtag

SEQ ID NO: 42819 - DNA, 1791 bp, Artificial Sequence
  Description of Artificial Sequence: Synthetic coding sequence
atggctgatgctgaggcccgggcagagttccctgaggaggcccggccagaccggggcaccctgcaggtgctgcaggacatggccagccggctgcgcatccacagcatccgggccacctgcagcaccagcagcggccaccccaccagctgcagcagcagcagcgagatcatgtctgtgctcttcttctacatcatgagatacaagcagagcgaccctgaaaatccagacaatgacagatttgtgctggccaagaggctgagctttgtggatgtggccaccggctggctgggccagggcctgggcgtggcctgtggcatggcctacacaggcaagtactttgaccgggccagctacagagtcttctgcctgatgtctgatggagagagcagcgagggctctgtgtgggaggccatggcctttgccagctactacagcctggacaacctggtggccatctttgatgtgaaccggctgggccacagcggggccctgcctgctgagcactgcatcaacatctaccagaggcgctgtgaggccttcggctggaacacctacgtggtggatggaagagatgtggaggccctgtgccaggtgttctggcaggccagccaggtgaagcacaagcccacagctgtggtggccaagaccttcaagggccggggcacccccagcattgaagatgctgagagctggcacgccaagcccatgccccgggagcgggcagatgccatcatcaagctgattgagagccagatccagaccagcaggaacctggacccccagccccccatcgaggacagccctgaggtgaacatcacagatgtgaggatgaccagccccccagactacagagtgggggacaagatcgccaccaggaaggcctgtggcctggccctggccaagctgggctacgccaacaacagagtggtggtgctggatggagacacccgctacagcaccttcagcgagatcttcaacaaggagtacccagagcgcttcatcgagtgcttcatggccgagcagaacatggtgtctgtggccctgggctgtgccagccggggccgcaccatcgcctttgccagcacctttgctgccttcctgacccgggcctttgaccacatccgcatcggcggcctggccgagagcaacatcaacatcatcggcagccactgcggcgtgtctgtgggagatgatggagccagccagatggccctggaggacatcgccatgttccgcaccatccccaagtgcaccatcttctaccccacagatgctgtgtccacagagcacgctgtggccctggccgccaatgccaagggcatgtgcttcatccgcaccaccaggcctgagaccatggtgatctacaccccccaggagagatttgaaattggccaggccaaggtgctgcggcactgtgtgtctgacaaggtgaccgtcatcggggccggcatcaccgtgtatgaggccctggccgctgctgatgagctgagcaagcaggacatcttcatccgggtcatcgacctcttcaccatcaagcccctggatgtggccaccatcgtgagcagcgccaaggccacagagggccgcatcatcaccgtggaggaccactacccccagggcggcatcggggaggccgtgtgtgccgctgtgtccatggaccctgacatccaggtgcacagcctggccgtgtctggagtgccccagagcggcaagtctgaggagctgctggacatgtatggcatcagcgcccggcacatcatcgtggccgtgaagtgcatgctgctgaactag

SEQ ID NO: 42820 - DNA, 1500 bp, Artificial Sequence
  Description of Artificial Sequence: Synthetic coding sequence
atgtggagccggcggcagggccgcctgcggcccaccgtgtgtggggtggaggagctgcggaggagaagaagagagcgggaggccgccctgaggaaggcccggcgggagcagcagctggtgtccaagaggctgctgagaaatgatgcccctgaggaggccggggagggctgtgtggccgccatcctgggggagacagaggtgcagcagttcctgcggcaggcccagaggggcacagaggagaaggagcgggagggcgccctggtgtccctgcggcggggcctgcagcaccctgagacccagcagaccttcatccggctggagggctccatgaggaccctggtgggcctgctgaccagcaaccaggccctgctgcagctggaggccgcccgctgcctgcacgagctgagccacagcgagcagagcacagtggccgaggcctgcctgcctgccaccagctacctgctgacctacctgagcagccacagcagtgacttcatcgagctgtgcctgtacaccctgggcaacctgattgtggagagcgaggccgtgcggcggcagctgctgccccagggcatcgtgcctgccctggccgcctgcatccagagcccccacgtggccgtgctggaggccctgggctacgccctgagccagctgctgcaggccgaggaggcccctgagaagatcatccccccagccagcgccagcagcagcatcctggccagcaccctgccccagcacatgctgcagatgctgcagcccggccccaagctgaaccctggggtggccgtggagtttgcctggtgcctgcactacatcatctgcagccaggtgagcaaccccctgctgattggacatggagccctgagcaccctgggcctgctgctgctggacctggccggggctgtgcagaagacagaagatgctggcctggagctgctggcctgccctgtgctgcgctgcctgagcaacctgctgacagaggccgctgtggagaccgtgggcggccagatgcagctgagagatgagcgggtggtggccgccctcttcatcctgctgcagttcttcttccagaagcagcccagcctgctgcctgagggcctgtggctgctgaacaacctgacagccaacagccccagcttctgcaccagcctgctgagcctggacctgattgagcccctgctgcagctgctgcctgtgtccaatgtggtgtctgtgatggtgctgactgtgctgtgcaatgtggccgagaagggccctgcctactgccagaggctgtggccaggccccctgctgcctgccctgctgcacaccctggccttcagtgacacagaggtggtgggccagagcctggagctgctgcacctgctcttcctgtaccagcctgaggccgtgcaggtgttcctgcagcagagcggcctgcaggccctggagcggcaccaggaggaggcccagctgcaggacagagtgtatgccctgcagcagacagccctgcagggctag

SEQ ID NO: 42821 - DNA, 1482 bp, Artificial Sequence
  Description of Artificial Sequence: Synthetic coding sequence
atgtggagccggcggcagggccgcctgcggcccaccgtgtgtggggtggaggagctgcggaggagaagaagagagcgggaggccgccctgaggaaggcccggcgggagcagcagctggtgtccaagaggctgctgagaaatgatgcccctgaggaggccggggagggctgtgtggccgccatcctgggggagacagaggtgcagcagttcctgcggcaggcccagaggggcacagaggagaaggagcgggagggcgccctggtgtccctgcggcggggcctgcagcaccctgagacccagcagaccttcatccggctggagggctccatgaggaccctggtgggcctgctgaccagcaaccaggccctgctgcagctggaggccgcccgctgcctgcacgagctgagccacagcgagcagagcacagtggccgaggcctgcctgcctgccaccagctacctgctgacctacctgagcagccacagcagtgacttcatcgagctgtgcctgtacaccctgggcaacctgattgtggagagcgaggccgtgcggcggcagctgctgccccagggcatcgtgcctgccctggccgcctgcatccagagcccccacgtggccgtgctggaggccctgggctacgccctgagccagctgctgcaggccgaggaggcccctgagaagatcatccccagcatcctggccagcaccctgccccagcacatgctgcagatgctgcagcccggccccaagctgaaccctggggtggccgtggagtttgcctggtgcctgcactacatcatctgcagccaggtgagcaaccccctgctgattggacatggagccctgagcaccctgggcctgctgctgctggacctggccggggctgtgcagaagacagaagatgctggcctggagctgctggcctgccctgtgctgcgctgcctgagcaacctgctgacagaggccgctgtggagaccgtgggcggccagatgcagctgagagatgagcgggtggtggccgccctcttcatcctgctgcagttcttcttccagaagcagcccagcctgctgcctgagggcctgtggctgctgaacaacctgacagccaacagccccagcttctgcaccagcctgctgagcctggacctgattgagcccctgctgcagctgctgcctgtgtccaatgtggtgtctgtgatggtgctgactgtgctgtgcaatgtggccgagaagggccctgcctactgccagaggctgtggccaggccccctgctgcctgccctgctgcacaccctggccttcagtgacacagaggtggtgggccagagcctggagctgctgcacctgctcttcctgtaccagcctgaggccgtgcaggtgttcctgcagcagagcggcctgcaggccctggagcggcaccaggaggaggcccagctgcaggacagagtgtatgccctgcagcagacagccctgcagggctag

SEQ ID NO: 42822 - DNA, 357 bp, Artificial Sequence
  Description of Artificial Sequence: Synthetic coding sequence
atgtggagccggcggcagggccgcctgcggcccaccgtgtgtggggtggaggagctgcggaggagaagaagagagcgggaggccgccctgaggaaggcccggcgggagcagcagctggtgtccaagaggctgctgagaaatgatgcccctgaggaggccggggagggctgtgtggccgccatcctgggggagacagaggtgcagcagttcctgcggcaggcccagaggggcacagaggagaaggagcgggagggcgccctggtgtccctgcggcggggcctgcagcaccctgagacccagcagaccttcatccgctctgtgtggatggtgtggtggagggaggagctgggcctgtag

SEQ ID NO: 42823 - DNA, 762 bp, Artificial Sequence
  Description of Artificial Sequence: Synthetic coding sequence
atgctgcagatgctgcagcccggccccaagctgaaccctggggtggccgtggagtttgcctggtgcctgcactacatcatctgcagccaggtgagcaaccccctgctgattggacatggagccctgagcaccctgggcctgctgctgctggacctggccggggctgtgcagaagacagaagatgctggcctggagctgctggcctgccctgtgctgcgctgcctgagcaacctgctgacagaggccgctgtggagaccgtgggcggccagatgcagctgagagatgagcgggtggtggccgccctcttcatcctgctgcagttcttcttccagaagcagcccagcctgctgcctgagggcctgtggctgctgaacaacctgacagccaacagccccagcttctgcaccagcctgctgagcctggacctgattgagcccctgctgcagctgctgcctgtgtccaatgtggtgtctgtgatggtgctgactgtgctgtgcaatgtggccgagaagggccctgcctactgccagaggctgtggccaggccccctgctgcctgccctgctgcacaccctggccttcagtgacacagaggtggtgggccagagcctggagctgctgcacctgctcttcctgtaccagcctgaggccgtgcaggtgttcctgcagcagagcggcctgcaggccctggagcggcaccaggaggaggcccagctgcaggacagagtgtatgccctgcagcagacagccctgcagggctag

SEQ ID NO: 42824 - DNA, 903 bp, Artificial Sequence
  Description of Artificial Sequence: Synthetic coding sequence
atgctgcccctgctggccgccctgctggccgccgcctgccccctgccccctgtgcggggcggcgctgctgatgcccctggcctgctgggcgtgcccagcaatgcctctgtgaatgccagcagcgcagatgagcccatcgccccccggctgctggccagcgctgcccctggccccccagagcggcccggccctgaggaggccgctgctgctgctgccccctgcaacatctctgtgcagaggcagatgctgagcagcctgctggtgcgctggggccggccccggggcttccagtgtgacctgctgctcttcagcaccaatgcccacggccgggccttctttgctgctgccttccaccgggtgggcccccccctgctgattgagcacctgggcctggccgccggcggggcccagcaggacctgcggctgtgtgtgggctgcggctgggtgcggggccgcaggacaggccgcctgcggcctgctgctgcccccagcgctgctgctgccacagctggggcccccacagccctgcctgcctacccagctgctgagcccccaggccccctgtggctgcagggcgagcccctgcacttctgctgcctggacttcagcctggaggagctgcagggcgagcccggctggaggctgaacaggaagcccatcgagagcaccctggtggcctgcttcatgaccctggtgattgtggtgtggagcgtggccgccctgatctggcctgtgcccatcatcgccggcttcctgcccaacggcatggagcagaggaggaccacagccagcaccacagctgccaccccagctgctgtgcctgctggcaccacagctgctgctgctgctgctgctgctgctgctgctgctgctgctgtgaccagcggcgtggccaccaagtag

SEQ ID NO: 42825 - DNA, 2526 bp, Artificial Sequence
  Description of Artificial Sequence: Synthetic coding sequence
atgcccctggccgcctactgctacctgcgggtggtgggcaagggcagctatggagaggtgaccctggtgaagcacagaagagatggcaagcagtatgtgatcaagaagctgaacctgagaaatgccagcagccgggagaggagagctgctgagcaggaggcccagctgctgagccagctgaagcaccccaacatcgtgacctacaaggagagctgggagggcggagatggcctgctgtacatcgtgatgggcttctgtgagggcggggacctgtacaggaagctgaaggagcagaagggccagctgctgcctgagaaccaggtggtggagtggtttgtgcagatcgccatggccctgcagtacctgcacgagaagcacatcctgcaccgggacctgaagacccagaatgtgttcctgaccaggaccaacatcatcaaggtgggggacctgggcatcgcccgggtgctggagaaccactgtgacatggccagcaccctgattggcaccccctactacatgagccctgagctgttcagcaacaagccctacaactacaagagtgatgtgtgggccctgggctgctgcgtgtatgagatggccaccctgaagcacgccttcaatgccaaggacatgaacagcctggtgtaccgcatcatcgagggcaagctgccccccatgccccgggactacagccctgagctggccgagctgatccgcaccatgctgagcaagaggcctgaggagcggcccagcgtgcgcagcatcctgcggcagccctacatcaagaggcagatctccttcttcctggaggccaccaagatcaagaccagcaagaacaacatcaagaatggagacagccagagcaagccctttgccaccgtggtgtctggagaggccgagagcaaccatgaagtcatccacccccagcccctgagcagcgagggcagccagacctacatcatgggagagggcaagtgcctgagccaggagaagccccgggccagcggcctgctgaagagccctgccagcctgaaggcccacacctgcaagcaggacctgagcaacaccacagagctggccaccatcagctctgtgaacatcgacatcctgcctgccaagggccgggacagcgtgtctgatggctttgtgcaggagaaccagccccgctacctggatgccagcaatgagctgggcggcatctgcagcatcagccaggtggaggaggagatgctgcaggacaacaccaagagcagcgcccagcctgagaacctgatccccatgtggagcagtgacatcgtgactggagagaagaatgaacctgtgaagcccctgcagcccctcatcaaggagcagaagcccaaggaccagagcctggccctgagccccaagctggagtgcagcggcaccatcctggcccacagcaacctgcggctgctgggcagcagtgacagccctgccagcgccagccgggtggccggcatcactggagtgtgccaccacgcccaggaccaggtggccggggagtgcatcatcgagaagcagggccgcatccacccagacctgcagccccacaacagcggcagcgagcccagcctgagccggcagaggcggcagaagaggcgggagcagacagagcacagaggagagaagaggcaggtgcggcgggacctgtttgccttccaggagagccccccacgcttcctgcccagccaccccatcgtgggcaaggtggatgtgaccagcacccagaaggaggccgagaaccagaggagagtggtgacaggctctgtgagcagcagccgcagcagcgagatgagcagcagcaaggaccggcccctgagcgcccgggagcggcggcggctgaagcagagccaggaggagatgagcagcagcggccccagcgtgaggaaggccagcctgtctgtggccggccctgggaagccccaggaggaggaccagcccctgcctgcccggcggctgagcagtgactgcagcgtgacccaggagaggaagcagatccactgcctgtctgaagatgagctgagcagcagcaccagcagcacagacaagagtgatggagactatggagagggcaagggccagaccaatgagatcaatgccctggtgcagctgatgacccagaccctgaagctggacagcaaggagagctgtgaagatgtgcctgtggccaaccctgtgtctgagttcaagctgcacaggaagtacagagacaccctcatcctgcacggcaaggtggccgaggaggccgaggagatccacttcaaggagctgcccagcgccatcatgcctggcagcgagaagatccggcggctggtggaggtgctgaggacagatgtgatccggggcctgggcgtgcagctgctggagcaggtgtatgacctgctggaggaggaggatgaatttgaccgggaggtgcggctgcgggagcacatgggagagaagtacaccacctacagcgtgaaggcccggcagctgaagttctttgaggagaacatgaacttctag

SEQ ID NO: 42826 - DNA, 486 bp, Artificial Sequence
  Description of Artificial Sequence: Synthetic coding sequence
atggccaaggaggagccccagagcatcagccgggacctgcaggagctgcagaagaagctgagcctgctgattgacagcttccagaacaacagcaaggtggtggccttcatgaagagccctgtgggccagtacctggacagccaccccttcctggccttcaccctgctggtgttcatcgtgatgtctgctgtgcctgtgggcttcttcctgctgattgtggtgctgaccaccctggccgccctgctgggcgtcatcatcctggagggcctggtgatctctgtgggcggcttcagcctgctgtgcatcctgtgtggcctgggctttgtgtccctggccatgagcggcatgatgattgccagctatgtggtggtgagcagcctcatcagctgctggttcagcccccggcccctgacccagcagaacaccagctgtgacttcctgcctgccatgaagtctgctgagtttgagggcctgtaccaggagtag

SEQ ID NO: 42827 - DNA, 558 bp, Artificial Sequence
  Description of Artificial Sequence: Synthetic coding sequence
atggccaaggaggagccccagagcatcagccgggacctgcaggagctgcagaagaagctgagcctgctgattgacagcttccagaacaacagcaagctgccccagcacagccgcatcagcctggacagtgatgatggagtgtcccggctgggcagcgctggcagcaaggtggtggccttcatgaagagccctgtgggccagtacctggacagccaccccttcctggccttcaccctgctggtgttcatcgtgatgtctgctgtgcctgtgggcttcttcctgctgattgtggtgctgaccaccctggccgccctgctgggcgtcatcatcctggagggcctggtgatctctgtgggcggcttcagcctgctgtgcatcctgtgtggcctgggctttgtgtccctggccatgagcggcatgatgattgccagctatgtggtggtgagcagcctcatcagctgctggttcagcccccggcccctgacccagcagaacaccagctgtgacttcctgcctgccatgaagtctgctgagtttgagggcctgtaccaggagtag

SEQ ID NO: 42828 - DNA, 885 bp, Artificial Sequence
  Description of Artificial Sequence: Synthetic coding sequence
atggctgctggccgcctgctgctgtacacaggcctgagcctggccctgtgtgccctgggcatgctggccgtggccatctgcagcgaccactggtatgaaacagatgccaggaagcaccgggaccgctgcaaggccttcaacaccaggagagtggaccccggcttcatctacaacaacaacaacaacctgcccctgcgggccagccgcagccggctggaccgctgggagggcaagctgctgcgggccaggaacagacggcagctgtttgccatgagccctgcagatgagtgcagccggcagtacaacagcaccaacatgggcctgtggaggaagtgccaccggcagggctttgatcctgagattgctgccctgatcagaaaaggagaaattgagcgctgcacctacatcaagtaccactacagcagcgccaccatccccaggaacctgaccttcaacatcaccaagaccatccggcaggatgagtggcacgccctgcacctgcggaggatgacagctggcttcatgggcatggctgtggccatcatcctgtttggctggatcatcggcgtgctgggctgctgctgggaccggggcctgatgcagtatgtggccggcctgctcttcctgatgggcggcaccttctgcatcatcagcctgtgcacctgtgtggccggcatcaactttgagctgagccgctacccccgctacctgtatggcctgcctgatgacatcagccacggctacggctggagcatgttctgtgcctggggcggcctgggcctgaccctcatcagcggcttcttctgcaccctggcccccagcgtgcagcctgtgcccaggaccaactaccccaagagcaggccagaaaatggcaccgtgtgctag

SEQ ID NO: 42829 - DNA, 1053 bp, Artificial Sequence
  Description of Artificial Sequence: Synthetic coding sequence
atgaacctgcggggcctcttccaggacttcaaccccagcaagttcctgatctatgcctgcctgctgctcttctctgtgctgctggccctgcggctggatggcatcatccagtggagctactgggccgtgtttgcccccatctggctgtggaagctgatggtgattgtgggcgcctctgtgggcaccggggtgtgggccaggaacccccagtacagagctgagggggagacctgtgtggagttcaaggccatgctgattgctgtgggcatccacctgctgctgctgatgtttgaggtgctggtgtgtgacagaattgagcggggcagccacttctggctgctggtgttcatgcccctcttctttgtgtcccctgtgtctgtggccgcctgtgtgtggggcttcagacatgacaggagcctggagctggagatcctgtgcagcgtgaacatcctgcagttcatcttcatcgccctgcggctggacaagatcatccactggccctggctggtggtgtgtgtgcccctgtggatcctgatgtccttcctgtgcctggtggtgctgtactacatcgtgtggagcgtgctcttcctgcgctccatggatgtgattgctgagcagaggaggacccacatcaccatggccctgtcctggatgaccatcgtggtgcccctgctgacctttgagatcctgctggtgcacaagctggatggccacaatgccttcagcagcatccccatctttgtgcccctgtggctgagcctcatcaccctgatggccaccaccttcggccagaagggcggcaaccactggtggtttggcatcaggaaggacttctgccagttcctgctggagatcttccccttcctgcgggagtatggcaacatctcctatgacctgcaccacgaggacaatgaggagacagaggagacccctgtgcctgagccccccaagatcgcccccatgttcaggaagaaggcccgggtggtgatcacccagagccctgggaagtatgtgctgcccccacccaagctgaacatcgagatgccagactag

SEQ ID NO: 42830 - DNA, 876 bp, Artificial Sequence
  Description of Artificial Sequence: Synthetic coding sequence
atgaacctgcggggcctcttccaggacttcaaccccagggctgagggggagacctgtgtggagttcaaggccatgctgattgctgtgggcatccacctgctgctgctgatgtttgaggtgctggtgtgtgaccgcatcgagcggggcagccacttctggctgctggtgttcatgcccctcttctttgtgtcccctgtgtctgtggccgcctgtgtgtggggcttcagacatgacaggagcctggagctggagatcctgtgcagcgtgaacatcctgcagttcatcttcatcgccctgcggctggacaagatcatccactggccctggctggtggtgtgtgtgcccctgtggatcctgatgtccttcctgtgcctggtggtgctgtactacatcgtgtggagcgtgctcttcctgcgctccatggatgtgattgctgagcagaggaggacccacatcaccatggccctgtcctggatgaccatcgtggtgcccctgctgacctttgagatcctgctggtgcacaagctggatggccacaatgccttcagcagcatccccatctttgtgcccctgtggctgagcctcatcaccctgatggccaccaccttcggccagaagggcggcaaccactggtggtttggcatcaggaaggacttctgccagttcctgctggagatcttccccttcctgcgggagtatggcaacatctcctatgacctgcaccatgaagataatgaggagacagaggagacccctgtgcctgagccccccaagatcgcccccatgttcaggaagaaggcccgggtggtgatcacccagagccctgggaagtatgtgctgcccccacccaagctgaacatcgagatgccagactag

SEQ ID NO: 42831 - DNA, 519 bp, Artificial Sequence
  Description of Artificial Sequence: Synthetic coding sequence
atgtccttcctgtgcctggtggtgctgtactacatcgtgtggagcgtgctcttcctgcgctccatggatgtgattgctgagcagaggaggacccacatcaccatggccctgtcctggatgaccatcgtggtgcccctgctgacctttgagatcctgctggtgcacaagctggatggccacaatgccttcagcagcatccccatctttgtgcccctgtggctgagcctcatcaccctgatggccaccaccttcggccagaagggcggcaaccactggtggtttggcatcaggaaggacttctgccagttcctgctggagatcttccccttcctgcgggagtatggcaacatctcctatgacctgcaccacgaggacaatgaggagacagaggagacccctgtgcctgagccccccaagatcgcccccatgttcaggaagaaggcccgggtggtgatcacccagagccctgggaagtatgtgctgcccccacccaagctgaacatcgagatgccagactag

SEQ ID NO: 42832 - DNA, 1254 bp, Artificial Sequence
  Description of Artificial Sequence: Synthetic coding sequence
atgggcccccggcagggccgctggtggctgctgctgtggctgccccccctggccaccctgcctgtgcggggggaggccgctgctgctgccctgtctgtgcggcgctgcaaggccctgaaggagaaggacctgatccgcaccagcgagagtgactgctactgctacaaccagaacagccaggtggagtggaagtacatctggagcaccatgcaggtgaagatcaccagccctggcctcttccgcatcgtgtacatcgccgagcggcacaactgccagtacccagagaacatcctgtccttcatcaagtgtgtgatccacaacttctggatccccaaggagagcaatgagatcaccatcatcatcaacccctaccgggagaccgtgtgcttctctgtggagcctgtgaagaagatcttcaactacatgatccacgtgaacagaaacatcatggacttcaagctgttcctggtgtttgtggccggggtcttcctgttcttctacgcccggaccctgagccagagccccaccttctactacagcagcggcaccgtgctgggcgtgctgatgaccctggtgtttgtgctgctgctggtgaagcgcttcatccccaagtacagcaccttctgggccctgatggtgggctgctggtttgcctctgtgtacatcgtgtgccagctgatggaggacctgaagtggctgtggtatgagaaccgcatctacgtgctgggctacgtgctgattgtgggcttcttctcctttgtggtgtgctacaagcacggccccctggctgatgacaggagccgcagcctgctgatgtggatgctgcggctgctgagcctggtgctggtgtatgccggcgtggccgtgccccagtttgcctatgctgccatcatcctgctgatgagctcctggagcctgcactaccccctgcgggcctgcagctacatgcgctggaagatggagcagtggttcaccagcaaggagctggtggtgaagtacctgacagaagatgagtaccgggagcaggctgatgctgagaccaacagcgccctggaggagctgcggcgggcctgcaggaagccagacttccccagctggctggtggtgtcccggctgcacacccccagcaagtttgctgactttgtgctgggcggcagccacctgagccctgaggagatcagcctgcacgaggagcagtatggcctgggcggggccttcctggaggagcagctgttcaaccccagcacagcctag

SEQ ID NO: 42833 - DNA, 822 bp, Artificial Sequence
  Description of Artificial Sequence: Synthetic coding sequence
atggagcggcgggagcacctgaccctgaccttccacagccctgaggtgcccaagatcaagggcaacaggaagtaccagaggcccaccgtgcctgccaagaagcaccccagcgcctccatgagctgccagaggcagcagcagctgatggaccaggcccacatctacatccgcaccctgtgtggcagcctgtgcagcttcagcctgctgatgctgattgccatgagccccctgaactgggtgcagttcctggtgatcaagaatggcctggagctgtatgccggcctgtggaccctgtgcaaccacgagctgtgctggagccacacccccaagccaccctactacctgcagtacagccgggccttcttcctgatctctgtgttcaccatcctgaccggcctgggctggctgttcagctcctggatcctgaacagaggctccatgaccaccaacctggacctgaaggtgtccatgctgtccttcatcagcgccacctgcctgctgctgtgcctgaacctgtttgtggcccaggtgcactggcacaccagagatgccatggagagtgacctgctgtggacctactacctgaactggtgcagcgacatcttctacatgtttgctggcatcatcagcctgctgaactacctgaccagccgcagccctgcctgtgatgaaaatgtgaccgtcatccccacagagaggagccggctgggcgtgggccctgtgaccaccgtgtccccagccaaggatgagggccccaggtctgagatggagagcctgtctgtgcgggagaagaacctgcccaagagcggcctgtggtggtag

SEQ ID NO: 42834 - DNA, 585 bp, Artificial Sequence
  Description of Artificial Sequence: Synthetic coding sequence
atgaagggcctgtaccaggccgccggccgcatcctggtgaccctgggcatcctgtctgtgtgcagcggcgtgattgccttcttccctgtgttctcctacaagccctggttcaccggctggagcgtgcgcatcgcctgccccatctggaatggagccctggccatcaccactggagtgctgctgctgctggcctaccgggagtggacccagcgctacctgggggaggccaccttcaccttcgtcatcctgagcatcatgggctgccccctgcactttgccatcgccctggagagcgccctgctgggcccctactgcttctacagcttcagcggcattgctggcaccaactacctgggctatgctgtgaccttcccctacccctatgccaagttccccctggcctgtgtggaccccccccactatgaggagtaccacctgaccctgcaggccctggacctgtgcctgtccttcaccctgctgtgcaccagcctgactgtgttcatcaagctgagcgcccggctcatccagaatggccacatcaacatgcagctgcctgctggcaaccccaaccccttcagcccctag

SEQ ID NO: 42835 - DNA, 453 bp, Artificial Sequence
  Description of Artificial Sequence: Synthetic coding sequence
gcctgccccatctggaatggagccctggccatcaccactggagtgctgctgctgctggcctaccgggagtggacccagcgctacctgggggaggccaccttcaccttcgtcatcctgagcatcatgggctgccccctgcactttgccatcgccctggagagcgccctgctgggcccctactgcttctacagcttcagcggcattgctggcaccaactacctgggctatgctgtgaccttcccctacccctatgccaagttccccctggcctgtgtggaccccccccactatgaggagtaccacctgaccctgcaggccctggacctgtgcctgtccttcaccctgctgtgcaccagcctgactgtgttcatcaagctgagcgcccggctcatccagaatggccacatcaacatgcagctgcctgctggcaaccccaaccccttcagcccctag

SEQ ID NO: 42836 - DNA, 876 bp, Artificial Sequence
  Description of Artificial Sequence: Synthetic coding sequence
atggcccggagctatggaggccgggtgctggccgccatgaccctgctgggcattgctgctgctgtgctggccgccctgggcgcccagctgctcttccagctgcaggccggccgggcagagctgcggggcctgcgggcagagggcctgggccaggagctgggcgccggccctggcctgcctgaagatgctgctggcaccctgctgcccctggccgccgccctggccgccctggtgctggtgctgggcttcacctgcctgctgctggccgccctgtgtggccacctgggcgctgagctggcccggggccctggcccccggcggagtgactggttcctgtatgactgccgcctgctgcggcacgtggccctgggcctcttctgctgcggcatctctgtgtacctggccgccctgagcatctatgccctgctgctgtttgaaattgaaacaggagctgctgctgccagcatcctgggcagcggcaccctggtgctggtggccgtgctgacccacaccctgctgcgggccgcccgggccgcccggcggggcctgcacgagctgagcccccccagctttgaagatgacctggcccggcctgctgaggtgtccaaggccagcccccgggcccagccccagcagggcatccacaggaggaccccctacagcacctgcccagagcccggggaccccttcggctccatggccacagccacagccccagctgccctggagggcggctgggagagcagcctgcctgccagcaggatgcacaggaccctgtctgctggcctgggccactgggatggagtgacccatgagatgaggaggatgctgggccacaggcctggctccatgggcaaggacagcaccctggtgtag

SEQ ID NO: 42837 - DNA, 1056 bp, Artificial Sequence
  Description of Artificial Sequence: Synthetic coding sequence
atggccagcggccgcctcatcaagtttgtggtgtttgagctgctggagtttgctgccttcagcatccccaccctggtgatcacagagcagtttgccacagcctaccagggcacccgggcccggagtgacaacacccactactggctgatcatcagctgcagcatcgcctacgtggccctggtgaccctgctgatctgggtgcctgtgaaggtgatcctgcacaagaagcgctacatctacaggaagatcaagggctggaggcctgtgctgatgatgtgtgtggtgctgaccaccctgccctgcctgaccttcagcattgctgtgacagaggtgcagaagagcatcaatggcagcgcagatgtgctgcctgacatgctgcctgacctgcctgtgtccctggtgctgctgagcctcatcatggtggacatcatcgagaagctgcgcatctaccccctgcggggcagccagaagagcagtgaaaatggccacatccacagcaccagcctgcagcacatcaagacagtgacagagcaggtgcggcagagcccagaaaatgctgccagcccccaggccaccaacagcacccaggtgtcccagcccagcggggccatgaccaggagccaggagagcgtcttcatgggcccccaggagcccagctgtgacagcggcatcctgaggatgatgagcagaagagatgtgcgggcagagctgttcctgtggagcttcctgctgtggagcgacaccatcgagatggtgcgggtggccggccaccccaacgtgtacaagagctcctggctgtaccctgtgtacatcttctccttcatcagcctgctgcgcatcaccttcaccccccagaaccccctgctgaacagcctgtctgtgctgctgcaggacctgccctttgtgtttgtgcggctgggcctcatcatcgccctgggcaccatcacccctgtgctgggcctgtgcaagaacatcctggtgaccctgagctacatctacttcaactacctgacccgcatccgcatcttcagcgcctttgagatgagccccttctag

SEQ ID NO: 42838 - DNA, 531 bp, Artificial Sequence
  Description of Artificial Sequence: Synthetic coding sequence
atggctgctgccccagctgtgtgtgccagccagggcagccccccaggggcccccagcgccccagctgctgccccagccccagctgctggcctgggccgctgcaggatggccctgctgctggccgtggccctggatgtggccggcatggccgccctgctgactggagtgtttgcccagctgcaggtgcggggccgggactttggagacctgctgatctacagcggggccctgctggtgttcctgagcctgctgggctggatcctgtggtacacaggcaacatcgagatcagccggcaggagctggagcgggactatggcctgcggcccagcgccctggcccggctggccaggaagctgagccgccgctggagcgccccagctgctgctggccagaggcctgcccctggcagccggcgggccaggagagctgcccgggcccctcctcctcctgctgctggcagcagaagagtgcggctgcagctggccaccctggaggccggccctggagctgctggagctggcagcgagtag

SEQ ID NO: 42839 - DNA, 588 bp, Artificial Sequence
  Description of Artificial Sequence: Synthetic coding sequence
atgagggtgggcacctggatctgcctgcccggccggcccggccgctgcaggaagcagcacgacctgggcaactgcccagaggtgcccggcatcttcaagaccctggccctgagccctggggccccagacatgatgcagcagccccgggtggagacagacaccatcggggccggggagggcccccagcaggccgtgccctggagcgcctgggtgaccaggcatggctgggtgcgctggtgggtgagccacatgcctccttcctggatccagtggtggagcaccagcaactggaggcagcccctgcagaggctgctgtggggcctggagggcatcctgtacctgctgctggccctgatgctgtgccacgccctcttcaccaccggcagccacctgctgagcagcctgtggcctgtggtggccgctgtgtggaggcacctgctgcctgccctgctgctgctggtgctgagcgccctgcctgccctgctcttcaccgccagcttcctgctgctcttcagcaccctgctgagcctggtgggcctgctgacctccatgacccaccctggggacacccaggacctggaccagtag

SEQ ID NO: 42840 - DNA, 765 bp, Artificial Sequence
  Description of Artificial Sequence: Synthetic coding sequence
atgacccggctgtgcctgcccaggcctgaggcccgggaggaccccatccctgtgcccccccggggcctgggcgctggggagggcagcggcagccctgtgcggccccctgtgtccacctggggccccagctgggcccagctgctggacagcgtgctgtggctgggcgccctgggcctgaccatccaggccgtgttcagcaccaccggccctgccctgctgctgctgctggtgtccttcctgacctttgacctgctgcaccgctgcaccaggcatgatgctgctgctgccagcggggaccgctaccaccggggctggaggggggccacagctggcagcgccctggtgtccctgggccacgaggcctggctgggcgccctggtgggggagccccacgcccctgagctggaccctgtggtggagcacctggagctggccgccacagctgctgccccagctgtgggcagcggcggggacaccctgcctgctgctggaacagatgtggtgccctgcaccctgcaccactggctgcccccagctgagctgctggtggcctgccggggccggggcgtggcccccccagccaccggcagccctgctgctggggcccagtgcagcgcctgcccccccctgcacggcctgctgcctgctgccctgctgcacacagctgagccctgtggccccccccacctgcatgacagccccaggaggcacagcggcttcggcagcattgagggccagccccaccccacagcctgtgtgtgctag

SEQ ID NO: 42841 - DNA, 459 bp, Artificial Sequence
  Description of Artificial Sequence: Synthetic coding sequence
atgatgcagcagccccgggtggagacagacaccatcggggccggggagggcccccagcaggccgtgccctggagcgcctgggtgaccaggcatggctgggtgcgctggtgggtgagccacatgccacccagctggatccagtggtggagcaccagcaactggaggcagcccctgcagaggctgctgtggggcctggagggcatcctgtacctgctgctggccctgatgctgtgccacgccctcttcaccaccggcagccacctgctgagcagcctgtggcctgtggtggccgctgtgtggaggcacctgctgcctgccctgctgctgctggtgctgagcgccctgcctgccctgctcttcaccgccagcttcctgctgctcttcagcaccctgctgagcctggtgggcctgctgacctccatgacccaccctggggacacccaggacctggaccagtag

SEQ ID NO: 42842 - DNA, 969 bp, Artificial Sequence
  Description of Artificial Sequence: Synthetic coding sequence
atggccctgcccccaggccctgctgccctgcggcacaccctgctgctgctgcctgccctgctgagcagcggctggggcgagctggagccccagattgatggccagacctgggccgagcgggccctgcgggagaatgaaagacatgccttcacctgccgggtggccggcggccctggcaccccccggctggcctggtacctggatggccagctgcaggaggccagcaccagccggctgctgtctgtgggcggggaggccttcagcggcggcaccagcaccttcaccgtgacagcccaccgggcccagcacgagctgaactgcagcctgcaggaccccaggagcggccgcagcgccaatgccagcgtcatcctgaatgtgcagttcaagccagagatcgcccaggtgggcgccaagtaccaggaggcccagggccctggcctgctggtggtgctgtttgccctggtgcgggccaaccccccagccaacgtgacctggattgaccaggacggccctgtgacagtgaacaccagtgacttcctggtgctggatgcccagaactacccctggctgaccaaccacacagtgcagctgcagctgcggagcctggcccacaacctgtctgtggtggccaccaatgatgtgggcgtgaccagcgccagcctgcctgcccctggccccagccgccaccccagcctcatcagcagtgacagcaacaacctgaagctgaacaacgtgcggctgccccgggagaacatgagcctgcccagcaacctgcagctgaatgacctgaccccagacagcagagctgtgaagccagctgaccggcagatggcccagaacaacagcaggcctgagctgctggaccctgagcccggcggcctgctgaccagccagggcttcatccggctgcctgtgctgggctacatctacagagtgtcctctgtgtccagtgatgagatctggctgtag

SEQ ID NO: 42843 - DNA, 969 bp, Artificial Sequence; identical to SEQ ID NO: 42842
  Description of Artificial Sequence: Synthetic coding sequence

SEQ ID NO: 42844 - DNA, 660 bp, Artificial Sequence
  Description of Artificial Sequence: Synthetic coding sequence
atggctgctgaggaccgggagatgatggaggcccggggggccggggagagctgccccaccttccccaagatggtgcctggggacagcaagtctgagggcaagccccgggcctacctggaggccgagagccagaagccagacagcagctatgactacctggaggagatggaggcctgtgaagatggcggctgccagggccccctgaagagcctgagccccaagagctgccgggccaccaagggccaggccggagatggccccaagccagctgagctgccccccaccccaggcacagagaggaaccctgagatggagctggagaaggtgaggatggagtttgagctgacccggctgaagtacctgcacgagaagaaccagaggcagaggcagcacgaggtggtgatggagcagctgcagcgggagcggcagcacgaggtggtgatggagcagctgcagcaggaggccgcccccaggctcttcagcggcggcctgcagaacttcctgctgccccagaaccagtttgccatgttcctgtactgcttcatcttcatccacatcatctacgtgaccaaggagatggtgttcttcctgtttgccaagcactacctgttctgcatcgccgccatcctgctgtgcctgatcaagaccttctggagctag

SEQ ID NO: 42845 - DNA, 1320 bp, Artificial Sequence
  Description of Artificial Sequence: Synthetic coding sequence
atgggagaggcccccagccctgccccagccctgtgggactgggactacctggaccgctgctttgcccggcaccgggtgtgcatcagctttggcctgtggatctgtgccagcagctgctggattgctgcccacgccctgctgctgtacctgcgctgtgcccagaagccccggcaggaccagagcgccctgtgtgccgcctgctgcctgctgaccagcctgtgtgacacagtgggcgccctgctggcccggcagctgaccatccaggtgttcaccggggcctacctggccgccatcgacctggtgaacttcatgttcatcctcttccctgtgtgtggcagcaagttcaagagcaacagcgaccgggaggcccgggagaggaagagaagacggcagctgcgggcctctgtgtttgccctggccctgcccctgagcctgggcccctgctgggccctgtgggtggccgtgcccaaggccagcgccaccatccggggcccccagaggcggctgctggccagcctgctgcaggagaacacagagatcctgggctacctgctgggctctgtggccgccttcggctcctgggccagccgcatcccccccctgagccgcatctgccggggcaagaccttccccagcatccacctgtggacccggctgctgagcgccctggccggcctgctgtatgccagcgccatcgtggcccatgaccagcaccctgagtacctgctgcgggccaccccctggttcctgaccagcctgggccgggccgccctggacctggccatcatcttcctgagctgtgtgatgaagagcaagatgaggcaggccctgggctttgccaaggaggcccgggagagcccagacacccaggccctgctgacctgtgccgagaaggaggaggagaaccaggagaacctggactgggtgcccctgaccaccctgagccactgcaagagcctgcggaccatgacagccatcagccgctacatggagctgaccatcgagcctgtgcagcaggccggctgcagcgccacccggctgcctggagatggccagaccagcgctggagatgccagcctgcaggaccccccatcctacccacctgtgcaggtgatccgggcccgggtgagcagcggcagcagcagcgaggtgagcagcatcaacagcgacctggagcagaagtactgggaggccctgaacagcgagcagtgggaccctgaagatgtgaacctggagggcagcaaagaaaatgtggagctgctgggcagccaggtgcaccaggacagcgtgaggacagcccacctgagtgatgatgactag

SEQ ID NO: 42846 - DNA, 342 bp, Artificial Sequence
  Description of Artificial Sequence: Synthetic coding sequence
atgttcatcctcttccctgtgtgtggcagcaagttcaagagcaacagcgaccgggaggcccgggagaggaagagaagacggcagctgcgggcctctgtgtttgccctggccctgcccctgagcctgggcccctgctgggccctgtgggtggccgtgcccaaggccagcgccaccatccggggcccccagaggcggctgctggccagcctgctgcaggagaacacagagatcctgggctacctgctgggctctgtggccgccttcggctcctgggccagccgcatcccccccctgagcagaattgtgcggcctggggtgggcatgggcctgtgggtgacctag

SEQ ID NO: 42847 - DNA, 1287 bp, Artificial Sequence
  Description of Artificial Sequence: Synthetic coding sequence
atgggagaggcccccagccctgccccagccctgtgggactgggactacctggaccgctgctttgcccggcaccgggtgtgcatcagctttggcctgtggatctgtgccagcagctgctggattgctgcccacgccctgctgctgtacctgcgctgtgcccagaagccccggcaggaccagagcgccctgtgtgccgcctgctgcctgctgaccagcctgtgtgacacagtgggcgccctgctggcccggcagctgaccatccaggtgttcaccggggcctacctggccgccatcgacctggtgaacttcatgttcatcctcttccctgtgtgtggcagcaagttcaagagcaacagcgaccgggaggcccgggagaggaagagaagacggcagctgcgggcctctgtgtttgccctggccctgcccctgagcctgggcccctgctgggccctgtgggtggccgtgcccaaggccagcgccaccatccggggcccccagaggcggctgctggccagcctgctgcaggagaacacagagatcctgggctacctgctgggctctgtggccgccttcggctcctgggccagccgcatcccccccctgagccgcatctgccggggcaagaccttccccagcatccacctgtggacccggctgctgagcgccctggccggcctgctgtatgccagcgccatcgtggcccatgaccagcaccctgagtacctgctgcgggccaccccctggttcctgaccagcctgggccgggccgccctggacctggccatcatcttcctgagctgtgtgatgaagagcaagatgaggcaggccctgggctttgccaaggaggcccgggagagcccagacacccaggccctgctgacctgtgccgagaaggaggaggagaaccaggagaacctggactgggtgcccctgaccaccctgagccactgcaagagcctgcggaccatgacagccatcagccgctacatggagctgaccatcgagcctgtgcagcaggccggctgcagcgccacccggctgcctggagatggccagaccagcgctggagatgccagcctgcaggaccccccatcctacccacctgtgcaggtgatccgggcccgggtgagcagcggcagcagcagcgaggtgagcagcatcaacagcgacctggagtgggaccctgaagatgtgaacctggagggcagcaaagaaaatgtggagctgctgggcagccaggtgcaccaggacagcgtgaggacagcccacctgagtgatgatgactag

SEQ ID NO: 42848 - DNA, 1191 bp, Artificial Sequence
  Description of Artificial Sequence: Synthetic coding sequence
atgggagaggcccccagccctgccccagccctgtgggactgggactacctggaccgctgctttgcccggcaccgggtgtgcatcagctttggcctgtggatctgtgccagcagctgctggattgctgcccacgccctgctgctgtacctgcgctgtgcccagaagccccggcaggaccagagcgccctgtgtgccgcctgctgcctgctgaccagcctgtgtgacacagtgggcgccctgctggcccggcagctgaccatccaggtgttcaccggggcctacctggccgccatcgacctggtgaacttcatgttcatcctcttccctgtgtgtggcagcaagttcaagagcaacagcgaccgggaggcccgggagaggaagagaagacggcagctgcgggcctctgtgtttgccctggccctgcccctgagcctgggcccctgctgggccctgtgggtggccgtgcccaaggccagcgccaccatccggggcccccagaggcggctgctggccagcctgctgcaggagaacacagagatcctgggctacctgctgggctctgtggccgccttcggctcctgggccagccgcatcccccccctgagccgcatctgccggggcaagaccttccccagcatccacctgtggacccggctgctgagcgccctggccggcctgctgtatgccagcgccatcgtggcccatgaccagcaccctgagtacctgctgcgggccaccccctggttcctgaccagcctgggccgggccgccctggacctggccatcatcttcctgagctgtgtgatgaagagcaagatgaggcaggccctgggctttgccaaggaggcccgggagagcccagacacccaggccctgctgacctgtgccgagaaggaggaggagaaccaggagaacctggactgggtgcccctgaccaccctgagccactgcaagagcctgcggaccatgacagccatcagccgctacatggagctgaccatcgagcctgtgcagcaggccgctgtgcccccaggctgccaggtgactggaagaagagcccctgagatgaggccctgcaggacccccaggaggaccctgcccttccgcagcagcggccctggctgcctgcctgctgcccccctgcggagcccccccagcacccccacctggagcggcaccctgaagatgtag

SEQ ID NO: 42849 - DNA, 1428 bp, Artificial Sequence
  Description of Artificial Sequence: Synthetic coding sequence
atgggagaggcccccagccctgccccagccctgtgggactgggactacctggaccgctgctttgcccggcaccgggtgtgcatcagctttggcctgtggatctgtgccagcagctgctggattgctgcccacgccctgctgctgtacctgcgctgtgcccagaagccccggcaggaccagagcgccctgtgtgccgcctgctgcctgctgaccagcctgtgtgacacagtgggcgccctgctggcccggcagctgaccatccaggtgttcaccggggcctacctggccgccatcgacctggtgaacttcatgttcatcctcttccctgtgtgtggcagcaagttcaagagcaacagcgaccgggaggcccgggagaggaagagaagacggcagctgcgggcctctgtgtttgccctggccctgcccctgagcctgggcccctgctgggccctgtgggtggccgtgcccaaggccagcgccaccatccggggcccccagaggcggctgctggccagcctgctgcaggagaacacagagatcctgggctacctgctgggctctgtggccgccttcggctcctgggccagccgcatcccccccctgagccgcatcgcccccccacccaccctgggcatcaccacccagcacgagatctggaggggccagatgagcaagcccagccagagccccagccgcagccccagcggccactggagggctgctgcccagaggcaggtgctgggcacagagatgtgccggggcaagaccttccccagcatccacctgtggacccggctgctgagcgccctggccggcctgctgtatgccagcgccatcgtggcccatgaccagcaccctgagtacctgctgcgggccaccccctggttcctgaccagcctgggccgggccgccctggacctggccatcatcttcctgagctgtgtgatgaagagcaagatgaggcaggccctgggctttgccaaggaggcccgggagagcccagacacccaggccctgctgacctgtgccgagaaggaggaggagaaccaggagaacctggactgggtgcccctgaccaccctgagccactgcaagagcctgcggaccatgacagccatcagccgctacatggagctgaccatcgagcctgtgcagcaggccggctgcagcgccacccggctgcctggagatggccagaccagcgctggagatgccagcctgcaggacccccccagctacccacctgtgcaggtgatccgggcccgggtgagcagcggcagcagcagcgaggtgagcagcatcaacagcgacctggagtgggaccctgaagatgtgaacctggagggcagcaaagaaaatgtggagctgctgggcagccaggtgcaccaggacagcgtgaggacagcccacctgagtgatgatgactag

SEQ ID NO: 42850 - DNA, 1317 bp, Artificial Sequence
  Description of Artificial Sequence: Synthetic coding sequence
atgggagaggcccccagccctgccccagccctgtgggactgggactacctggaccgctgctttgcccggcaccgggtgtgcatcagctttggcctgtggatctgtgccagcagctgctggattgctgcccacgccctgctgctgtacctgcgctgtgcccagaagccccggcaggaccagagcgccctgtgtgccgcctgctgcctgctgaccagcctgtgtgacacagtgggcgccctgctggcccggcagctgaccatccaggtgttcaccggggcctacctggccgccatcgacctggtgaacttcatgttcatcctcttccctgtgtgtggcagcaagttcaagagcaacagcgaccgggaggcccgggagaggaagagaagacggcagctgcgggcctctgtgtttgccctggccctgcccctgagcctgggcccctgctgggccctgtgggtggccgtgcccaaggccagcgccaccatccggggcccccagaggcggctgctggccagcctgctgcaggagaacacagagatcctgggctacctgctgggctctgtggccgccttcggctcctgggccagccgcatcccccccctgagccgcatctgccggggcaagaccttccccagcatccacctgtggacccggctgctgagcgccctggccggcctgctgtatgccagcgccatcgtggcccatgaccagcaccctgagtacctgctgcgggccaccccctggttcctgaccagcctgggccgggccgccctggacctggccatcatcttcctgagctgtgtgatgaagagcaagatgaggcaggccctgggctttgccaaggaggcccgggagagcccagacacccaggccctgctgacctgtgccgagaaggaggaggagaaccaggagaacctggactgggtgcccctgaccaccctgagccactgcaagagcctgcggaccatgacagccatcagccgctacatggagctgaccatcgagcctgtgcagcaggccggctgcagcgccacccggctgcctggagatggccagaccagcgctggagatgccagcctgcaggaccccccatcctacccacctgtgcaggtgatccgggcccgggtgagcagcggcagcagcagcgaggtgagcagcatcaacagcgacctggagaagtactgggaggccctgaacagcgagcagtgggaccctgaagatgtgaacctggagggcagcaaagaaaatgtggagctgctgggcagccaggtgcaccaggacagcgtgaggacagcccacctgagtgatgatgactag

SEQ ID NO: 42851 - DNA, 477 bp, Artificial Sequence
  Description of Artificial Sequence: Synthetic coding sequence
atggccggcttcctggacaacttccgctggccagaatgtgagtgcatcgactggagcgagaggagaaatgctgtggcctctgtggtggccggcatcctcttcttcaccggctggtggatcatgattgatgctgctgtggtgtaccccaagccagagcagctgaaccacgccttccacacctgtggggtcttcagcaccctggccttcttcatgatcaatgctgtgtccaatgcccaggtgcggggggacagctatgaaagtggctgcctgggccgcactggagcccgggtgtggctgttcatcggcttcatgctgatgtttggcagcctgattgcctccatgtggatcctgtttggagcctacgtgacccagaacacagatgtgtacccaggcctggccgtgttcttccagaatgccctgatcttcttcagcaccctcatctacaagtttggccgcacagaggagctgtggacctag

SEQ ID NO: 42852 - DNA, 831 bp, Artificial Sequence
  Description of Artificial Sequence: Synthetic coding sequence
atgtaccgcatcagccagctgatgagcacccctgtggccagcagcagccggctggagcgggagtatgctggggagctgagccccacctgcatcttccccagcttcacctgtgacagcctggatggctaccacagctttgaatgtggcagcattgaccccctgaccggcagccactacacctgccgccgcagcccccggctgctgaccaacggctactacatctggacagaagattccttcctgtgtgacaaggatggcaacatcaccctgaaccccagccagacctctgtgatgtacaaggagaacctggtgtccaccagcaagtcctggctgcacggcagcatctttggagacatcaacagcagccccagcgaggacaactggctgaagggcacccggcggctggacacagaccactgcaatggaaatgctgatgacctggactgcagcagcctgacagatgactgggagagcggcaagatgaatgctgagagcgtcatcaccagcagcagcagccacatcatcagccagcccccaggcggcaacagccacagcctgagcctgcagagccagctgacagccagcgagcgcttccaggagaacagcagtgaccacagcgagacccggctgctgcaggaggtgttcttccaggccatcctgctggccgtgtgcctgatcatcagcgcctgtgcccgctggttcatgggagagatcctggcctctgtgttcacctgcagcctgatgatcaccgtggcctacgtgaagagcctcttcctgagcctggccagctacttcaagaccacagcctgtgccaggtttgtgaagatctag

SEQ ID NO: 42853 - DNA, 699 bp, Artificial Sequence
  Description of Artificial Sequence: Synthetic coding sequence
atgtaccgcatcagccagctgatgagcacccctgtggccagcagcagccggctggagcgggagtatgctggggagctgagccccacctgcatcttccccagcttcacctgtgacagcctggatggctaccacagctttgaatgtggcagcattgaccccctgaccggcagccactacacctgccgccgcagcccccggctgctgaccaacggctactacatctggacagaagattccttcctgtgtgacaaggatggcaacatcaccctgaaccccagccagacctctgtgatgtacaaggagaacctggtgcgcatcttcaggaagaagaagaggatctgccacagcttcagcagcctcttcaacctgagcaccagcaagtcctggctgcacggcagcatctttggagacatcaacagcagccccagcgaggacaactggctgaagggcacccggcggctggacacagaccactgcaatggaaatgagacccggctgctgcaggaggtgttcttccaggccatcctgctggccgtgtgcctgatcatcagcgcctgtgcccgctggttcatgggagagatcctggcctctgtgttcacctgcagcctgatgatcaccgtggcctacgtgaagagcctcttcctgagcctggccagctacttcaagaccacagcctgtgccaggtttgtgaagatctag

SEQ ID NO: 42854 - DNA, 300 bp, Artificial Sequence
  Description of Artificial Sequence: Synthetic coding sequence
atgtaccgcatcagccagctgatgagcacccctgtggccagcagcagccggctggagcgggagtatgctggggagctgagccccacctgcatcttccccagcttcacctgtgacagcctggatggctaccacagctttgaatgtggcagcattgaccccctgaccggcagccactacacctgccgccgcagcccccggctgctgaccaacggctactacatctggacagaagattccttcctgtgtgacaaggatggcaacatcaccctgaaccccagccagacctctgtgatgtactag

SEQ ID NO: 42855 - DNA, 279 bp, Artificial Sequence
  Description of Artificial Sequence: Synthetic coding sequence
atgtaccgcatcagccagctgatgagcacccctgtggccagcagcagccggctggagcgggagtatgctggggagctgagccccacctgcatcttccccagcttcacctgtgacagcctggatggctaccacagctttgaatgtggcagcattgaccccctgaccggcagccactacacctgccgccgcagcccccggctgctgaccaacggctactacatctggacagaagattccttcctgtgtgacaaggatggcaacatcaccctgaacccctag

SEQ ID NO: 42856 - DNA, 666 bp, Artificial Sequence
  Description of Artificial Sequence: Synthetic coding sequence
atgggcaccctggtggccaagctgctgctgcccaccctgagcagcctggccttcctgcccaccgtgtccattgctgccaagaggcgcttccacatggaggccatggtgtacctgttcaccctcttctttgtggccctgcaccacgcctgcaatggacctggcctgtctgtgctgtgcttcatgagacatgacatcctggagtacttctctgtgtatggaacagccctgtccatgtgggtgtccctgatggccctggccgactttgatgagcccaagaggagcacctttgtgatgtttggagtgctgaccatcgctgtgcgcatctaccatgaccgctggggctatggagtgtacagcggccccatcggcacagccatcctgatcatcgccgccaagtggctgcagaagatgaaggagaagaagggcctgtacccagacaagtctgtgtacacccagcagatcggccctggcctgtgcttcggggccctggccctgatgctgcgcttcttctttgaggactgggactacacctacgtgcacagcttctaccactgtgccctggccatgagctttgtgctgctgctgcccaaggtgaacaagaaggccggcagccctggcaccccagccaagctggactgcagcaccctgtgctgtgcctgtgtgtag

SEQ ID NO: 42857 - DNA, 555 bp, Artificial Sequence
  Description of Artificial Sequence: Synthetic coding sequence
atgtggaggctggccctgggcggcgtcttcctggccgccgcccaggcctgtgtgttctgccgcctgcctgcccatgacctgagcggccgcctggcccggctgtgcagccagatggaggcccggcagaaggaatgtggggccagcccagacttcagcgcctttgccctggatgaggtgtccatgaacaaggtgacagagaagacccaccgggtgctgcgggtgatggagatcaaggaggccgtgagcagcctgcccagctactggagctggctgaggaagaccaagctgcctgagtacacccgggaggccctgtgccccccagcctgccccctgcccctgctgagccctgctgggggcagcaccaccctgtacaactgcagcacctgcaagggcacagaggtgtcctgctggcccaggaagcgctgcttccctggcagccaggacctgtgggaggccaagatcctgctgctgagcatctttggagccttcctgctgctgggcgtgctgagcctgctggtggagagccaccacctgcaggccaagagcggcctgtag

SEQ ID NO: 42858 - DNA, 612 bp, Artificial Sequence
  Description of Artificial Sequence: Synthetic coding sequence
atgtggaggctggccctgggcggcgtcttcctggccgccgcccaggcctgtgtgttctgccgcctgcctgcccatgacctgagcggccgcctggcccggctgtgcagccagatggaggcccggcagaaggaatgtggggccagcccagacttcagcgcctttgccctggatgaggtgtccatgaacaaggtgacagagaagacccaccgggtgctgcgggtgatggagatcaaggaggccgtgagcagcctgcccagctactggagctggctgaggaagaccaagctgcctgagtacacccgggaggccctgtgccccccagcctgccggggcagcaccaccctgtacaactgcagcacctgcaagggcacagaggtgtcctgctggcccaggaagcgctgcttccctggcagcctgggcagccaggacagcgcccccctgcacctgcgctccttccctgccagcggctgcagcgagcccccaggaggagtgcccccaccacccagcaagaagtggctggtgaagaccctgaagaccagccagcccccagccctgcggggcatgcacagccagctgccccaccccctggagggcaaccagagcgccccctag

SEQ ID NO: 42859 - DNA, 1755 bp, Artificial Sequence
  Description of Artificial Sequence: Synthetic coding sequence
atgcctggccgcacctgggagctgtgcctgctgctgctgctgggcctgggcctgggcagccaggaggccctgcccccaccctgtgagagcgagatctactgccacggggagctgctgaaccaggtgcagatggccaagctgtaccaggatgacaagcagtttgtggacatgcccctgagcatcgcccctgagcaggtgctgcagaccttcacagagctgagccgggaccacaaccacagcatcccccgggagcagctgcaggcctttgtgcatgagcacttccaggccaagggccaggagctgcagccctggaccccagctgactggaaggacagcccccagttcctgcagaagatcagtgatgccaagctgcgggcctgggccggccagctgcaccagctgtggaagaagctgggcaagaagatgaagccagaggtgctgagccaccctgagcgcttcagcctcatctacagcgagcaccccttcatcgtgcctgggggccgctttgtggagttctactactgggacagctactgggtgatggagggcctgctgctgtctgagatggccgagaccgtgaagggcatgctgcagaacttcctggacctggtgaagacctacggccacgtgcccaacggcggccgggtgtactacctgcagaggagccagccccccctgctgaccctgatgatggactgctacctgacccacaccaatgacacagccttcctgcaggagaacatcgagaccctggccctggagctggacttctggaccaagaacagaacagtgtctgtgtccctggagggcaagaactacctgctgaaccgctactacgtgccctacggcggccccaggcctgagagctacagcaaggatgtggagctggccgacaccctgcctgagggggaccgggaggccctgtgggccgagctgaaggccggggctgagagcggctgggacttcagcagccgctggctgattggaggccccaaccccaacagcctgagcggcatccgcaccagcaagctggtgcctgtggacctgaatgccttcctgtgccaggccgaggagctgatgagcaacttctacagccggctggccggaaatgacagccaggccaccaagtaccgcatcctgcggagccagaggctggccgccctgaacacagtgctgtgggatgagcagacaggagcctggtttgattatgacctggagaagaagaagaagaaccgggagttctaccccagcaacctgacccccctgtgggccggctgcttcagtgaccccggggtggccgacaaggccctgaagtacctggaggacaaccgcatcctgacctaccagtatggcatccccaccagcctgcagaagacaggccagcagtgggacttccccaatgcctgggcccccctgcaggacctggtgatccggggcctggccaaggcccccctgcggcgggcccaggaggtggccttccagctggcccagaactggatccgcaccaactttgatgtgtacagccagaagagcgccatgtatgagaagtatgatgtgtccaatggaggccagcccggcggcggcggggagtatgaggtgcaggagggcttcggctggaccaatggagtggtgctgatgctgctggacagatatggagaccggctgaccagcggggccaagctggccttcctggagccccactgcctggccgccaccctgctgcccagcctgctgctgagcctgctgccctggtag

SEQ ID NO: 42860 - DNA, 2715 bp, Artificial Sequence
  Description of Artificial Sequence: Synthetic coding sequence
atgccccagctgctgagaaatgtgctgtgtgtgattgagaccttccacaagtatgccagcgaggacagcaatggagccaccctgaccggccgggagctgaagcagctgatccagggcgagtttggagacttcttccagccctgtgtgctgcatgctgtggagaagaacagcaacctgctgaacatcgacagcaatggcatcatcagctttgatgaatttgtgctggccatcttcaacctgctgaacctgtgctacctggacatcaagagcctgctgagcagcgagctgcggcaggtgaccaagccagagaaggagaagctggatgatgtggatgtgcaggccaccactggagatggccagtggacagtgggcaccagccccacccaggagaagaggatgctgcccagcggcatggccagcagcagccagctgatccctgaggagagcggggctgtgggcaacaacagagtggacccctggagggaggccaagacccacaacttccctggagaggccagcgagcacaatgaccccaagaacaagcacctggagggagatgagcagagccaggaggtggcccaggacatccagaccacagaggacaatgaaggccagctgaagaccaacaagcccatggccggcagcaagaagaccagcagccccacagagaggaagggccaggacaaggagatcagccaggagggagatgagcccgcccgggagcagagcgtgtccaagatccgggaccagtttggagagcaggagggcaacctggccacccagagcagcccccccaaggaggccacccagaggccctgtgaggaccaggaggtgaggacagagaaggagaagcacagcaacatccaggagccccccctgcagcgggaggatgagcccagcagccagcacgccgacctgcctgagcaggccgccgcccggagccccagccagacccagaagagcacagacagcaaggatgtgtgcaggatgtttgacacccaggagcccgggaaggatgctgaccagaccccagccaagaccaagaacctgggggagcctgaggactatggccgcaccagcgagacccaggagaaggaatgtgagaccaaggacctgcctgtgcagtatggcagcagaaatggcagcgagaccagtgacatgagagatgagaggaaggagcggcggggccctgaggcccacggcacagctggccagaaggagcgggacaggaagacccggcccctggtgctggagacccagacccaggacggcaagtaccaggagctgcagggcctgagcaagagcaaggatgctgagaagggcagcgagacccagtacctgagcagcgagggcggggaccagacccaccctgagctggagggcacagctgtgtctggagaggaggccgagcacaccaaggagggcacagctgaggcctttgtgaacagcaagaatgccccagctgctgagaggaccctgggcgcccgggagaggacccaggacctggcccccctggagaagcagagcgtgggggagaacaccagggtgaccaagacccatgaccagcctgtggaggaggaggatggctaccagggagaagatcctgagagccccttcacccagagtgatgagggcagcagcgagacccccaacagcctggccagcgaggagggcaacagcagcagcgagaccggggagctgcctgtgcagggcgacagccagagccagggcgaccagcacggggagagcgtgcagggcggccacaacaacaacccagacacccagaggcagggcaccccaggagagaagaacagagccctggaggccgtggtgcctgctgtgagaggagaagatgtgcagctgacagaggaccaggagcagcctgcccggggggagcacaagaaccagggccctggcaccaagggccctggagctgctgtggagcccaacggccaccctgaggcccaggagagcacagctggagatgaaaataggaagagcctggagattgagatcactggagccctggatgaggacttcacagaccagctgagcctgatgcagctgcccgggaagggggacagcagaaatgagctgaaggtgcagggccccagcagcaaggaggagaagggccgggccacagaggcccagaacaccctgctggagagcctggatgaggacaacagcgccagcctgaagatccagctggagaccaaggagcctgtgaccagcgaggaggaggatgagagcccccaggagctggccggggagggcggggaccagaagagccctgccaagaaggagcacaacagctctgtgccctggagcagcctggagaagcagatgcagagggaccaggagccctgcagcgtggagagaggagctgtgtacagcagccccctgtaccagtacctgcaggagaagatcctgcagcagaccaacgtgacccaggaggagcaccagaagcaggtgcagatcgcccaggccagcggccctgagctgtgcagcgtgtccctgaccagcgagatcagtgactgcagcgtcttcttcaactacagccaggccagccagccctacacccggggcctgcccctggatgagagccctgctggggcccaggagaccccagccccccaggccctggaggacaagcagggccacccccagcgggagcggctggtgctgcagcgggaggccagcaccaccaagcagtag

SEQ ID NO: 42861 - DNA, 1248 bp, Artificial Sequence
  Description of Artificial Sequence: Synthetic coding sequence
gagatcgccaagcagctgcaggccgtgaagaggaagatcagagatgagagcctgtgcccccagcaccacgaggccctgagcctcttctgctatgaggaccaggaggccgtgtgcctgatctgtgccatcagccacacccaccgggcccacacagtggtgcccctggatgatgccacccaggagtacaaggagaagctgcagaagtgcctggagcccctggagcagaagctgcaggagatcacccgctgcaagagcagcgaggagaagaagccaggagagctgaagaggctggtggagagccggcggcagcagatcctgcgggagtttgaggagctgcaccggcggctggatgaggagcagcaggtgctgctgagccggctggaggaggaggagcaggacatcctgcagaggctgcgggagaatgctgcccacctgggggacaagagaagagacctggcccacctggccgctgaggtggagggcaagtgcctgcagagcggctttgagatgctgaaggatgtgaagagcaccctggagaagtgtgagaaggtgaagaccatggaggtgacctctgtgtccattgagctggagaagaacttcagcaacttcccccggcagtactttgccctgaggaagatcctgaagcagctgattgctgatgtgaccctggaccctgagacagcccaccccaacctggtgctgtctgaggacaggaagtctgtgaagtttgtggagacccggctgcgggacctgcctgacaccccccggcgcttcaccttctacccctgtgtgctggccacagagggcttcaccagcggccgccactactgggaggtggaggccgcccactgtgtgctggcccaggaccctgagaaccaggccctggcccgcttctactgctacacagagaggaccatcgccaagaggctggtgctgcggcgggaccccagcgtgaagaggaccctgtgccggggctgcagcagcctgctggtgcccggcctgacctgcacccagaggcagaggcgctgccggggccagcgctggacagtgcagacctgcctgacctgccagaggagccagcgcttcctgaatgaccccggccacctgctgtggggagacaggcctgaggcccagctgggcagccaggccgacagcaagcccctgcagcccctgcccaacacagcccacagcatcagtgaccggctgcctgaggagaagatgcagacccagggcagcagcaaccagtag

SEQ ID NO: 42862 - DNA, 1602 bp, Artificial Sequence
  Description of Artificial Sequence: Synthetic coding sequence
atggaggagaagggcagcaagaggggcctggaggccgccggcaaggccggcctggccacagctggccctggcctgctgcccaggaagcccccaggcctggccgccggccctgctggcacctacggcaaggctgtgtccccaccacccagcccccgggccagccctgtggccgccctgaaggccaaggtgatccagaagctggaggatgtgtccaagcccccagcctatgcctacccagccacccccagcagccaccccaccagccccccaccagccagccccccacccaccccaggcatcaccaggaaggaggaggccccagaaaatgtggtggagaagaaggacctggagctggagaaggaggcccccagccccttccaggccctcttcagtgacatccccccacgctaccccttccaggccctgcccccccactacggccggccctaccccttcctgctgcagcccacagctgctgctgatgctgatggcctggccccagatgtgcccctgcctgcagatggccctgagcggctggccctgagccctgaggacaagcccatccggctgagccccagcaagatcacagagcccctgcgggagggccctgaggaggagcccctggccgagcgggaggtgaaggccgaggtggaggacatggatgagggccccacagagctgccccccctggagagccccctgcccctgcctgctgctgaggccatggccacccccagccctgctgggggctgcggcggcggcctgctggaggcccaggccctgagcgccaccggccagagctgtgccgagcccagtgaatgtcctgactttgtggagggccctgagccccgggtggacagccctggccgcacagagccctgcacagctgccctggacctgggcgtgcagctgaccccagagaccctggtggaggccaaggaggagcctgtggaggtgcctgtggccgtgcctgtggtggaggccgtgcctgaggagggcctggcccaggtggcccccagcgagagccagcccaccctggagatgtctgactgtgatgtgcctgctggggagggccagtgccccagcctggagccccaggaggccgtgcctgtgctgggcagcacctgcttcctggaggaggccagcagtgaccagttcctgcccagcctggaggaccccctggccggcatgaatgccctggccgctgctgctgagctgccccaggcccggcccctgcccagccctggagctgctggggcccaggccctggagaagctggaggccgctgagagcctggtgctggagcagagcttcctgcacggcatcaccctgctgtctgaaattgctgagctggagctggagaggaggagccccccccagggcctgcccccctgcatgggccagggcagccccatgcctgctggcctgcctgactgtgcccggggccctgcccccaccctgagcggctggccccggctgggggagcagagccgggtgggcctgcagcccggggtgtctgtgaagggcacccgctggaggggccctggcactggaccaccctggagcaagcccagccactacaggaagccccagtggtgctag

SEQ ID NO: 42863 - DNA, 8907 bp, Artificial Sequence
  Description of Artificial Sequence: Synthetic coding sequence
atggatggccgggactttggcccccagaggtctgtgcacggccccccaccacccctgctgagcggcctggccatggacagccaccgggtgggcgccgccacagctggccgcctgcctgccagcggcctgcccggccccctgcccccaggcaagtacatggccggcctgaacctgcacccccaccctggagaggccttcctgggcagctttgtggccagcggcatgggccccagcgccagcagccacggcagccctgtgcccctgcccagcgacctgtccttccgcagccccacccccagcaacctgcccatggtgcagctgtgggccgcccacgcccacgagggcttcagccacctgcccagcggcctgtaccccagctacctgcacctgaaccacctggagccccccagcagcggcagccccctgctgagccagctgggccagcccagcatctttgacacccagaagggccagggccctggaggagatggcttctacctgcccacagctggggcccctggcagcctgcacagccacgcccccagcgcccggacccctgggggcggccacagcagcggggccccagccaagggcagcagcagcagagatggccctgccaaggagcgggccggccggggcggggagcccccacccctgtttgggaagaaggacccccgggcccggggggaggaggccagcggcccccggggcgtggtggacctgacccaggaggcccgggcagagggccggcaggaccggggccccccccggctggccgagcggctgagccccttcctggccgagagcaagaccaagaatgctgccctgcagcccagcgtgctgaccatgtgcaatggaggagctggagatgtgggcctgcctgccctggtggccgaggccggccggggcggggccaaggaggccgcccggcaggatgagggcgcccggctgctgcggaggacagagaccctgctgcccggcccccggccctgccccagccccctgcccccacctccagccccacccaagggccccccagcccccccagctgccaccccagctggggtgtacaccgtcttccgggagcagggccgggagcaccgggtggtggcccccacctttgtgcccagcgtggaggcctttgatgagaggcctggccccatccagatcgccagccaggccagagatgcccgggcccgggagcgggaggccggccggcctggggtgctgcaggcccctcctggcagcccccggcccctggacaggcctgagggcctgcgggagaagaacagcgtcatccgcagcctgaagaggcctcctccagcagatgcccccaccgtgcgggccacccgggccagcccagacccccgggcctacgtgcctgccaaggagctgctgaagccagaggccgacccccggccctgtgagcgggccccccggggccctgctggccctgctgcccagcaggccgccaagctgtttggcctggagcccggccggcccccacccaccggccctgagcacaagtggaagccctttgagctgggcaactttgctgccacccagatggctgtgctggccgcccagcaccaccacagcagagctgaggaggaggccgctgtggtggccgccagcagcagcaagaaggcctacctggaccccggggctgtgctgcccaggtctgctgccacctgtggccggcctgtggccgacatgcacagcgctgcccacggcagcggggaggccagcgccatgcagagcctcatcaagtacagcggcagctttgccagagatgctgtggccgtgcggcctgggggctgcggcaagaagagcccctttggaggcctgggcaccatgaagccagagcccgcccccaccagcgctggggccagccgggcccaggcccggctgccccacagcggcggccctgctgctgggggcggccggcagctgaagagggaccctgagaggcctgagagcgccaaggccttcggccgggagggcagcggggcccagggcgaggccgaggtgcgccacccccctgtgggcattgctgtggccgtggcccggcagaaggacagcggcggcagcggccgcctgggccctggcctggtggaccaggagaggagcctgagcctgagcaatgtgaagggccacggccgggcagatgaggactgtgtggatgaccgggcccggcaccgggaggagcggctgctgggcgcccggctggaccgggaccaggagaagctgctgcgggagagcaaggagctggccgacctggcccggctgcaccccaccagctgtgccccaaatggcctgaaccccaacctgatggtgactggaggccctgccctggccggcagcggccgctggagcgctgaccctgctgcccacctggccacccacccctggctgcccaggtctggaaatgcctccatgtggctggccggccacccctacggcctgggcccccccagcctgcaccagggcatggccccagccttccccccaggcctgggcggcagcctgcccagcgcctaccagtttgtgcgggacccccagagcggccagctggtggtgatccccagcgaccacctgccccactttgctgagctgatggagcgggccaccgtgccccccctgtggccagccctgtacccacctggccgcagccccctgcaccacgcccagcagctgcagctgttcagccagcagcacttcctgcggcagcaggagttcctgtacctgcagcagcaggccgcccaggccctggagctgcagaggtctgcccagctggtgcaggagcggctgaaggcccaggagcacagagctgagatggaggagaagggcagcaagaggggcctggaggccgccggcaaggccggcctggccacagctggccctggcctgctgcccaggaagcccccaggcctggccgccggccctgctggcacctacggcaaggctgtgagccccccacccagcccccgggccagccctgtggccgccctgaaggccaaggtgatccagaagctggaggatgtgtccaagcccccagcctatgcctacccagccacccccagcagccaccccaccagccccccaccagccagccccccacccaccccaggcatcaccaggaaggaggaggccccagaaaatgtggtggagaagaaggacctggagctggagaaggaggcccccagccccttccaggccctcttcagtgacatccccccacgctaccccttccaggccctgcccccccactacggccggccctaccccttcctgctgcagcccacagctgctgctgatgctgatggcctggccccagatgtgcccctgcctgcagatggccctgagcggctggccctgagccctgaggacaagcccatccggctgagccccagcaagatcacagagcccctgcgggagggccctgaggaggagcccctggccgagcgggaggtgaaggccgaggtggaggacatggatgagggccccacagagctgccccccctggagagccccctgcccctgcctgctgctgaggccatggccacccccagccctgctgggggctgcggcggcggcctgctggaggcccaggccctgagcgccaccggccagagctgtgccgagcccagcgagtgcccagactttgtggagggccctgagccccgggtggacagccctggccgcacagagccctgcacagctgccctggacctgggcgtgcagctgaccccagagaccctggtggaggccaaggaggagcctgtggaggtgcctgtggccgtgcctgtggtggaggccgtgcctgaggagggcctggcccaggtggcccccagcgagagccagcccaccctggagatgtctgactgtgatgtgcctgctggggagggccagtgccccagcctggagccccaggaggccgtgcctgtgctgggcagcacctgcttcctggaggaggccagcagtgaccagttcctgcccagcctggaggaccccctggccggcatgaatgccctggccgctgctgctgagctgccccaggcccggcccctgcccagccctggagctgctggggcccaggccctggagaagctggaggccgctgagagcctggtgctggagcagagcttcctgcacggcatcaccctgctgtctgaaattgctgagctggagctggagcggcgcagccaggagatgggcggcgctgagcgggccctggtggcccggcccagcctggagagcctgctggccgccggcagccacatgctgcgggaggtgctggatggccctgtggtggaccccctgaagaacctgcggctgccccgggagctgaagcccaacaagaagtacagctggatgaggaagaaggaggagaggatgtatgccatgaagagcagcctggaggacatggatgccctggagctggacttcaggatgaggctggccgaggtgcagaggcagtacaaggagaagcagcgggagctggtgaagctgcagaggagaagagacagtgaagatagaagagaggagccccacaggagcctggcccggcggggccctggccggcccaggaagaggacccacgcccccagcgccctgagcccccccaggaagaggggcaagagcggccacagcagcggcaagctgagcagcaagagcctgctgaccagtgatgattatgagctgggcgccggcatcaggaagaggcacaagggcagcgaggaggagcatgatgccctgattggcatgggcaaggcccggggcaggaaccagacctgggatgagcacgaggccagcagtgacttcatcagccagctgaagatcaagaagaagaagatggccagtgaccaggagcagctggccagcaagctggacaaggccctgagcctgaccaagcaggacaagctgaagagccccttcaagttcagtgacagcgctgggggcaagagcaagaccagcggcggctgcggccgctacctgaccccctatgacagcctgctgggcaagaacaggaaggccctggccaagggcctgggcctgagcctgaagagcagccgggagggcaagcacaagagagctgccaagaccaggaagatggaggtgggcttcaaggcccggggccagcccaagagcgcccacagcccctttgccagcgaggtgagcagctacagctacaacacagattctgaagaagatgaggagttcctgaaggatgagtggccagcccagggccccagcagcagcaagctgacccccagcctgctgtgcagcatggtggccaagaacagcaaggccgccggcggccccaagctgaccaagaggggcctggccgcccccaggaccctgaagcccaagccagccaccagcaggaagcagcccttctgcctgctgctgcgggaggccgaggcccggagcagcttcagtgacagcagcgaggagagctttgaccaggatgagagcagcgaggaggaggatgaggaggaggagctggaggaggaggatgaggccagcggcggcggctaccgcctgggcgcccgggagcgggccctgagccctggcctggaggagagcggcctgggcctgctggccaggtttgctgccagcgccctgcccagccccaccgtgggccccagcctgtctgtggtgcagctggaggccaagcagaaggccaggaagaaggaggagcggcagagcctgctgggcacagaatttgagtacacagattctgagagcgaggtgaaggtgaggaagaggagccctgctggcctgctgcggcccaagaagggcctgggggagcccggccccagcctggccgcccccacccctggggcccggggccctgaccccagcagcccagacaaggccaagctggccgtggagaagggcaggaaggccaggaagctgcggggccccaaggagcccggctttgaggccggccctgaggccagtgatgatgacctgtggaccaggagaagaagtgagcgcatcttcctgcatgatgccagcgctgctgccccagcccctgtgtccacagccccagccaccaagaccagccgctgtgccaagggcggccccctgagccccaggaaggatgctggccgggccaaggacaggaaggaccccaggaagaagaagaagggcaaggaggccggccctggggccggcctgcccccaccccgggccccagccctgcccagcgaggcccgggccccccacgccagcagcctgacagctgccaagaggagcaaggccaaggccaagggcaaggaggtgaagaaggagaacagaggcaagggcggcgctgtgtccaagctgatggagagcatggctgctgaagaagattttgagcccaaccaggacagcagcttctctgaagatgagcacctgccccggggcggcgctgtggagcggcccctgaccccagcccccaggagctgcatcatcgacaaggatgagctgaaggatggcctgcgggtgctgatccccatggatgacaagctgctgtatgccggccacgtgcagacagtgcacagcccagacatctacagagtggtggtggagggggagcggggcaaccggccccacatctactgcctggagcagctgctgcaggaggccatcattgatgtgcggcctgccagcacccgcttcctgccccagggcaccagaattgctgcctactggagccagcagtaccgctgcctgtacccaggcaccgtggtgcggggcctgctggacctggaggatgatggagacctgatcaccgtggagtttgatgatggagacaccggccgcatccccctgagccacatccggctgctgcccccagactacaagatccagtgtgccgagcccagccctgccctgctggtgcccagcgccaagaggaggagcaggaagaccagcaaggacacaggagagggcaaggatggcggcacagctggcagcgaggagcccggggccaaggcccggggccggggcaggaagcccagcgccaaggccaagggcggccgggccgccaccctggaggagggcaaccccacagatgaggtgcccagcacccccctggccctggagcccagcagcaccccaggcagcaagaagagccccccagagcctgtggacaagagggccaaggcccccaaggcccggcctgccccaccccagcccagccctgcccccccagccttcaccagctgcccagcccctgagccctttgctgagctgcctgccccagccaccagcctggccccagcccccctcatcaccatgcctgccacccggcccaagcccaagaaggcccgggctgctgaggagagcggggccaagggcccccggcggcctggagaggaggccgagctgctggtgaagctggaccacgagggcgtgaccagccccaagagcaagaaggccaaggaggccctgctgctgagagaagatcctggagctgggggctggcaggagcccaagagcctgctgagcctgggcagctacccacctgctgctggcagcagcgagcccaaggccccctggcccaaggccacagatggagacctggcccaggagcccggccctggcctgacctttgaggacagcggcaaccccaagagcccagacaaggcccaggccgagcaggatggagctgaggagagcgagagcagcagcagcagcagcagcggcagcagcagcagcagcagcagcagcagcagcagcggcagcgagacagaaggagaggaggagggggacaagaatggagatggcggctgcggcactggaggcaggaactgcagcgctgccagcagcagagctgccagccctgccagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcaccacagatgaggacagcagctgcagcagtgatgatgaagctgccccagcccccacagctggccccagcgcccaggccgccctgcccaccaaggccaccaagcaggccggcaaggcccggcccagcgcccacagccctgggaagaagaccccagccccccagccccaggcccccccaccccagcccacccagcccctgcagcccaaggcccaggccggggccaagagccggcccaagaagcgggagggcgtgcacctgcccaccaccaaggagctggccaagaggcagaggctgcccagcgtggagaaccggcccaagattgctgccttcctgcctgcccggcagctgtggaagtggtttgggaagcccacccagaggcggggcatgaagggcaaggccaggaagctgttctacaaggccatcgtgcggggcaaggagatgatcagaattggagactgtgctgtgttcctgtctgctggccggcccaacctgccctacatcggccgcatccagagcatgtgggagagctggggcaacaacatggtggtgcgggtgaagtggttctaccaccctgaggagaccagccctgggaagcagttccaccagggccagcactgggaccagaagagcagccgcagcctgcctgctgccctgcgggtgagcagccagaggaaggacttcatggagcgggccctgtaccagagcagccacgtggatgaaaatgatgtgcagacagtgagccacaagtgcctggtggtgggcctggagcagtatgagcagatgctgaagaccaagaagtaccaggacagcgagggcctgtactacctggccggcacctatgagcccaccaccggcatgatcttcagcacagatggagtgcctgtgctgtgctag

SEQ ID NO: 42864 - DNA, 3939 bp, Artificial Sequence
  Description of Artificial Sequence: Synthetic coding sequence
atggaggagaagggcagcaagaggggcctggaggccgccggcaaggccggcctggccacagctggccctggcctgctgcccaggaagcccccaggcctggccgccggccctgctggcacctacggcaaggctgtgtccccaccacccagcccccgggccagccctgtggccgccctgaaggccaaggtgatccagaagctggaggatgtgtccaagcccccagcctatgcctacccagccacccccagcagccaccccaccagccccccaccagccagccccccacccaccccaggcatcaccaggaaggaggaggccccagaaaatgtggtggagaagaaggacctggagctggagaaggaggcccccagccccttccaggccctcttcagtgacatccccccacgctaccccttccaggccctgcccccccactacggccggccctaccccttcctgctgcagcccacagctgctgctgatgctgatggcctggccccagatgtgcccctgcctgcagatggccctgagcggctggccctgagccctgaggacaagcccatccggctgagccccagcaagatcacagagcccctgcgggagggccctgaggaggagcccctggccgagcgggaggtgaaggccgaggtggaggacatggatgagggccccacagagctgccccccctggagagccccctgcccctgcctgctgctgaggccatggccacccccagccctgctgggggctgcggcggcggcctgctggaggcccaggccctgagcgccaccggccagagctgtgccgagcccagtgaatgtcctgactttgtggagggccctgagccccgggtggacagccctggccgcacagagccctgcacagctgccctggacctgggcgtgcagctgaccccagagaccctggtggaggccaaggaggagcctgtggaggtgcctgtggccgtgcctgtggtggaggccgtgcctgaggagggcctggcccaggtggcccccagcgagagccagcccaccctggagatgtctgactgtgatgtgcctgctggggagggccagtgccccagcctggagccccaggaggccgtgcctgtgctgggcagcacctgcttcctggaggaggccagcagtgaccagttcctgcccagcctggaggaccccctggccggcatgaatgccctggccgctgctgctgagctgccccaggcccggcccctgcccagccctggagctgctggggcccaggccctggagaagctggaggccgctgagagcctggtgctggagcagagcttcctgcacggcatcaccctgctgtctgaaattgctgagctggagctggagaggaggagccaggagatgggcggcgctgagcgggccctggtggcccggcccagcctggagagcctgctggccgccggcagccacatgctgcgggaggtgctggatggccctgtggtggaccccctgaagaacctgcggctgccccgggagctgaagcccaacaagaagtacagctggatgaggaagaaggaggagaggatgtatgccatgaagagcagcctggaggacatggatgccctggagctggacttcaggatgaggctggccgaggtgcagaggcagtacaaggagaagcagcgggagctggtgaagctgcagaggcggcgggacagcgaggaccggcgggaggagccccacaggagcctggcccggcggggccctggccggcccaggaagaggacccacgcccccagcgccctgagcccccccaggaagaggggcaagagcggccacagcagcggcaagctgagcagcaagagcctgctgaccagtgatgattatgagctgggcgccggcatcaggaagaggcacaagggcagcgaggaggagcatgatgccctgattggcatgggcaaggcccggggcaggaaccagacctgggatgaacatgaggccagcagtgacttcatcagccagctgaagatcaagaagaagaagatggccagtgaccaggagcagctggccagcaagctggacaaggccctgagcctgaccaagcaggacaagctgaagagccccttcaagttcagtgacagcgctgggggcaagagcaagaccagcggcggctgcggccgctacctgaccccctatgacagcctgctgggcaagaacaggaaggccctggccaagggcctgggcctgagcctgaagagcagccgggagggcaagcacaagagagctgccaagaccaggaagatggaggtgggcttcaaggcccggggccagcccaagagcgcccacagcccctttgccagcgaggtgtcctcctacagctacaacacagacagcgaggaggatgaggagttcctgaaggatgagtggccagcccagggccccagcagcagcaagctgacccccagcctgctgtgcagcatggtggccaagaacagcaaggctgctgggggccccaagctgaccaagaggggcctggccgcccccaggaccctgaagcccaagccagccaccagcaggaagcagcccttctgcctgctgctgcgggaggccgaggcccggagcagcttcagtgacagcagcgaggagagctttgaccaggatgagagcagcgaggaggaggatgaggaggaggagctggaggaggaggatgaggccagcggcggcggctaccgcctgggcgcccgggagcgggccctgagccctggcctggaggagagcggcctgggcctgctggccaggtttgctgccagcgccctgcccagccccaccgtgggccccagcctgtctgtggtgcagctggaggccaagcagaaggccaggaagaaggaggagcggcagagcctgctgggcacagaatttgagtacacagacagcgagagcgaggtgaaggtgaggaagaggagccctgctggcctgctgcggcccaagaagggcctgggggagcccggccccagcctggccgcccccacccctggggcccggggccctgaccccagcagcccagacaaggccaagctggccgtggagaagggcaggaaggccaggaagctgcggggccccaaggagcccggctttgaagctggccctgaggccagtgatgatgacctgtggacccggcggcgctctgagcgcatcttcctgcatgatgccagcgctgctgccccagcccctgtgtccacagccccagccaccaagaccagccgctgtgccaagggcggccccctgagccccaggaaggatgctggccgggccaaggacaggaaggaccccaggaagaagaagaagggcaaggaggccggccctggagctggcctgcccccaccccgggccccagccctgcccagcgaggcccgggcccctcctcctcctcctcctcctcctccaccccacccccccctgcccccaccacccctgcccccaccacccctgcccctgcggctgccccccctgcccccaccacccctgccccggccccaccccccacctcctccacccctgccccccctgctgcccccaccccagaccaggaccctgcctgctgcccggaccatgaggcagcccccaccaccccggctggccctgcccaggagaagaagaagccccccccggccccccagcaggcctgcccggcggggcccccggcccaccccccaggccaggagaagaccccggcccagcccccggcggctgctgcggagcccccacagcctgtgcagcccccggctgcggcccggccccagggctgacccccggcgggagcgggccagcaccagccccccacccaggtcctggcccagcggcagcgcctgccggccctggaggacaggccccaggagcccccccagctgccagcccggcagcagcggcagcggcagcgccagccccccatctggagtggcctag

SEQ ID NO: 42865 - DNA, 912 bp, Artificial Sequence
  Description of Artificial Sequence: Synthetic coding sequence
atggatggccgggactttggcccccagaggtctgtgcacggccccccaccacccctgctgagcggcctggccatggacagccaccgggtgggcgccgccacagctggccgcctgcctgccagcggcctgcccggccccctgcccccaggcaagtacatggccggcctgaacctgcacccccaccctgggaagtgcccagccccctgccccagcccccctgtgtttcctggccgcagcacccggcccggcccccctgtgcacagccggcccggcctgggggacagccccagcgtgggccacggcggggccggccgcctgggcagccagggctgggagaccccaggccctggggccaaggctgtggagagcgtggcccggctgggctacctgttccgctctgtgctgggcccccgggagcccaaggccggcgtggtggcccgggccactggagccatccccatccctggggccccagctgcccgggcctgggccggggtcttcaagatctgggccaggaaggagcagacaggccctgccccccgggagacccccctgcctgagctggagagcttctcctggcagaccctgctgctggccctggtgggccccccaggcttctgcagccagctgcaccacagccggcgggccggcagcctggccgtgacagagcggcggggcatgagagaatatgccggcggctgcggcagcacagtgaccccagccctgggcccctggccccggggcggcagagatgcccccttcttccctggccgcacagctgccctgggcacctgcacccctgtgggcggcagaagaccccggcccagcggcaccccctgcttccctgccaggaagagggtgcggcgctgtggccgggacacagagaccggccccagccgcagcaggacatag

SEQ ID NO: 42866 - DNA, 8907 bp, Artificial Sequence
  Description of Artificial Sequence: Synthetic coding sequence
atggatggccgggactttggcccccagaggtctgtgcacggccccccaccacccctgctgagcggcctggccatggacagccaccgggtgggcgccgccacagctggccgcctgcctgccagcggcctgcccggccccctgcccccaggcaagtacatggccggcctgaacctgcacccccaccctggagaggccttcctgggcagctttgtggccagcggcatgggccccagcgccagcagccacggcagccctgtgcccctgcccagcgacctgtccttccgcagccccacccccagcaacctgcccatggtgcagctgtgggccgcccacgcccacgagggcttcagccacctgcccagcggcctgtaccccagctacctgcacctgaaccacctggagccccccagcagcggcagccccctgctgagccagctgggccagcccagcatctttgacacccagaagggccagggccctggaggagatggcttctacctgcccacagctggggcccctggcagcctgcacagccacgcccccagcgcccggacccctgggggcggccacagcagcggggccccagccaagggcagcagcagcagagatggccctgccaaggagcgggccggccggggcggggagcccccacccctgtttgggaagaaggacccccgggcccggggggaggaggccagcggcccccggggcgtggtggacctgacccaggaggcccgggcagagggccggcaggaccggggccccccccggctggccgagcggctgagccccttcctggccgagagcaagaccaagaatgctgccctgcagcccagcgtgctgaccatgtgcaatggaggagctggagatgtgggcctgcctgccctggtggccgaggccggccggggcggggccaaggaggccgcccggcaggatgagggcgcccggctgctgcggaggacagagaccctgctgcccggcccccggccctgccccagccccctgcccccacctccagccccacccaagggccccccagcccccccagctgccaccccagctggggtgtacaccgtcttccgggagcagggccgggagcaccgggtggtggcccccacctttgtgcccagcgtggaggcctttgatgagaggcctggccccatccagatcgccagccaggccagagatgcccgggcccgggagcgggaggccggccggcctggggtgctgcaggcccctcctggcagcccccggcccctggacaggcctgagggcctgcgggagaagaacagcgtcatccgcagcctgaagaggcctcctccagcagatgcccccaccgtgcgggccacccgggccagcccagacccccgggcctacgtgcctgccaaggagctgctgaagccagaggccgacccccggccctgtgagcgggccccccggggccctgctggccctgctgcccagcaggccgccaagctgtttggcctggagcccggccggcccccacccaccggccctgagcacaagtggaagccctttgagctgggcaactttgctgccacccagatggctgtgctggccgcccagcaccaccacagcagagctgaggaggaggccgctgtggtggccgccagcagcagcaagaaggcctacctggaccccggggctgtgctgcccaggtctgctgccacctgtggccggcctgtggccgacatgcacagcgctgcccacggcagcggggaggccagcgccatgcagagcctcatcaagtacagcggcagctttgccagagatgctgtggccgtgcggcctgggggctgcggcaagaagagcccctttggaggcctgggcaccatgaagccagagcccgcccccaccagcgctggggccagccgggcccaggcccggctgccccacagcggcggccctgctgctgggggcggccggcagctgaagagggaccctgagaggcctgagagcgccaaggccttcggccgggagggcagcggggcccagggcgaggccgaggtgcgccacccccctgtgggcattgctgtggccgtggcccggcagaaggacagcggcggcagcggccgcctgggccctggcctggtggaccaggagaggagcctgagcctgagcaatgtgaagggccacggccgggcagatgaggactgtgtggatgaccgggcccggcaccgggaggagcggctgctgggcgcccggctggaccgggaccaggagaagctgctgcgggagagcaaggagctggccgacctggcccggctgcaccccaccagctgtgccccaaatggcctgaaccccaacctgatggtgactggaggccctgccctggccggcagcggccgctggagcgctgaccctgctgcccacctggccacccacccctggctgcccaggtctggaaatgcctccatgtggctggccggccacccctacggcctgggcccccccagcctgcaccagggcatggccccagccttccccccaggcctgggcggcagcctgcccagcgcctaccagtttgtgcgggacccccagagcggccagctggtggtgatccccagcgaccacctgccccactttgctgagctgatggagcgggccaccgtgccccccctgtggccagccctgtacccacctggccgcagccccctgcaccacgcccagcagctgcagctgttcagccagcagcacttcctgcggcagcaggagttcctgtacctgcagcagcaggccgcccaggccctggagctgcagaggtctgcccagctggtgcaggagcggctgaaggcccaggagcacagagctgagatggaggagaagggcagcaagaggggcctggaggccgccggcaaggccggcctggccacagctggccctggcctgctgcccaggaagcccccaggcctggccgccggccctgctggcacctacggcaaggctgtgagccccccacccagcccccgggccagccctgtggccgccctgaaggccaaggtgatccagaagctggaggatgtgtccaagcccccagcctatgcctacccagccacccccagcagccaccccaccagccccccaccagccagccccccacccaccccaggcatcaccaggaaggaggaggccccagaaaatgtggtggagaagaaggacctggagctggagaaggaggcccccagccccttccaggccctcttcagtgacatccccccacgctaccccttccaggccctgcccccccactacggccggccctaccccttcctgctgcagcccacagctgctgctgatgctgatggcctggccccagatgtgcccctgcctgcagatggccctgagcggctggccctgagccctgaggacaagcccatccggctgagccccagcaagatcacagagcccctgcgggagggccctgaggaggagcccctggccgagcgggaggtgaaggccgaggtggaggacatggatgagggccccacagagctgccccccctggagagccccctgcccctgcctgctgctgaggccatggccacccccagccctgctgggggctgcggcggcggcctgctggaggcccaggccctgagcgccaccggccagagctgtgccgagcccagcgagtgcccagactttgtggagggccctgagccccgggtggacagccctggccgcacagagccctgcacagctgccctggacctgggcgtgcagctgaccccagagaccctggtggaggccaaggaggagcctgtggaggtgcctgtggccgtgcctgtggtggaggccgtgcctgaggagggcctggcccaggtggcccccagcgagagccagcccaccctggagatgtctgactgtgatgtgcctgctggggagggccagtgccccagcctggagccccaggaggccgtgcctgtgctgggcagcacctgcttcctggaggaggccagcagtgaccagttcctgcccagcctggaggaccccctggccggcatgaatgccctggccgctgctgctgagctgccccaggcccggcccctgcccagccctggagctgctggggcccaggccctggagaagctggaggccgctgagagcctggtgctggagcagagcttcctgcacggcatcaccctgctgtctgaaattgctgagctggagctggagcggcgcagccaggagatgggcggcgctgagcgggccctggtggcccggcccagcctggagagcctgctggccgccggcagccacatgctgcgggaggtgctggatggccctgtggtggaccccctgaagaacctgcggctgccccgggagctgaagcccaacaagaagtacagctggatgaggaagaaggaggagaggatgtatgccatgaagagcagcctggaggacatggatgccctggagctggacttcaggatgaggctggccgaggtgcagaggcagtacaaggagaagcagcgggagctggtgaagctgcagaggagaagagacagtgaagatagaagagaggagccccacaggagcctggcccggcggggccctggccggcccaggaagaggacccacgcccccagcgccctgagcccccccaggaagaggggcaagagcggccacagcagcggcaagctgagcagcaagagcctgctgaccagtgatgattatgagctgggcgccggcatcaggaagaggcacaagggcagcgaggaggagcatgatgccctgattggcatgggcaaggcccggggcaggaaccagacctgggatgagcacgaggccagcagtgacttcatcagccagctgaagatcaagaagaagaagatggccagtgaccaggagcagctggccagcaagctggacaaggccctgagcctgaccaagcaggacaagctgaagagccccttcaagttcagtgacagcgctgggggcaagagcaagaccagcggcggctgcggccgctacctgaccccctatgacagcctgctgggcaagaacaggaaggccctggccaagggcctgggcctgagcctgaagagcagccgggagggcaagcacaagagagctgccaagaccaggaagatggaggtgggcttcaaggcccggggccagcccaagagcgcccacagcccctttgccagcgaggtgagcagctacagctacaacacagattctgaagaagatgaggagttcctgaaggatgagtggccagcccagggccccagcagcagcaagctgacccccagcctgctgtgcagcatggtggccaagaacagcaaggccgccggcggccccaagctgaccaagaggggcctggccgcccccaggaccctgaagcccaagccagccaccagcaggaagcagcccttctgcctgctgctgcgggaggccgaggcccggagcagcttcagtgacagcagcgaggagagctttgaccaggatgagagcagcgaggaggaggatgaggaggaggagctggaggaggaggatgaggccagcggcggcggctaccgcctgggcgcccgggagcgggccctgagccctggcctggaggagagcggcctgggcctgctggccaggtttgctgccagcgccctgcccagccccaccgtgggccccagcctgtctgtggtgcagctggaggccaagcagaaggccaggaagaaggaggagcggcagagcctgctgggcacagaatttgagtacacagattctgagagcgaggtgaaggtgaggaagaggagccctgctggcctgctgcggcccaagaagggcctgggggagcccggccccagcctggccgcccccacccctggggcccggggccctgaccccagcagcccagacaaggccaagctggccgtggagaagggcaggaaggccaggaagctgcggggccccaaggagcccggctttgaggccggccctgaggccagtgatgatgacctgtggaccaggagaagaagtgagcgcatcttcctgcatgatgccagcgctgctgccccagcccctgtgtccacagccccagccaccaagaccagccgctgtgccaagggcggccccctgagccccaggaaggatgctggccgggccaaggacaggaaggaccccaggaagaagaagaagggcaaggaggccggccctggggccggcctgcccccaccccgggccccagccctgcccagcgaggcccgggccccccacgccagcagcctgacagctgccaagaggagcaaggccaaggccaagggcaaggaggtgaagaaggagaacagaggcaagggcggcgctgtgtccaagctgatggagagcatggctgctgaagaagattttgagcccaaccaggacagcagcttctctgaagatgagcacctgccccggggcggcgctgtggagcggcccctgaccccagcccccaggagctgcatcatcgacaaggatgagctgaaggatggcctgcgggtgctgatccccatggatgacaagctgctgtatgccggccacgtgcagacagtgcacagcccagacatctacagagtggtggtggagggggagcggggcaaccggccccacatctactgcctggagcagctgctgcaggaggccatcattgatgtgcggcctgccagcacccgcttcctgccccagggcaccagaattgctgcctactggagccagcagtaccgctgcctgtacccaggcaccgtggtgcggggcctgctggacctggaggatgatggagacctgatcaccgtggagtttgatgatggagacaccggccgcatccccctgagccacatccggctgctgcccccagactacaagatccagtgtgccgagcccagccctgccctgctggtgcccagcgccaagaggaggagcaggaagaccagcaaggacacaggagagggcaaggatggcggcacagctggcagcgaggagcccggggccaaggcccggggccggggcaggaagcccagcgccaaggccaagggggacagagctgccaccctggaggagggcaaccccacagatgaggtgcccagcacccccctggccctggagcccagcagcaccccaggcagcaagaagagccccccagagcctgtggacaagagggccaaggcccccaaggcccggcctgccccaccccagcccagccctgcccccccagccttcaccagctgcccagcccctgagccctttgctgagctgcctgccccagccaccagcctggccccagcccccctcatcaccatgcctgccacccggcccaagcccaagaaggcccgggctgctgaggagagcggggccaagggcccccggcggcctggagaggaggccgagctgctggtgaagctggaccacgagggcgtgaccagccccaagagcaagaaggccaaggaggccctgctgctgagagaagatcctggagctgggggctggcaggagcccaagagcctgctgagcctgggcagctacccacctgctgctggcagcagcgagcccaaggccccctggcccaaggccacagatggagacctggcccaggagcccggccctggcctgacctttgaggacagcggcaaccccaagagcccagacaaggcccaggccgagcaggatggagctgaggagagcgagagcagcagcagcagcagcagcggcagcagcagcagcagcagcagcagcagcagcagcggcagcgagacagaaggagaggaggagggggacaagaatggagatggcggctgcggcactggaggcaggaactgcagcgctgccagcagcagagctgccagccctgccagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcagcaccacagatgaggacagcagctgcagcagtgatgatgaagctgccccagcccccacagctggccccagcgcccaggccgccctgcccaccaaggccaccaagcaggccggcaaggcccggcccagcgcccacagccctgggaagaagaccccagccccccagccccaggcccccccaccccagcccacccagcccctgcagcccaaggcccaggccggggccaagagccggcccaagaagcgggagggcgtgcacctgcccaccaccaaggagctggccaagaggcagaggctgcccagcgtggagaaccggcccaagattgctgccttcctgcctgcccggcagctgtggaagtggtttgggaagcccacccagaggcggggcatgaagggcaaggccaggaagctgttctacaaggccatcgtgcggggcaaggagatgatcagaattggagactgtgctgtgttcctgtctgctggccggcccaacctgccctacatcggccgcatccagagcatgtgggagagctggggcaacaacatggtggtgcgggtgaagtggttctaccaccctgaggagaccagccctgggaagcagttccaccagggccagcactgggaccagaagagcagccgcagcctgcctgctgccctgcgggtgagcagccagaggaaggacttcatggagcgggccctgtaccagagcagccacgtggatgaaaatgatgtgcagacagtgagccacaagtgcctggtggtgggcctggagcagtatgagcagatgctgaagaccaagaagtaccaggacagcgagggcctgtactacctggccggcacctatgagcccaccaccggcatgatcttcagcacagatggagtgcctgtgctgtgctag

SEQ ID NO: 42867 - DNA, 504 bp, Artificial Sequence
  Description of Artificial Sequence: Synthetic coding sequence
atgatcaaggactgtggggccacctgggtggtgctgggccacagcgagaggagacatgtgtttggagagagtgatgagctgattggccagaaggtggcccacgccctggccgagggcctgggcgtgattgcctgcatcggggagaagctggatgagcgggaggccggcatcacagagaaggtggtgtttgagcagaccaaggtgattgctgacaacgtgaaggactggagcaaggtggtgctggcctatgagcctgtgtgggccatcggcaccgggaagacagccaccccccagcaggcccaggaggtgcatgagaagctgcggggctggctgaagagcaatgtgtctgatgctgtggcccagagcacccgcatcatctatggaggctctgtgactggagccacctgcaaggagctggccagccagccagatgtggatggcttcctggtgggcggggccagcctgaagccagagtttgtggacatcatcaatgccaagcagtag

SEQ ID NO: 42868 - DNA, 1398 bp, Artificial Sequence
  Description of Artificial Sequence: Synthetic coding sequence
atgcctgccacccccagcctgaaggtggtgcatgagctgcctgcctgcaccctgtgtgccggccccctggaggatgctgtgaccatcccctgtggccacaccttctgccgcctgtgcctgcctgccctgagccagatgggcgcccagagcagcggcaagatcctgctgtgccccctgtgccaggaggaggagcaggccgagacccccatggcccctgtgcccctgggccccctgggggagacctactgtgaggagcacggggagaagatctacttcttctgtgaaaatgatgctgagttcctgtgtgtgttctgccgggagggccccacccaccaggcccacacagtgggcttcctggatgaggccatccagccctacagagaccggctgcggagccggctggaggccctgagcacagaaagagatgaaattgaagatgtgaagtgccaggaggaccagaagctgcaggtgctgctgacccagatcgagagcaagaagcaccaggtggagacagcctttgagcggctgcagcaggagctggagcagcagcgctgcctgctgctggcccggctgcgggagctggagcagcagatctggaaggagagagatgagtacatcaccaaggtgtctgaggaggtgacccggctgggcgcccaggtgaaggagctggaggagaagtgccagcagcctgccagcgagctgctgcaggatgtgcgggtgaaccagagccgctgtgagatgaagacctttgtgtccccagaggccatcagcccagacctggtgaagaagatccgggacttccacaggaagatcctgaccctgcctgagatgatgaggatgttttctgagaacctggcccaccacctggagattgattctggagtcatcaccctggacccccagacagccagccgcagcctggtgctgtctgaggacaggaagtctgtgcgctacacccggcagaagaagagcctgcctgacagccccctgcgctttgatggcctgcctgctgtgctgggcttccctggcttcagcagcggccgccaccgctggcaggtggacctgcagctgggagatggcggcggctgcaccgtgggcgtggccggggagggcgtgagaagaaaaggagagatgggcctgtctgcagaagatggagtgtgggccgtcatcatcagccaccagcagtgctgggccagcaccagccctggaacagacctgcccctgtctgagatcccccggggcgtgcgggtggccctggactatgaagctggccaggtgaccctgcacaatgcccagacccaggagcccatcttcaccttcaccgccagcttcagcggcaaggtgttccccttctttgctgtgtggaagaagggcagctgcctgaccctgaagggctag

SEQ ID NO: 42869 - DNA, 348 bp, Artificial Sequence
  Description of Artificial Sequence: Synthetic coding sequence
atgcctgccacccccagcctgaaggtggtgcatgagctgcctgcctgcaccctgtgtgccggccccctggaggatgctgtgaccatcccctgtggccacaccttctgccgcctgtgcctgcctgccctgagccagatgggcgcccagagcagcggcaagatcctgctgtgccccctgtgccaggaggaggagcaggccgagacccccatggcccctgtgcccctgggccccctgggggagacctactgtgaggagcacggggagaagatctacttcttctgtgaaaatgatgctgagttcctgtgtgtgtctgaatgtaggaccacagatggcttcggctgtgcctag

SEQ ID NO: 42870 - DNA, 1398 bp, Artificial Sequence; identical to SEQ ID NO: 42868
  Description of Artificial Sequence: Synthetic coding sequence

SEQ ID NO: 42871 - DNA, 1191 bp, Artificial Sequence
  Description of Artificial Sequence: Synthetic coding sequence
atggcccctgtgcccctgggccccctgggggagacctactgtgaggagcacggggagaagatctacttcttctgtgaaaatgatgctgagttcctgtgtgtgttctgccgggagggccccacccaccaggcccacacagtgggcttcctggatgaggccatccagccctacagagaccggctgcggagccggctggaggccctgagcacagaaagagatgaaattgaagatgtgaagtgccaggaggaccagaagctgcaggtgctgctgacccagatcgagagcaagaagcaccaggtggagacagcctttgagcggctgcagcaggagctggagcagcagcgctgcctgctgctggcccggctgcgggagctggagcagcagatctggaaggagagagatgagtacatcaccaaggtgtctgaggaggtgacccggctgggcgcccaggtgaaggagctggaggagaagtgccagcagcctgccagcgagctgctgcaggtgatccgggagggcctgcacggctgtgagatgaagacctttgtgtccccagaggccatcagcccagacctggtgaagaagatccgggacttccacaggaagatcctgaccctgcctgagatgatgaggatgttttctgagaacctggcccaccacctggagattgacagcggggtcatcaccctggacccccagacagccagccgcagcctggtgctgtctgaggacaggaagtctgtgcgctacacccggcagaagaagagcctgcctgacagccccctgcgctttgatggcctgcctgctgtgctgggcttccctggcttcagcagcggccgccaccgctggcaggtggacctgcagctgggagatggcggcggctgcaccgtgggcgtggccggggagggcgtgcggaggaagggggagatgggcctgtctgcagaagatggagtgtgggccgtcatcatcagccaccagcagtgctgggccagcaccagccctggaacagacctgcccctgtctgagatcccccggggcgtgcgggtggccctggactatgaggccggccaggtgaccctgcacaatgcccagacccaggagcccatcttcaccttcaccgccagcttcagcggcaaggtgttccccttctttgctgtgtggaagaagggcagctgcctgaccctgaagggctag

SEQ ID NO: 42872 - DNA, 1398 bp, Artificial Sequence; identical to SEQ ID NO: 42868
  Description of Artificial Sequence: Synthetic coding sequence

SEQ ID NO: 42873 - DNA, 1398 bp, Artificial Sequence; identical to SEQ ID NO: 42868
  Description of Artificial Sequence: Synthetic coding sequence

SEQ ID NO: 42874 - DNA, 495 bp, Artificial Sequence
  Description of Artificial Sequence: Synthetic coding sequence
tgaaagaagcaccaggtggagacagcctttgagcggctgcagcaggagctggagcagcagcgctgcctgctgctggcccggctgcgggagctggagcagcagatctggaaggagagagatgagtacatcaccaaggtgtctgaggaggtgacccggctgggcgcccaggtgaaggagctggaggagaagtgccagcagcctgccagcgagctgctgcaggatgtgcgggtgaaccagagccgctgtgagatgaagacctttgtgtccccagaggccatcagcccagacctggtgaagaagatccgggacttccacaggaagatcctgaccctgcctgagatgatgaggatgttttctgagaacctggcccaccacctggagattgacagcgaccggcagcctgagcccggcagcctgggccggcaggaggtgtctgaggtgcaccctgctgaggaggagcccgcccggcagcccccagccctgcggcggccctag

SEQ ID NO: 42875 - DNA, 495 bp, Artificial Sequence; identical to SEQ ID NO: 42874
  Description of Artificial Sequence: Synthetic coding sequence

SEQ ID NO: 42876 - DNA, 495 bp, Artificial Sequence; identical to SEQ ID NO: 42874
  Description of Artificial Sequence: Synthetic coding sequence

SEQ ID NO: 42877 - DNA, 495 bp, Artificial Sequence; identical to SEQ ID NO: 42874
  Description of Artificial Sequence: Synthetic coding sequence

SEQ ID NO: 42878 - DNA, 1398 bp, Artificial Sequence; identical to SEQ ID NO: 42868
  Description of Artificial Sequence: Synthetic coding sequence

SEQ ID NO: 42879 - DNA, 495 bp, Artificial Sequence; identical to SEQ ID NO: 42874
  Description of Artificial Sequence: Synthetic coding sequence

SEQ ID NO: 42880 - DNA, 1398 bp, Artificial Sequence
  Description of Artificial Sequence: Synthetic coding sequence
atgcctgccacccccagcctgaaggtggtgcatgagctgcctgcctgcaccctgtgtgccggccccctggaggatgctgtgaccatcccctgtggccacaccttctgccgcctgtgcctgcctgccctgagccagatgggcgcccagagcagcggcaagatcctgctgtgccccctgtgccaggaggaggagcaggccgagacccccatggcccctgtgcccctgggccccctgggggagacctactgtgaggagcacggggagaagatctacttcttctgtgaaaatgatgctgagttcctgtgtgtgttctgccgggagggccccacccaccaggcccacacagtgggcttcctggatgaggccatccagccctacagagaccggctgcggagccggctggaggccctgagcacagaaagagatgaaattgaagatgtgaagtgccaggaggaccagaagctgcaggtgctgctgacccagatcgagagcaagaagcaccaggtggagacagcctttgagcggctgcagcaggagctggagcagcagcgctgcctgctgctggcccggctgcgggagctggagcagcagatctggaaggagagagatgagtacatcaccaaggtgtctgaggaggtgacccggctgggcgcccaggtgaaggagctggaggagaagtgccagcagcctgccagcgagctgctgcaggatgtgcgggtgaaccagagccgctgtgagatgaagacctttgtgtccccagaggccatcagcccagacctggtgaagaagatccgggacttccacaggaagatcctgaccctgcctgagatgatgaggatgttttctgagaacctggcccaccacctggagattgattctggagtcatcaccctggacccccagacagccagccgcagcctggtgctgtctgaggacaggaagtctgtgcgctacacccggcagaagaagaacctgcctgacagccccctgcgctttgatggcctgcctgctgtgctgggcttccctggcttcagcagcggccgccaccgctggcaggtggacctgcagctgggagatggcggcggctgcaccgtgggcgtggccggggagggcgtgagaagaaaaggagagatgggcctgtctgcagaagatggagtgtgggccgtcatcatcagccaccagcagtgctgggccagcaccagccctggaacagacctgcccctgtctgagatcccccggggcgtgcgggtggccctggactatgaagctggccaggtgaccctgcacaatgcccagacccaggagcccatcttcaccttcaccgccagcttcagcggcaaggtgttccccttctttgctgtgtggaagaagggcagctgcctgaccctgaagggctag

SEQ ID NO: 42881 - DNA, 1398 bp, Artificial Sequence; identical to SEQ ID NO: 42880
  Description of Artificial Sequence: Synthetic coding sequence

SEQ ID NO: 42882 - DNA, 1398 bp, Artificial Sequence; identical to SEQ ID NO: 42868
  Description of Artificial Sequence: Synthetic coding sequence

SEQ ID NO: 42883 - DNA, 495 bp, Artificial Sequence; identical to SEQ ID NO: 42874
  Description of Artificial Sequence: Synthetic coding sequence

SEQ ID NO: 42884 - DNA, 495 bp, Artificial Sequence; identical to SEQ ID NO: 42874
  Description of Artificial Sequence: Synthetic coding sequence

SEQ ID NO: 42885 - DNA, 495 bp, Artificial Sequence; identical to SEQ ID NO: 42874
  Description of Artificial Sequence: Synthetic coding sequence

SEQ ID NO: 42886 - DNA, 1191 bp, Artificial Sequence
  Description of Artificial Sequence: Synthetic coding sequence
atggcccctgtgcccctgggccccctgggggagacctactgtgaggagcacggggagaagatctacttcttctgtgaaaatgatgctgagttcctgtgtgtgttctgccgggagggccccacccaccaggcccacacagtgggcttcctggatgaggccatccagccctacagagaccggctgcggagccggctggaggccctgagcacagaaagagatgaaattgaagatgtgaagtgccaggaggaccagaagctgcaggtgctgctgacccagatcgagagcaagaagcaccaggtggagacagcctttgagcggctgcagcaggagctggagcagcagcgctgcctgctgctggcccggctgcgggagctggagcagcagatctggaaggagagagatgagtacatcaccaaggtgtctgaggaggtgacccggctgggcgcccaggtgaaggagctggaggagaagtgccagcagcctgccagcgagctgctgcaggtgatccgggagggcctgcacggctgtgagatgaagacctttgtgtccccagaggccatcagcccagacctggtgaagaagatccgggacttccacaggaagatcctgaccctgcctgagatgatgaggatgttttctgagaacctggcccaccacctggagattgacagcggggtcatcaccctggacccccagacagccagccgcagcctggtgctgtctgaggacaggaagtctgtgcgctacacccggcagaagaagaacctgcctgacagccccctgcgctttgatggcctgcctgctgtgctgggcttccctggcttcagcagcggccgccaccgctggcaggtggacctgcagctgggagatggcggcggctgcaccgtgggcgtggccggggagggcgtgcggaggaagggggagatgggcctgtctgcagaagatggagtgtgggccgtcatcatcagccaccagcagtgctgggccagcaccagccctggaacagacctgcccctgtctgagatcccccggggcgtgcgggtggccctggactatgaggccggccaggtgaccctgcacaatgcccagacccaggagcccatcttcaccttcaccgccagcttcagcggcaaggtgttccccttctttgctgtgtggaagaagggcagctgcctgaccctgaagggctag

SEQ ID NO: 42887 - DNA, 348 bp, Artificial Sequence; identical to SEQ ID NO: 42869
  Description of Artificial Sequence: Synthetic coding sequence

SEQ ID NO: 42888 - DNA, 348 bp, Artificial Sequence; identical to SEQ ID NO: 42869
  Description of Artificial Sequence: Synthetic coding sequence

SEQ ID NO: 42889 - DNA, 1191 bp, Artificial Sequence; identical to SEQ ID NO: 42871
  Description of Artificial Sequence: Synthetic coding sequence

SEQ ID NO: 42890 - DNA, 1191 bp, Artificial Sequence; identical to SEQ ID NO: 42871
  Description of Artificial Sequence: Synthetic coding sequence

SEQ ID NO: 42891 - DNA, 348 bp, Artificial Sequence; identical to SEQ ID NO: 42869
  Description of Artificial Sequence: Synthetic coding sequence

SEQ ID NO: 42892 - DNA, 348 bp, Artificial Sequence; identical to SEQ ID NO: 42869
  Description of Artificial Sequence: Synthetic coding sequence

SEQ ID NO: 42893 - DNA, 1191 bp, Artificial Sequence; identical to SEQ ID NO: 42871
  Description of Artificial Sequence: Synthetic coding sequence

SEQ ID NO: 42894 - DNA, 1191 bp, Artificial Sequence; identical to SEQ ID NO: 42886
  Description of Artificial Sequence: Synthetic coding sequence

SEQ ID NO: 42895 - DNA, 1191 bp, Artificial Sequence; identical to SEQ ID NO: 42871
  Description of Artificial Sequence: Synthetic coding sequence

SEQ ID NO: 42896 - DNA, 348 bp, Artificial Sequence; identical to SEQ ID NO: 42869
  Description of Artificial Sequence: Synthetic coding sequence

SEQ ID NO: 42897 - DNA, 1191 bp, Artificial Sequence; identical to SEQ ID NO: 42871
  Description of Artificial Sequence: Synthetic coding sequence

SEQ ID NO: 42898 - DNA, 348 bp, Artificial Sequence; identical to SEQ ID NO: 42869
  Description of Artificial Sequence: Synthetic coding sequence

SEQ ID NO: 42899 - DNA, 348 bp, Artificial Sequence; identical to SEQ ID NO: 42869
  Description of Artificial Sequence: Synthetic coding sequence

SEQ ID NO: 42900 - DNA, 1434 bp, Artificial Sequence
  Description of Artificial Sequence: Synthetic coding sequence
atggaggccgtggagctggccaggaagctgcaggaggaggccacctgcagcatctgcctggactacttcacagatcctgtgatgaccacctgtggccacaacttctgccgggcctgcatccagctgtcctgggagaaggcccggggcaagaagggccgcaggaagaggaagggcagcttcccctgcccagagtgccgggagatgagcccccagaggaacctgctgcccaaccggctgctgaccaaggtggccgagatggcccagcagcaccctggcctgcagaagcaggacctgtgccaggagcaccacgagcccctgaagctgttctgccagaaggaccagagccccatctgtgtggtgtgccgggagagccgggagcaccggctgcaccgggtgctgcctgctgaggaggccgtgcagggctacaagctgaagctggaggaggacatggagtacctgcgggagcagatcaccaggacaggcaacctgcaggcccgggaggagcagagcctggccgagtggcagggcaaggtgaaggagcggcgggagagaattgtgctggagtttgagaagatgaacctgtacctggtggaggaggagcagaggctgctgcaggccctggagacagaggaggaggagacagccagccggctgcgggagagcgtggcctgcctggaccggcagggccacagcctggagctgctgctgctgcagctggaggagaggagcacccagggccccctgcagatgctgcaggacatgaaggagcccctgagcaggaagaacaacgtgtctgtgcagtgcccagaggtggccccacccacccggcccaggacagtgtgccgggtgcccggccagatcgaggtgctgcggggcttcctggaggatgtggtgcctgatgccaccagcgcctacccctacctgctgctgtatgagagccggcagaggcgctacctgggcagcagccctgagggcagcggcttctgcagcaaggacagatttgtggcctacccctgtgctgtgggccagacagccttcagcagcggccgccactactgggaggtgggcatgaacatcactggagatgccctgtgggccctgggcgtgtgccgggacaacgtgtccaggaaggacagagtgcccaagtgcccagaaaatggcttctgggtggtgcagctgagcaagggcaccaagtacctgagcaccttcagcgccctgacccctgtgatgctgatggagccccccagccacatgggcatcttcctggactttgaggccggggaggtgtccttctacagcgtgtctgatggcagccacctgcacacctacagccaggccaccttccctggccccctgcagcccttcttctgcctgggcgcccccaagagcggccagatggtgatcagcacagtgaccatgtgggtgaagggctag

SEQ ID NO: 42901 - DNA, 528 bp, Artificial Sequence
  Description of Artificial Sequence: Synthetic coding sequence
atggaggccgtggagctggccaggaagctgcaggaggaggccacctgcagcatctgcctggactacttcacagatcctgtgatgaccacctgtggccacaacttctgccgggcctgcatccagctgtcctgggagaaggcccggggcaagaagggccgcaggaagaggaagggcagcttcccctgcccagagtgccgggagatgagcccccagaggaacctgctgcccaaccggctgctgaccaaggtggccgagatggcccagcagcaccctggcctgcagaagcaggacctgtgccaggagcaccacgagcccctgaagctgttctgccagaaggaccagagccccatctgtgtggtgtgccgggagagccgggagcaccggctgcaccgggtgctgcctgctgaggaggccgtgcagggctacaagctgaagctggaggaggacatggagtacctgcgggagcagatcaccaggacaggcaacctgcaggcccgggaggagcagagcctggccgagtggcagtag

SEQ ID NO: 42902 - DNA, 1434 bp, Artificial Sequence; identical to SEQ ID NO: 42900
  Description of Artificial Sequence: Synthetic coding sequence

SEQ ID NO: 42903 - DNA, 1434 bp, Artificial Sequence; identical to SEQ ID NO: 42900
  Description of Artificial Sequence: Synthetic coding sequence

SEQ ID NO: 42904 - DNA, 1032 bp, Artificial Sequence
  Description of Artificial Sequence: Synthetic coding sequence
atggaggccgtggagctggccaggaagctgcaggaggaggccacctgcagcatctgcctggactacttcacagatcctgtgatgaccacctgtggccacaacttctgccgggcctgcatccagctgtcctgggagaaggcccggggcaagaagggccgcaggaagaggaagggcagcttcccctgcccagagtgccgggagatgagcccccagaggaacctgctgcccaaccggctgctgaccaaggtggccgagatggcccagcagcaccctggcctgcagaagcaggacctgtgccaggagcaccacgagcccctgaagctgttctgccagaaggaccagagccccatctgtgtggtgtgccgggagagccgggagcaccggctgcaccgggtgctgcctgctgaggaggccgtgcagggctacaagctgaagctggaggaggacatggagtacctgcgggagcagatcaccaggacaggcaacctgcaggcccgggaggagcagagcctggccgagtggcagggcaaggtgaaggagcggcgggagagaattgtgctggagtttgagaagatgaacctgtacctggtggaggaggagcagaggctgctgcaggccctggagacagaggaggaggagacagccagccggctgcgggagagcgtggcctgcctggaccggcagggccacagcctggagctgctgctgctgcagctggaggagaggagcacccagggccccctgcagatgctgcaggacatgaaggagcccctgagcaggaagaacaacgtgtctgtgcagtgcccagaggtggccccacccacccggcccaggacagtgtgccgggtgcccggccagatcgaggtgctgcggggcttcctgggcaagtgggccccccgggcccggaccagtgaccccggcagcctgggagatgcccccctgtaccccctggccagcgaggccaccaatggaggcggcagcaccagcgccctgcctggagatggccactggctgttcaccgtgcccagctag

SEQ ID NO: 42905 - DNA, 153 bp, Artificial Sequence
  Description of Artificial Sequence: Synthetic coding sequence
atggaggccgtggagctggccaggaagctgcaggaggaggccacctgcagcatctgcctggactacttcacagatcctgtgatgaccacctgtggccacaacttctgccgggcctgcatccagctgtcctgggagaaggcccggggcaagtag

SEQ ID NO: 42906 - DNA, 1398 bp, Artificial Sequence
  Description of Artificial Sequence: Synthetic coding sequence
atggccagcaccaccagcaccaagaagatgatggaggaggccacctgcagcatctgcctgagcctgatgaccaaccctgtgtccatcaactgtggccacagctactgccacctgtgcatcacagacttcttcaagaaccccagccagaagcagctgcggcaggagaccttctgctgcccccagtgccgggcccccttccacatggacagcctgcggcccaacaagcagctgggcagcctgattgaggccctgaaggagacagaccaggagatgagctgtgaggagcacggggagcagttccacctgttctgtgaagatgagggccagctgatctgctggaggtgtgagcgggccccccagcacaagggccacaccacagccctggtggaggatgtgtgccagggctacaaggagaagctgcagaaggctgtgaccaagctgaagcagctggaggaccgctgcacagagcagaagctgagcacagccatgaggatcaccaagtggaaggagaaggtgcagatccagaggcagaagatccgcagtgacttcaagaacctgcagtgcttcctgcacgaggaggagaagagctacctgtggaggctggagaaggaggagcagcagaccctgagccggctgcgggactatgaagctggcctgggcctgaagagcaatgagctgaagagccacatcctggagctggaggagaagtgccagggcagcgcccagaagctgctgcagaatgtgaatgacaccctgagccgctcctgggccgtgaagctggagaccagcgaggccgtgtccctggagctgcacaccatgtgcaatgtgtccaagctgtactttgatgtgaagaagatgctgcggagccaccaggtgtctgtgaccctggaccctgacacagcccaccacgagctgatcctgtctgaagatcggcggcaggtgacccggggctacacccaggagaaccaggacaccagcagccgccgcttcaccgccttcccctgtgtgctgggctgtgagggcttcaccagcggccgccgctactttgaggtggatgtgggggagggcaccggctgggacctgggcgtgtgcatggagaatgtgcagaggggcaccggcatgaagcaggagccccagagcggcttctggaccctgcggctgtgcaagaagaagggctacgtggccctgaccagcccccccaccagcctgcacctgcacgagcagcccctgctggtgggcatcttcctggactatgaggccggcgtggtgtccttctacaatggaaacacaggctgccacatcttcaccttccccaaggccagcttcagtgacaccctgcggccctacttccaggtgtaccagtacagccccctcttcctgcccccacctggggactag

SEQ ID NO: 42907 - DNA, 1398 bp, Artificial Sequence; identical to SEQ ID NO: 42906
  Description of Artificial Sequence: Synthetic coding sequence

SEQ ID NO: 42908 - DNA, 1398 bp, Artificial Sequence; identical to SEQ ID NO: 42906
  Description of Artificial Sequence: Synthetic coding sequence

SEQ ID NO: 42909 - DNA, 690 bp, Artificial Sequence
  Description of Artificial Sequence: Synthetic coding sequence
atgatccccctgcagaaggacaaccaggaggagggcgtgtgccccatctgccaggagagcctgaaggaggccgtgtccaccaactgtggccacctgttctgccgggtgtgcctgacccagcacgtggagaaggccagcgccagcggggtcttctgctgccccctgtgcaggaagccctgcagcgaggaggtgctgggcaccggctacatctgccccaaccaccagaagagggtgtgccgcttctgtgaggagagccggctgctgctgtgtgtggagtgcctggtgtccccagagcacatgagccaccacgagctgaccattgaaaatgccctgagccactacaaggagcggctgaacagaagaagcaggaagctgaggaaggacattgctgagctgcagaggctgaaggcccagcaggagaagaagctgcaggccctgcagcagtggctgggccagctggagcacatgcctgctgaggccgcccgcatcctggacatcagcagagctgtgacccagctgcggagcctggtgattgacctggagaggacagccaaggagctggacaccaacaccctgaagaatgctggggacctgctgaacagaagtgccccccagaagctggaggtgatctacccccagctggagaagggcgtgtctgagctgctgctgcagcccccccagaagctgtag

SEQ ID NO: 42910 - DNA, 777 bp, Artificial Sequence
  Description of Artificial Sequence: Synthetic coding sequence
atgatccccctgcagaaggacaaccaggaggagggcgtgtgccccatctgccaggagagcctgaaggaggccgtgtccaccaactgtggccacctgttctgccgggtgtgcctgacccagcacgtggagaaggccagcgccagcggggtcttctgctgccccctgtgcaggaagccctgcagcgaggaggtgctgggcaccggctacatctgccccaaccaccagaagagggtgtgccgcttctgtgaggagagccggctgctgctgtgtgtggagtgcctggtgtccccagagcacatgagccaccacgagctgaccattgaaaatgccctgagccactacaaggagcggctgaacagaagaagcaggaagctgaggaaggacattgctgagctgcagaggctgaaggcccagcaggagaagaagctgcaggccctgcagttccaggtggaccacggcaaccaccggctggaggccggccctgagagccagcaccagacccgggagcagctgggcgccctgccccagcagtggctgggccagctggagcacatgcctgctgaggccgcccgcatcctggacatcagcagagctgtgacccagctgcggagcctggtgattgacctggagaggacagccaaggagctggacaccaacaccctgaagaatgctggggacctgctgaacagaagtgccccccagaagctggaggtgatctacccccagctggagaagggcgtgtctgagctgctgctgcagcccccccagaagctgtag

SEQ ID NO: 42911 - DNA, 777 bp, Artificial Sequence; identical to SEQ ID NO: 42910
  Description of Artificial Sequence: Synthetic coding sequence

SEQ ID NO: 42912 - DNA, 777 bp, Artificial Sequence; identical to SEQ ID NO: 42910
  Description of Artificial Sequence: Synthetic coding sequence

SEQ ID NO: 42913 - DNA, 690 bp, Artificial Sequence; identical to SEQ ID NO: 42909
  Description of Artificial Sequence: Synthetic coding sequence

SEQ ID NO: 42914 - DNA, 690 bp, Artificial Sequence
  Description of Artificial Sequence: Synthetic coding sequence
atgatccccctgcagaaggacaaccaggaggagggcgtgtgccccatctgccaggagagcctgaaggaggccgtgtccaccaactgtggccacctgttctgccgggtgtgcctgacccagcacgtggagaaggccagcgccagcggggtcttctgctgccccctgtgcaggaagccctgcagcgaggaggtgctgggcaccggctacatctgccccaaccaccagaagagggtgtgccgcttctgtgaggagagccggctgctgctgtgtgtggagtgcctggtgtccccagagcacatgagccaccacgagctgaccattgaaaatgccctgagccactacaaggagcggctgaacagaagaagcaggaagctgaggaaggacattgctgagctgcagaggctgaaggcccagcaggagaagaagctgcaggccctgcagcagtggctgggccagctggagcacatgcctgctgaggccgcccgcatcctggacatcagcagagctgtgacccagctgcggagcctggtgattgacctggagaggatggccaaggagctggacaccaacaccctgaagaatgctggggacctgctgaacagaagtgccccccagaagctggaggtgatctacccccagctgaagaagggcgtgtctgagctgctgctgcagcccccccagaagctgtag

SEQ ID NO: 42915 - DNA, 690 bp, Artificial Sequence; identical to SEQ ID NO: 42909
  Description of Artificial Sequence: Synthetic coding sequence

SEQ ID NO: 42916 - DNA, 777 bp, Artificial Sequence
  Description of Artificial Sequence: Synthetic coding sequence
atgatccccctgcagaaggacaaccaggaggagggcgtgtgccccatctgccaggagagcctgaaggaggccgtgtccaccaactgtggccacctgttctgccgggtgtgcctgacccagcacgtggagaaggccagcgccagcggggtcttctgctgccccctgtgcaggaagccctgcagcgaggaggtgctgggcaccggctacatctgccccaaccaccagaagagggtgtgccgcttctgtgaggagagccggctgctgctgtgtgtggagtgcctggtgtccccagagcacatgagccaccacgagctgaccattgaaaatgccctgagccactacaaggagcggctgaacagaagaagcaggaagctgaggaaggacattgctgagctgcagaggctgaaggcccagcaggagaagaagctgcaggccctgcagttccaggtggaccacggcaaccaccggctggaggccggccctgagagccagcaccagacccgggagcagctgggcgccctgccccagcagtggctgggccagctggagcacatgcctgctgaggccgcccgcatcctggacatcagcagagctgtgacccagctgcggagcctggtgattgacctggagaggatggccaaggagctggacaccaacaccctgaagaatgctggggacctgctgaacagaagtgccccccagaagctggaggtgatctacccccagctgaagaagggcgtgtctgagctgctgctgcagcccccccagaagctgtag

SEQ ID NO: 42917 - DNA, 690 bp, Artificial Sequence; identical to SEQ ID NO: 42909
  Description of Artificial Sequence: Synthetic coding sequence

SEQ ID NO: 42918 - DNA, 777 bp, Artificial Sequence; identical to SEQ ID NO: 42916
  Description of Artificial Sequence: Synthetic coding sequence

SEQ ID NO: 42919 - DNA, 777 bp, Artificial Sequence
  Description of Artificial Sequence: Synthetic coding sequence
atgatccccctgcagaaggacaaccaggaggagggcgtgtgccccatctgccaggagagcctgaaggaggccgtgtccaccaactgtggccacctgttctgccgggtgtgcctgacccagcacgtggagaaggccagcgccagcggggtcttctgctgccccctgtgcaggaagccctgcagcgaggaggtgctgggcaccggctacatctgccccaaccaccagaagagggtgtgccgcttctgtgaggagagccggctgctgctgtgtgtggagtgcctggtgtccccagagcacatgagccaccacgagctgaccattgaaaatgccctgagccactgcaaggagcggctgaacagaagaagcaggaagctgaggaaggacattgctgagctgcagaggctgaaggcccagcaggagaagaagctgcaggccctgcagttccaggtggaccacggcaaccaccggctggaggccggccctgagagccagcaccagacccgggagcagctgggcgccctgccccagcagtggctgggccagctggagcacatgcctgctgaggccgcccgcatcctggacatcagcagagctgtgacccagctgcggagcctggtgattgacctggagaggacagccaaggagctggacaccaacaccctgaagaatgctggggacctgctgaacagaagtgccccccagaagctggaggtgatctacccccagctggagaagggcgtgtctgagctgctgctgcagcccccccagaagctgtag

SEQ ID NO: 42920 - DNA, 777 bp, Artificial Sequence; identical to SEQ ID NO: 42910
  Description of Artificial Sequence: Synthetic coding sequence

SEQ ID NO: 42921 - DNA, 777 bp, Artificial Sequence; identical to SEQ ID NO: 42910
  Description of Artificial Sequence: Synthetic coding sequence

SEQ ID NO: 42922 - DNA, 690 bp, Artificial Sequence; identical to SEQ ID NO: 42909
  Description of Artificial Sequence: Synthetic coding sequence

SEQ ID NO: 42923 - DNA, 777 bp, Artificial Sequence; identical to SEQ ID NO: 42910
  Description of Artificial Sequence: Synthetic coding sequence

SEQ ID NO: 42924 - DNA, 690 bp, Artificial Sequence
  Description of Artificial Sequence: Synthetic coding sequence
atgatccccctgcagaaggacaaccaggaggagggcgtgtgccccatctgccaggagagcctgaaggaggccgtgtccaccaactgtggccacctgttctgccgggtgtgcctgacccagcacgtggagaaggccagcgccagcggggtcttctgctgccccctgtgcaggaagccctgcagcgaggaggtgctgggcaccggctacatctgccccaaccaccagaagagggtgtgccgcttctgtgaggagagccggctgctgctgtgtgtggagtgcctggtgtccccagagcacatgagccaccacgagctgaccattgaaaatgccctgagccactgcaaggagcggctgaacagaagaagcaggaagctgaggaaggacattgctgagctgcagaggctgaaggcccagcaggagaagaagctgcaggccctgcagcagtggctgggccagctggagcacatgcctgctgaggccgcccgcatcctggacatcagcagagctgtgacccagctgcggagcctggtgattgacctggagaggacagccaaggagctggacaccaacaccctgaagaatgctggggacctgctgaacagaagtgccccccagaagctggaggtgatctacccccagctggagaagggcgtgtctgagctgctgctgcagcccccccagaagctgtag

SEQ ID NO: 42925 - DNA, 690 bp, Artificial Sequence; identical to SEQ ID NO: 42914
  Description of Artificial Sequence: Synthetic coding sequence

SEQ ID NO: 42926 - DNA, 777 bp, Artificial Sequence; identical to SEQ ID NO: 42910
  Description of Artificial Sequence: Synthetic coding sequence

SEQ ID NO: 42927 - DNA, 777 bp, Artificial Sequence; identical to SEQ ID NO: 42919
  Description of Artificial Sequence: Synthetic coding sequence

SEQ ID NO: 42928 - DNA, 777 bp, Artificial Sequence; identical to SEQ ID NO: 42910
  Description of Artificial Sequence: Synthetic coding sequence

SEQ ID NO: 42929 - DNA, 777 bp, Artificial Sequence; identical to SEQ ID NO: 42910
  Description of Artificial Sequence: Synthetic coding sequence

SEQ ID NO: 42930 - DNA, 2172 bp, Artificial Sequence
  Description of Artificial Sequence: Synthetic coding sequence
atggagacagccatgtgtgtgtgctgcccctgctgcacctggcagcgctgctgcccccagctgtgcagctgcctgtgctgcaagttcatcttcaccagcgagaggaactgcacctgcttcccctgcccctacaaggatgagaggaactgccagttctgccactgcacctgcagcgagagccccaactgccactggtgctgctgctcctgggccaatgaccccaactgcaagtgctgctgcacagccagcagcaacctgaactgctactactatgagagccgctgctgcaggaacaccatcatcaccttccacaagggccgcctgcggagcatccacaccagcagcaagacagccctgaggacaggcagcagtgacacccaggtggatgaggtgaagagcatcccagccaacagccacctggtgaaccacctgaactgccccatgtgcagccggctgcggctgcacagcttcatgctgccctgcaaccacagcctgtgtgagaagtgcctgcggcagctgcagaagcatgctgaggtgacagagaacttcttcatcctgatctgccctgtgtgtgacaggagccactgcatgccctacagcaacaagatgcagctgcctgagaactacctgcacggccgcctgaccaagcgctacatgcaggagcacggctacctgaagtggaggtttgacaggagcagcggccccatcctgtgccaggtgtgcaggaacaagagaattgcctacaagcgctgcatcacctgccgcctgaacctgtgcaatgactgcctgaaggccttccacagtgatgtggccatgcaggaccacgtgtttgtggacaccagcgctgaggagcaggatgagaagatctgcatccaccaccccagcagccgcatcatcgagtactgcagaaatgacaacaagctgctgtgcaccttctgcaagttctccttccacaatggacatgacaccatcagcctgattgatgcctgcagcgagcgggccgccagcctcttcagcgccatcgccaagttcaaggctgtgcgctatgaaattgacaatgacctgatggagttcaacatcctgaagaacagcttcaaggctgacaaggaggccaagaggaaggagatcagaaatggcttcctgaagctgcggagcatcctgcaggagaaggagaagatcatcatggagcagatcgagaacctggaggtgtcccggcagaaggagattgagaagtatgtgtatgtgaccaccatgaaggtgaatgagatggatggcctgattgcctacagcaaggaggccctgaaggagaccggccaggtggccttcctgcagagcgccaagatcctggtggaccagattgaagatggcatccagaccacctacagaccagacccccagctgcggctgcacagcatcaactacgtgcccctggactttgtggagctgagcagcgccatccacgagctgttccccaccggccccaagaaggtgcgcagcagcggggacagcctgcccagcccctaccctgtgcacagcgagaccatgattgccaggaaggtgaccttcagcacccacagcctgggcaaccagcacatctaccagaggagcagctccatgctgtccttcagcaacacagacaagaaggccaaggtgggcctggaggcctgtggccgggcccagagcgccaccccagccaagcccacagatggcctgtacacctactggagcgctggagctgacagccagagcgtgcagaacagcagcagcttccacaactggtacagcttcaatgatggctctgtgaagaccccaggccccatcgtcatctaccagaccctggtgtacccccgggccgccaaggtgtactggacctgcccagcagaagatgtggacagctttgagatggagttctatgaggtgatcaccagcccccccaacaacgtgcagatggagctgtgtggccagatccgggacatcatgcagcagaacctggagctgcacaacctgacccccaacacagaatatgtgttcaaggtgcgggccatcaatgacaatggacctggccagtggagcgacatctgcaaggtggtgaccccagatggccacggcaagaacagagccaagtggggcctgctgaagaacatccagagcgccctgcagaagcacttctag

SEQ ID NO: 42931 - DNA, 1341 bp, Artificial Sequence
  Description of Artificial Sequence: Synthetic coding sequence
atggacagcgacttcagccacgccttccagaaggagctgacctgtgtgatctgcctgaactacctggtggaccctgtgaccatctgctgcggccacagcttctgccggccctgcctgtgcctgtcctgggaggaggcccagagccctgccaactgcccagcctgccgggagcccagccccaagatggacttcaagaccaacatcctgctgaagaacctggtgaccatcgccaggaaggccagcctgtggcagttcctgagcagcgagaagcagatctgtggcacccaccggcagaccaagaagatgttctgtgacatggacaagagcctgctgtgcctgctgtgcagcaacagccaggagcacggggcccacaagcaccaccccatcgaggaggccgctgaggagcaccgggagaagctgctgaagcagatgaggatcctgtggaagaagatccaggagaaccagaggaacctgtatgaggagggccgcacagccttcctgtggagaggaaatgtggtgctgcgggcccagatgatcagaaatgagtacaggaagctgcaccctgtgctgcacaaggaggagaagcagcacctggagcggctgaacaaggagtaccaggagatcttccagcagctgcagaggtcctgggtgaagatggaccagaagagcaagcacctgaaggagatgtaccaggagctgatggagatgtgccacaagccagatgtggagctgctgcaggacctgggggacatcgtggcccggtctgagagcgtgctgctgcacatgccccagcctgtgaaccctgagctgacagctggccccatcaccggcctggtgtaccgcctgaaccgcttccgggtggagatctccttccactttgaggtgaccaaccacaacatccggctgtttgaagatgtgcgctcctggatgttccggcggggccccctgaacagcgacagaagtgactactttgctgcctggggcgcccgggtcttctcctttgggaagcactactgggagctggatgtggacaacagctgtgactgggccctgggcgtgtgcaacaacagctggatcaggaagaacagcaccatggtgaacagcgaggacatcttcctgctgctgtgcctgaaggtggacaaccacttcaacctgctgaccaccagccctgtgttcccccactacatcgagaagcccctgggccgggtgggcgtcttcctggactttgaaagtggctctgtgtccttcctgaatgtgaccaagagcagcctcatctggagctacccagctggcagcctgaccttccctgtgcggcccttcttctacacaggccacaggtag

SEQ ID NO: 42932 - DNA, 2280 bp, Artificial Sequence
  Description of Artificial Sequence: Synthetic coding sequence
atggccgagggggaggacatgcagaccttcaccagcatcatggatgccctggtgcgcatcagcacctccatgaagaacatggagaaggagctgctgtgccctgtgtgccaggagatgtacaagcagcccctggtgctgccctgcacccacaacgtgtgccaggcctgtgcccgggaggtgctgggccagcagggctacatcggccatggaggagaccccagcagcgagcccaccagccctgccagcacccccagcaccaggagcccccggctgagcaggaggaccctgcccaagccagaccggctggaccggctgctgaagagcggcttcggcacctacccaggcaggaagagaggagccctgcacccccaggtgatcatgttcccctgcccagcctgccagggagatgtggagctgggggagcggggcctggccggcctcttcaggaacctgaccctggagcgggtggtggagcgctaccggcagagcgtgtctgtgggcggggccatcctgtgccagctgtgcaagcccccacccctggaggccaccaagggctgcacagagtgccgggccaccttctgcaatgaatgcttcaagctgttccacccctggggcacccagaaggcccagcacgagcccaccctgcccaccctgtccttccggcccaagggcctgatgtgcccagaccacaaggaggaggtgacccactactgcaagacctgccagaggctggtgtgccagctgtgccgggtgcggaggacccacagcggccacaagatcacccctgtgctgagcgcctaccaggccctgaaggacaagctgaccaagagcctgacctacatcctgggcaaccaggacacagtgcagacccagatctgtgagctggaggaggccgtgcgccacacagaggtgtctggccagcaggccaaggaggaggtgtcccagctggtgcggggcctgggcgctgtgctggaggagaagagggccagcctgctgcaggccatcgaggagtgccagcaggagcggctggcccggctgagcgcccagatccaggagcacaggagcctgctggatggcagcggcctggtgggctacgcccaggaggtgctgaaggagacagaccagccctgctttgtgcaggccgccaagcagctgcacaacagaattgcccgggccacagaggccctgcagaccttccggcctgctgccagcagcagcttccgccactgccagctggatgtgggccgggagatgaagctgctgacagagctgaacttcctgcgggtgcctgaggcccctgtgattgacacccagaggacctttgcctatgaccagatcttcctgtgctggaggctgcccccccacagccccccagcctggcactacacagtggagttcagaagaacagatgtgcctgcccagcccggccccacccgctggcagaggcgggaggaggtgcggggcaccagcgccctgctggagaacccagacaccggctctgtgtatgtgctgcgggtgcggggctgcaacaaggccggctacggggagtacagtgaagatgtgcacctgcacaccccaccagcccctgtgctgcacttcttcctggacagccgctggggcgccagccgggagcggctggccatcagcaaggaccagagagctgtgcgctctgtgcccggcctgcccctgctgctggccgctgaccggctgctgaccggctgccacctgtctgtggatgtggtgctgggagatgtggccgtgacccagggccgcagctactgggcctgtgctgtggaccctgccagctacctggtgaaggtgggcgtgggcctggagagcaagctgcaggagagcttccagggcgccccagatgtgatcagccccaggtatgaccctgacagcggccatgacagcggggctgaagatgccaccgtggaggccagccccccatttgccttcctgaccatcggcatgggcaagatcctgctgggcagcggggccagcagcaatgccggcctgaccggcagagatggccccacagctggctgcaccgtgcccctgcccccccggctgggcatctgcctggactatgagcggggccgggtgtccttcctggatgctgtgtccttccggggcctgctggagtgccccctggactgcagcggccctgtgtgcccagccttctgcttcatcggcggcggcgctgtgcagctgcaggagcctgtgggcaccaagccagagaggaaggtgaccatcggcggctttgccaagctggactag

SEQ ID NO: 42933 - DNA, 2211 bp, Artificial Sequence
  Description of Artificial Sequence: Synthetic coding sequence
atgaagaacatggagaaggagctgctgtgccctgtgtgccaggagatgtacaagcagcccctggtgctgccctgcacccacaacgtgtgccaggcctgtgcccgggaggtgctgggccagcagggctacatcggccacggcggggaccccagcagcgagcccaccagccctgccagcacccccagcaccaggagcccccggctgagcaggaggaccctgcccaagccagaccggctggaccggctgctgaagagcggcttcggcacctacccaggcaggaagagaggagccctgcacccccaggtgatcatgttcccctgcccagcctgccagggagatgtggagctgggggagcggggcctggccggcctcttcaggaacctgaccctggagcgggtggtggagcgctaccggcagagcgtgtctgtgggcggggccatcctgtgccagctgtgcaagcccccacccctggaggccaccaagggctgcacagaatgtcgggccaccttctgcaatgaatgcttcaagctgttccacccctggggcacccagaaggcccagcacgagcccaccctgcccaccctgtccttccggcccaagggcctgatgtgcccagaccacaaggaggaggtgacccactactgcaagacctgccagaggctggtgtgccagctgtgccgggtgcggaggacccacagcggccacaagatcacccctgtgctgagcgcctaccaggccctgaaggacaagctgaccaagagcctgacctacatcctgggcaaccaggacacagtgcagacccagatctgtgagctggaggaggccgtgcgccacacagaggtgtctggccagcaggccaaggaggaggtgtcccagctggtgcggggcctgggcgctgtgctggaggagaagagggccagcctgctgcaggccatcgaggagtgccagcaggagcggctggcccggctgagcgcccagatccaggagcacaggagcctgctggatggcagcggcctggtgggctacgcccaggaggtgctgaaggagacagaccagccctgctttgtgcaggccgccaagcagctgcacaaccgcatcgcccgggccacagaggccctgcagaccttccggcctgctgccagcagcagcttccgccactgccagctggatgtgggccgggagatgaagctgctgacagagctgaacttcctgcgggtgcctgaggcccctgtgattgacacccagaggacctttgcctatgaccagatcttcctgtgctggaggctgcccccccacagccccccagcctggcactacacagtggagttccggaggacagatgtgcctgcccagcccggccccacccgctggcagaggcgggaggaggtgcggggcaccagcgccctgctggagaacccagacaccggctctgtgtatgtgctgcgggtgcggggctgcaacaaggccggctatggagagtacagtgaagatgtgcacctgcacaccccaccagcccctgtgctgcacttcttcctggacagccgctggggcgccagccgggagcggctggccatcagcaaggaccagagagctgtgcgctctgtgcccggcctgcccctgctgctggccgctgaccggctgctgaccggctgccacctgtctgtggatgtggtgctgggagatgtggccgtgacccagggccgcagctactgggcctgtgctgtggaccctgccagctacctggtgaaggtgggcgtgggcctggagagcaagctgcaggagagcttccagggcgccccagatgtgatcagccccaggtatgaccctgattctggccatgattctggagcagaagatgccaccgtggaggccagccccccatttgccttcctgaccatcggcatgggcaagatcctgctgggcagcggggccagcagcaatgccggcctgaccggcagagatggccccacagctggctgcaccgtgcccctgcccccccggctgggcatctgcctggactatgaaagaggccgggtgtccttcctggatgctgtgtccttccggggcctgctggagtgccccctggactgcagcggccctgtgtgcccagccttctgcttcatcggcggcggcgctgtgcagctgcaggagcctgtgggcaccaagccagagaggaaggtgaccatcggcggctttgccaagctggactag

SEQ ID NO: 42934 - DNA, 1935 bp, Artificial Sequence
  Description of Artificial Sequence: Synthetic coding sequence
atggccgagggggaggacatgcagaccttcaccagcatcatggatgccctggtgcgcatcagcacctccatgaagaacatggagaaggagctgctgtgccctgtgtgccaggagatgtacaagcagcccctggtgctgccctgcacccacaacgtgtgccaggcctgtgcccgggaggtgctgggccagcagggctacatcggccatggaggagaccccagcagcgagcccaccagccctgccagcacccccagcaccaggagcccccggctgagcaggaggaccctgcccaagccagaccggctggaccggctgctgaagagcggcttcggcacctacccaggcaggaagagaggagccctgcacccccaggtgatcatgttcccctgcccagcctgccagggagatgtggagctgggggagcggggcctggccggcctcttcaggaacctgaccctggagcgggtggtggagcgctaccggcagagcgtgtctgtgggcggggccatcctgtgccagctgtgcaagcccccacccctggaggccaccaagggctgcacagagtgccgggccaccttctgcaatgaatgcttcaagctgttccacccctggggcacccagaaggcccagcacgagcccaccctgcccaccctgtccttccggcccaagggcctgatgtgcccagaccacaaggaggaggtgacccactactgcaagacctgccagaggctggtgtgccagctgtgccgggtgcggaggacccacagcggccacaagatcacccctgtgctgagcgcctaccaggccctgaaggacaagctgaccaagagcctgacctacatcctgggcaaccaggacacagtgcagacccagatctgtgagctggaggaggccgtgcgccacacagaggtgtctggccagcaggccaaggaggaggtgtcccagctggtgcggggcctgggcgctgtgctggaggagaagagggccagcctgctgcaggccatcgaggagtgccagcaggagcggctggcccggctgagcgcccagatccaggagcacaggagcctgctggatggcagcggcctggtgggctacgcccaggaggtgctgaaggagacagaccagccctgctttgtgcaggccgccaagcagctgcacaacagaattgcccgggccacagaggccctgcagaccttccggcctgctgccagcagcagcttccgccactgccagctggatgtgggccgggagatgaagctgctgacagagctgaacttcctgcgggtgcctgaggcccctgtgattgacacccagaggacctttgcctatgaccagatcttcctgtgctggaggctgcccccccacagccccccagcctggcactacacagtggagttcagaagaacagatgtgcctgcccagcccggccccacccgctggcagaggcgggaggaggtgcggggcaccagcgccctgctggagaacccagacaccggctctgtgtatgtgctgcgggtgcggggctgcaacaaggccggctacggggagtacagtgaagatgtgcacctgcacaccccaccagcccctgtgctgcacttcttcctggacagccgctggggcgccagccgggagcggctggccatcagcaaggaccagagagctgtgcgctctgtgcccggcctgcccctgctgctggccgctgaccggctgctgaccggctgccacctgtctgtggatgtggtgctgggagatgtggccgtgacccagggccgcagctactgggcctgtgctgtggaccctgccagctacctggtgaaggtgggcgtgggcctggagagcaagctgcaggagagcttccagggcgccccagatgtgatcagccccaggagtgaccccagcggcagagatggagtgtggggctcctggtgggagtag

SEQ ID NO: 42935 - DNA, 1656 bp, Artificial Sequence
  Description of Artificial Sequence: Synthetic coding sequence
atggccgagggggaggacatgcagaccttcaccagcatcatggatgccctggtgcgcatcagcacctccatgaagaacatggagaaggagctgctgtgccctgtgtgccaggagatgtacaagcagcccctggtgctgccctgcacccacaacgtgtgccaggcctgtgcccgggaggtgctgggccagcagggctacatcggccatggaggagaccccagcagcgagcccaccagccctgccagcacccccagcaccaggagcccccggctgagcaggaggaccctgcccaagccagaccggctggaccggctgctgaagagcggcttcggcacctacccaggcaggaagagaggagccctgcacccccaggtgatcatgttcccctgcccagcctgccagggagatgtggagctgggggagcggggcctggccggcctcttcaggaacctgaccctggagcgggtggtggagcgctaccggcagagcgtgtctgtgggcggggccatcctgtgccagctgtgcaagcccccacccctggaggccaccaagggctgcacagagtgccgggccaccttctgcaatgaatgcttcaagctgttccacccctggggcacccagaaggcccagcacgagcccaccctgcccaccctgtccttccggcccaagggcctgatgtgcccagaccacaaggaggaggtgacccactactgcaagacctgccagaggctggtgtgccagctgtgccgggtgcggaggacccacagcggccacaagatcacccctgtgctgagcgcctaccaggccctgaaggacaagctgaccaagagcctgacctacatcctgggcaaccaggacacagtgcagacccagatctgtgagctggaggaggccgtgcgccacacagaggtgtctggccagcaggccaaggaggaggtgtcccagctggtgcggggcctgggcgctgtgctggaggagaagagggccagcctgctgcaggccatcgaggagtgccagcaggagcggctggcccggctgagcgcccagatccaggagcacaggagcctgctggatggcagcggcctggtgggctacgcccaggaggtgctgaaggagacagaccagccctgctttgtgcaggccgccaagcagctgcacaacagaattgcccgggccacagaggccctgcagaccttccggcctgctgccagcagcagcttccgccactgccagctggatgtgggccgggagatgaagctgctgacagagctgaacttcctgcgggtgcctgaggcccctgtgattgacacccagaggacctttgcctatgaccagatcttcctgtgctggaggctgcccccccacagccccccagcctggcactacacagtggagttcagaagaacagatgtgcctgcccagcccggccccacccgctggcagaggcgggaggaggtgcggggcaccagcgccctgctggagaacccagacaccggctctgtgtatgtgctgcgggtgcggggctgcaacaaggccggctacggggagtacagtgaagatgtgcacctgcacaccccaccagcccctggcatccagaacctggcccggcggggcggggcctgcctgcagttccagctgctgggccgcctgaggtag

SEQ ID NO: 42936 - DNA, 1497 bp, Artificial Sequence
  Description of Artificial Sequence: Synthetic coding sequence
atggccgagggggaggacatgcagaccttcaccagcatcatggatgccctggtgcgcatcagcacctccatgaagaacatggagaaggagctgctgtgccctgtgtgccaggagatgtacaagcagcccctggtgctgccctgcacccacaacgtgtgccaggcctgtgcccgggaggtgctgggccagcagggctacatcggccatggaggagaccccagcagcgagcccaccagccctgccagcacccccagcaccaggagcccccggctgagcaggaggaccctgcccaagccagaccggctggaccggctgctgaagagcggcttcggcacctacccaggcaggaagagaggagccctgcacccccaggtgatcatgttcccctgcccagcctgccagggagatgtggagctgggggagcggggcctggccggcctcttcaggaacctgaccctggagcgggtggtggagcgctaccggcagagcgtgtctgtgggcggggccatcctgtgccagctgtgcaagcccccacccctggaggccaccaagggctgcacagagtgccgggccaccttctgcaatgaatgcttcaagctgttccacccctggggcacccagaaggcccagcacgagcccaccctgcccaccctgtccttccggcccaagggcctgatgtgcccagaccacaaggaggaggtgacccactactgcaagacctgccagaggctggtgtgccagctgtgccgggtgcggaggacccacagcggccacaagatcacccctgtgctgagcgcctaccaggccctgaaggacaagctgaccaagagcctgacctacatcctgggcaaccaggacacagtgcagacccagatctgtgagctggaggaggccgtgcgccacacagaggtgtctggccagcaggccaaggaggaggtgtcccagctggtgcggggcctgggcgctgtgctggaggagaagagggccagcctgctgcaggccatcgaggagtgccagcaggagcggctggcccggctgagcgcccagatccaggagcacaggagcctgctggatggcagcggcctggtgggctacgcccaggaggtgctgaaggagacagaccagccctgctttgtgcaggccgccaagcagctgcacaacagaattgcccgggccacagaggccctgcagaccttccggcctgctgccagcagcagcttccgccactgccagctggatgtgggccgggagatgaagctgctgacagagctgaacttcctgcggggctgcggccaccggggcctgtgcagcggggccccccagtgcctgcggccccccagcctgaccccatctgcccccctgcccatgatccgcagcagctgtgccggcggctgcccccccatccaccacctgcccggcaccatccccctgagcagcggggccaggatgtgcctgctgagccaggcccccccagctggcagcggcggcagaagatag

SEQ ID NO: 42937 - DNA, 2154 bp, Artificial Sequence
  Description of Artificial Sequence: Synthetic coding sequence
atggccgccaagaggggcaccaagacctccatgaagaacatggagaaggagctgctgtgccctgtgtgccaggagatgtacaagcagcccctggtgctgccctgcacccacaacgtgtgccaggcctgtgcccgggaggtgctgggccagcagggctacatcggccacggcggggaccccagcagcgagcccaccagccctgccagcacccccagcaccaggagcccccggctgagcaggaggaccctgcccaagccagaccggctggaccggctgctgaagagcggcttcggcacctacccaggcaggaagagaggagccctgcacccccaggtgatcatgttcccctgcccagcctgccagggagatgtggagctgggggagcggggcctggccggcctcttcaggaacctgaccctggagcgggtggtggagcgctaccggcagagcgtgtctgtgggcggggccatcctgtgccagctgtgcaagcccccacccctggaggccaccaagggctgcacagaatgtcgggccaccttctgcaatgaatgcttcaagctgttccacccctggggcacccagaaggcccagcacgagcccaccctgcccaccctgtccttccggcccaagggcctgatgtgcccagaccacaaggaggaggtgacccactactgcaagacctgccagaggctggtgtgccagctgtgccgggtgcggaggacccacagcggccacaagatcacccctgtgctgagcgcctaccaggccctgaaggacaagctgaccaagagcctgacctacatcctgggcaaccaggacacagtgcagacccagatctgtgagctggaggagaagagggccagcctgctgcaggccatcgaggagtgccagcaggagcggctggcccggctgagcgcccagatccaggagcacaggagcctgctggatggcagcggcctggtgggctacgcccaggaggtgctgaaggagacagaccagccctgctttgtgcaggccgccaagcagctgcacaacagaattgcccgggccacagaggccctgcagaccttccggcctgctgccagcagcagcttccgccactgccagctggatgtgggccgggagatgaagctgctgacagagctgaacttcctgcgggtgcctgaggcccctgtgattgacacccagaggacctttgcctatgaccagatcttcctgtgctggaggctgcccccccacagccccccagcctggcactacacagtggagttcagaagaacagatgtgcctgcccagcccggccccacccgctggcagaggcgggaggaggtgcggggcaccagcgccctgctggagaacccagacaccggctctgtgtatgtgctgcgggtgcggggctgcaacaaggccggctacggggagtacagtgaagatgtgcacctgcacaccccaccagcccctgtgctgcacttcttcctggacagccgctggggcgccagccgggagcggctggccatcagcaaggaccagagagctgtgcgctctgtgcccggcctgcccctgctgctggccgctgaccggctgctgaccggctgccacctgtctgtggatgtggtgctgggagatgtggccgtgacccagggccgcagctactgggcctgtgctgtggaccctgccagctacctggtgaaggtgggcgtgggcctggagagcaagctgcaggagagcttccagggcgccccagatgtgatcagccccaggtatgaccctgacagcggccatgacagcggggctgaagatgccaccgtggaggccagccccccatttgccttcctgaccatcggcatgggcaagatcctgctgggcagcggggccagcagcaatgccggcctgaccggcagagatggccccacagctggctgcaccgtgcccctgcccccccggctgggcatctgcctggactatgagcggggccgggtgtccttcctggatgctgtgtccttccggggcctgctggagtgccccctggactgcagcggccctgtgtgcccagccttctgcttcatcggcggcggcgctgtgcagctgcaggagcctgtgggcaccaagccagagaggaaggtgaccatcggcggctttgccaagctggactag

SEQ ID NO: 42938 - DNA, 1518 bp, Artificial Sequence
  Description of Artificial Sequence: Synthetic coding sequence
atgaggcggggcggcatcctgggccacaggcctggcccccaggccttcctggtgcctggggccagcgctgccaccctgtacaagacctccatgaagaacatggagaaggagctgctgtgccctgtgtgccaggagatgtacaagcagcccctggtgctgccctgcacccacaacgtgtgccaggcctgtgcccgggaggtgctgggccagcagggctacatcggccacggcggggaccccagcagcgagcccaccagccctgccagcacccccagcaccaggagcccccggctgagcaggaggaccctgcccaagccagaccggctggaccggctgctgaagagcggcttcggcacctacccaggcaggaagagaggagccctgcacccccaggtgatcatgttcccctgcccagcctgccagggagatgtggagctgggggagcggggcctggccggcctcttcaggaacctgaccctggagcgggtggtggagcgctaccggcagagcgtgtctgtgggcggggccatcctgtgccagctgtgcaagcccccacccctggaggccaccaagggctgcacagaatgtcgggccaccttctgcaatgaatgcttcaagctgttccacccctggggcacccagaaggcccagcacgagcccaccctgcccaccctgtccttccggcccaagggcctgatgtgcccagaccacaaggaggaggtgacccactactgcaagacctgccagaggctggtgtgccagctgtgccgggtgcggaggacccacagcggccacaagatcacccctgtgctgagcgcctaccaggccctgaaggacaagctgaccaagagcctgacctacatcctgggcaaccaggacacagtgcagacccagatctgtgagctggaggaggccgtgcgccacacagaggtgtctggccagcaggccaaggaggaggtgtcccagctggtgcggggcctgggcgctgtgctggaggagaagagggccagcctgctgcaggccatcgaggagtgccagcaggagcggctggcccggctgagcgcccagatccaggagcacaggagcctgctggatggcagcggcctggtgggctacgcccaggaggtgctgaaggagacagaccagccctgctttgtgcaggccgccaagcagctgcacaaccgcatcgcccgggccacagaggccctgcagaccttccggcctgctgccagcagcagcttccgccactgccagctggatgtgggccgggagatgaagctgctgacagagctgaacttcctgcggggctgcggccaccggggcctgtgcagcggggccccccagtgcctgcggccccccagcctgacccccagcgcccccctgcccatgatccgcagcagctgtgccggcggctgcccccccatccaccacctgcccggcaccatccccctgagcagcggggccaggatgtgcctgctgagccaggcccctcctgctggcagcggcggcagaagatag

SEQ ID NO: 42939 - DNA, 1902 bp, Artificial Sequence
  Description of Artificial Sequence: Synthetic coding sequence
atgttcccctgcccagcctgccagggagatgtggagctgggggagcggggcctggccggcctcttcaggaacctgaccctggagcgggtggtggagcgctaccggcagagcgtgtctgtgggcggggccatcctgtgccagctgtgcaagcccccacccctggaggccaccaagggctgcacagagtgccgggccaccttctgcaatgaatgcttcaagctgttccacccctggggcacccagaaggcccagcacgagcccaccctgcccaccctgtccttccggcccaagggcctgatgtgcccagaccacaaggaggaggtgacccactactgcaagacctgccagaggctggtgtgccagctgtgccgggtgcggaggacccacagcggccacaagatcacccctgtgctgagcgcctaccaggccctgaaggacaagctgaccaagagcctgacctacatcctgggcaaccaggacacagtgcagacccagatctgtgagctggaggaggccgtgcgccacacagaggtgtctggccagcaggccaaggaggaggtgtcccagctggtgcggggcctgggcgctgtgctggaggagaagagggccagcctgctgcaggccatcgaggagtgccagcaggagcggctggcccggctgagcgcccagatccaggagcacaggagcctgctggatggcagcggcctggtgggctacgcccaggaggtgctgaaggagacagaccagccctgctttgtgcaggccgccaagcagctgcacaacagaattgcccgggccacagaggccctgcagaccttccggcctgctgccagcagcagcttccgccactgccagctggatgtgggccgggagatgaagctgctgacagagctgaacttcctgcgggtgcctgaggcccctgtgattgacacccagaggacctttgcctatgaccagatcttcctgtgctggaggctgcccccccacagccccccagcctggcactacacagtggagttcagaagaacagatgtgcctgcccagcccggccccacccgctggcagaggcgggaggaggtgcggggcaccagcgccctgctggagaacccagacaccggctctgtgtatgtgctgcgggtgcggggctgcaacaaggccggctacggggagtacagtgaagatgtgcacctgcacaccccaccagcccctgtgctgcacttcttcctggacagccgctggggcgccagccgggagcggctggccatcagcaaggaccagagagctgtgcgctctgtgcccggcctgcccctgctgctggccgctgaccggctgctgaccggctgccacctgtctgtggatgtggtgctgggagatgtggccgtgacccagggccgcagctactgggcctgtgctgtggaccctgccagctacctggtgaaggtgggcgtgggcctggagagcaagctgcaggagagcttccagggcgccccagatgtgatcagccccaggtatgaccctgacagcggccatgacagcggggctgaagatgccaccgtggaggccagccccccatttgccttcctgaccatcggcatgggcaagatcctgctgggcagcggggccagcagcaatgccggcctgaccggcagagatggccccacagctggctgcaccgtgcccctgcccccccggctgggcatctgcctggactatgagcggggccgggtgtccttcctggatgctgtgtccttccggggcctgctggagtgccccctggactgcagcggccctgtgtgcccagccttctgcttcatcggcggcggcgctgtgcagctgcaggagcctgtgggcaccaagccagagaggaaggtgaccatcggcggctttgccaagctggactag

SEQ ID NO: 42940 - DNA, 675 bp, Artificial Sequence
  Description of Artificial Sequence: Synthetic coding sequence
atgagccgccgcatcatcgtgggcaccctgcagaggacccagaggaacatgaacagcggcatcagccaggtgttccagcgggagctgacctgccccatctgcatgaactacttcattgatcctgtgaccatcgactgtggccacagcttctgccggccctgcttctacctgaactggcaggacatccccatcctgacccagtgctttgagtgcatcaagaccatccagcagaggaacctgaagaccaacatccggctgaagaagatggccagcctggccaggaaggccagcctgtggctgttcctgagcagcgaggagcagatgtgtggcatccaccgggagaccaagaagatgttctgtgaggtggacaggagcctgctgtgcctgctgtgcagcagcagccaggagcaccgctaccaccgccactgcccagctgagtgggccgctgaggagcactgggagaagctgctgaagaagatgcagagcctgtgggagaaggcctgtgagaaccagaggaacctgaatgtggagaccacccgcatcagccactggaaggcctttggagacatcctgtacagaagtgagagcgtgctgctgcacatgccccagcccctgaacctggccctgcgggccggccccatcaccggcctgcgggaccggctgaaccagttctag

SEQ ID NO: 42941 - DNA, 1359 bp, Artificial Sequence
  Description of Artificial Sequence: Synthetic coding sequence
atgaacagcggcatcctgcaggtgttccagggcgagctgatctgccccctgtgcatgaactacttcattgatcctgtgaccatcgactgtggccacagcttctgccggccctgcttctacctgaactggcaggacatccccttcctggtgcagtgcagcgagtgcaccaagagcacagagcagatcaacctgaagaccaacatccacctgaagaagatggccagcctggccaggaaggtgtccctgtggctgttcctgagcagcgaggagcagatgtgtggcacccaccgggagaccaagaagatcttctgtgaggtggacaggagcctgctgtgcctgctgtgcagcagcagccaggagcaccgctaccaccgccaccggcccatcgagtgggccgctgaggagcaccgggagaagctgctgcagaagatgcagagcctgtgggagaaggcctgtgagaaccacaggaacctgaatgtggagaccaccaggacccgctgctggaaggactatgtgaacctgcggctggaggccatccgggcagagtaccagaagatgcctgccttccaccacgaggaggagaagcacaacctggagatgctgaagaagaagggcaaggagatcttccaccggctgcacctgagcaaggccaagatggcccacaggatggagatcctgcggggcatgtatgaggagctgaatgagatgtgccacaagccagatgtggagctgctgcaggccttcggggacatcctgcacaggtctgagagcgtgctgctgcacatgccccagcccctgaaccctgagctgtctgctggccccatcaccggcctgcgggaccggctgaaccagttccgggtgcacatcaccctgcaccacgaggaggccaacaatgacatcttcctgtatgagatcctgcgctccatgtgcatcggctgtgaccaccaggatgtgccctacttcaccgccacccccaggagcttcctggcctggggcgtgcagaccttcaccagcggcaagtactactgggaggtgcacgtgggggacagctggaactgggcctttggagtgtgcaacatgtacaggaaggagaagaaccagaatgagaagattgatggcaaggccggcctcttcctgctgggctgtgtgaagaatgacatccagtgcagcctcttcaccaccagccccctgatgctgcagtacatccccaagcccaccagccgggtgggcctcttcctggactgtgaggccaagacagtgtcctttgtggatgtgaaccagagcagcctcatctacaccatccccaactgcagcttcagcccccccctgcggcccatcttctgctgcatccacttctag

SEQ ID NO: 42942 - DNA, 1341 bp, Artificial Sequence
  Description of Artificial Sequence: Synthetic coding sequence
atgaacagcggcatcctgcaggtgttccagggcgagctgatctgccccctgtgcatgaactacttcattgatcctgtgaccatcgactgtggccacagcttctgccggccctgcttctacctgaactggcaggacatccccttcctggtgcagtgcagcgagtgcaccaagagcacagagcagatcaacctgaagaccaacatccacctgaagaagatggccagcctggccaggaaggtgtccctgtggctgttcctgagcagcgaggagcagatgtgtggcacccaccgggagaccaagaagatcttctgtgaggtggacaggagcctgctgtgcctgctgtgcagcagcagccaggagcaccgctaccaccgccaccggcccatcgagtgggccgctgaggagcaccgggagaagctgctgcagaagatgcagagcctgtgggagaaggcctgtgagaaccacaggaacctgaatgtggagaccaccaggacccgctgctggaaggactatgtgaacctgcggctggaggccatccgggcagagtaccagaagatgcctgccttccaccacgaggaggagaagcacaacctggagatgctgaagaagaagggcaaggagatcttccaccggctgcacctgagcaaggccaagatggcccacaggatggagatcctgcggggcatgtatgaggagctgaatgagatgtgccacaagccagatgtggagctgctgcaggacctgggggacatggtggcccggtctgagagcgtgctgctgcacatgctgcagcctgtgaaccctgagctgcccaccggccccatcaccggccctgtggaccggctgaaccacttccgggtggagatctccttcacctgggagggcaccaactacaacatcggcctgtttgaagatgtgcgcagcctgatgttccggcggggcagcctgaacagcgacagaagtgactactttgctgcctggggcgcctgggtgttcagcagcggcaagcactactgggagctggatgtggacaacagctgggactgggccctgggcgtgtgcaaggacagctggatcaggaagaacagcaccatgttcaacagcaaggacatcttcctgctgctgtgtgtgaaggtggacaaccacttcagcctgctgaccaccagccccatgttcccccactacgtggagaagcccctggtgcgggtgggcgtcttcctgaactttgaaagtggctctgtgtccttcctgaatgtgaccaagaacagcctcatctggaactacccagctggcagcctgaacttccctgtgcgctccttcttctacacaggccacaggtag

SEQ ID NO: 42943 - DNA, 1359 bp, Artificial Sequence
  Description of Artificial Sequence: Synthetic coding sequence
atgaacagcggcatcctgcaggtgttccagggcgagctgatctgccccctgtgcatgaactacttcattgatcctgtgaccatcgactgtggccacagcttctgccggccctgcttctacctgaactggcaggacatccccttcctggtgcagtgcagcgagtgcaccaagagcacagagcagatcaacctgaagaccaacatccacctgaagaagatggccagcctggccaggaaggtgtccctgtggctgttcctgagcagcgaggagcagatgtgtggcacccaccgggagaccaagaagatcttctgtgaggtggacaggagcctgctgtgcctgctgtgcagcagcagccaggagcaccgctaccaccgccaccggcccatcgagtgggccgctgaggagcaccgggagaagctgctgcagaagatgcagagcctgtgggagaaggcctgtgagaaccacaggaacctgaatgtggagaccaccaggacccgctgctggaaggactatgtgaacctgcggctggaggccatccgggcagagtaccagaagatgcctgccttccaccacgaggaggagaagcacaacctggagatgctgaagaagaagggcaaggagatcttccaccggctgcacctgagcaaggccaagatggcccacaggatggagatcctgcggggcatgtatgaggagctgaatgagatgtgccacaagccagatgtggagctgctgcaggccttcggggacatcctgcacaggtctgagagcgtgctgctgcacatgccccagcccctgaaccctgagctgtctgctggccccatcaccggcctgcgggaccggctgaaccagttccgggtgcacatcaccctgcaccacgaggaggccaacagcgacatcttcctgtatgagatcctgcgctccatgtgcatcggctgtgaccaccaggatgtgccctacttcaccgccacccccaggagcttcctggcctggggcgtgcagaccttcaccagcggcaagtactactgggaggtgcacgtgggggacagctggaactgggcctttggagtgtgcaacatgtacaggaaggagaagaaccagaatgagaagattgatggcaaggagggcctcttcctgctgggctgcatcaagaatgacatccagtgcagcctcttcaccaccagccccctgatgctgcagtacatccccaagcccaccagccgggtgggcctcttcctggactgtgaggccaagacagtgtcctttgtggatgtgaaccagagcagcctcatctacaccatccccaactgcagcttcagcccccccctgcggcccatcttctgctgcatccacttctag

SEQ ID NO: 42944 - DNA, 894 bp, Artificial Sequence
  Description of Artificial Sequence: Synthetic coding sequence
atggccggctacgccaccacccccagccccatgcagaccctgcaggaggaggccgtgtgtgccatctgcctggactacttcaaggaccctgtgtccatcagctgtggccacaacttctgccggggctgtgtgacccagctgtggagcaaagaagatgaggaggaccagaatgaggaggaggatgagtgggaggaggaggaggatgaggaggccgtgggcgccatggatggctgggatggcagcatccgggaggtgctgtacagaggaaatgctgatgaggagctgttccaggaccaggatgatgatgagctgtggctgggggacagcggcatcaccaactgggacaacgtggactacatgtgggatgaggaggaggaggaggaggaggaggaccaggactactacctgggcggcctgcggccagacctgagaattgatgtgtaccgggaggaggagatcctggaggcctatgatgaagatgaagatgaggagctgtacccagacatccaccccccacccagcctgcccctgcccggccagttcacctgcccccagtgcaggaagagcttcacccggcgctccttccggcccaacctgcagctggccaacatggtgcagatcatccggcagatgtgccccaccccctaccggggcaacagaagcaatgaccagggcatgtgcttcaagcaccaggaggccctgaagctgttctgtgaggtggacaaggaggccatctgtgtggtgtgccgggagagccgcagccacaagcagcacagcgtgctgcccctggaggaggtggtgcaggagtaccaggagatcaagctggagaccaccctggtgggcatcctgcagatcgagcaggagagcatccacagcaaggcctacaaccagtag

SEQ ID NO: 42945 - DNA, 1461 bp, Artificial Sequence
  Description of Artificial Sequence: Synthetic coding sequence
atggcctgggcccctcctggagagcggctgcgggaggatgcccgctgccctgtgtgcctggacttcctgcaggagcctgtgtctgtggactgtggccacagcttctgcctgcgctgcatcagcgagttctgtgagaagagtgatggagcccagggcggcgtgtatgcctgcccccagtgccggggccccttccggcccagcggcttccggcccaaccggcagctggccggcctggtggagagcgtgcggcggctgggcctgggcgccggccctggggcccggcgctgtgcccggcatggagaggacctgagccgcttctgtgaagaagatgaggccgccctgtgctgggtgtgtgatgctggccctgagcacaggacccacaggacagcccccctgcaggaggccgccggcagctaccaggtgaagctgcagatggccctggagctgatgaggaaggagctggaggatgccctgacccaggaggccaacgtgggcaagaagacagtcatctggaaggagaaggtggagatgcagaggcagcgcttccggctggagtttgagaagcaccggggcttcctggcccaggaggagcagaggcagctgcggcggctggaggccgaggagcgggccaccctgcagaggctgcgggagagcaagagccggctggtgcagcagagcaaggccctgaaggagctggctgatgagctgcaggagcgctgccagaggcctgccctgggcctgctggagggcgtgcggggcgtgctgagccgcagcaaggctgtgacccggctggaggccgagaacatccccatggagctgaagacagcctgctgcatccctggccggcgggagctgctgaggaagttccaggtggatgtgaagctggaccctgccacagcccaccccagcctgctgctgacagctgacctgcggtctgtgcaggatggagagccctggagagatgtgcccaacaaccctgagagatttgacacctggccctgcatcctgggcctgcagagcttcagcagcggccgccactactgggaggtgctggtgggggagggcgctgagtggggcctgggcgtgtgccaggacaccctgcccaggaagggggagaccacccccagcccagaaaatggagtgtgggccctgtggctgctgaagggaaatgagtacatggtgctggccagccccagcgtgcccctgctgcagctggagagcccccgctgcatcggcatcttcctggactatgaagctggggagatctccttctacaacgtgacagatggcagctacatctacaccttcaaccagctgttcagcggcctgctgcggccctacttcttcatctgtgatgccacccccctcatcctgccccccaccaccatcgccggcagcggcaactgggccagccgggaccacctggaccctgccagtgatgtgagagatgaccacctgtag

SEQ ID NO: 42946 - DNA, 1416 bp, Artificial Sequence
  Description of Artificial Sequence: Synthetic coding sequence
atggagtttgtgacagccctggtgaacctgcaggaggagagcagctgccccatctgcctggagtacctgaaggaccctgtgaccatcaactgtggccacaacttctgccgcagctgcctgtctgtgtcctggaaggacctggatgacaccttcccctgccctgtgtgccgcttctgcttcccctacaagagcttcagaagaaacccccagctgaggaacctgacagaaattgccaagcagctgcagatccgccgcagcaagaggaagaggcagaaggaaaatgccatgtgtgagaagcacaaccagttcctgaccctcttctgtgtgaaggacctggagatcctgtgcacccagtgcagcttcagcaccaagcaccagaagcactacatctgccccatcaagaaggccgccagctaccaccgggagatcctggagggcagcctggagcccctgaggaacaacatcgagcgggtggagaaggtgatcatcctgcagggcagcaagtctgtggagctgaagaagaaggtggagtacaagcgggaggagatcaacagcgagtttgagcagatccgcctcttcctgcagaatgagcaggagatgatcctgcggcagatccaggatgaggagatgaacatcctggccaagctgaatgaaaacctggtggagctgagtgactatgtgtccaccctgaagcacctgctgcgggaggtggagggcaagtctgtgcagagcaacctggagctgctgacccaggccaagtccatgcaccacaagtaccagaacctgaagtgcccagagctgttctccttccggctgaccaagtatggcttcagcctgcccccccagtacagcggcctggaccgcatcatcaagcccttccaggtggatgtgatcctggacctgaacacagcccacccccagctgctggtgtctgaggacaggaaggctgtgcgctatgaaaggaagaagaggaacatctgctatgacccccggcgcttctacgtgtgcccagctgtgctgggcagccagcgcttcagcagcggccgccactactgggaggtggaggtgggcaacaagcccaagtggatcctgggcgtgtgccaggactgcctgctgaggaactggcaggaccagcccagcgtgctgggcggcttctgggccatcggccgctacatgaagagcggctacgtggccagcggccccaagaccacccagctgctgcctgtggtgaagcccagcaagattggcatcttcctggactatgagctgggggacctgtccttctacaacatgaatgacaggagcatcctgtacaccttcaatgactgcttcacagaagctgtgtggccctacttctacacaggaacagacagcgagcccctgaagatctgcagcgtgtctgattctgaaagatag

SEQ ID NO: 42947 - DNA, 273 bp, Artificial Sequence
  Description of Artificial Sequence: Synthetic coding sequence
atggagtttgtgacagccctggtgaacctgcaggaggagagcagctgccccatctgcctggagtacctgaaggaccctgtgaccatcaactgtggccacaacttctgccgcagctgcctgtctgtgtcctggaaggacctggatgacaccttcccctgccctgtgtgccgcttctgcttcccctacaagagcttcagaagaaacccccagctgaggaacctgacagaaattgccaagcagctgcagatccgccgcagcaagaggaagaggtag

SEQ ID NO: 42948 - DNA, 1416 bp, Artificial Sequence; identical to SEQ ID NO: 42946
  Description of Artificial Sequence: Synthetic coding sequence

SEQ ID NO: 42949 - DNA, 1416 bp, Artificial Sequence; identical to SEQ ID NO: 42946
  Description of Artificial Sequence: Synthetic coding sequence

SEQ ID NO: 42950 - DNA, 630 bp, Artificial Sequence
  Description of Artificial Sequence: Synthetic coding sequence
atggagtttgtgacagccctggccgacctgcgggcagaggccagctgccccatctgcctggactacctgaaggaccctgtgaccatcagctgtggccacaacttctgcctgagctgcatcatcatgtcctggaaggacctgcatgacagcttcccctgccccttctgccacttctgctgcccagagaggaagttcatcagcaacccccagctgggcagcctgacagaaattgccaagcagctgcagatccgcagcaagaagaggaagaggcaggaggagaagcacgtgtgcaagaagcacaaccaggtgctgaccttcttctgccagaaggacctggagctgctgtgcccccgctgcagcctgagcacagaccaccagcaccactgtgtgtggcccatcaagaaggccgccagctaccacaggaagaagctggaggagtacaatgccccctggaaggagcgggtggagctgattgagaaggtgatcaccatgcagaccaggaagagcctggagctgaagaagaagatggagagccccagcgtgacccggctggagtgcagctgcaccatcagcgcccacttcaacctgcggctgcccggcagcagtgacagcagcgccagcggcagctag

SEQ ID NO: 42951 - DNA, 1428 bp, Artificial Sequence
  Description of Artificial Sequence: Synthetic coding sequence
atggcctgcagcctgaaggatgagctgctgtgcagcatctgcctgagcatctaccaggaccctgtgtccctgggctgtgagcactacttctgccgccgctgcatcacagagcactgggtgcggcaggaggcccagggcgcccgggactgcccagagtgcaggaggacctttgctgagcccgccctggcccccagcctgaagctggccaacatcgtggagcgctacagcagcttccccctggatgccatcctgaatgccaggagagctgcccggccctgccaggcccatgacaaggtgaagctgttctgcctgacagaccgggccctgctgtgcttcttctgtgatgagcccgccctgcacgagcagcaccaggtgactggaattgatgatgcctttgatgagctgcagcgggagctgaaggaccagctgcaggccctgcaggacagcgagcgggagcacacagaggccctgcagctgctgaagaggcagctggccgagaccaagagcagcaccaagagcctgcggaccaccatcggggaggcctttgagcggctgcaccggctgctgcgggagcggcagaaggccatgctggaggagctggaggccgacacagcccggaccctgacagacatcgagcagaaggtgcagcgctacagccagcagctgaggaaggtgcaggagggcgcccagatcctgcaggagcggctggccgagacagacagacacaccttcctggccggcgtggccagcctgtctgagcggctgaagggcaagatccacgagaccaacctgacctatgaggacttccccaccagcaagtacacaggccccctgcagtacaccatctggaagagcctcttccaggacatccaccctgtgcctgctgccctgaccctggaccctggaacagcccaccagaggctcatcctgagtgatgactgcaccatcgtggcctacggcaacctgcacccccagcccctgcaggacagccccaagagatttgatgtggaggtgtctgtgctgggcagcgaggccttcagcagcggcgtgcactactgggaggtggtggtggccgagaagacccagtgggtgattggcctggcccatgaagctgccagcaggaagggcagcatccagatccagcccagccggggcttctactgcatcgtgatgcatgatggcaaccagtacagcgcctgcacagagccctggacccggctgaatgtgcgggacaagctggacaaggtgggcgtcttcctggactatgaccagggcctgctgatcttctacaatgctgatgacatgtcctggctgtacaccttccgggagaagtttcctgggaagctgtgcagctacttcagccctggccagagccacgccaacgggaagaatgtgcagcccctgcgcatcaacacagtgcgcatctag

SEQ ID NO: 42952 - DNA, 1185 bp, Artificial Sequence
  Description of Artificial Sequence: Synthetic coding sequence
atggcctgcagcctgaaggatgagctgctgtgcagcatctgcctgagcatctaccaggaccctgtgtccctgggctgtgagcactacttctgccgccgctgcatcacagagcactgggtgcggcaggaggcccagggcgcccgggactgcccagagtgcaggaggacctttgctgagcccgccctggcccccagcctgaagctggccaacatcgtggagcgctacagcagcttccccctggatgccatcctgaatgccaggagagctgcccggccctgccaggcccatgacaaggtgaagctgttctgcctgacagaccgggccctgctgtgcttcttctgtgatgagcccgccctgcacgagcagcaccaggtgactggaattgatgatgcctttgatgagctgcagcgggagctgaaggaccagctgcaggccctgcaggacagcgagcgggagcacacagaggccctgcagctgctgaagaggcagctggccgagaccaagagcagcaccaagagcctgcggaccaccatcggggaggcctttgagcggctgcaccggctgctgcgggagcggcagaaggccatgctggaggagctggaggccgacacagcccggaccctgacagacatcgagcagaaggtgcagcgctacagccagcagctgaggaaggtgcaggagggcgcccagatcctgcaggagcggctggccgagacagacagacacaccttcctggccggcgtggccagcctgtctgagcggctgaagggcaagatccacgagaccaacctgacctatgaggacttccccaccagcaagtacacaggccccctgcagtacaccatctggaagagcctcttccaggacatccaccctgtgcctgctgccctgaccctggaccctggaacagcccaccagaggctcatcctgagtgatgactgcaccatcgtggcctacggcaacctgcacccccagcccctgcaggacagccccaagagatttgatgtggaggtgtctgtgctgggcagcgaggccttcagcagcggcgtgcactactgggaggtggtggtggccgagaagacccagtgggtgattggcctggcccatgaagctgccagcaggaagggcagcatccagatccagaacctgggctgcaagggcgtgtgggagatgtccttcccctag

SEQ ID NO: 42953 - DNA, 1185 bp, Artificial Sequence; identical to SEQ ID NO: 42952
  Description of Artificial Sequence: Synthetic coding sequence

SEQ ID NO: 42954 - DNA, 1428 bp, Artificial Sequence; identical to SEQ ID NO: 42951
  Description of Artificial Sequence: Synthetic coding sequence

SEQ ID NO: 42955 - DNA, 1065 bp, Artificial Sequence
  Description of Artificial Sequence: Synthetic coding sequence
atgcctgagaagacagctgtggaccagccctggacccaggccctgcgggagctgaaggaccagctgcaggccctgcaggacagcgagcgggagcacacagaggccctgcagctgctgaagaggcagctggccgagaccaagagcagcaccaagagcctgcggaccaccatcggggaggcctttgagcggctgcaccggctgctgcgggagcggcagaaggccatgctggaggagctggaggccgacacagcccggaccctgacagacatcgagcagaaggtgcagcgctacagccagcagctgaggaaggtgcaggagggcgcccagatcctgcaggagcggctggccgagacagacagacacaccttcctggccggcgtggccagcctgtctgagcggctgaagggcaagatccacgagaccaacctgacctatgaggacttccccaccagcaagtacacaggccccctgcagtacaccatctggaagagcctcttccaggacatccaccctgtgcctgctgccctgaccctggaccccggcacagcccaccagaggctcatcctgagtgatgactgcaccatcgtggcctacggcaacctgcacccccagcccctgcaggacagccccaagagatttgatgtggaggtgtctgtgctgggcagcgaggccttcagcagtggagtgcactactgggaggtggtggtggccgagaagacccagtgggtgattggcctggcccacgaggccgccagcaggaagggcagcatccagatccagcccagccggggcttctactgcatcgtgatgcatgatggcaaccagtacagcgcctgcacagagccctggacccggctgaatgtgcgggacaagctggacaaggtgggcgtcttcctggactatgaccagggcctgctgatcttctacaatgctgatgacatgtcctggctgtacaccttccgggagaagtttcctgggaagctgtgcagctacttcagccctggccagagccacgccaacgggaagaatgtgcagcccctgcgcatcaacacagtgcgcatctag

SEQ ID NO: 42956 - DNA, 1350 bp, Artificial Sequence
  Description of Artificial Sequence: Synthetic coding sequence
atggacagtgatgacctgcaggtgttccagaatgaactcatctgctgcatctgtgtgaactacttcattgatcctgtgaccatcgactgtggccacagcttctgccggccctgcctgtgcctgtgcagcgaggagggccgggcccccatgcgctgccccagctgcaggaagaccagcgagaagcccaacttcaacaccaacctggtgctgaagaagctgagcagcctggcccggcagacccggccccagaacatcaacagcagtgacaacatctgtgtgctgcacgaggagaccaaggagctgttctgtgaggccgacaagaggctgctgtgtggcccctgcagcgagagccctgagcacatggcccacagccacagccccatcggctgggccgctgaggagtgccgggagaagctgatcaaggagatggactacctgtgggagatcaaccaggagaccaggaacaacctgaaccaggagaccagcaccttccacagcctgaaggactatgtgtctgtgaggaagaggatcatcaccatccagtaccagaagatgcccatcttcctggatgaggaggagcagaggcacctgcaggccctggagcgggaggccgaggagctgttccagcagctgcaggacagccaggtgaggatgacccagcacctggagaggatgaaggacatgtaccgggagctgtgggagacctgccacatgccagatgtggtgctgctgcaggatgtgagaaatgtgtctgccaggacagacctggcccagatgcagaagccccagcctgtgaaccctgagctgacctcctggtgcatcactggagtgctggacatgctgaacaacttccgggtggacagcgccctgagcacagagatgatcccctgctacatcagcctgtctgaagatgtgcgctacgtgatctttggagatgaccacctgagcgcccccacagacccccagggcgtggacagctttgctgtgtggggcgcccaggccttcaccagcggcaagcactactgggaggtggatgtgaccctgagcagcaactggatcctgggcgtgtgccgggacagcaggacagcagatgccaactttgtgattgacagtgatgagcgcttcttcctgatcagcagcaagaggagcaaccactacagcctgagcaccaacagccccccactcatccagtatgtgcagaggcccctgggccgggtgggcgtcttcctggactatgacaatggatctgtgtccttctttgatgtgtccaagggcagcctcatctacggcttcccccccagcagcttcagcagccccctgcggcccttcttctgcttcggctgcacctag

SEQ ID NO: 42957 - DNA, 1344 bp, Artificial Sequence
  Description of Artificial Sequence: Synthetic coding sequence
atggacagcgacaccctgcgggtcttccagaatgaactcatctgctgcatctgtgtgaactacttcattgatcctgtgaccacagactgtgtgcacagcttctgccggccctgcctgtgcctgtgcagcgaggagggccgggcccccatgcgctgccccctgtgcaggaagatcagcgagaagcccaacttcaacaccaacgtggccctgaagaagctggccagcctggcccggcagacccggccccagaacatcaacagcagtgacaacatctgtgtgctgcacgaggagaccaaggagctgttctgtgaggccgacaagaggctgctgtgtggcccctgcagcgagagccctgagcacatggcccacagccacagccccatcggctgggccgctgaggagtgccgggtgcagaagctgatcaaggagatggactacctgtggaagatcaaccaggagacccagaacaacctgaaccaggagaccagcaagttctgcagcctggtggaggacaagaggaaccgcatcgtgtaccgctaccagaagatgcacatcttcctggatgaggaggagcagaggcacctgcaggccctggagcgggaggccaaggagctgttccagcagctgcaggacagccaggtgaggatgacccagcacctggagggcatgaaggacatgtaccgggagctgtgggagacctaccacatgccagatgtggagctgctgcaggatgtgggcaacatcagcgccaggacagacctggcccagatgcccaagccccagcctgtgaaccctgagctgacctcctggtgcatcactggagtgctggacatgctgaacaacttccgggtggacaatgccctgagcacagagatgaccccctgctacatcagcctgtctgaagatgtgcggcgggtcatctttggagatgaccacaggtctgcccccatggacccccagggcgtggagagctttgctgtgtggtgtgcccaggccttcaccagcggcaagcactactgggaggtggatgtgacccacagcagcaactggatcctgggcgtgtgccgggacagcaggacagctgacaccaacatcgtgattgacagcgacaagaccttcttcagcatcagcagcaagaccagcaaccactacagcctgagcaccaacagccccccactcatccagtatgtgcagaggcccctgggctgggtgggcgtcttcctggactatgacaatggatctgtgtccttctttgatgtgtccaagggcagcctcatctacggcttcccccccagcagcttcagcagccccctgcggcccttcttctgcttcggctgcacctag

SEQ ID NO: 42958 - DNA, 1554 bp, Artificial Sequence
  Description of Artificial Sequence: Synthetic coding sequence
atggccgcccagctgctggaggagaagctgacctgtgccatctgcctgggcctgtaccaggaccctgtgaccctgccctgtggccacaacttctgtggggcctgcatccgggactggtgggacagatgtgggaaggcctgcccagaatgtcgggagcccttcccagatggagctgagctgcggagaaatgtggccctgtctggagtgctggaggtggtgcgggccggccctgcccgggaccccggccctgaccccggccctggccctgaccctgctgcccgctgccccaggcatggccggcccctggagctgttctgcaggacagagggccgctgtgtgtgcagcgtgtgcaccgtgagagaatgtcggctgcacgagcgggccctgctggatgctgagcggctgaagcgggaggcccagctgcgggccagcctggaggtgacccagcagcaggccacccaggccgagggccagctgctggagctgaggaagcagagcagccagatccagaacagcgcctgcatcctggcctcctgggtgtctgggaagttcagcagcctgctgcaggccctggagatccagcacaccacagccctgcggagcattgaggtggccaagacccaggccctggcccaggccagagatgaggagcagaggctgcgggtgcacctggaggccgtggcccggcacggctgccgcatccgggagctgctggagcaggtggatgagcagaccttcctgcaggagagccagctgctgcagcccccaggccccctgggccccctgacccccctgcagtgggatgaggaccagcagctgggggacctgaagcagctgctgagccggctgtgtggcctgctgctggaggagggcagccaccctggggccccagccaagcctgtggacctggcccctgtggaggcccctggccccctggcccctgtgcccagcacagtgtgccccctgcggaggaagctgtggcagaactacagaaacctgacctttgatcctgtgtctgccaacagacacttctacctgagccggcaggaccagcaggtgaagcactgccggcagagccggggccctgggggccctggcagctttgagctgtggcaggtgcagtgtgcccagagcttccaggccggccaccactactgggaggtgcgggccagtgaccacagcgtgaccctgggcgtgtcctacccccagctgccccgctgccgcctgggcccccacacagacaacatcggccggggcccctgctcctggggcctgtgtgtgcaggaggacagcctgcaggcctggcacaatggagaggcccagaggctgcccggggtgtctggccgcctgctgggcatggacctggacctggccagcggctgcctgaccttctacagcctggagccccagacccagcccctgtacaccttccacgccctcttcaaccagcccctgacccctgtgttctggctgctggagggccgcaccctgaccctgtgccaccagcctggagctgtgttccccctgggcccccaggaggaggtgctgtcctag

SEQ ID NO: 42959 - DNA, 1407 bp, Artificial Sequence
  Description of Artificial Sequence: Synthetic coding sequence
atgagcacagctgacctgatggagaacctgcgggaggagctgacctgcttcatctgcctggactacttcagcagccctgtgaccacagaatgtggccacagcttctgcctggtgtgcctgctgcgctcctgggaggagcacaacacccccctgagctgcccagagtgctggaggaccctggagggcccccacttccagagcaatgaaaggctgggccgcctggccagcatcgcccggcagctgcggagccaggtgctgcagagtgaagatgagcagggcagctatggccgcatgcccaccacagccaaggccctgagtgatgatgagcagggcggcagcgcctttgtggcccagagccacggggccaacagagtgcacctgagcagcgaggccgaggagcaccaccgggagaagctgcaggagatcctgaacctgctgcgggtgcggaggaaggaggcccaggccgtgctgacccatgagaaggagcgggtgaagctgtgccaggaggagaccaagacctgcaagcaggtggtggtgtctgagtacatgaagatgcaccagttcctgaaggaggaggagcagctgcagctgcagctgctggagcaggaggagaaggagaacatgaggaagctgaggaacaatgagatcaagctgacccagcagatccgcagcctgagcaagatgattgcccagatcgagagcagcagccagagcagcgcctttgagagcctggaggaggtgcggggggccctggagaggtctgagcccctgctgctgcagtgcccagaggccaccaccacagagctgagcctgtgccgcatcaccggcatgaaggagatgctgaggaagttcagcacagagatcaccctggaccctgccacagccaatgcctacctggtgctgtctgaggacctgaagtctgtgaagtatggaggcagccggcagcagctgcctgacaaccctgagagatttgaccagagcgccaccgtgctgggcacccagatcttcaccagcggccgccactactgggaggtggaggtgggcaacaagacagagtgggaggtgggcatctgcaaggacagcgtgtccaggaaaggaaacctgcccaagcccccaggggacctcttcagcctgattggcctgaagattggagatgactacagcctgtgggtgagcagccccctgaagggccagcacgtgcgggagcctgtgtgcaaggtgggcgtcttcctggactatgaaagtggccacatcgccttctacaacggcacagatgagagcctcatctacagcttcccccaggccagcttccaggaggccctgcggcccatcttcagcccctgcctgcccaatgaaggcaccaacacagaccccctgaccatctgcagcctgaacagccacgtgtag

SEQ ID NO: 42960 - DNA, 1164 bp, Artificial Sequence
  Description of Artificial Sequence: Synthetic coding sequence
atggtgtgtggcatccaggaggccgctgagaactacaggaagctgttccaggagatcctgaacaccagccgggagaagctggaggccgccaagagcatcctgacagatgagcaggagaggatggccatgatccaggaggaggagcagaacttcaagaagatgattgaaagtgagtacagcatgaggctgcggctgctgaatgaagaatgtgagcagaacctgcagaggcagcaggagtgcatcagtgacctgaacctgcgggagaccctgctgaaccaggccatcaagctggccacagagctggaggagatgttccaggagatgctgcagaggctgggccgggtgggccgggagaacatggagaagctgaaggagagcgaggcccgggccagcgagcaggtgcgcagcctgctgaagctgattgtggagctggagaagaagtgtggggagggcaccctggccctgctgaagaatgccaagtacagcctggagaggagcaagagcctgctgctggagcacctggagcccgcccacatcacagacctgagcctgtgccacatccggggcctgagctccatgttccgggtgctgcagaggcacctgaccctggaccctgagacagcccacccctgcctggccctgtctgaggacctgcggaccatgaggctgcggcacggccagcaggatggagctggcaaccctgagcggctggacttcagcgccatggtgctggccgctgagagcttcaccagcggccgccactactgggaggtggatgtggagaaggccacccgctggcaggtgggcatctaccacggcagcgcagatgccaagggcagcacagcccgggccagcggggagaaggtgctgctgaccggctctgtgatgggcacagagtggaccctgtgggtgttcccccccctgaagaggctcttcctggagaagaagctggacacagtgggcgtcttcctggactgtgagcacggccagatctccttctacaacgtgacagagatgagcctcatctacaacttcagccactgtgccttccagggcgccctgcggcctgtgttcagcctgtgcatccccaacggggacaccagcccagacagcctgaccatcctgcagcacggccccagctgtgatgccaccgtgagcccctag

SEQ ID NO: 42961 - DNA, 666 bp, Artificial Sequence
  Description of Artificial Sequence: Synthetic coding sequence
atgagcaagaggctgagcccccagctgcagcacaacatcacagaagatgcctactgtgagacccacctggagcccaccaggctcttctgtgatgtggaccagatcaccctgtgcagcaagtgcttccagagccaggagcacaagcaccacatggtgtgtggcatccaggaggccgctgagaactacaggaagctgttccaggagatcctgaacaccagccgggagaagctggaggccgccaagagcatcctgacagatgagcaggagaggatggccatgatccaggaggaggagcagaacttcaagaagatgattgaaagtgagtacagcatgaggctgcggctgctgaatgaagaatgtgagcagaacctgcagaggcagcaggagtgcatcagtgacctgaacctgcgggagaccctgctgaaccaggccatcaagctggccacagagctggaggagatgttccaggagatgctgcagaggctgggccgggtgggccgggagaacatggagaagctgaaggagagcgaggcccgggccagcgagcaggtgcgcagcctgctgaagctgattgtggagctggagaagaagtgtggggagggcaccctggccctgctgaaggtgcgctgctgggagaaggagaacaagatccacagcagcatctag

SEQ ID NO: 42962 - DNA, 1173 bp, Artificial Sequence
  Description of Artificial Sequence: Synthetic coding sequence
atgtgcatctgccacctgccctgcaggcctgtgaagcccaacatcatcggggagcagatcaccagcaagatgggcgcccactaccactgcatcatctgcagcgccaccatcaccaggagaacagacatgctgggccacgtgcggcggcacatgaacaagggggagaccaagagcagctacatcgccgccagcacagccaagccacccaaggagatcctgaaggaggccgacacagatgtgcaggtgtgccccaactacagcatcccccagaagacagacagctacttcaaccccaagatgaagctgaaccggcagctgatcttctgcaccctggccgccctggccgaggagaggaagcccctggagtgcctggatgcctttggagccaccggcatcatgggcctgcagtgggccaagcacctgggcaatgctgtgaaggtgaccatcaatgacctgaatgaaaacagcgtgaccctcatccaggagaactgccacctgaacaagctgaaggtggtggtggacagcaaggagaaggagaagagtgatgacatcctggaggagggggagaagaacctgggcaacatcaaggtgaccaagatggatgccaacgtgctgatgcacctgcggagctttgacttcatccacctggaccccttcggcacctctgtgaactacctggacagcgccttcaggaacatccggaacctgggcatcgtgtctgtgaccagcacagacatcagcagcctgtatgccaaggcccagcacgtggcccggcggcactacggctgcaacatcgtgaggacagagtactacaaggagctggccgcccgcatcgtggtggccgctgtggcccgggctgctgcccgctgcaacaagggcatcgaggtgctgtttgctgtggccctggagcactttgtgctggtggtggtgcgggtgctgcggggccccaccagcgcagatgaaacagccaagaagatccagtacctgatccactgccagtggtgtgaggagcgcatcttccagaaggatggcaacatggtggaggactacagcgccaacttcgtcatctcctacacaggcttcccctttgtgaaccggcaggacatcaggaagacccacatcgacagctgcctggtgacagtgatggaggcctgcctggagcggcagcagtag

SEQ ID NO: 42963 - DNA, 2202 bp, Artificial Sequence
  Description of Artificial Sequence: Synthetic coding sequence
atggagaacatggccgaggaggagctgctgcccctggagaaggaggaggtggaggtggcccaggtgcaggtgcccaccccagcccgggacagcgctggggtgcctgccccagccccagattctgccctggacagcgcccccaccccagccagcgccccagccccagccccagccctggcccaggccccagccctgagccccagcctggccagcgcccctgaggaggccaagagcaagaggcacatcagcatccagaggcagctggccgacctggagaacctggcctttgtgacagatggcaactttgacagcgccagcagcctgaacagcgacaacctggatgctggcaaccggcaggcctgccccctgtgccccaaggagaagttccgggcctgcaacagccacaagctgcggcggcacctgcagaacctgcactggaaggtgtctgtggagtttgagggctacaggatgtgcatctgccacctgccctgcaggcctgtgaagcccaacatcatcggggagcagatcaccagcaagatgggcgcccactaccactgcatcatctgcagcgccaccatcaccaggagaacagacatgctgggccacgtgcggcggcacatgaacaagggggagaccaagagcagctacatcgccgccagcacagccaagccacccaaggagatcctgaaggaggccgacacagatgtgcaggtgtgccccaactacagcatcccccagaagacagacagctacttcaaccccaagatgaagctgaaccggcagctgatcttctgcaccctggccgccctggccgaggagaggaagcccctggagtgcctggatgcctttggagccaccggcatcatgggcctgcagtgggccaagcacctgggcaatgctgtgaaggtgaccatcaatgacctgaatgaaaacagcgtgaccctcatccaggagaactgccacctgaacaagctgaaggtggtggtggacagcaaggagaaggagaagagtgatgacatcctggaggagggggagaagaacctgggcaacatcaaggtgaccaagatggatgccaacgtgctgatgcacctgcggagctttgacttcatccacctggaccccttcggcacctctgtgaactacctggacagcgccttcaggaacatccggaacctgggcatcgtgtctgtgaccagcacagacatcagcagcctgtatgccaaggcccagcacgtggcccggcggcactacggctgcaacatcgtgaggacagagtactacaaggagctggccgcccgcatcgtggtggccgctgtggcccgggctgctgcccgctgcaacaagggcatcgaggtgctgtttgctgtggccctggagcactttgtgctggtggtggtgcgggtgctgcggggccccaccagcgcagatgaaacagccaagaagatccagtacctgatccactgccagtggtgtgaggagcgcatcttccagaaggatggcaacatggtggaggagaacccctaccggcagctgccctgcaactgccacggctccatgcctgggaagacagccatcgagctgggccccctgtggagcagcagcctcttcaacacaggcttcctgaagaggatgctgtttgagagcctgcaccacggcctggatgacatccagaccctcatcaagaccctcatctttgaaagtgagtgcaccccccagagccagttcagcatccacgccagcagcaatgtgaacaagcaggaggagaatggagtcttcatcaagaccacagatgacaccaccacagacaactacatcgcccagggcaagaggaagagcaatgagatgatcaccaacctgggcaagaagcagaagacagatgtgtccacagagcacccccccttctactacaacatccaccgccacagcatcaagggcatgaacatgcccaagctgaagaagttcctgtgctacctgagccaggccggcttccgggtgtccaggacccactttgaccccatgggcgtgaggacagatgcccccctgatgcagttcaagagcatcctgctgaagtacagcacccccacctacacaggaggccagagcgagagccacgtgcagagcgccagcgaggacacagtgacagagcgggtggagatgtctgtgaatgacaaggccgaggccagcggctgccgccgctggtag

SEQ ID NO: 42964 - DNA, 639 bp, Artificial Sequence
  Description of Artificial Sequence: Synthetic coding sequence
acctctgtgaactacctggacagcgccttcaggaacatccggaacctgggcatcgtgtctgtgaccagcacagacatcagcagcctgtatgccaaggcccagcacgtggcccggcggcactacggctgcaacatcgtgaggacagagtactacaaggagctggccgcccgcatcgtggtggccgctgtggcccgggctgctgcccgctgcaacaagggcatcgaggtgctgtttgctgtggccctggagcactttgtgctggtggtggtgcgggtgctgcggggccccaccagcgcagatgaaacagccaagaagatccagtacctgatccactgccagtggtgtgaggagcgcatcttccagaaggatggcaacatggtggaggagaacccctaccggcagctgccctgcaactgccacggctccatgcctgggaagacagccatcgagctgggccccctgtggagcagcagcctcttcaacacaggcttcctgaagaggatgctgtttgagagcctgcaccacggcctggatgacatccagaccctcatcaagaccctcatctttgaaagtgagtgcaccccccagagccagttcagcatccacgccagcagcaatgtgaacaagcagggcgactag

SEQ ID NO: 42965 - DNA, 1392 bp, Artificial Sequence
  Description of Artificial Sequence: Synthetic coding sequence
atggccctgagctgcaccctgaaccgctacctgctgctgatggcccaggagcacctggagttccggctgcctgagatcaagagcctgctgctgctgtttggaggccagtttgccagcagccaggagacctacggcaagagccccttctggatcctgagcatccccagtgaagatattgccaggaacctgatgaagaggacagtgtgtgccaagagcatctttgagctgtggggccacggccagagccctgaggagctgtacagcagcctgaagaactaccctgtggagaagatggtgcccttcctgcacagcgacagcacctacaagatcaagatccacaccttcaacaagaccctgacccaggaggagaagatcaagagaattgatgccctggagttcctgccctttgagggcaaggtgaacctgaagaagccccagcacgtgttttctgtgctggaggactatggcctggaccccaactgcatccctgagaacccccacaacatctacttcggccgctggattgctgatggccagcgggagctgattgagagctacagcgtgaagaagaggcacttcatcggcaacacctccatggatgctggcctgtccttcatcatggccaaccacggcaaggtgaaggaaaatgacatcgtgtttgacccctttgtgggcaccggcggcctgctgattgcctgtgcccactttggagcctacgtgtatggaacagacatcgactacaacacagtgcacggcctgggcaaggccaccaggaagaaccagaagtggaggggcccagatgagaacatccgggccaacctgcggcagtatggcctggagaagtactacctggatgtgctggtgtctgatgccagcaagcccagctggaggaagggcacctactttgatgccatcatcacagatcctccctacggcatccgggagagcaccaggagaacaggcagccagaaggagatccccaagggcatcgagaagtgggagaagtgcccagagagccacgtgcctgtgtccctgagctaccacctgagtgacatgttcctggacctgctgaactttgctgctgagaccctggtgctgggcggccgcctggtgtactggctgcctgtgtacaccccagagtacacagaggagatggtgccctggcacccctgcctggagctggtgagcaactgtgagcagaagctgagcagccacaccagccggcggctcatcaccatggagaaggtgaagaagtttgagaacagagaccagtacagccacctgctgagtgaccacttcctgccctaccagggccacaacagcttccgggagaagtacttcagcggcgtgaccaagagaattgccaaggaggagaagagcacccaggagtag

SEQ ID NO: 42966 - DNA, 1377 bp, Artificial Sequence
  Description of Artificial Sequence: Synthetic coding sequence
atggccctgagctgcaccctgaaccgctacctgctgctgatggcccaggagcacctggagttccggctgcctgagatcaagagcctgctgctgctgtttggaggccagtttgccagcagccaggagacctacggcaagagccccttctggatcctgagcatccccagtgaagatattgccaggaacctgatgaagaggacagtgtgtgccaagagcatctttgagctgtggggccacggccagagccctgaggagctgtacagcagcctgaagaactaccctgtggagaagatggtgcccttcctgcacagcgacagcacctacaagatcaagatccacaccttcaacaagaccctgacccaggaggagaagatcaagagaattgatgccctggagttcctgccctttgagggcaaggtgaacctgaagaagccccagcacgtgttttctgtgctggaggactatggcctggaccccaactgcatccctgagaacccccacaacatctacttcggccgctggattgctgatggccagcgggagctgattgagagctacagcgtgaagaagaggcacttcatcggcaacacctccatggatgctggcctgtccttcatcatggccaaccacggcaaggtgaaggaaaatgacatcgtgtttgacccctttgtgggcaccggcggcctgctgattgcctgtgcccactttggagcctacgtgtatggaacagacatcgactacaacacagtgcacggcctgggcaaggccaccaggaagaaccagaagtggaggggcccagatgagaacatccgggccaacctgcggcagtatggcctggagaagtactacctggatgtgctggtgtctgatgccagcaagcccagctggaggaagggcacctactttgatgccatcatcacagatcctccctacggcatccgggagagcaccaggagaacaggcagccagaaggagatccccaagggcatcgagaagtgggagaagtgcccagagagccacgtgcctgtgtccctgagctaccacctgagtgacatgttcctggacctgctgaactttgctgctgagaccctggtgctgggcggccgcctggtgtactggctgcctgtgtacaccccagagtacacagaggagatggtgccctggcacccctgcctggagctggtgagcaactgtgagcagaagctgagcagccacaccagccggcggctcatcaccatggagaagaacagagaccagtacagccacctgctgagtgaccacttcctgccctaccagggccacaacagcttccgggagaagtacttctctggagtgaccaagagaattgccaaggaggagaagagcacccaggagtag

SEQ ID NO: 42967 - DNA, 282 bp, Artificial Sequence
  Description of Artificial Sequence: Synthetic coding sequence
atgaagaggacagtgtgtgccaagagcatctttgagctgtggggccacggccagagccctgaggagctgtacagcagcctgaagaactaccctgtggagaagatggtgcccttcctgcacagcgacagcacctacaagatcaagatccacaccttcaacaagaccctgacccaggaggagaagatcaagagaattgatgccctggagttcctgccctttgagggcaaggtgaacctgaagaagccccagcacgtgttttctgtgctggaggactatggatag

SEQ ID NO: 42968 - DNA, 405 bp, Artificial Sequence
  Description of Artificial Sequence: Synthetic coding sequence
atgaagaggacagtgtgtgccaagagcatctttgagctgtggggccacggccagagccctgaggagctgtacagcagcctgaagaactaccctgtggagaagatggtgcccttcctgcacagcgacagcacctacaagatcaagatccacaccttcaacaagaccctgacccaggaggagaagatcaagagaattgatgccctggagttcctgccctttgagggcaaggtgaacctgaagaagccccagcacgtgttttctgtgctggaggactatggcctggaccccaactgcatccctgagaacccccacaacatctacttcggccgctggattgctgatggccagcgggagctgattgagagctacagcgtgaagaagaggcacttcatcggcaacacctag

SEQ ID NO: 42969 - DNA, 774 bp, Artificial Sequence
  Description of Artificial Sequence: Synthetic coding sequence
atggccctgagctgcaccctgaaccgctacctgctgctgatggcccaggagcacctggagttccggctgcctgagatcaagagcctgctgctgctgtttggaggccagtttgccagcagccaggagacctacggcaagagccccttctggatcctgagcatccccagtgaagatattgccaggaacctgatgaagaggacagtgtgtgccaagagcatctttgagctgtggggccacggccagagccctgaggagctgtacagcagcctgaagaactaccctgtggagaagatggtgcccttcctgcacagcgacagcacctacaagatcaagatccacaccttcaacaagaccctgacccaggaggagaagatcaagagaattgatgccctggagttcctgccctttgagggcaaggtgaacctgaagaagccccagcacgtgttttctgtgctggaggactatggcctggaccccaactgcatccctgagaacccccacaacatctacttcggccgctggattgctgatggccagcgggagctgattgagagctacagcgtgaagaagaggcacttcatcggcaacacctccatggatgctggcctgtccttcatcatggccaaccacggcaaggtgaaggaaaatgacatcgtgtttgacccctttgtgggcaccggcggcctgctgattgcctgtgcccactttggagcctacgtgtatggaacagacatcgactacaacacagtgcacggcctggcctgcagcacctag

SEQ ID NO: 42970 - DNA, 513 bp, Artificial Sequence
  Description of Artificial Sequence: Synthetic coding sequence
tgactgtccttcatcatggccaaccacggcaaggtgaaggaaaatgacatcgtgtttgacccctttgtgggcactggaggcctgctgattgcctgtgcccactttggagcctacgtgtatggaacagacatcgactacaacacagtgcacggcctgggcaaggccaccaggaagaaccagaagtggaggggcccagatgagaacatccgggccaacctgcggcagtatggcctggagaagtactacctggatgtgctggtgtctgatgccagcaagcccagctggaggaagggcacctactttgatgccatcatcacagaccccccctacggcatccgggagagcaccaggagaacaggcagccagaaggagatccccaagggcattgaaaaatgtcctgagagccacgtgcctgtgtccctgagctaccacctgagtgacatgttcctggacctgctgaactttgctgctgagaccctggtgctgggcggccgcctggtgtactggctgtag

SEQ ID NO: 42971 - DNA, 378 bp, Artificial Sequence
  Description of Artificial Sequence: Synthetic coding sequence
atgaagctgctgacccacaacctgctgagcagccacgtgcggggcgtgggcagccggggcttccccctgcggctgcaggccacagaggtgcgcatctgccctgtggagttcaaccccaactttgtggccaggatgatccccaaggtggagtggagcgccttcctggaggccgctgacaacctgcggctcatccaggtgcccaagggccctgtggagggctatgaggagaatgaggagttcctgcggaccatgcaccacctgctgctggaggtggaggtgattgagggcaccctgcagtgcccagagagcggccgcatgttccccatcagccggggcatccccaacatgctgctgtctgaggaggagacagagagctag

SEQ ID NO: 42972 - DNA, 1347 bp, Artificial Sequence
  Description of Artificial Sequence: Synthetic coding sequence
atgagagaaaatgtggtggtgagcaacatggagcgggagagcggcaagcctgtggccgtggtggccgtggtgacagagccctggttcacccagcgctaccgggagtacctgcagaggcagaagctgtttgacacccagcaccgggtggagaagatgccagatggctctgtggccctgcctgtgctgggggagaccctgcctgagcagcacctgcaggagctgaggaacagagtggcccctggcagcccctgcatgctgacccagctgcctgaccctgtgcccagcaagagggcccagggctgcagccctgcccagaagctgtgcctggaggtgagccgctgggtggagggccggggcgtgaagtggagcgctgagctggaggccgacctgcccaggtcctggcagagacatggcaacctgctgctgctgtctgaggactgcttccaggccaagcagtggaagaacctgggccctgagctgtgggagaccgtggccctggccctgggcgtgcagaggctggccaagaggggccgggtgtccccagatggcaccaggaccccagctgtgaccctgctgctgggggaccacggctgggtggagcacgtggacaatggcatccgctacaagtttgatgtgacccagtgcatgttctcctttggaaacatcacagagaagctgcgggtggccagcctgagctgtgccggggaggtgctggtggacctgtatgccggcatcggctacttcaccctgcccttcctggtgcacgccggggccgcctttgtgcacgcctgtgagtggaacccccatgctgtggtggccctgaggaacaacctggagatcaatggagtggccgaccgctgccagatccactttggagacaacaggaagctgaagctgagcaacattgctgacagagtcatcctgggcctcatccccagcagcgaggagggctggcccatcgcctgccaggtgctgcggcaggatgctgggggcatcctgcacatccaccagaatgtggagagcttccctgggaagaacctgcaggccctgggcgtgtccaaggtggagaaggagcactggctgtacccccagcagatcaccaccaaccagtggaagaatggagccacccgggacagccggggcaagatgctgagccctgccaccaagccagagtggcagcgctgggccgagagcgctgagaccagaattgccaccctgctgcagcaggtgcacggcaagccctggaagacccagatcctgcacatccagcctgtgaagagctatgcccctcatgtggaccacatcgtgctggacctggagtgctgcccctgccccagcgtgggctag

SEQ ID NO: 42973 - DNA, 1434 bp, Artificial Sequence
  Description of Artificial Sequence: Synthetic coding sequence
atgctgatggcctggtgccggggccctgtgctgctgtgcctgcggcagggcctgggcaccaacagcttcctgcacggcctgggccaggagccctttgagggcgcccggagcctgtgctgccgcagcagcccccgggacctgagagatggagagcgggagcacgaggccgcccagaggaaggcccctggagctgagagctgccccagcctgcccctgagcatcagtgacattggaacaggctgcctgagcagcctggagaacctgcggctgcccaccctgcgggaggagagcagcccccgggagctggaggacagcagcggggaccagggccgctgtggccccacccaccagggcagcgaggaccccagcatgctgagccaggcccagagcgccacagaggtggaggagcggcacgtgagccccagctgcagcaccagccgggagcggcccttccaggccggggagctgatcctggccgagactggagagggggagaccaagttcaagaagctgttccggctgaacaactttggcctgctgaacagcaactggggcgctgtgccctttgggaagatcgtgggcaagtttcctggccagatcctgcggagcagctttgggaagcagtacatgctgcggcggcctgccctggaggactatgtggtgctgatgaagaggggcacagccatcaccttccccaaggacatcaacatgatcctgtccatgatggacatcaaccctggggacacagtgctggaggccggcagcggcagcggcggcatgagcctcttcctgagcaaggctgtgggcagccagggccgggtcatcagctttgaggtgaggaaggaccaccacgacctggccaagaagaactacaagcactggagggacagctggaagctgagccacgtggaggagtggccagacaacgtggacttcatccacaaggacatcagcggggccacagaggacatcaagagcctgacctttgatgctgtggccctggacatgctgaacccccacgtgaccctgcccgtcttctacccccacctgaagcacggcggcgtgtgtgctgtgtatgtggtgaacatcacccaggtgattgagctgctggatggcatccgcacctgtgagctggccctgagctgtgagaagatcagcgaggtgattgtgcgggactggctggtgtgcctggccaagcagaagaatggcatcctggcccagaaggtggagagcaagatcaacacagatgtgcagctggacagccaggagaagattggagtgaagggggagctgttccaggaggatgaccacgaggagagccacagcgacttcccctacggcagcttcccctacgtggcccggcctgtgcactggcagcccggccacacagccttcctggtgaagctgaggaaggtgaagccccagctgaactag

SEQ ID NO: 42974 - DNA, 933 bp, Artificial Sequence
  Description of Artificial Sequence: Synthetic coding sequence
atgctggtggtggaggtggccaacggccgcagcctggtgtggggcgctgaggccgtgcaggccctgcgggagcggctgggcgtgggcggccgcacagtgggcgccctgccccggggcccccggcagaacagccggctgggcctgcccctgctgctgatgcctgaggaggcccggctgctggccgagattggagctgtgaccctggtgtctgcccccaggccagacagccgccaccacagcctggccctgaccagcttcaagaggcagcaggaggagagcttccaggagcagagcgccctggccgctgaggcccgggagacccggcggcaggagctgctggagaagatcacagagggccaggccgccaagaagcagaagctggagcaggccagcggggccagcagcagccaggaggccggcagcagccaggccgccaaggaggatgagaccagtgatggccaggccagcggggagcaggaggaggccggccccagcagcagccaggccggccccagcaatggagtggcccccctgcccaggtctgccctgctggtgcagctggccacagcccggcccaggcctgtgaaggcccggcccctggactggagggtgcagagcaaggactggccccacgccggccgcccagcccacgagctgcgctacagcatctacagagacctgtgggagcggggcttcttcctgtctgctgctgggaagtttggaggagacttcctggtgtacccaggggaccccctgcgcttccacgcccactacatcgcccagtgctgggcccctgaggacaccatccccctgcaggacctggtggccgccggccgcctgggcacctctgtgaggaagaccctgctgctgtgcagcccccagccagatggcaaggtggtgtacaccagcctgcagtgggccagcctgcagtag

SEQ ID NO: 42975 - DNA, 933 bp, Artificial Sequence; identical to SEQ ID NO: 42974
  Description of Artificial Sequence: Synthetic coding sequence

SEQ ID NO: 42976 - DNA, 933 bp, Artificial Sequence; identical to SEQ ID NO: 42974
  Description of Artificial Sequence: Synthetic coding sequence

SEQ ID NO: 42977 - DNA, 933 bp, Artificial Sequence; identical to SEQ ID NO: 42974
  Description of Artificial Sequence: Synthetic coding sequence

SEQ ID NO: 42978 - DNA, 933 bp, Artificial Sequence; identical to SEQ ID NO: 42974
  Description of Artificial Sequence: Synthetic coding sequence

SEQ ID NO: 42979 - DNA, 933 bp, Artificial Sequence; identical to SEQ ID NO: 42974
  Description of Artificial Sequence: Synthetic coding sequence

SEQ ID NO: 42980 - DNA, 933 bp, Artificial Sequence; identical to SEQ ID NO: 42974
  Description of Artificial Sequence: Synthetic coding sequence

SEQ ID NO: 42981 - DNA, 933 bp, Artificial Sequence; identical to SEQ ID NO: 42974
  Description of Artificial Sequence: Synthetic coding sequence

SEQ ID NO: 42982 - DNA, 933 bp, Artificial Sequence; identical to SEQ ID NO: 42974
  Description of Artificial Sequence: Synthetic coding sequence

SEQ ID NO: 42983 - DNA, 933 bp, Artificial Sequence; identical to SEQ ID NO: 42974
  Description of Artificial Sequence: Synthetic coding sequence

SEQ ID NO: 42984 - DNA, 933 bp, Artificial Sequence; identical to SEQ ID NO: 42974
  Description of Artificial Sequence: Synthetic coding sequence

SEQ ID NO: 42985 - DNA, 933 bp, Artificial Sequence; identical to SEQ ID NO: 42974
  Description of Artificial Sequence: Synthetic coding sequence

SEQ ID NO: 42986 - DNA, 2199 bp, Artificial Sequence
  Description of Artificial Sequence: Synthetic coding sequence
atggaccccagcgctgacacctgggacctcttcagccccctcatcagcctgtggatcaaccgcttctacatctacctgggctttgctgtgtccatcagcctgtggatctgtgtgcagatcgtcatcaagacccagggcaagaacctgcaggagaagtctgtgcccaaggccgcccaggacctgatgaccaacggctacgtgtccctgcaggagaaggacatctttgtgtctggagtgaagatcttctacggcagccagacaggaacagccaagggctttgccaccgtgctggccgaggccgtgaccagcctggacctgcctgtggccatcatcaacctgaaggagtatgaccctgatgaccacctgattgaggaggtgaccagcaagaatgtgtgtgtgttcctggtggccacctacacagatggcctgcccacagaatctgctgagtggttctgcaagtggctggaggaggccagcattgacttccgctttgggaagacctacctgaagggcatgagatatgctgtgtttggcctgggcaacagcgcctatgccagccacttcaacaaggtgggcaagaatgtggacaagtggctgtggatgctgggcgcccaccgggtgatgagcagaggagagggggactgtgatgtggtgaagagcaagcacggcagcattgaagctgacttccgggcctggaagaccaagttcatcagccagctgcaggccctgcagaagggggagaggaagaagagctgtggcggccactgcaagaagggcaaatgtgagagccaccagcacggcagcgaggagcgggaggagggcagccatgagcaggatgagctgcaccaccgggacacagaggaggaggagccctttgagagcagcagcgaggaggagtttggaggagaggaccaccagagcctgaacagcatcgtggatgtggaggacctgggcaagatcatggaccacgtgaagaaggagaagcgggagaaggagcagcaggaggagaagagcggcctcttcaggaacatgggcagaaatgaagatggagagcggcgggccatgatcaccccagccctgcgggaggccctgaccaagcagggctaccagctgattggcagccacagcggcgtgaagctgtgccgctggaccaagtccatgctgcggggccggggcggctgctacaagcacaccttctacggcatcgagagccaccgctgcatggagaccacccccagcctggcctgtgccaacaagtgtgtgttctgctggaggcaccacaccaaccctgtgggcacagagtggcgctggaagatggaccagcctgagatgatcctgaaggaggccatcgagaaccaccagaacatgatcaagcagttcaagggcgtgcctggggtgaaggccgagagatttgaggagggcatgacagtgaagcactgtgccctgagcctggtgggggagcccatcatgtacccagagatcaaccgcttcctgaagctgctgcaccagtgcaagatcagcagcttcctggtgaccaatgcccagtttcctgctgagatccggaacctggagcctgtgacccagctgtatgtgtctgtggatgccagcaccaaggacagcctgaagaagattgaccggcccctcttcaaggacttctggcagcgcttcctggacagcctgaaggccctggccgtgaagcagcagaggacagtgtaccgcctgaccctggtgaaggcctggaatgtggatgagctgcaggcctatgcccagctggtgtccctgggcaacccagacttcatcgaggtgaagggcgtgacctactgtggggagagcagcgccagcagcctgaccatggcccacgtgccctggcatgaggaggtggtgcagtttgtgcatgagctggtggacctgatcccagaatatgaaattgcctgtgaacatgagcacagcaactgcctgctgattgcccacaggaagttcaagattggaggagagtggtggacctggattgactacaaccgcttccaggagctgatccaggagtatgaagattctgggggcagcaagaccttcagcgccaaggactacatggcccggaccccccactgggccctgtttggagccagcgagcggggctttgaccccaaggacaccaggcaccagaggaagaacaagagcaaggccatcagcggctgctag

SEQ ID NO: 42987 - DNA, 1017 bp, Artificial Sequence
  Description of Artificial Sequence: Synthetic coding sequence
atggaccccagcgctgacacctgggacctcttcagccccctcatcagcctgtggatcaaccgcttctacatctacctgggctttgctgtgtccatcagcctgtggatctgtgtgcagatcgtcatcaagacccagggctttgccaccgtgctggccgaggccgtgaccagcctggacctgcctgtggccatcatcaacctgaaggagtatgaccctgatgaccacctgattgaggaggtgaccagcaagaatgtgtgtgtgttcctggtggccacctacacagatggcctgcccacagaatctgctgagtggttctgcaagtggctggaggaggccagcattgacttccgctttgggaagacctacctgaagggcatgagatatgctgtgtttggcctgggcaacagcgcctatgccagccacttcaacaaggtgggcaagaatgtggacaagtggctgtggatgctgggcgcccaccgggtgatgagcagaggagagggggactgtgatgtggtgaagagcaagcacggcagcattgaagctgacttccgggcctggaagaccaagttcatcagccagctgcaggccctgcagaagggggagaggaagaagagctgtggcggccactgcaagaagggcaaatgtgagagccaccagcacggcagcgaggagcgggaggagggcagccatgagcaggatgagctgcaccaccgggacacagaggaggaggagccctttgagagcagcagcgaggaggagtttggaggagaggaccaccagagcctgaacagcatcgtggatgtggaggacctgggcaagatcatggaccacgtgaagaaggagaagcgggagaaggagcagcaggaggagaagagcggcctcttcaggaacatgggcagaaatgaagatggagagcggcgggccatgatcaccccagccctgcgggaggccctgaccaagcaggtgcacgccccccgggagcggcggctgctgcagacccacatcctgtggaactag

SEQ ID NO: 42988 - DNA, 531 bp, Artificial Sequence
  Description of Artificial Sequence: Synthetic coding sequence
atggaccccagcgctgacacctgggacctcttcagccccctcatcagcctgtggatcaaccgcttctacatctacctgggctttgctgtgtccatcagcctgtggatctgtgtgcagatcgtcatcaagacccagggctttgccaccgtgctggccgaggccgtgaccagcctggacctgcctgtggccatcatcaacctgaaggagtatgaccctgatgaccacctgattgaggaggaggaggagccctttgagagcagcagcgaggaggagtttggaggagaggaccaccagagcctgaacagcatcgtggatgtggaggacctgggcaagatcatggaccacgtgaagaaggagaagcgggagaaggagcagcaggaggagaagagcggcctcttcaggaacatgggcagaaatgaagatggagagcggcgggccatgatcaccccagccctgcgggaggccctgaccaagcaggtgcacgccccccgggagcggcggctgctgcagacccacatcctgtggaactag

SEQ ID NO: 42989 - DNA, 780 bp, Artificial Sequence
  Description of Artificial Sequence: Synthetic coding sequence
atggacagatctgctgagttcaggaagtggaaggcccagtgcctgagcaaggctgacctgagcaggaaaggatctgtggatgaagatgtggtggagctggtgcagttcctgaacatgagggaccagttcttcaccaccagcagctgtgccggccgcatcctgctgctggaccggggcatcaatggatttgaggtgcagaagcagaactgctgctggctgctggtgacccacaagctgtgtgtgaaggatgatgtgattgtggccctgaagaaggccaatggagatgccaccctgaagtttgagccctttgtgctgcacgtgcagtgccggcagctgcaggatgcccagatcctgcacagcatggccattgattctggcttcaggaacagcggcatcaccgtgggcaagaggggcaagaccatgctggccgtgcgcagcacccacggcctggaggtgcccctgagccacaagggcaagctgatggtgacagaggagtacatcgacttcctgctgaatgtggccaaccagaagatggaggagaacaagaagagaattgagcgcttctacaactgcctgcagcacgccctggagcgggagaccatgaccaacctgcaccccaagatcaaggagaagaacaacagcagctacatccacaagaagaagaggaaccctgagaagacccgggcccagtgcatcaccaaggagagtgatgaggagctggagaatgatgatgatgatgacctgggcatcaacgtgaccatcttccctgaggactactag

SEQ ID NO: 42990 - DNA, 528 bp, Artificial Sequence
  Description of Artificial Sequence: Synthetic coding sequence
atggacagatctgctgagttcaggaagtggaaggcccagtgcctgagcaaggctgacctgagcaggaaaggatctgtggatgaagatgtggtggagctggtgcagttcctgaacatgagggaccagttcttcaccaccagcagctgtgccggccgcatcctgctgctggacagagctgtgcgcagcacccacggcctggaggtgcccctgagccacaagggcaagctgatggtgacagaggagtacatcgacttcctgctgaatgtggccaaccagaagatggaggagaacaagaagagaattgagcgcttctacaactgcctgcagcacgccctggagcgggagaccatgaccaacctgcaccccaagatcaaggagaagaacaacagcagctacatccacaagaagaagaggaaccctgagaagacccgggcccagtgcatcaccaaggagagtgatgaggagctggagaatgatgatgatgatgacctgggcatcaacgtgaccatcttccctgaggactactag

SEQ ID NO: 42991 - DNA, 681 bp, Artificial Sequence
  Description of Artificial Sequence: Synthetic coding sequence
atggacagatctgctgagttcaggaagtggaaggcccagtgcctgagcaaggctgacctgagcaggaaaggatctgtggatgaagatgtggtggagctggtgcagttcctgaacatgagggaccagttcttcaccaccagcagctgtgccggccgcatcctgctgctggaccggggcatcaatggatttgaggtgcagaagcagaactgctgctggctgctggtgacccacaagctgtgtgtgaaggatgatgtgcacagcatggccatcgacagcggcttcagaaattctggcatcaccgtgggcaagaggggcaagaccatgctggccgtgcgcagcacccacggcctggaggtgcccctgagccacaagggcaagctgatggtgacagaggagtacatcgacttcctgctgaatgtggccaaccagaagatggaggagaacaagaagagaattgagcgcttctacaactgcctgcagcacgccctggagcgggagaccatgaccaacctgcaccccaagatcaaggagaagaacaacagcagctacatccacaagaagaagagaaatcctgagaagacccgggcccagtgcatcaccaaggagagtgatgaggagctggagaatgatgatgatgatgacctgggcatcaacgtgaccatcttccctgaggactactag

SEQ ID NO: 42992 - DNA, 948 bp, Artificial Sequence
  Description of Artificial Sequence: Synthetic coding sequence
atggccggccagcacctgcctgtgccccggctggagggcgtgtcccgggagcagttcatgcagcacctgtacccccagaggaagcccctggtgctggagggcatcgacctgggcccctgcaccagcaagtggacagtggactacctgagccaggtgggcggcaagaaggaggtgaagatccacgtggccgctgtggcccagatggacttcatcagcaagaactttgtgtaccgcaccctgccctttgaccagctggtgcagagagctgctgaggagaagcacaaggagttctttgtgtctgaagatgagaagtactacctgcggagcctgggggaggaccccaggaaggatgtggccgacatcaggaagcagttccccctgctgaagggggacatcaagtttcctgagttcttcaaggaggagcagttcttcagcagcgtcttccgcatcagcagccctggcctgcagctgtggacccactatgatgtgatggacaacctgctgatccaggtgacaggcaagaagagggtggtgctcttcagccccagagatgcccagtacctgtacctgaagggcaccaagtctgaggtgctgaacatcgacaacccagacctggccaagtaccccctcttcagcaaggccaggagatatgagtgcagcctggaggccggagatgtgctcttcatcccagccctgtggttccacaacgtcatcagcgaggagtttggagtgggcgtgaacatcttctggaagcacctgcccagcgagtgctatgacaagacagacacctacggcaacaaggaccccacagctgccagcagagctgcccagatcctggaccgggccctgaagaccctggccgagctgcctgaggagtacagagacttctacgcccggaggatggtgctgcacatccaggacaaggcctacagcaagaacagcgagtag

SEQ ID NO: 42993 - DNA, 825 bp, Artificial Sequence
  Description of Artificial Sequence: Synthetic coding sequence
atgctgaacctgctgctgctggccctgcctgtgctggccagccgggcctatgctgccccagcccctggccaggccctgcagagggtgggcatcgtgggcggccaggaggcccccaggagcaagtggccctggcaggtgtccctgcgggtgcgggaccgctactggatgcacttctgtggcggcagcctcatccacccccagtgggtgctgacagctgcccactgtgtgggcccagatgtgaaggacctggccgccctgcgggtgcagctgcgggagcagcacctgtactaccaggaccagctgctgcctgtgagccgcatcatcgtgcacccccagttctacacagcccagatcggggctgacatcgccctgctggagctggaggagcctgtgaatgtgagcagccacgtgcacacagtgaccctgcccccagccagcgagaccttcccccccatgccctgctgggtgacaggctggggagatgtggacaatgatgagcggctgcccccacccttccccctgaagcaggtgaaggtgcccatcatggagaaccacatctgtgatgccaagtaccacctgggcgcctacacaggagatgatgtgagaattgtgagagatgacatgctgtgtgccggcaacacccggcgggacagctgccagggcgacagcggcggccccctggtgtgcaaggtgaatggcacctggctgcaggccggcgtggtgtcctggggcgagggctgtgcccagcccaacagacctggcatctacaccagggtgacctactacctggactggatccaccactacgtgcccaagaagccctag

SEQ ID NO: 42994 - DNA, 2271 bp, Artificial Sequence
  Description of Artificial Sequence: Synthetic coding sequence
atgagcaagatgcctgccaagaagaagagctgcttccagatcacctctgtgaccacagcccaggtggccaccagcatcacagaggacacagagagcctggatgatcctgatgagagcaggacagaagatgtgagcagcgagatctttgatgtgtcccgggccacagattatggccctgaggaggtgtgtgagaggagcagcagcgaggagaccctgaacaacgtgggagatgctgagaccccaggcaccgtgagccccaacctgctgctggatggccagctggccgctgctgctgctgccccagccaatggaggcggcgtggtgtctgcccggtctgtgtctggggccctggccagcaccctggccgccgccgccaccagcgccccagcccctggggcccctgggggcccccagctggccggcagcagcgctggccctgtgacagctgcccccagccagccccccaccacctgcagcagccgcttccgggtcatcaagctggaccacggcagcggggagccctaccgccggggccgctggacctgcatggagtactatgaaagagacagcgacagctctgtgctgaccaggtctggggactgcatccgccacagcagcacctttgaccagacagctgagcgggacagcggcctgggcgccactggaggctctgtggtggtggtggtggcctccatgcagggcgcccacggccctgagagcggcacagacagcagcctgacagctgtgtcccagctgcccccatctgagaagatgagccagcccaccccagcccagccccagagcttctctgtgggccagccccagcccccacctcctcctgtgggcggcgctgtggcccagagcagcgcccccctgccccccttccctggggccgccaccggcccccagcccatgatggccgccgcccagcccagccagccccagggcgccggccctgggggccagaccctgccccccaccaacgtgaccctggcccagcctgccatgagcctgcccccccagcccggccctgctgtgggcgccccagctgcccagcagccccagcagtttgcctacccccagccccagatccccccaggccacctgctgcctgtgcagcccagcggccagagcgagtacctgcagcagcacgtggccggcctgcagccccccagccctgcccagcccagcagcactggagctgctgccagccctgccacagctgccaccctgcctgtgggcaccggccagaatgccagctctgtgggcgcccagctgatgggcgccagcagccagcccagcgaggccatggcccccaggactggacctgcccagggcggccaggtggccccctgccagcccactggagtgcccccagccaccgtgggcggcgtggtgcagccctgcctgggccctgctggagctggccagccccagagcgtgcccccaccccagatgggcggcagcggccccctgtctgctgtgcctgggggcccccatgctgtggtgcctggggtgcccaacgtgcctgctgctgtgcctgcccccagcgtgcccagcgtgtccaccacctctgtgaccatgcccaacgtgcctgcccccctggcccagagccagcagctgagcagccacacccctgtgagccgcagcagcagcatcatccagcacgtgggcctgcccctggcccctggcacccacagcgcccccaccagcctgccccagagcgacctgagccagttccagacccagacccagcccctggtgggccaggtggatgacaccaggaggaagtctgagcccctgccccagccccccctgagcctgattgctgagaacaagcctgtggtgaagccccctgtggccgacagcctggccaaccccctgcagctgacccccatgaacagcctggccacctctgtgttcagcatcgccatccctgtggatggagatgaagattctgccagcggcggcggcgtggtggccatcgacaacaagattgagcaggccatggacctggtgaagagccacctgatgtatgctgtgcgggaggaggtggaggtgctgaaggagcagatcaaggagctggtggagaggaacagcctgctggagagagaaaatgccctgctgaagagcctgagcagcaatgaccagctgagccagctgcccacccagcaggccaaccctggcagcaccagccagcagcaggccgtcatcgcccagcccccccagcccacccagcccccccagcagcccaacgtgtcctctgcctag

SEQ ID NO: 42995 - DNA, 2343 bp, Artificial Sequence
  Description of Artificial Sequence: Synthetic coding sequence
atgagcaagatgcctgccaagaagaagagctgcttccagatcacctctgtgaccacagcccaggtggccaccagcatcacagaggacacagagagcctggatgatcctgatgagagcaggacagaagatgtgagcagcgagatctttgatgtgtcccgggccacagattatggccctgaggaggtgtgtgagaggagcagcagcgaggagaccctgaacaacgtgggagatgctgagaccccaggcaccgtgagccccaacctgctgctggatggccagctggccgctgctgctgctgccccagccaatggaggcggcgtggtgtctgcccggtctgtgtctggggccctggccagcaccctggccgccgccgccaccagcgccccagcccctggggcccctgggggcccccagctggccggcagcagcgctggccctgtgacagctgcccccagccagccccccaccacctgcagcagccgcttccgggtcatcaagctggaccacggcagcggggagccctaccgccggggccgctggacctgcatggagtactatgaaagagacagcgacagctctgtgctgaccaggtctggggactgcatccgccacagcagcacctttgaccagacagctgagcgggacagcggcctgggcgccactggaggctctgtggtggtggtggtggcctccatgcagggcgcccacggccctgagagcggcacagacagcagcctgacagctgtgtcccagctgcccccatctgagaagatgagccagcccaccccagcccagccccagagcttctctgtgggccagccccagcccccacctcctcctgtgggcggcgctgtggcccagagcagcgcccccctgccccccttccctggggccgccaccggcccccagcccatgatggccgccgcccagcccagccagccccagggcgccggccctgggggccagaccctgccccccaccaacgtgaccctggcccagcctgccatgagcctgcccccccagcccggccctgctgtgggcgccccagctgcccagcagccccagcagtttgcctacccccagccccagatccccccaggccacctgctgcctgtgcagcccagcggccagagcgagtacctgcagcagcacgtggccggcctgcagccccccagccctgcccagcccagcagcactggagctgctgccagccctgccacagctgccaccctgcctgtgggcaccggccagaatgccagctctgtgggcgcccagctgatgggcgccagcagccagcccagcgaggccatggcccccaggactggacctgcccagggcggccaggtggccccctgccagcccactggagtgcccccagccaccgtgggcggcgtggtgcagccctgcctgggccctgctggagctggccagccccagagcgtgcccccaccccagatgggcggcagcggccccctgtctgctgtgcctgggggcccccatgctgtggtgcctggggtgcccaacgtgcctgctgctgtgcctgcccccagcgtgcccagcgtgtccaccacctctgtgaccatgcccaacgtgcctgcccccctggcccagagccagcagctgagcagccacacccctgtgagccgcagcagcagcatcatccagcacgtgggcctgcccctggcccctggcacccacagcgcccccaccagcctgccccagagcgacctgagccagttccagacccagacccagcccctggtgggccaggtggatgacaccaggaggaagtctgagcccctgccccagccccccctgagcctgattgctgagaacaagcctgtggtgaagccccctgtggccgacagcctggccaaccccctgcagctgacccccatgaacagcctggccacctctgtgttcagcatcgccatccctgtggatggagatgaagatagaaaccccagcacagccttctaccaggccttccacctgaacaccctgaaggagagcaagagcctgtgggacagcgccagcggcggcggcgtggtggccatcgacaacaagattgagcaggccatggacctggtgaagagccacctgatgtatgctgtgcgggaggaggtggaggtgctgaaggagcagatcaaggagctggtggagaggaacagcctgctggagagagaaaatgccctgctgaagagcctgagcagcaatgaccagctgagccagctgcccacccagcaggccaaccctggcagcaccagccagcagcaggccgtcatcgcccagcccccccagcccacccagcccccccagcagcccaacgtgtcctctgcctag

SEQ ID NO: 42996 - DNA, 690 bp, Artificial Sequence
  Description of Artificial Sequence: Synthetic coding sequence
atgcccaacgtgcctgcccccctggcccagagccagcagctgagcagccacacccctgtgagccgcagcagcagcatcatccagcacgtgggcctgcccctggcccctggcacccacagcgcccccaccagcctgccccagagcgacctgagccagttccagacccagacccagcccctggtgggccaggtggatgacaccaggaggaagtctgagcccctgccccagccccccctgagcctgattgctgagaacaagcctgtggtgaagccccctgtggccgacagcctggccaaccccctgcagctgacccccatgaacagcctggccaccagcgtcttcagcatcgccatccctgtggatggagatgaggacagcgccagcggcggcggcgtggtggccatcgacaacaagattgagcaggccatggacctggtgaagagccacctgatgtatgctgtgcgggaggaggtggaggtgctgaaggagcagatcaaggagctggtggagaggaacagcctgctggagcgggagaatgccctgctgaagagcctgagcagcaatgaccagctgagccagctgcccacccagcaggccaaccctggcagcaccagccagcagcaggccgtgattgcccagcccccccagcccacccagcccccccagcagcccaacgtgagcagcgcctag

SEQ ID NO: 42997 - DNA, 576 bp, Artificial Sequence
  Description of Artificial Sequence: Synthetic coding sequence
atggccggggctgctgaagatgcccgggccctcttccgggccggcgtgtgtgccgccctggaggcctggccagccctgcagattgctgtggagaatggatttggaggagtgcacagccaggagaaggccaagtggctgggcggcgctgtggaggactacttcatgagaaatgctgacctggagctggatgaggtggaggacttcctgggggagctgctgaccaatgaatttgacacagtggtggaggatggcagcctgccccaggtgtcccagcagctgcagaccatgttccaccacttccagagaggagatggagctgccctgcgggagatggccagctgcatcacccagaggaagtgcaaggtgacagccacagccctgaagacagcccgggagacagatgaagatgaagatgatgtggacagcgtggaggagatggaggtgacagccaccaatgatggagctgccacagatggagtgtgcccccagcctgagcccagcgaccctgatgcccagaccatcaaggaggaggacatcgtggaggatggctggaccatcgtgcggaggaagaagtag

SEQ ID NO: 42998 - DNA, 801 bp, Artificial Sequence
  Description of Artificial Sequence: Synthetic coding sequence
atgatgaagaccctgagcagcggcaactgcaccctgtctgtgcctgccaagaacagctacaggatggtggtgctgggcgccagccgggtgggcaagagcagcatcgtgagccgcttcctgaatggccgctttgaggaccagtacacccccaccatcgaggacttccacaggaaggtgtacaacatccggggggacatgtaccagctggacatcctggacaccagcggcaaccaccccttccctgccatgaggcggctgagcatcctgactggagatgtgttcatcctggtgttcagcctggacaaccgggagagctttgatgaggtgaagaggctgcagaagcagatcctggaggtgaagagctgcctgaagaacaagaccaaggaggccgctgagctgcccatggtgatctgtggcaacaagaatgaccacggggagctgtgccggcaggtgcccaccacagaggccgagctgctggtgtctggagatgagaactgtgcctactttgaggtgtctgccaagaagaacaccaacgtggatgagatgttctacgtgctcttctccatggccaagctgccccatgagatgagccctgccctgcacaggaagatctctgtgcagtatggagatgccttccacccccggcccttctgcatgagaagagtgaaggagatggatgcctacggcatggtgagcccctttgcccggcggcccagcgtgaacagcgacctgaagtacatcaaggccaaggtgctgcgggagggccaggcccgggagcgggacaagtgcaccatccagtag

SEQ ID NO: 42999 - DNA, 636 bp, Artificial Sequence
  Description of Artificial Sequence: Synthetic coding sequence
atggaggccgagcggggccctgagaggaggcctgctgagaggagcagccctggccagaccccagaggagggcgcccaggccctggccgagtttgctgccctgcacggccctgccctgcgggccagcggcgtgcctgagcgctactggggccgcctgctgcacaagctggagcacgaggtgtttgatgctggggaggtgtttggcatcatgcaggtggaggaggtggaggaggaggaggatgaggccgcccgggaggtgaggaagcagcagcccaaccctggaaatgagctgtgctacaaggtgattgtgacccgggagagcggcctgcaggccgcccaccccaacagcatcttcctgattgaccacgcctggacctgccgggtggagcacgcccggcagcagctgcagcaggtgcccggcctgctgcacaggatggccaacctgatgggcatcgagttccacggggagctgcccagcacagaggccgtggccctggtgctggaggagatgtggaagttcaaccagacctacagacatgtgtgccggcggccccacgccgaggtgggccagaggccccgctggaaggctggagatgctgctgctgaccctggaggagagctgcagccccggctgtag

SEQ ID NO: 43000 - DNA, 1380 bp, Artificial Sequence
  Description of Artificial Sequence: Synthetic coding sequence
atggagcccagcacctgcaggaccatggagagtgaagaagattatgtggaggagaaggagagcgagaagtgtgtgaaggagggcgtgaccaaccccagcaacagcagccagcaggccctgctgaaggctgactacaaggccctgaagaatggagtgcccagccccatcatggccaccaagatccccaagaaggtgattgcccctgtggacacaggagacctggaggccggccgcaggaagagaagaaggaagagaagaagcctggccatcaacctgaccaactgcaagtatgaatctgtgagaagagctgcccagatgtgtggcctgaaggaggtgggggaggatgaggagtggaccctgtactggacagactgtgctgtgtccctggagcgggtgatggacatgaagcgcttccagaagatcaaccacttccctggcatgacagagatctgcaggaaggacctgctggccaggaacctgaacaggatgtacaagctgtaccccagcgagtacaacatcttccccaggacctggtgcctgcctgctgactatggagacttccagagctatggccggcagaggaaggcccggacctacatctgcaagccagattctggctgccagggccggggcatcttcatcaccaggaacccccgggagatcaagccaggagagcacatgatctgccagcagtacatcagcaagcccctgctgattgatggcttcaagtttgacatgagggtgtatgtgctgatcaccagctgtgaccccctgcgcatcttcacctatgaggagggcctggccaggtttgccaccaccccctacatggagcccagccacaacaacctggacaacgtgtgcatgcacctgaccaactatgccatcaacaagcacaatgaaaattttgtgagagatggagctgtgggcagcaagaggaagctgagcaccctgaacatctggctgcaggagcacagctacaaccctggagagctgtggggagacatcgaggacatcatcatcaagaccatcatcagcgcccacagcgtgctgcggcacaactaccgcacctgcttcccccagtacctgaatggaggcacctgtgcctgctttgagatcctgggctttgacatcctgctggaccacaagctgaagccctggctgctggaggtgaaccacagccccagcttcaccacagacagctgcctggaccaggaggtgaaggatgccctgctgtgtgatgccatgaccctggtgaacctgcggggctgtgacaagaggaaggtgatggaggaggacaagagaagagtgaaggagcggctcttccagtgctaccggcagccccgggagagccgctgtgcccgctgcctggcctgtgtgtag

SEQ ID NO: 43001 - DNA, 2448 bp, Artificial Sequence
  Description of Artificial Sequence: Synthetic coding sequence
atggagcccagcacctgcaggaccatggagagtgaagaagattatgtggaggagaaggagagcgagaagtgtgtgaaggagggcgtgaccaaccccagcaacagcagccagcaggccctgctgaaggctgactacaaggccctgaagaatggagtgcccagccccatcatggccaccaagatccccaagaaggtgattgcccctgtggacacaggagacctggaggccggccgcaggaagagaagaaggaagagaagaagcctggccatcaacctgaccaactgcaagtatgaatctgtgagaagagctgcccagatgtgtggcctgaaggaggtgggggaggatgaggagtggaccctgtactggacagactgtgctgtgtccctggagcgggtgatggacatgaagcgcttccagaagatcaaccacttccctggcatgacagagatctgcaggaaggacctgctggccaggaacctgaacaggatgtacaagctgtaccccagcgagtacaacatcttccccaggacctggtgcctgcctgctgactatggagacttccagagctatggccggcagaggaaggcccggacctacatctgcaagccagattctggctgccagggccggggcatcttcatcaccaggaacccccgggagatcaagccaggagagcacatgatctgccagcagtacatcagcaagcccctgctgattgatggcttcaagtttgacatgagggtgtatgtgctgatcaccagctgtgaccccctgcgcatcttcacctatgaggagggcctggccaggtttgccaccaccccctacatggagcccagccacaacaacctggacaacgtgtgcatgcacctgaccaactatgccatcaacaagcacaatgaaaattttgtgagagatggagctgtgggcagcaagaggaagctgagcaccctgaacatctggctgcaggagcacagctacaaccctggagagctgtggggagacatcgaggacatcatcatcaagaccatcatcagcgcccacagcgtgctgcggcacaactaccgcacctgcttcccccagtacctgaatggaggcacctgtgcctgctttgagatcctgggctttgacatcctgctggaccacaagctgaagccctggctgctggaggtgaaccacagccccagcttcaccacagacagctgcctggaccaggaggtgaaggatgccctgctgtgtgatgccatgaccctggtgaacctgcggggctgtgacaagaggaaggtgatggaggaggacaagagaagagtgaaggagcggctcttccagtgctaccggcagccccgggagagcaggaaggagaagacagagagcagccacgtggccatgctggaccaggagagatatgaggacagccacctgggcaagtaccgccgcatctacccaggccctgacacagagaagtatgcccgcttcttcaagcacaacggcagcctcttccaggagacagctgccagcaaggcccgggaggagtgtgcccggcagcagctggaggagatccggctgaagcaggagcagcaggagaccagcggcaccaagaggcagaaggcccgggaccagaaccagggcgagagcgctggggagaagagccggcccagggctggcctgcagagcctgagcacccacctggcctacagaaacagaaactgggagaaggagctgctgcccggccagctggacaccatgaggccccaggagatcgtggaggaggaggagctggagaggatgaaggccctgctgcagcgggagaccctcatccgcagcctgggcatcgtggagcagctgacccggctgcagcaccctggcccccagggccagaagaagctgcacgagagccgggaccggctgggcagccaggagctgaagtccatgagcctggtgctgctggtgctgctgcggggggccgccacagagcagggcgccccccacttcctgcaccctgtgctgccccatgagagcatcccccgcatcctgggcgccctgcccagcatgaatgctgccatcccccacgtgccccgctaccacctgcagcccaagaacttcaactggacaggagagcctgctgccatcaacagctgcagcctgtccatgaagaaggccggccgctgctacttcagcagcgcccgcatccggctgaccagccagggccaggccagccggcggctggaggccatcaacagagtgctggccggctctgtgccccccaccctgacccccaagcagggctacttcctgcagcctgagcgggtggccagtgacagctggacagagtgcaccctgcccagcatggtgaacagcgagcacagagctgccaaggtgcccctgtgcccagccagcgcccccatgctgcagaggagccgggccctgctgaacatcaaccagttcagatag

SEQ ID NO: 43002 - DNA, 1779 bp, Artificial Sequence
  Description of Artificial Sequence: Synthetic coding sequence
atgaggggccgggacctgtgcagcagcacccagagccaggccctgggcagcctgcggaccaccaccccagccttcaccctgaacatccccagcgaggccaaccacacagagcagcccccagctggcctgggcgcccggctgcaggaggccggcgtgtccatccccccaagaagaggccggcccacccccaccctggagaagaagaagaagccccacctgatggccgaggatgagcccagcggggccctgctgaagcccctggtgttccgggtggatgagaccaccccagctgtggtgcagagcgtgctgctggagcggggctggaacaagtttgacaagcaggagcagaatgctgaggactggaacctgtactggaggaccagcagcttcaggatgacagagcacaacagcgtgaagccctggcagcagctgaaccaccaccctggcaccaccaagctgaccaggaaggactgcctggccaagcacctgaagcacatgaggaggatgtatggcaccagcctgtaccagttcatccccctgacctttgtgatgcccaatgactacaccaagtttgtggccgagtacttccaggagcggcagatgctgggcaccaagcacagctactggatctgcaagccagctgagctgagccggggccggggcatcctgatcttcagtgacttcaaggacttcatctttgatgacatgtacatcgtgcagaagtacatcagcaaccccctgctgattggccgctacaagtgtgacctgcgcatctacgtgtgtgtgacaggcttcaagcccctgaccatctacgtgtaccaggagggcctggtgcgctttgccacagagaagtttgacctgagcaacctgcagaacaactatgcccacctgaccaacagcagcatcaacaagagcggggccagctatgagaagatcaaggaggtgattggccacggctgcaagtggaccctgagccgcttcttctcctacctgcgctcctgggatgtggatgacctgctgctgtggaagaagatccacaggatggtgatcctgaccatcctggccatcgcccccagcgtgccctttgctgccaactgctttgagctgtttggatttgacatcctgattgatgacaacctgaagccctggctgctggaggtgaactacagccctgccctgaccctggactgcagcacagatgtgctggtgaagaggaagctggtgcatgacatcatcgacctgatctacctgaatggcctgagaaatgaaggccgggaggccagcaatgccacccacggcaacagcaacattgatgctgccaagagtgacagaggaggcctggatgccccagactgcctgccctatgacagcctgtccttcaccagcaggatgtacaatgaagatgacagcgtggtggagaaggctgtgtctgtgcggcctgaggccgccccagccagccagctggagggggagatgagcggccaggacttccacctgagcacccgggagatgccccagagcaagcccaagctgcggagccgccacaccccccacaagaccctgatgccctatgccagcctcttccagagccacagctgcaagaccaagaccagcccctgtgtgctgagtgaccggggcaaggccccagacccccaggccggcaactttgtgctggtgttccccttcaatgaggccaccctgggcgccagcagaaatggcctgaatgtgaagaggatcatccaggagctgcagaagctgatgaacaagcagcacagctag

SEQ ID NO: 43003 - DNA, 1560 bp, Artificial Sequence
  Description of Artificial Sequence: Synthetic coding sequence
atggctgaagatgagcccagcggggccctgctgaagcccctggtgttccgggtggatgagaccaccccagctgtggtgcagagcgtgctgctggagcggggctggaacaagtttgacaagcaggagcagaatgctgaggactggaacctgtactggaggaccagcagcttcaggatgacagagcacaacagcgtgaagccctggcagcagctgaaccaccaccctggcaccaccaagctgaccaggaaggactgcctggccaagcacctgaagcacatgaggaggatgtatggcaccagcctgtaccagttcatccccctgacctttgtgatgcccaatgactacaccaagtttgtggccgagtacttccaggagcggcagatgctgggcaccaagcacagctactggatctgcaagccagctgagctgagccggggccggggcatcctgatcttcagtgacttcaaggacttcatctttgatgacatgtacatcgtgcagaagtacatcagcaaccccctgctgattggccgctacaagtgtgacctgcgcatctacgtgtgtgtgacaggcttcaagcccctgaccatctacgtgtaccaggagggcctggtgcgctttgccacagagaagtttgacctgagcaacctgcagaacaactatgcccacctgaccaacagcagcatcaacaagagcggggccagctatgagaagatcaaggaggtgattggacatggctgcaagtggaccctgagccgcttcttctcctacctgcgctcctgggatgtggatgacctgctgctgtggaagaagatccacaggatggtgatcctgaccatcctggccatcgcccccagcgtgccctttgctgccaactgctttgagctgtttggatttgacatcctgattgatgacaacctgaagccctggctgctggaggtgaactacagccctgccctgaccctggactgcagcacagatgtgctggtgaagaggaagctggtgcatgacatcatcgacctgatctacctgaatggcctgagaaatgaaggccgggaggccagcaatgccacccacggcaacagcaacattgatgctgccaagagtgaccggggcggcctggatgccccagactgcctgccctatgacagcctgtccttcaccagcaggatgtacaatgaagatgattctgtggtggagaaggctgtgtctgtgcggcctgaggccgccccagccagccagctggagggggagatgagcggccaggacttccacctgagcacccgggagatgccccagagcaagcccaagctgcggagccgccacaccccccacaagaccctgatgccctatgccagcctcttccagagccacagctgcaagaccaagaccagcccctgtgtgctgagtgaccggggcaaggccccagacccccaggccggcaactttgtgctggtgttccccttcaatgaggccaccctgggcgccagcagaaatggcctgaatgtgaagaggatcatccaggagctgcagaagctgatgaacaagcagcacagctag

SEQ ID NO: 43004 - DNA, 2013 bp, Artificial Sequence
  Description of Artificial Sequence: Synthetic coding sequence
atgcccagcctgccccaggagggcgtcatccagggccccagccccctggacctgaacacagagctgccctaccagagcaccatgaagaggaaggtgaggaagaagaagaagaagggcaccatcacagccaacgtggccggcaccaagtttgagatcgtgcggctggtgattgatgagatgggcttcatgaagaccccagatgaagatgagaccagcaacctgatctggtgtgacagcgctgtgcagcaggagaagatcagcgagctgcagaactaccagaggatcaaccacttccctggcatgggagagatctgcaggaaggacttcctggccaggaacatgaccaagatgatcaagagccggcccctggactacacctttgtgcccaggacctggatcttccctgctgagtacacccagttccagaactacgtgaaggagctgaagaagaagaggaagcagaagaccttcatcgtgaagccagccaatggagccatgggccacggcatcagcctcatcagaaatggagacaagctgcccagccaggaccacctgattgtgcaggagtacatcgagaagcccttcctgatggagggctacaagtttgacctgcgcatctacatcctggtgaccagctgtgaccccctgaagatcttcctgtaccatgatggcctggtgaggatgggcacagagaagtacatccccccaaatgaaagcaacctgacccagctgtacatgcacctgaccaactacagcgtgaacaagcacaatgagcactttgaaagagatgaaacagagaacaagggcagcaagaggagcatcaagtggttcacagagttcctgcaggccaaccagcatgatgtggccaagttctggagcgacatcagcgagctggtggtgaagaccctcatcgtggccgagccccacgtgctgcacgcctacaggatgtgcaggcctggccagcccccaggcagcgagagcgtgtgctttgaggtgctgggctttgacatcctgctggacaggaagctgaagccctggctgctggagatcaacagagcccccagctttggaacagaccagaagattgattatgatgtgaagaggggcgtgctgctgaatgccctgaagctgctgaacatccgcaccagtgacaagagaagaaacctggccaagcagaaggccgaggcccagaggcggctgtatggccagaacagcatcaagaggctgctgcccggcagcagtgactgggagcagcagaggcaccagctggagaggaggaaggaggagctgaaggagcggctggcccaggtgaggaagcagatcagccgggaggagcatgaaaatagacacatgggcaactaccgccgcatctaccccccagaggacaaggccctgctggagaagtatgagaacctgctggccgtggccttccagaccttcctgagcggccgggccgccagcttccagcgggagctgaacaaccccctgaagaggatgaaggaggaggacatcctggacctgctggagcagtgtgaaattgatgatgagaagctgatgggcaagaccaccaagacccggggccccaagcccctgtgcagcatgcctgagagcacagagatcatgaagaggcccaagtactgcagcagtgacagcagctatgacagcagcagcagcagcagcgagagtgatgaaaatgagaaggaggagtaccagaacaagaagcgggagaagcaggtgacctacaacctgaagcccagcaaccactacaagctgatccagcagcccagcagcatcagaagatctgtgtcctgccccaggagcatcagcgcccagagccccagcagcggggacacccggcccttcagcgcccagcagatgatctctgtgtcccggcccaccagcgccagccgcagccacagcctgaacagagccagcagctacatgaggcacctgccccacagcaatgatgcctgcagcaccaacagccaggtggtggccatcatccggcagtag

SEQ ID NO: 43005 - DNA, 1710 bp, Artificial Sequence
  Description of Artificial Sequence: Synthetic coding sequence
ctgggccagaggcagctgttccaggccctgcgggtggagcacaggagccctgagccctggctgcccagggctgtgggcggcagaagaagagccccagaccaccagtgccgcctgcccagccggggcggccggccccggggcagctgtgaggcccgggagcacctgggggaccggctgcagaggggccgggaggaccccggctgggccttcctgacccgggagctggtggtgaagaccctgattgtggccgagccccacgtgctgcacgcctacaggatgtgccggcccggccagcccccaggcagcgagagcgtgtgctttgaggtgctgggctttgacatcctgctggacaggaagctgaagccctggctgctggagatcaacagagcccccagctttggaacagaccagaagattgattatgatgtgaagaggggcgtgctgctgaatgccctgaagctgctgaacatccgcaccagtgacaagagaagaaacctggccaagcagaaggccgaggcccagaggcggctgtatggccagaacagcatcaagaggctgctgcccggcagcagtgactgggagcagcagaggcaccagctggagaggaggaaggaggagctgaaggagcggctggcccaggtgaggaagcagatcagccgggaggagcacgagaacagacacatgggcaactaccgccgcatctacccacctgaggacaaggccctgctggagaagtatgagaacctgctggccgtggccttccagaccttcctgagcggccgggccgccagcttccagcgggagctgaacaaccccctgaagaggatgaaggaggaggacatcctggacctgctggagcagtgtgaaattgatgatgagaagctgatgggcaagaccaccaagacccggggccccaagcccctgtgcagcatgcctgagagcacagagatcatgaagaggcccaagtactgcagcagtgacagcagctatgacagcagcagcagcagcagcgagagtgatgaaaatgagaaggaggagtaccagaacaagaagcgggagaagcaggtgacctacaacctgaagcccagcaaccactacaagctgatccagcagcccagcagcatccgccgctctgtgtcctgccccaggagcatcagcgcccagagccccagcagcggggacacccggcccttcagcgcccagcagatgatctctgtgtcccggcccaccagcgccagccgcagccacagcctgaacagagccagcagctacatgaggcacctgccccacagcaatgatgcctgcagcaccaacagccaggtgtctgagagcctgcggcagctgaagaccaaggagcaggaggatgacctgaccagccagaccctgtttgtgctgaaggacatgaagatccgcttccctgggaagagtgatgctgagagcgagctgctgattgaggacatcatcgacaactggaagtaccacaagaccaaggtggccagctactggctgatcaagctggacagcgtgaagcagaggaaggtgctggacatcgtgaagaccagcatcagaacagtgctgccccgcatctggaaggtgcctgatgtggaggaggtgaacctgtaccgcatcttcaacagagtcttcaaccggctgctgtggagccggggccagggcctgtggaactgcttctgtgacagcggctacctgtag

SEQ ID NO: 43006 - DNA, 1101 bp, Artificial Sequence
  Description of Artificial Sequence: Synthetic coding sequence
atgtcctggaacatcagccacccccagctgagtgacaagctgtttgggaagaatggagtgctggaggagcagaagagccctggcttcaagaagcgggagacagaggtgtatgtgggcaacctgcccctggacatcagcaaggaggagatcctgtacctgctgaaggacttcaaccccctggatgtgcacaagatccagaatggctgcaagtgctttgcctttgtggacctgggctccatgcagaaggtgaccctggccatccaggagctgaatggcaagctgttccacaagaggaagctgtttgtgaacaccagcaagaggcctcccaagaggaccccagacatgatccagcagccccgggcccccctggtgctggagaaggccagcggggagggctttgggaagacagctgccatcatccagctggcccccaaggcccctgtggacctgtgtgaaacagagaagctgcgggccgccttctttgctgtgcccctggagatgaggggcagcttcctggtgctgctgctgcgggagtgcttccgggacctgtcctggctggccctgatccacagcgtgcggggggaggccggcctgctggtgaccagcatcgtgcccaagacccccttcttctgggccatgcacgtgacagaggccctgcaccagaacatgcaggccctcttcagcaccctggcccaggccgaggagcagcagccctacctggagggcagcacagtgatgaggggcacccgctgcctggccgagtaccacctgggggactatggccacgcctggaaccgctgctgggtgctggacagagtggacacctgggccgtggtgatgttcatcgactttggccagctggccaccatccctgtgcagagcctgcggagcctggacagtgatgacttctggaccatcccccccctgacccagcccttcatgctggagaaggacatcctgagcagctatgaggtggtgcaccgcatcctgaagggcaagatcactggagccctgaacagcgctgtgacagccccagccagcaacctggccgtggtgccccccctgctgcccctgggctgcctgcagcaggccgccgcctag

SEQ ID NO: 43007 - DNA, 1056 bp, Artificial Sequence
  Description of Artificial Sequence: Synthetic coding sequence
atgtcctggaacatcagccacccccagctgagtgacaagctgtttgggaagaatggagtgctggaggagcagaagagccctggcttcaagaagcgggagacagaggtgtatgtgggcaacctgcccctggacatcagcaaggaggagatcctgtacctgctgaaggacttcaaccccctggatgtgcacaagatccagaatggctgcaagtgctttgcctttgtggacctgggctccatgcagaaggtgaccctggccatccaggagctgaatggcaagctgttccacaagaggaagctgtttgtgaacaccagcaagaggcctcccaagaggaccccagacatgatccagcagccccgggcccccctggtgctggagaaggccagcggggagggctttgggaagacagctgccatcatccagctggcccccaaggcccctgtggacctgtgtgaaacagagaagctgcgggccgccttctttgctgtgcccctggagatgaggggcagcttcctggtgctgctgctgcgggagtgcttccgggacctgtcctggctggccctgatccacagcgtgcggggggaggccggcctgctggtgaccagcatcgtgcccaagacccccttcttctgggccatgcacgtgacagaggccctgcaccagaacatgcaggccctcttcagcaccctggcccaggccgaggagcagcagccctacctggagggcagcacagtgatgaggggcacccgctgcctggccgagtaccacctgggggactatggccacgcctggaaccgctgctgggtgctggacagagtggacacctgggccgtggtgatgttcatcgactttggccagctggccaccatccctgtgcagagcctgcggagcctggacagtgatgacttctggaccatcccccccctgacccagcccttcatgctggagaaggacatcctgagcagctatgaggtggtgcaccgcatcctgaagggcaagatcactggagccctgaacagcgccctgcacatcctgaagtttgaggagagcaagtag

SEQ ID NO: 43008 - DNA, 1188 bp, Artificial Sequence
  Description of Artificial Sequence: Synthetic coding sequence
atgctgcagctgctggtgctgaagattgaggaccccggctgcttctgggtgatcatcaagggctgcagccccttcctggaccatgatgtggactaccagaagctgaacagcgccatgaatgacttctacaacagcacctgccaggacatcgagatcaagcccctgaccctggaggagggccaggtgtgtgtggtgtactgtgaggagctgaagtgctggtgccgggccatcgtgaagagcatcaccagcagcgctgaccagtacctggccgagtgcttcctggtggactttgccaagaacatccctgtgaagagcaagaacatccgggtggtggtggagagcttcatgcagctgccctaccgggccaagaagttcagcctgtactgcaccaagcctgtgaccctgcacatcgacttctgccgggacagcacagacatcgtgcctgccaagaagtgggacaatgctgccatccagtacttccagaacctgctgaaggccaccacccaggtggaggcccggctgtgtgctgtggaggaggacacctttgaggtgtacctgtatgtgaccatcaaggatgagaaggtgtgtgtgaatgatgacctggtggccaagaactatgcctgctacatgagccccaccaagaacaagaacctggactacctggagaagccccggctgaacatcaagagcgcccccagcttcaacaagctgaacccagccctgaccctgtggcccatgttcctgcagggcaaggatgtgcagggcatggaggacagccacggcgtgaacttccctgcccagagcctgcagcacacctggtgcaagggcatcgtgggggacctgcggcccacagccacagcccaggacaaggctgtgaagtgcaacatggacagcctgcgggacagccccaaggacaagtctgagaagaagcaccactgcatcagcctgaaggacaccaacaagagggtggagagctctgtgtactggccagccaagaggggcatcaccatctatgctgaccctgatgtgcctgaggccagcgccctgagccagaagagcaatgagaagcccctgcggctgacagagaagaaggagtatgatgagaagaacagctgtgtgaagctgctgcagttcctgaacccagaccccctgcgggcagatggcatcagtgacctgcagcagacctag

SEQ ID NO: 43009 - DNA, 3534 bp, Artificial Sequence
  Description of Artificial Sequence: Synthetic coding sequence
atgctgcagctgctggtgctgaagattgaggaccccggctgcttctgggtgatcatcaagggctgcagccccttcctggaccatgatgtggactaccagaagctgaacagcgccatgaatgacttctacaacagcacctgccaggacatcgagatcaagcccctgaccctggaggagggccaggtgtgtgtggtgtactgtgaggagctgaagtgctggtgccgggccatcgtgaagagcatcaccagcagcgctgaccagtacctggccgagtgcttcctggtggactttgccaagaacatccctgtgaagagcaagaacatccgggtggtggtggagagcttcatgcagctgccctaccgggccaagaagttcagcctgtactgcaccaagcctgtgaccctgcacatcgacttctgccgggacagcacagacatcgtgcctgccaagaagtgggacaatgctgccatccagtacttccagaacctgctgaaggccaccacccaggtggaggcccggctgtgtgctgtggaggaggacacctttgaggtgtacctgtatgtgaccatcaaggatgagaaggtgtgtgtgaatgatgacctggtggccaagaactatgcctgctacatgagccccaccaagaacaagaacctggactacctggagaagccccggctgaacatcaagagcgcccccagcttcaacaagctgaacccagccctgaccctgtggcccatgttcctgcagggcaaggatgtgcagggcatggaggacagccacggcgtgaacttccctgcccagagcctgcagcacacctggtgcaagggcatcgtgggggacctgcggcccacagccacagcccaggacaaggctgtgaagtgcaacatggacagcctgcgggacagccccaaggacaagtctgagaagaagcaccactgcatcagcctgaaggacaccaacaagagggtggagagctctgtgtactggccagccaagaggggcatcaccatctatgctgaccctgatgtgcctgaggccagcgccctgagccagaagagcaatgagaagcccctgcggctgacagagaagaaggagtatgatgagaagaacagctgtgtgaagctgctgcagttcctgaacccagaccccctgcgggcagatggcatcagtgacctgcagcagctgcagaagctgaagggcctgcagccccctgtggtggtgctgaggaacaagatcaagccctgcctgaccatcgacagcagccccctgtctgctgacctgaagaaggccctgcagaggaacaagtttcctggccccagccacacagagagctacagctggccacccatcgcccggggctgtgatgtggtggtgatcagccactgtgagagcaaccccctgctgtacctgctgcctgtgctgactgtgctgcagacaggagcctgctacaagagcctgcccagcagaaatggccccctggccgtcatcgtgtgccccggctggaagaaggcccagttcatctttgagctgctgggggagtacagcatgagcagccggcccctgcaccctgtgctgctgaccatcggcctgcacaaggaggaggccaagaacaccaagctgccccggggctgtgatgtgattgtgaccaccccctacagcctgctgcggctgctggcctgccagagcctgctcttcctgcggctgtgccacctgatcctggatgaggtggaggtgctcttcctggaggccaatgagcagatgtttgccatcctggacaacttcaagaagaacatcgaggtggaggagcgggagagcgccccccaccagatcgtggccgtgggcgtgcactggaacaagcacatcgagcacctgatcaaggagttcatgaatgacccctacatcgtcatcacagccatggaggaggccgccctgtatggaaatgtgcagcaggtggtgcacctgtgcctggagtgtgagaagaccagcagcctgctgcaggccctggacttcatccccagccaggcccagaagaccctcatcttcacctgcagcgtggccgagacagagatcgtgtgcaaggtggtggagagcagcagcatcttctgcctgaagatgcacaaggagatgatcttcaacctgcagaatgtgctggagcagtggaagaagaagctgagcagcggcagccagatcatcctggccctgacagatgactgtgtgcccctgctggccatcacagatgccacctgtgtgatccacttctccttccctgccagccccaaggtgtttggaggccgcctgtactgcatgtctgaccacttccacgccgagcagggcagccctgctgagcagggcgacaagaaggccaagtctgtgctgctgctgacagagaaggatgccagccatgctgtgggcgtgctgcgctacctggagcgggcagatgccaaggtgcctgctgagctgtatgagttcaccgctggggtgctggaggccaaggaggacaagaaggccggccggcccctgtgcccctacctgaaggccttcggcttctgcaaggacaagaggatctgcccagacagacaccgcatcaaccctgagacagacctgcccaggaagctgagcagccaggccctgcccagctttggctacatcaagatcatccccttctacatcctgaatgccaccaactacttcggccgcatcgtggacaagcacatggacctgtatgccaccctgaatgctgagatgaatgagtacttcaaggacagcaacaagaccaccgtggagaaggtggagaagtttggcctgtatggcctggccgagaagaccctcttccaccgggtgcaggtgctggaggtgaaccagaaggaggatgcctgggccctggatgacatcctggtggagttcattgatgagggccgcacaggcctggtgacccgggaccagctgctgcacctgcctgagcacttccacaccctgcccccccaggccgtggagttcatcgtgtgccgggtgaagccagctgacaatgaaattgagtggaaccccaaggtgacccgctacatccaccacaagatcgtgggcaagctgcatgatgccaaggtgatcctggccctgggcaacacagtgtggattgaccccatggtgcacatcaccaacctgagcagcctgaagacctctgtgattgactacaacgtgcgggcagagatcctgtccatgggcatgggcatcgacaaccctgagcacatcgagcagctgaagaagctgcgggaggatgccaagatcccagcctgtgaggagagcctgagccagaccccaccccgggtgacaggcaccagccctgcccaggaccaggaccaccccagcgaggagcagggcggccagggcaccccaccagcagaagatgctgcctgcctgcagagcccccagcctgaggacaccggggctgagggcggcgctgagagcaagaccagcagcgagaaccagaagccaggcggctacctggtgttcaagcgctggctgagcagcaacagatag

SEQ ID NO: 43010 - DNA, 561 bp, Artificial Sequence
  Description of Artificial Sequence: Synthetic coding sequence
atggacaccttcagcaccaagagcctggccctgcaggcccagaagaagctgctgagcaagatggccagcaaggctgtggtggccgtgctggtggatgacaccagcagcgaggtgctggatgagctgtaccgggccacccgggagttcaccaggagcaggaaggaggcccagaagatgctgaagaacctggtgaaggtggccctgaagctgggcctgctgctgcggggggaccagctgggcggggaggagctggccctgctgcggcgcttccgccaccgggcccgctgcctggccatgacagctgtgtccttccaccaggtggacttcacctttgacagaagagtgctggccgccggcctgctggagtgccgggacctgctgcaccaggccgtgggcccccacctgacagccaagagccacggccgcatcaaccacgtgtttggccacctggccgactgtgacttcctggccgccctgtatggccctgctgagccctaccgcagccacctgcggcgcatctgtgagggcctgggccgcatgctggatgagggcagcctgtag

SEQ ID NO: 43011 - DNA, 561 bp, Artificial Sequence; identical to SEQ ID NO: 43010
  Description of Artificial Sequence: Synthetic coding sequence

SEQ ID NO: 43012 - DNA, 879 bp, Artificial Sequence
  Description of Artificial Sequence: Synthetic coding sequence
atgggcaagccccggcagaaccccagcaccctggtgtccaccctgtgtgaggccgagcccaagggcaagctgtgggtgaatggctacgccggcacccagggcaccagagatgccaccctgcagaccaggctcatccccctgtccttccacctgcagaggggcaagggcctggccgcccccctgagcgccctgagcgccccccggctgcctgagaggcctgcagatggccgggtggccgtggatgcccagcctgctgcccgctccatggacagcgacagcggggagcagagcgagggggagcctgtgacagctgctggcccagatgtgttcagcagcaagagcctggccctgcaggcccagaagaagatcctgagcaagatcgccagcaagacagtggccaacatgctgattgatgacaccagcagcgagatctttgatgagctgtacaaggtgaccaaggagcacacccacaacaagaaggaggcccacaagatcatgaaggacctgatcaaggtggccatcaagattggcatcctgtacagaaacaaccagttcagccaggaggagctggtgattgtggagaagttcaggaagaagctgaaccagacagccatgaccatcgtgtccttctatgaggtggagtacacctttgacagaaatgtgctgagcaacctgctgcacgagtgcaaggacctggtgcatgagctggtgcagaggcacctgacccccaggacccacggccgcatcaaccacgtgttcaaccactttgctgatgtggagttcctgagcaccctgtacagcctggatggagactgccggcccaacctgaagaggatctgtgagggcatcaacaagctgctggatgagaaggtgctgtag

SEQ ID NO: 43013 - DNA, 411 bp, Artificial Sequence
  Description of Artificial Sequence: Synthetic coding sequence
atgcctcatgccaggacagagacctctgtgggcacctatgagagccacagcaccagcgagctggaggacctgacagagcctgagcagcgggagctgaagaccaagctgaccaagctggaggccgagatcgtgaccctgcggcacgtgctggccgccaaggagcggcgctgtggggagctgaagaggaagctgggcctgacagccctggtgggcctgcggcagaacctgagcaagtcctggctggatgtgcaggtgagcaacacctacgtgaagcagaagaccagcgctgccctgagcaccatgggcaccctcatctgcaggaagctgggcggcgtgaagaagagcgccaccttccgcagctttgagggcctcatcttcaacaagtacaccctgaaccagggcagaaattag

SEQ ID NO: 43014 - DNA, 423 bp, Artificial Sequence
  Description of Artificial Sequence: Synthetic coding sequence
atgcctcatgccaggacagagacctctgtgggcacctatgagagccacagcaccagcgagctggaggacctgacagagcctgagcagcgggagctgaagaccaagctgaccaagctggaggccgagatcgtgaccctgcggcacgtgctggccgccaaggagcggcgctgtggggagctgaagaggaagctgggcctgacagccctggtgggcctgcggcagaacctgagcaagtcctggctggatgtgcaggtgagcaacacctacgtgaagcagaagaccagcgctgccctgagcaccatgggcaccctcatctgcaggaagctgggcggcgtgaagaagagcgccaccttccgcagctttgagggcctgatgggcaccatcaagagcaaggtgtctgggggcaagagggcctggccctag

SEQ ID NO: 43015 - DNA, 399 bp, Artificial Sequence
  Description of Artificial Sequence: Synthetic coding sequence
atgcctcatgccaggacagagacctctgtgggcacctatgagagccacagcaccagcgagctggaggacctgacagagcctgagcagcgggagctgaagaccaagctgaccaagctggaggccgagatcgtgaccctgcggcacgtgctggccgccaaggagcggcgctgtggggagctgaagaggaagctgggcctgacagccctggtgggcctgcggcagaacctgagcaagtcctggctggatgtgcaggtgagcaacacctacgtgaagcagaagaccagcgctgccctgagcaccatgggcaccctcatctgcaggaagctgggcggcgtgaagaagagcgccaccttccgcagctttgagggcaaccccaagggggagggcagccgcatctag

SEQ ID NO: 43016 - DNA, 999 bp, Artificial Sequence
  Description of Artificial Sequence: Synthetic coding sequence
atgctggccgtgcactttgacaagccaggcggccctgagaacctgtatgtgaaggaggtggccaagcccagccctggagagggggaggtgctgctgaaggtggccgccagcgccctgaacagagctgacctgatgcagaggcagggccagtatgaccccccacctggggccagcaacatcctgggcctggaggccagcggccacgtggccgagctgggccctggctgccagggccactggaagatcggggacacagccatggccctgctgcccggcggcggccaggcccagtatgtgacagtgcctgagggcctgctgatgcccatccctgagggcctgaccctgacccaggccgccgccatccctgaggcctggctgacagccttccagctgctgcacctggtgggcaatgtgcaggccggggactatgtgctgattcatgctggcctgtctggagtgggcacagctgccatccagctgaccaggatggccggggccatccccctggtgacagctggcagccagaagaagctgcagatggccgagaagctgggcgctgctgctggcttcaactacaagaaggaggacttcagcgaggccaccctgaagttcaccaagggggccggcgtgaacctgatcctggactgcattggaggcagctactgggagaagaatgtgaactgcctggccctggatggccgctgggtgctgtatggcctgatgggcggcggggacatcaatggccccctcttcagcaagctgctcttcaagaggggcagcctcatcaccagcctgctgcggagccgggacaacaagtacaagcagatgctggtgaatgccttcacagagcagatcctgccccacttcagcacagagggcccccagaggctgctgcctgtgctggaccgcatctaccctgtgacagagatccaggaggcccacaagtacatggaggccaacaagaacatcggcaagatcgtgctggagctgccccagtag

SEQ ID NO: 43017 - DNA, 747 bp, Artificial Sequence
  Description of Artificial Sequence: Synthetic coding sequence
atgctggccgtgcactttgacaagccaggcggccctgagaacctgtatgtgaaggaggtggccaagcccagccctggagagggggaggtgctgctgaaggtggccgccagcgccctgaacagagctgacctgatgcagaggcagggccagtatgaccccccacctggggccagcaacatcctgggcctggaggccagcggccacgtggccgagctgggccctggctgccagggccactggaagatcggggacacagccatggccctgctgcccggcggcggccaggcccagtatgtgacagtgcctgagggcctgctgatgcccatccctgagggcctgaccctgacccaggccgccgccatccctgaggcctggctgacagccttccagctgctgcacctggtgggcaatgtgcaggccggggactatgtgctgattcatgctggcctgtctggagtgggcacagctgccatccagctgaccaggatggccggggccatccccctggtgacagctggcagccagaagaagctgcagatggccgagaagctgggcgctgctgctggcttcaactacaagaaggaggacttcagcgaggccaccctgaagttcaccaaggtgcaggccaatgctggggagtgcttccacggggccaacagcgccagcctgctgcatggaggcccccccaccagcgctgctggcagcggccagaacctgcccagcgacagaaatcctgggggcccctag

SEQ ID NO: 43018 - DNA, 999 bp, Artificial Sequence; identical to SEQ ID NO: 43016
  Description of Artificial Sequence: Synthetic coding sequence

SEQ ID NO: 43019 - DNA, 651 bp, Artificial Sequence
  Description of Artificial Sequence: Synthetic coding sequence
tttgacaagccaggcggccctgagaacctgtatgtgaaggaggtggccaagcccagccctggagagggggaggtgctgctgaaggtggccgccagcgccctgaacagagctgacctgatgcagaggcagggccagtatgaccccccacctggggccagcaacatcctgggcctggaggccagcggccacgtggccgagctgggccctggctgccagggccactggaagattggagacacagccatggccctgctgcccggcggcggccaggcccagtatgtgacagtgcctgagggcctgctgatgcccatccctgagggcctgaccctgacccaggccgccgccatccctgaggcctggctgacagccttccagctgctgcacctggtgggcaatgtgcaggccggggactatgtgctgattcatgctggcctgagcggcgtgggcacagctgccatccagctgaccaggatggccggggccatccccctggtgacagctggcagccagaagaagctgcagatggccgagaagctgggcgctgctgctggcttcaactacaagaaggaggacttcagcgaggccaccctgaagttcaccaagggcaagcagctgctgctgcagttcagcaggaacctgagagatgactag

SEQ ID NO: 43020 - DNA, 261 bp, Artificial Sequence
  Description of Artificial Sequence: Synthetic coding sequence
atgggcagcagcagcgaggccagcttccgcagcgcccaggccagctgcagcggggcccggcggcagggcctgggccgcggggaccagaacctgtctgtgatgcccccaaatggccgggcccagacccacaccccaggctgggtgtctgaccccctggtgctgggcgcccaggtgcatggaggctgccggggcatcgaggccctgtctgtgagcagcggctcctggagcagcgccaccgtgtggatcctgactgtgcagtag

SEQ ID NO: 43021 - DNA, 363 bp, Artificial Sequence
  Description of Artificial Sequence: Synthetic coding sequence
atgggcagcagcagcgaggccagcttccgcagcgcccaggccagctgcagcggggcccggcggcagggcctgggccgcggggaccagaacctgtctgtgatgcccccaaatggccgggcccagacccacaccccaggctgggtgtctgaccccctggtgctgggcgcccaggtgcatggaggctgccggggcatcgaggccctgtctgtgagcagcggctcctggagcagcgccaccgtgtggatcctgaccggcctgagccggcccttcctgcccggggccaccgtgctgcgggaccggcccctgggcagcgcctttgagctgtcctatgaccagaagaaggcccccctgcggctgcagtag

SEQ ID NO: 43022 - DNA, 831 bp, Artificial Sequence
  Description of Artificial Sequence: Synthetic coding sequence
atgctgcggagcctgctgctgcacagcctgcggctgtgtgcccagacagccagctgcctggtgctcttcccccgcttcctgggcacagccttcatgctgtggctgctggacttcctgtgcatcaggaagcacttcctgggcagaagaagaagaggccagcctgagcctgaggtggagctgaacagcgagggggaggaggtgcccccagatgacccccccatctgtgtgtctgatgacaaccggctgtgcaccctggccagcctgaaggctgtgtggcacggccagaagctggacttcttcaagcaggcccacgagggcggccctgcccccaacagcgaggtggtgctgcctgatggcttccagagccagcacatcctggactatgcccagggcaaccggcccctggtgctgaactttggcagctgcccccccttcatggccaggatgtctgccttccagaggctggtgaccaagtaccagagagatgtggacttcctgatcatctacatcgaggaggcccaccccagtgatggctgggtgaccacagacagcccctacatcatcccccagcacaggagcctggaggacagagtgtctgctgcccgggtgctgcagcagggcgcccctggctgtgccctggtgctggacaccatggccaacagcagcagcagcgcctacggggcctactttgagcggctgtatgtgatccagagcggcaccatcatgtaccagggcggccggggcccagatggctaccaggtgtctgagctgcggacctggctggagagatatgatgagcagctgcatggagcccggccccggcgggtgtag

SEQ ID NO: 43023 - DNA, 4209 bp, Artificial Sequence
  Description of Artificial Sequence: Synthetic coding sequence
atgcaccagaccctgtgcctgaaccctgagagcctgaagatgtctgcctgcagcgactttgtggagcacatctggaagccaggcagctgcaagaactgcttctgcctgcggagtgaccaccagctggtggccggccccccccagcccagggctggcagcctgcccccaccaccccggctgccccccaggcctgagaactgccgcctggaggatgaaggagtgaacagcagcccctacagcaagcccaccatcgctgtgaagcccaccatgatgagcagcgaggccagtgatgtgtggacagaggccaacctgtctgctgaggtgtcccaggtgatctggaggcgggcccctgggaagctgcccctgcccaagcaggaggatgcccctgtggtgtacctgggcagcttccggggcgtgcagaagccagctggccccagcaccagcccagatggcaacagccgctgccccccagcctacaccatggtgggcctgcacaacctggagcccagaggagagagaaatattgccttccaccctgtgtccttccctgaggagaaggctgtgcacaaggagaagcccagcttcccctaccaggaccggcccagcacccaggagagcttccggcagaagctggccgcctttgctggcaccaccagcggctgccaccagggccctggccccctgcgggagagcctgcccagtgaagatgacagcgaccagcgctgcagccccagcggggacagcgagggcggggagtactgcagcatcctggactgctgccccggcagccctgtggccaaggccgccagccagacagctggcagccggggcagacatggaggccgggactgcagccccacctgctgggagcagggcaaatgttctggccctgctgagcaggagaagaggggccccagcttccccaaggagtgctgcagccagggccccacagcccaccccagctgcctgggccccaagaagctgagcctgaccagcgaggccgccatcagcagtgatggcctgagctgtggcagcggcagcggcagcggggccagcagcccctttgtgccccacctggagagtgactactgcagcctgatgaaggagcccgcccctgagaagcagcaggaccccggctgccctggggtgacccccagccgctgcctgggcctgaccggggagccccagcccccagcccacccccgggaggccacccagcctgagcccatctatgcagagagcaccaagaggaagaaggccgcccctgtgcccagcaagagccaggccaagattgaacatgctgctgctgcccagggccagggccaggtgtgcacaggaaatgcctgggcccagaaggccgccagcggctggggccgggacagcccagaccccaccccccaggtgtctgccaccatcaccgtgatggccgcccaccctgaggaggaccacaggaccatctacctgagcagcccagattctgctgtgggcgtgcagtggccccggggccctgtgtcccagaacagcgaggtgggggaggaggagaccagcgctggccagggcctgagcagccgggagagccacgcccacagcgccagcgagagcaagcccaaggagaggcctgccatcccccccaagctgagcaagagcagccctgtgggcagccctgtgagccccagcgctgggggcccccctgtgagccccctggccgacctgagtgatggcagcagcggcggcagcagcatcggcccccagccccccagccagggccctgctgaccctgcccccagctgcaggaccaacggggtggccatcagtgaccccagccgctgcccccagcctgctgccagcagcgccagcgagcagaggcggccccgcttccaggccggcacctggagccggcagtgcagaattgaggaggaggaggaggtggagcaggagctgctgagccacagctggggccgggagaccaagaatggccccacagaccacagcaacagcaccacctggcaccggctgcaccccacagatggcagcagcggccagaacagcaaggtgggcaccggcatgagcaagagcgccagctttgcctttgagttccccaaggacaggagcggcatcgagaccttcagccccccacctcctccacccaagagccgccacctgctgaagatgaacaagagcagcagtgacctggagaaggtgtcccagggcagcgctgagagcctgagccccagcttccggggcgtgcacgtgtccttcaccaccggcagcacagacagcctggccagtgacagcaggacctgcagtgatggcggccccagcagcgagctggcccacagccccaccaacagcggcaagaagctgtttgcccctgtgcccttccccagcggcagcacagaagatgtgagccccagcggcccccagcagcccccacccctgccccagaagaagatcgtgtcccgggccgccagcagcccagatggcttcttctggacccagggcagccccaagccaggcacagccagccccaagctgaacctgagccacagcgagaccaacgtgcatgatgagagccacttctcctacagcctgagccctggcaacagacaccaccctgtgttcagcagcagtgaccccctggagaaggccttcaagggcagcggccactggctgcctgctgctggcctggccggcaacagaggaggctgcggcagccctggcctgcagtgcaagggggcccccagcgccagcagcagccagctgtctgtgagcagccaggccagcacaggcagcacccagctgcagctgcacggcctgctgagcaacatcagcagcaaggagggcacctacgccaagctgggcggcctgtacacccagagcctggcccggctggtggccaagtgtgaagatctcttcatgggcggccagaagaaggagctgcacttcaatgaaaacaactggagcctcttcaagctgacctgcaacaagccctgctgtgacagcggagatgccatctactactgtgccacctgcagtgaagatcctggcagcacctatgctgtgaagatctgcaaggcccctgagcccaagacagtgtcctactgcagccccagcgtgcctgtgcacttcaacatccagcaggactgtggccactttgtggcctctgtgcccagctccatgctgagcagcccagatgcccccaaggaccctgtgcctgccctgcccacccaccccccagcccaggagcaggactgtgtggtggtgatcacccgggaggtgccccaccagacagccagtgactttgtgcgggacagcgctgccagccaccaggccgagcctgaggcctatgaaagaagagtgtgcttcctgctgctgcagctgtgcaatggcctggagcacctgaaggagcacggcatcatccaccgggacctgtgcctggagaacctgctgctggtgcactgcaccctgcaggccggccctggccctgccccagccccagccccagccccagctgctgctgccccaccctgcagcagcgctgcccccccagctgggggcaccctgagccctgctgctggccctgccagccctgagggcccccgggagaagcagctgcccaggctcatcatcagcaacttcctgaaggccaagcagaagccaggcggcacccccaacctgcagcagaagaagagccaggcccggctggcccctgagatcgtgtctgccagccagtacaggaagtttgatgagttccagacaggcatcctgatctatgagctgctgcaccagcccaacccctttgaggtgcgggcccagctgcgggagcgggactaccggcaggaggacctgccccccctgcctgccctgagcctgtacagccctggcctgcagcagctggcccacctgctgctggaggccgaccccatcaagaggatccgcatcggggaggccaagagggtgctgcagtgcctgctgtggggcccccggcgggagctggtgcagcagcccggcaccagcgaggaggccctgtgtggcaccctgcacaactggattgacatgaagagggccctgatgatgatgaagtttgctgagaaggctgtggacagaagaagaggagtggagctggaggactggctgtgctgccagtacctggccagcgctgagcccggggccctgctgcagagcctgaagctgctgcagctgctgtag

SEQ ID NO: 43024 - DNA, 4209 bp, Artificial Sequence; identical to SEQ ID NO: 43023
  Description of Artificial Sequence: Synthetic coding sequence

SEQ ID NO: 43025 - DNA, 1416 bp, Artificial Sequence
  Description of Artificial Sequence: Synthetic coding sequence
atgtctgactttgatgaatttgagcggcagctgaatgaaaacaagcaggagcgggacaaggaaaatagacacaggaagaggagccacagccgcagccgcagccgggacaggaagagaagaagccgcagccgggacagaagaaacagagaccagaggtctgccagccgggacagaagaagaagaagcaagcccctgaccaggggggccaaggaggagcacggcggcctcatccgcagccccaggcatgagaagaagaagaaggtgaggaagtactgggatgtgcccccacctggctttgagcacatcacccccatgcagtacaaggccatgcaggccgccggccagatcccagccacagccctgctgcccaccatgaccccagatggcctggccgtgacccccacccctgtgcctgtggtgggcagccagatgacccggcaggcccggcggctgtatgtgggcaacatccccttcggcatcacagaggaggccatgatggacttcttcaatgcccagatgaggctgggcggcctgacccaggcccctggcaaccctgtgctggccgtgcagatcaaccaggacaagaactttgccttcctggagttccgctctgtggatgagaccacccaggccatggcctttgatggcatcatcttccagggccagagcctgaagatcagaagacctcatgactaccagcccctgcccggcatgtctgagaaccccagcgtgtatgtgcctggggtggtgtccacagtggtgcctgattctgcccacaagctgttcatcggcggcctgcccaactacctgaatgatgaccaggtgaaggagctgctgaccagctttggccccctgaaggccttcaacctggtgaaggacagcgccaccggcctgagcaagggctacgccttctgtgaatatgtggacatcaacgtgacagaccaggccatcgccggcctgaatggcatgcagctgggggacaagaagctgctggtgcagagggcctctgtgggcgccaagaatgccaccctgagcaccatcaaccagacccctgtgaccctgcaggtgcccggcctgatgagcagccaggtgcagatgggcggccaccccacagaggtgctgtgcctgatgaacatggtgctgcctgaggagctgctggatgatgaggagtatgaggagatcgtggaggatgtgagagatgaatgttccaaatatggcctggtgaagagcattgagatccccaggcctgtggatggagtggaggtgcccggctgcggcaagatctttgtggagttcacctctgtgtttgactgccagaaggccatgcagggcctgaccggcaggaagtttgccaacagagtggtggtgaccaagtactgtgaccctgacagctaccacagaagagacttctggtag

SEQ ID NO: 43026 - DNA, 783 bp, Artificial Sequence
  Description of Artificial Sequence: Synthetic coding sequence
atgtggcacgccatcagcaggaccagcaggatgagccagagcggctgccccagcggcctgctggccgacaagaacatcagcagcagcgccaccagggtcatcgtgaagacagctggcaaccagaaggacttcatggtggctgatgacatctctgtgcggcagttcaaggagatgctgctggcccacttccagtgccagatggaccagctggtgctggtgttcatgggctgcctgctgaaggaccatgacaccctgagccagaggggcatcatggatggccacaccatctacctggtgatcaagagcaagcagggcagccgcagcctggcccacagcttccgggacctgcccaccaatgacccctgccaccgggacaggaacaccaaggccaatgacaccctgaacaaggtgaaccacaccagcaaggccaacacagccatgatcagcaccaagggccagagccacatctgtgccacccggcagcctgcctggatcccagccctgcccagcattgagctgacccagcagctgcaggaggagtacaaggatgccaccgtgtccctgagcagcagccggcagaccctgaagggggacctgcagctgagtgatgagcagagcagcagccagatcactggaggcatgatgcagctgctgatgaacaacccctacctggccgcccagatcatgctgttcacctccatgccccagctgtctgagcagtggaggcagcagctgcccaccttcctgcagcagacccagatcagtgacctgctgagcgcctag

SEQ ID NO: 43027 - DNA, 1428 bp, Artificial Sequence
  Description of Artificial Sequence: Synthetic coding sequence
atgtggcacgccatcagcaggaccagcaggatgagccagagcggctgccccagcggcctgctggccgacaagaacatcagcagcagcgccaccagggtcatcgtgaagacagctggcaaccagaaggacttcatggtggctgatgacatctctgtgcggcagttcaaggagatgctgctggcccacttccagtgccagatggaccagctggtgctggtgttcatgggctgcctgctgaaggaccatgacaccctgagccagaggggcatcatggatggccacaccatctacctggtgatcaagagcaagcagggcagccgcagcctggcccacagcttccgggacctgcccaccaatgacccctgccaccgggacaggaacaccaagggcaacagcagccgggtgcaccagcccaccggcatgaaccaggcccctgtggagctggcccactttgtgggcagtgatgcccccaaggtgcacacccagaacctggaggtgagccaccctgagtgcaaggcccagatgctggagaaccccagcatccagaggctgctgagcaacatggagttcatgtggcagttcatcagcgagcacctggacacccagcagctgatgcagcagaaccctgaggtgtcccggctgctgctggacaacagcgagatcctgctgcagaccctggagctggccaggaacctggccatgatccaggagatcatgcagatccagcagcccagccagaacctggagtaccccctgaacccccagccctacctgggcctggagaccatgcctgggggcaacaatgccctgggccagaactatgctgacatcaatgaccagatgctgaacagcatgcaggacccctttggaggcaaccccttcaccgccctgctggccggccaggtgctggagcaggtgcagagcagccccccacctcctccacccagccaggagcagcaggaccagctgacccagcacccagccaccagggtcatctacaacagcagcggcggcttcagcagcaacaccagcgccaatgacaccctgaacaaggtgaaccacaccagcaaggccaacacagccatgatcagcaccaagggccagagccacatctgtgccacccggcagcctgcctggatcccagccctgcccagcattgagctgacccagcagctgcaggaggagtacaaggatgccaccgtgtccctgagcagcagccggcagaccctgaagggggacctgcagctgagtgatgagcagagcagcagccagatcaccggcggcatgatgcagctgctgatgaacaacccctacctggccgcccagatcatgctgttcacctccatgccccagctgtctgagcagtggaggcagcagctgcccaccttcctgcagcagacccagatcagtgacctgctgagcgcctag

SEQ ID NO: 43028 - DNA, 1146 bp, Artificial Sequence
  Description of Artificial Sequence: Synthetic coding sequence
atgaatgccctggatggagtgcccttcaagctgcccaagggctttgtgattggaacagagcccctgcccggccctgagctgtctgtgcctgcctgtggggaggtgctgctgggctccatgcatgacttcagcctggagaggacagccctcttctgggtggaggccgccggccagggccccagcccctaccagtgtggggaccccggcacagccagcgcccccccagcctggctgctgctggtgtccccagagcacggcctggccccagcccccaccaccatccgggaccctgaggccggccaccaggagaggcctgaggaggagggggaggatgaagctgaggccagcagcggcagcgaggaggagcccgcccccagcagcctgcagcccggcagccctgccagccctggccctggccggcggctgtgcagcctggatgtgctgcggggcgtgcggctggagctggccggggcccggcggcggctgtctgagggcaagctggtgtcccggccccgggccctgctgcacggcctgcggggccaccgggccctgagcctgtgccccagccctgcccagagccccaggtctgccagccccccaggccctgccccccagcaccctgctgccccagccagccccccccggcccagcacagctggggccatcccccccctgcggagccacaagcccaccgtggccagcctgagcccctacacctgcctgccccccctgggcggggccccccagcccctgaacccccacaagagccacccagacacagctgctgacctgctgagcgccctgagccaggaggagcaggacctgattggccctgtggtggccctgggctaccccctgcggcgggccatcatcgccctgcagaagacaggccggcagagcctgagccagttcctgagctacctgagcgcctgtgaccggctgctgcggcagggctatgaggagggcctggtggatgaggccatggagatgttccagttcagcgagagccaggccggggagttcctgcggctgtgggagcagttcagtgacatgggcttccagcaggaccgcatcaaggaggtgctgctggtgcacggcaacagaagagagcaggccctggaggagctggtggcctgtgcccagtag

SEQ ID NO: 43029 - DNA, 1146 bp, Artificial Sequence; identical to SEQ ID NO: 43028
  Description of Artificial Sequence: Synthetic coding sequence

SEQ ID NO: 43030 - DNA, 1746 bp, Artificial Sequence
  Description of Artificial Sequence: Synthetic coding sequence
atgatgacctctgtgtccagtgaccactgccgcggggcccgggagaagccccagatctctgctgcccagagcacccagccccagaagcaggtggtgcaggccacagctgagcagatgaggctggcccaggtgatctttgacaagaatgacagcgactttgaggccaaggtgaagcagctgatggaggtgacaggcaagaaccaggatgagtgcatcgtggccctgcatgactgcaatggagatgtgaacaaggccatcaacatcctgctggagggcaacagcgacaccacctcctgggagaccgtgggctgcaagaagaagaactttgccaaggagaacagcgagaacaaggagaaccgggagaagaagaagcacactggagacctgaccagcagccccctgagccagctgagcagcagcctgagcagccaccagagcagcctgagcgcccacgccgccctgagcagcagcaccagccacacccacgcctctgtggagagcgccagcagccaccagagcagcgccaccttcagcacagctgccacctctgtgagcagcagcgccagcagcggggccagcctgagcagctccatgaacacagccaacagcctgtgcctgggcggcaccccagccagcgccagcagcagcagcagccgggccgcccccctggtgaccagcggcaaggccccacccaacctgccccagggcgtgccccccctgctgcacaaccagtacctggtgggccctgggggcctgctgcctgcctaccccatctacggctatgatgagctgcagatgctgcagagccggctgcctgtggactactacggcatcccctttgctgcccccacagccctggccagcagagatggcagcctggccaacaacccctacccaggagatgtgaccaagtttggccgcggggacagcgccagccctgccccagccaccaccagcagcgccacagctgagcccatcacagatcctccccacagccctgctgccctgcgggagagctgcacagccacctggagctacacaggcctgccctactacacaggcatgcccagcgccttccagtatggccccaccatgtttgtgcccccagccagcgccaagcagcacggcgtgaacctgagcacccccaccccacccttccagcaggccagcggctacggccagcacggctacagcacaggctatgatgacctgacccagggcacagctgctggggactacagcaaaggaggctacgccggcagcagccaggcccccaacaagtctgctggcagcggccctggaaaaggagtgtctgtgagcagcagcaccaccggcctgcctgacatgacaggctctgtgtacaacaagacccagacctttgacaagcagggcttccacgccggcaccccaccacccttcagcctgcccagcgtgctgggcagcacaggccccctggccagcggggccgcccctggctacgcccccccacccttcctgcacatcctgcctgcccaccagcagccccacagccagctgctgcaccaccacctgccccaggatgcccagagcggcagcggccagaggagccctgccccctgcagccccagcctgaagccacccaacctgcccaccctgagcatcctggacaagctgaaccctgaggagcggggcggcctgggccagggcctgtcctgggccggggagaacacccgggcccgcatctgggagcccagcgccctgtcctag

SEQ ID NO: 43031 - DNA, 3360 bp, Artificial Sequence
  Description of Artificial Sequence: Synthetic coding sequence
atgatgacctctgtgtccagtgaccactgccgcggggcccgggagaagccccagatctctgctgcccagagcacccagccccagaagcaggtggtgcaggccacagctgagcagatgaggctggcccaggtgatctttgacaagaatgacagcgactttgaggccaaggtgaagcagctgatggaggtgacaggcaagaaccaggatgagtgcatcgtggccctgcatgactgcaatggagatgtgaacaaggccatcaacatcctgctggagggcaacagcgacaccacctcctgggagaccgtgggctgcaagaagaagaactttgccaaggagaacagcgagaacaaggagaaccgggagaagaagtctgagaaggagagcagccggggccggggcaacaacaacaggaagggccggggcggcaacagaggccgggagttccggggggaggagaatggaattgactgcaaccaggtggacaagcccagcgaccggggcaagagggcccggggccggggcttcggccggggccggggcagaggagctggccgcttcagcacccagggcatgggcaccttcaacccagctgactacagcgacagcaccagcacagatgtgtgtggcaccaagctggtggtgtgggaggccgcccagaatggagcagatgagggcacagagctggccagcaacacccacaacatcgcccaggacctgagcaacaagagcagctatggcctgaagggggcctggaagaacagcgtggaggagtggaccacagaggactggacagaggacctgtctgagaccaaggtgttcaccgccagcagcgccccagctgagaaccacatcctgcccggccagagcattgacctggtggccctgctgcagaagcctgtgccccacagccaggccagcgaggccaacagctttgagaccagccagcagcagggcttcggccaggccctggtgttcaccaacagccagcacaacaaccagatggcccctggcaccggcagcagcacagctgtgaacagctgcagcccccagagcctgagctctgtgctgggcagcggctttggagagctggccccacccaagatggccaacatcaccagcagccagatcctggaccagctgaaggcccccagcctgggccagttcaccaccacccccagcacccagcagaacagcaccagccaccccaccaccaccacctcctgggacctgaagccacccaccagccagagctctgtgctgagccacctggacttcaagagccagcctgagcccagccctgtgctgagccagctgagccagaggcagcagcaccagagccaggccgtgacagtgcccccacctggcctggagagcttccccagccaggccaagctgcgggagagcacccctggggacagccccagcacagtgaacaagctgctgcagctgcccagcaccaccatcgagaacatctctgtgtctgtgcaccagccccagcccaagcacatcaagctggccaagaggcgcatccccccagccagcaagatcccagccagcgctgtggagatgcctggcagcgcagatgtgacaggcctgaatgtgcagtttggagccctggagtttggaagtgagcccagcctgtctgaatttggcagcgcccccagcagcgagaacagcaaccagatccccatcagcctgtacagcaagagcctgtctgagcccctgaacaccagcctgtccatgaccagcgctgtgcagaacagcacctacaccaccagcgtcatcaccagctgcagcctgaccagcagcagcctgaacagcgccagccctgtggccatgagcagcagctatgaccagagctctgtgcacaaccgcatcccctaccagagccctgtgagcagcagcgagagcgcccctggcaccatcatgaatggccacggcggcggccgcagccagcagaccctggacacccccaagaccactggacctccttctgccctgcccagcgtgagcagcctgcccagcaccaccagctgcacagccctgctgcccagcaccagccagcacactggagacctgaccagcagccccctgagccagctgagcagcagcctgagcagccaccagagcagcctgagcgcccacgccgccctgagcagcagcaccagccacacccacgcctctgtggagagcgccagcagccaccagagcagcgccaccttcagcacagctgccacctctgtgagcagcagcgccagcagcggggccagcctgagcagctccatgaacacagccaacagcctgtgcctgggcggcaccccagccagcgccagcagcagcagcagccgggccgcccccctggtgaccagcggcaaggccccacccaacctgccccagggcgtgccccccctgctgcacaaccagtacctggtgggccctgggggcctgctgcctgcctaccccatctacggctatgatgagctgcagatgctgcagagccggctgcctgtggactactacggcatcccctttgctgcccccacagccctggccagcagagatggcagcctggccaacaacccctacccaggagatgtgaccaagtttggccgcggggacagcgccagccctgccccagccaccaccccagcccagccccagcagagccagagccagacccaccacacagcccagcagccctttgtgaacccagccctgcccccaggctacagctacacaggcctgccctactacacaggcatgcccagcgccttccagtatggccccaccatgtttgtgcccccagccagcgccaagcagcacggcgtgaacctgagcacccccaccccacccttccagcaggccagcggctacggccagcacggctacagcacaggctatgatgacctgacccagggcacagctgctggggactacagcaaaggaggctacgccggcagcagccaggcccccaacaagtctgctggcagcggccctggaaaaggagtgtctgtgagcagcagcaccaccggcctgcctgacatgacaggctctgtgtacaacaagacccagacctttgacaagcagggcttccacgccggcaccccaccacccttcagcctgcccagcgtgctgggcagcacaggccccctggccagcggggccgcccctggctacgcccccccacccttcctgcacatcctgcctgcccaccagcagccccacagccagctgctgcaccaccacctgccccaggatgcccagagcggcagcggccagaggagccagcccagcagcctgcagcccaagagccaggccagcaagccagcctacggcaacagcccctactggaccaactag

SEQ ID NO: 43032 - DNA, 978 bp, Artificial Sequence
  Description of Artificial Sequence: Synthetic coding sequence
atggccaacatcaccagcagccagatcctggaccagctgaaggcccccagcctgggccagttcaccaccacccccagcacccagcagaacagcaccagccaccccaccaccaccacctcctgggacctgaagccacccaccagccagagctctgtgctgagccacctggacttcaagagccagcctgagcccagccctgtgctgagccagctgagccagaggcagcagcaccagagccaggccgtgacagtgcccccacctggcctggagagcttccccagccaggccaagctgcgggagagcacccctggggacagccccagcacagtgaacaagctgctgcagctgcccagcaccaccatcgagaacatctctgtgtctgtgcaccagccccagcccaagcacatcaagctggccaagaggcgcatccccccagccagcaagatcccagccagcgctgtggagatgcctggcagcgcagatgtgacaggcctgaatgtgcagtttggagccctggagtttggcagcgagcccagcctgtctgaatttggaagtgcccccagcagcgagaacagcaaccagatccccatcagcctgtacagcaagagcctgtctgagcccctgaacaccagcctgtccatgaccagcgctgtgcagaacagcacctacaccaccagcgtcatcaccagctgcagcctgaccagcagcagcctgaacagcgccagccctgtggccatgagcagcagctatgaccagagctctgtgcacaaccgcatcccctaccagagccctgtgagcagcagcgagagcgcccctggcaccatcatgaatggacatggaggcggccgcagccagcagaccctggacagcaagtacagcagcaagctgctgctgtcctggctggtgcccaccaagcagaggaagagaattgcccacgtgatgtggaagacccctgtgggccagtggctgatcagatag

SEQ ID NO: 43033 - DNA, 1077 bp, Artificial Sequence
  Description of Artificial Sequence: Synthetic coding sequence
atgaacacagccaacagcctgtgcctgggcggcaccccagccagcgccagcagcagcagcagcagagctgcccccctggtgaccagcggcaaggccccacccaacctgccccagggcgtgccccccctgctgcacaaccagtacctggtgggccctgggggcctgctgcctgcctaccccatctacggctatgatgagctgcagatgctgcagagccggctgcctgtggactactacggcatcccctttgctgcccccacagccctggccagcagagatggcagcctggccaacaacccctacccaggagatgtgaccaagtttggccgcggggacagcgccagccctgccccagccaccaccccagcccagccccagcagagccagagccagacccaccacacagcccagcagccctttgtgaacccagccctgcccccaggctacagctacacaggcctgccctactacacaggcatgcccagcgccttccagtatggccccaccatgtttgtgcccccagccagcgccaagcagcacggcgtgaacctgagcacccccaccccacccttccagcaggccagcggctacggccagcacggctacagcacaggctatgatgacctgacccagggcacagctgctggggactacagcaagggcggctacgccggcagcagccaggcccccaacaagtctgctggcagcggccctgggaagggcgtgtctgtgagcagcagcaccaccggcctgcctgacatgactggatctgtgtacaacaagacccagacctttgacaagcagggcttccacgccggcaccccaccacccttcagcctgcccagcgtgctgggcagcacaggccccctggccagcggggccgcccctggctacgcccccccacccttcctgcacatcctgcctgcccaccagcagccccacagccagctgctgcaccaccacctgccccaggatgcccagagcggcagcggccagaggagccagcccagcagcctgcagcccaagagccaggccagcaagccagcctacggcaacagcccctactggaccaactag

SEQ ID NO: 43034 - DNA, 3360 bp, Artificial Sequence; identical to SEQ ID NO: 43031
  Description of Artificial Sequence: Synthetic coding sequence

SEQ ID NO: 43035 - DNA, 2559 bp, Artificial Sequence
  Description of Artificial Sequence: Synthetic coding sequence
atggacagcaagggcctgggccgcatcctgtggaagagcggccagcagaagacaggcctgaagatcatcgacctggtggccctgctgcagaagcctgtgccccacagccaggccagcgaggccaacagctttgagaccagccagcagcagggcttcggccaggccctggtgttcaccaacagccagcacaacaaccagatggcccctggcaccggcagcagcacagctgtgaacagctgcagcccccagagcctgagctctgtgctgggcagcggctttggagagctggccccacccaagatggccaacatcaccagcagccagatcctggaccagctgaaggcccccagcctgggccagttcaccaccacccccagcacccagcagaacagcaccagccaccccaccaccaccacctcctgggacctgaagccacccaccagccagagctctgtgctgagccacctggacttcaagagccagcctgagcccagccctgtgctgagccagctgagccagaggcagcagcaccagagccaggccgtgacagtgcccccacctggcctggagagcttccccagccaggccaagctgcgggagagcacccctggggacagccccagcacagtgaacaagctgctgcagctgcccagcaccaccatcgagaacatctctgtgtctgtgcaccagccccagcccaagcacatcaagctggccaagaggcgcatccccccagccagcaagatcccagccagcgctgtggagatgcctggcagcgcagatgtgacaggcctgaatgtgcagtttggagccctggagtttggcagcgagcccagcctgtctgaatttggaagtgcccccagcagcgagaacagcaaccagatccccatcagcctgtacagcaagagcctgtctgagcccctgaacaccagcctgtccatgaccagcgctgtgcagaacagcacctacaccaccagcgtcatcaccagctgcagcctgaccagcagcagcctgaacagcgccagccctgtggccatgagcagcagctatgaccagagctctgtgcacaaccgcatcccctaccagagccctgtgagcagcagcgagagcgcccctggcaccatcatgaatggacatggaggcggccgcagccagcagaccctggacacccccaagaccaccggcccccccagcgccctgcccagcgtgagcagcctgcccagcaccaccagctgcacagccctgctgcccagcaccagccagcacactggagacctgaccagcagccccctgagccagctgagcagcagcctgagcagccaccagagcagcctgagcgcccatgctgccctgagcagcagcaccagccacacccacgcctctgtggagagcgccagcagccaccagagcagcgccaccttcagcacagctgccacctctgtgagcagcagcgccagcagcggggccagcctgagcagctccatgaacacagccaacagcctgtgcctgggcggcaccccagccagcgccagcagcagcagcagcagagctgcccccctggtgaccagcggcaaggccccacccaacctgccccagggcgtgccccccctgctgcacaaccagtacctggtgggccctgggggcctgctgcctgcctaccccatctacggctatgatgagctgcagatgctgcagagccggctgcctgtggactactacggcatcccctttgctgcccccacagccctggccagcagagatggcagcctggccaacaacccctacccaggagatgtgaccaagtttggccgcggggacagcgccagccctgccccagccaccaccccagcccagccccagcagagccagagccagacccaccacacagcccagcagccctttgtgaacccagccctgcccccaggctacagctacacaggcctgccctactacacaggcatgcccagcgccttccagtatggccccaccatgtttgtgcccccagccagcgccaagcagcacggcgtgaacctgagcacccccaccccacccttccagcaggccagcggctacggccagcacggctacagcacaggctatgatgacctgacccagggcacagctgctggggactacagcaagggcggctacgccggcagcagccaggcccccaacaagtctgctggcagcggccctgggaagggcgtgtctgtgagcagcagcaccaccggcctgcctgacatgactggatctgtgtacaacaagacccagacctttgacaagcagggcttccacgccggcaccccaccacccttcagcctgcccagcgtgctgggcagcacaggccccctggccagcggggccgcccctggctacgcccccccacccttcctgcacatcctgcctgcccaccagcagccccacagccagctgctgcaccaccacctgccccaggatgcccagagcggcagcggccagaggagccagcccagcagcctgcagcccaagagccaggccagcaagccagcctacggcaacagcccctactggaccaactag

SEQ ID NO: 43036 - DNA, 1023 bp, Artificial Sequence
  Description of Artificial Sequence: Synthetic coding sequence
atggaggtgacaggcaagaaccaggatgagtgcatcgtggccctgcatgactgcaatggagatgtgaacaaggccatcaacatcctgctggagggcaacagcgacaccacctcctgggagaccgtgggctgcaagaagaagaactttgccaaggagaacagcgagaacaaggagaaccgggagaagaagtctgagaaggagagcagccggggccggggcaacaacaacaggaagggccggggcggcaacagaggccgggagttccggggggaggagaatggaattgactgcaaccaggtggacaagcccagcgaccggggcaagagggcccggggccggggcttcggccggggccggggcagaggagctggccgcttcagcacccagggcatgggcaccttcaacccagctgactacagcgacagcaccagcacagatgtgtgtggcaccaagctggtggtgtgggaggccgcccagaatggagcagatgagggcaccggggcctggaagaacagcgtggaggagtggaccacagaggactggacagaggacctgtctgagaccaaggtgttcaccgccagcagcgccccagctgagaaccacatcctgcccggccagagcattgacctggtggccctgctgcagaagcctgtgccccacagccaggccagcgaggccaacagctttgagaccagccagcagcagggcttcggccaggccctggtgttcaccaacagccagcacaacaaccagatggcccctggcaccggcagcagcacagctgtgaacagctgcagcccccagagcctgagctctgtgctgggcagcggctttggagagctggccccacccaagatggccaacatcaccagcagccagatcctggaccagctgaaggcccccagcctgggccagttcaccaccacccccagcacccagcagaacagcaccagccaccccaccaccaccacctcctgggacctgaagccacccaccagccagagctctgtgctgagccactag

SEQ ID NO: 43037 - DNA, 1239 bp, Artificial Sequence
  Description of Artificial Sequence: Synthetic coding sequence
atgatgacctctgtgtccagtgaccactgccgcggggcccgggagaagccccagatctctgctgcccagagcacccagccccagaagcaggtggtgcaggccacagctgagcagatgaggctggcccaggtgatctttgacaagaatgacagcgactttgaggccaaggtgaagcagctgatggaggtgacaggcaagaaccaggatgagtgcatcgtggccctgcatgactgcaatggagatgtgaacaaggccatcaacatcctgctggagggcaacagcgacaccacctcctgggagaccgtgggctgcaagaagaagaactttgccaaggagaacagcgagaacaaggagaaccgggagaagaagtctgagaaggagagcagccggggccggggcaacaacaacaggaagggccggggcggcaacagaggccgggagttccggggggaggagaatggaattgactgcaaccaggtggacaagcccagcgaccggggcaagagggcccggggccgggagctggccagcaacacccacaacatcgcccaggacctgagcaacaagagcagctatggcctgaagggggcctggaagaacagcgtggaggagtggaccacagaggactggacagaggacctgtctgagaccaaggtgttcaccgccagcagcgccccagctgagaaccacatcctgcccggccagagcattgacctggtggccctgctgcagaagcctgtgccccacagccaggccagcgaggccaacagctttgagaccagccagcagcagggcttcggccaggccctggtgttcaccaacagccagcacaacaaccagatggcccctggcaccggcagcagcacagctgtgaacagctgcagcccccagagcctgagctctgtgctgggcagcggctttggagagctggccccacccaagatggccaacatcaccagcagccagatcctggaccagctgaaggcccccagcctgggccagttcaccaccacccccagcacccagcagaacagcaccagccaccccaccaccaccacctcctgggacctgaagccacccaccagccagagctctgtgctgagccacctggacttcaagagccagcctgagcccagccctgtgctgagccagctgagccagaggcagcagcaccagagccaggccgtgacagtgcccccacctggcctggagagcttccccagccaggccaagctgtag

SEQ ID NO: 43038 - DNA, 2061 bp, Artificial Sequence
  Description of Artificial Sequence: Synthetic coding sequence
atgatgacctctgtgtccagtgaccactgccgcggggcccgggagaagccccagatctctgctgcccagagcacccagccccagaagcaggtggtgcaggccacagctgagcagatgaggctggcccaggtgatctttgacaagaatgacagcgactttgaggccaaggtgaagcagctgatggaggtgacaggcaagaaccaggatgagtgcatcgtggccctgcatgactgcaatggagatgtgaacaaggccatcaacatcctgctggagggcaacagcgacaccacctcctgggagaccgtgggctgcaagaagaagaactttgccaaggagaacagcgagaacaaggagaaccgggagaagaagtctgagaaggagagcagccggggccggggcaacaacaacaggaagggccggggcggcaacagaggccgggagttccggggggaggagaatggaattgactgcaaccaggtggacaagcccagcgaccggggcaagagggcccggggccgggagctggccagcaacacccacaacatcgcccaggacctgagcaacaagagcagctatggcctgaagggggcctggaagaacagcgtggaggagtggaccacagaggactggacagaggacctgtctgagaccaaggtgttcaccgccagcagcgccccagctgagaaccacatcctgcccggccagagcattgacctggtggccctgctgcagaagcctgtgccccacagccaggccagcgaggccaacagctttgagaccagccagcagcagggcttcggccaggccctggtgttcaccaacagccagcacaacaaccagatggcccctggcaccggcagcagcacagctgtgaacagctgcagcccccagagcctgagctctgtgctgggcagcggctttggagagctggccccacccaagatggccaacatcaccagcagccagatcctggaccagctgaaggcccccagcctgggccagttcaccaccacccccagcacccagcagaacagcaccagccaccccaccaccaccacctcctgggacctgaagccacccaccagccagagctctgtgctgagccacctggacttcaagagccagcctgagcccagccctgtgctgagccagctgagccagaggcagcagcaccagagccaggccgtgacagtgcccccacctggcctggagagcttccccagccaggccaagctgcgggagagcacccctggggacagccccagcacagtgaacaagctgctgcagctgcccagcaccaccatcgagaacatctctgtgtctgtgcaccagccccagcccaagcacatcaagctggccaagaggcgcatccccccagccagcaagatcccagccagcgctgtggagatgcctggcagcgcagatgtgacaggcctgaatgtgcagtttggagccctggagtttggcagcgagcccagcctgtctgaatttggaagtgcccccagcagcgagaacagcaaccagatccccatcagcctgtacagcaagagcctgtctgagcccctgaacaccagcctgtccatgaccagcgctgtgcagaacagcacctacaccaccagcgtcatcaccagctgcagcctgaccagcagcagcctgaacagcgccagccctgtggccatgagcagcagctatgaccagagctctgtgcacaaccgcatcccctaccagagccctgtgagcagcagcgagagcgcccctggcaccatcatgaatggacatggaggcggccgcagccagcagaccctggacacccccaagaccaccggcccccccagcgccctgcccagcgtgagcagcctgcccagcaccaccagctgcacagccctgctgcccagcaccagccagcacactggagacctgaccagcagccccctgagccagctgagctccatgcctgtgtggagggcccccctgcccaccagcccccagccccccagcccccggcagaggcctcccagccaggtgccccacccccaggccccagcctgccctgtggcctag

SEQ ID NO: 43039 - DNA, 831 bp, Artificial Sequence
  Description of Artificial Sequence: Synthetic coding sequence
gagaaggagagcagccggggccggggcaacaacaacaggaagggccggggcggcaacagaggccgggagttccggggggaggagaatggaattgactgcaaccaggtggacaagcccagcgaccggggcaagagggcccggggccggggcttcggccggggccggggcagaggagctggccgcttcagcacccagggcatgggcaccttcaacccagctgactacagcgacagcaccagcacagatgtgtgtggcaccaagctggtggtgtgggaggccgcccagaatggagcagatgagggcaccggggcctggaagaacagcgtggaggagtggaccacagaggactggacagaggacctgtctgagaccaaggtgttcaccgccagcagcgccccagctgagaaccacatcctgcccggccagagcattgacctggtggccctgctgcagaagcctgtgccccacagccaggccagcgaggccaacagctttgagaccagccagcagcagggcttcggccaggccctggtgttcaccaacagccagcacaacaaccagatggcccctggcaccggcagcagcacagctgtgaacagctgcagcccccagagcctgagctctgtgctgggcagcggctttggagagctggccccacccaagatggccaacatcaccagcagccagatcctggaccagctgaaggcccccagcctgggccagttcaccaccacccccagcacccagcagaacagcaccagccaccccaccaccaccacctcctgggacctgaagccacccaccagccagagctctgtgctgagccactag

SEQ ID NO: 43040 - DNA, 3087 bp, Artificial Sequence
  Description of Artificial Sequence: Synthetic coding sequence
atgaggctggcccaggtgatctttgacaagaatgacagcgactttgaggccaaggtgaagcagctgatggaggtgacaggcaagaaccaggatgagtgcatcgtggccctgcatgactgcaatggagatgtgaacaaggccatcaacatcctgctggagggcaacagcgacaccacctcctgggagaccgtgggctgcaagaagaagaactttgccaaggagaacagcgagaacaaggagaaccgggagaagaagtctgagaaggagagcagccggggccggggcaacaacaacaggaagggccggggcggcaacagaggccgggagttccggggggaggagaatggaattgactgcaaccaggtggacaagcccagcgaccggggcaagagggcccggggccgggagctggccagcaacacccacaacatcgcccaggacctgagcaacaagagcagctatggcctgaagggggcctggaagaacagcgtggaggagtggaccacagaggactggacagaggacctgtctgagaccaaggtgttcaccgccagcagcgccccagctgagaaccacatcctgcccggccagagcattgacctggtggccctgctgcagaagcctgtgccccacagccaggccagcgaggccaacagctttgagaccagccagcagcagggcttcggccaggccctggtgttcaccaacagccagcacaacaaccagatggcccctggcaccggcagcagcacagctgtgaacagctgcagcccccagagcctgagctctgtgctgggcagcggctttggagagctggccccacccaagatggccaacatcaccagcagccagatcctggaccagctgaaggcccccagcctgggccagttcaccaccacccccagcacccagcagaacagcaccagccaccccaccaccaccacctcctgggacctgaagccacccaccagccagagctctgtgctgagccacctggacttcaagagccagcctgagcccagccctgtgctgagccagctgagccagaggcagcagcaccagagccaggccgtgacagtgcccccacctggcctggagagcttccccagccaggccaagctgcgggagagcacccctggggacagccccagcacagtgaacaagctgctgcagctgcccagcaccaccatcgagaacatctctgtgtctgtgcaccagccccagcccaagcacatcaagctggccaagaggcgcatccccccagccagcaagatcccagccagcgctgtggagatgcctggcagcgcagatgtgacaggcctgaatgtgcagtttggagccctggagtttggcagcgagcccagcctgtctgaatttggaagtgcccccagcagcgagaacagcaaccagatccccatcagcctgtacagcaagagcctgtctgagcccctgaacaccagcctgtccatgaccagcgctgtgcagaacagcacctacaccaccagcgtcatcaccagctgcagcctgaccagcagcagcctgaacagcgccagccctgtggccatgagcagcagctatgaccagagctctgtgcacaaccgcatcccctaccagagccctgtgagcagcagcgagagcgcccctggcaccatcatgaatggacatggaggcggccgcagccagcagaccctggacacccccaagaccaccggcccccccagcgccctgcccagcgtgagcagcctgcccagcaccaccagctgcacagccctgctgcccagcaccagccagcacactggagacctgaccagcagccccctgagccagctgagcagcagcctgagcagccaccagagcagcctgagcgcccatgctgccctgagcagcagcaccagccacacccacgcctctgtggagagcgccagcagccaccagagcagcgccaccttcagcacagctgccacctctgtgagcagcagcgccagcagcggggccagcctgagcagctccatgaacacagccaacagcctgtgcctgggcggcaccccagccagcgccagcagcagcagcagcagagctgcccccctggtgaccagcggcaaggccccacccaacctgccccagggcgtgccccccctgctgcacaaccagtacctggtgggccctgggggcctgctgcctgcctaccccatctacggctatgatgagctgcagatgctgcagagccggctgcctgtggactactacggcatcccctttgctgcccccacagccctggccagcagagatggcagcctggccaacaacccctacccaggagatgtgaccaagtttggccgcggggacagcgccagccctgccccagccaccaccccagcccagccccagcagagccagagccagacccaccacacagcccagcagccctttgtgaacccagccctgcccccaggctacagctacacaggcctgccctactacacaggcatgcccagcgccttccagtatggccccaccatgtttgtgcccccagccagcgccaagcagcacggcgtgaacctgagcacccccaccccacccttccagcaggccagcggctacggccagcacggctacagcacaggctatgatgacctgacccagggcacagctgctggggactacagcaagggcggctacgccggcagcagccaggcccccaacaagtctgctggcagcggccctgggaagggcgtgtctgtgagcagcagcaccaccggcctgcctgacatgactggatctgtgtacaacaagacccagacctttgacaagcagggcttccacgccggcaccccaccacccttcagcctgcccagcgtgctgggcagcacaggccccctggccagcggggccgcccctggctacgcccccccacccttcctgcacatcctgcctgcccaccagcagccccacagccagctgctgcaccaccacctgccccaggatgcccagagcggcagcggccagaggagccagcccagcagcctgcagcccaagagccaggccagcaagccagcctacggcaacagcccctactggaccaactag

SEQ ID NO: 43041 - DNA, 3360 bp, Artificial Sequence; identical to SEQ ID NO: 43031
  Description of Artificial Sequence: Synthetic coding sequence

SEQ ID NO: 43042 - DNA, 2625 bp, Artificial Sequence
  Description of Artificial Sequence: Synthetic coding sequence
atgaggctggcccaggtgatctttgacaagaatgacagcgactttgaggccaaggtgaagcagctgtctgagaccaaggtgttcaccgccagcagcgccccagctgagaaccacatcctgcccggccagagcattgacctggtggccctgctgcagaagcctgtgccccacagccaggccagcgaggccaacagctttgagaccagccagcagcagggcttcggccaggccctggtgttcaccaacagccagcacaacaaccagatggcccctggcaccggcagcagcacagctgtgaacagctgcagcccccagagcctgagctctgtgctgggcagcggctttggagagctggccccacccaagatggccaacatcaccagcagccagatcctggaccagctgaaggcccccagcctgggccagttcaccaccacccccagcacccagcagaacagcaccagccaccccaccaccaccacctcctgggacctgaagccacccaccagccagagctctgtgctgagccacctggacttcaagagccagcctgagcccagccctgtgctgagccagctgagccagaggcagcagcaccagagccaggccgtgacagtgcccccacctggcctggagagcttccccagccaggccaagctgcgggagagcacccctggggacagccccagcacagtgaacaagctgctgcagctgcccagcaccaccatcgagaacatctctgtgtctgtgcaccagccccagcccaagcacatcaagctggccaagaggcgcatccccccagccagcaagatcccagccagcgctgtggagatgcctggcagcgcagatgtgacaggcctgaatgtgcagtttggagccctggagtttggcagcgagcccagcctgtctgaatttggaagtgcccccagcagcgagaacagcaaccagatccccatcagcctgtacagcaagagcctgtctgagcccctgaacaccagcctgtccatgaccagcgctgtgcagaacagcacctacaccaccagcgtcatcaccagctgcagcctgaccagcagcagcctgaacagcgccagccctgtggccatgagcagcagctatgaccagagctctgtgcacaaccgcatcccctaccagagccctgtgagcagcagcgagagcgcccctggcaccatcatgaatggacatggaggcggccgcagccagcagaccctggacacccccaagaccaccggcccccccagcgccctgcccagcgtgagcagcctgcccagcaccaccagctgcacagccctgctgcccagcaccagccagcacactggagacctgaccagcagccccctgagccagctgagcagcagcctgagcagccaccagagcagcctgagcgcccatgctgccctgagcagcagcaccagccacacccacgcctctgtggagagcgccagcagccaccagagcagcgccaccttcagcacagctgccacctctgtgagcagcagcgccagcagcggggccagcctgagcagctccatgaacacagccaacagcctgtgcctgggcggcaccccagccagcgccagcagcagcagcagcagagctgcccccctggtgaccagcggcaaggccccacccaacctgccccagggcgtgccccccctgctgcacaaccagtacctggtgggccctgggggcctgctgcctgcctaccccatctacggctatgatgagctgcagatgctgcagagccggctgcctgtggactactacggcatcccctttgctgcccccacagccctggccagcagagatggcagcctggccaacaacccctacccaggagatgtgaccaagtttggccgcggggacagcgccagccctgccccagccaccaccccagcccagccccagcagagccagagccagacccaccacacagcccagcagccctttgtgaacccagccctgcccccaggctacagctacacaggcctgccctactacacaggcatgcccagcgccttccagtatggccccaccatgtttgtgcccccagccagcgccaagcagcacggcgtgaacctgagcacccccaccccacccttccagcaggccagcggctacggccagcacggctacagcacaggctatgatgacctgacccagggcacagctgctggggactacagcaagggcggctacgccggcagcagccaggcccccaacaagtctgctggcagcggccctgggaagggcgtgtctgtgagcagcagcaccaccggcctgcctgacatgactggatctgtgtacaacaagacccagacctttgacaagcagggcttccacgccggcaccccaccacccttcagcctgcccagcgtgctgggcagcacaggccccctggccagcggggccgcccctggctacgcccccccacccttcctgcacatcctgcctgcccaccagcagccccacagccagctgctgcaccaccacctgccccaggatgcccagagcggcagcggccagaggagccagcccagcagcctgcagcccaagagccaggccagcaagccagcctacggcaacagcccctactggaccaactag

SEQ ID NO: 43043 - DNA, 1593 bp, Artificial Sequence
  Description of Artificial Sequence: Synthetic coding sequence
atggaggatgacagcctgtacctgggcggggagtggcagttcaaccacttcagcaagctgaccagcagcaggccagatgctgcctttgctgagatccagaggaccagcctgcctgagaagagccccctgagctgtgagaccagggtggacctgtgtgatgacctggcccctgtggcccggcagctggccccccgggagaagctgcccctgagcagcagaagacctgctgctgtgggcgccggcctgcagaacatgggcaacacctgctacgtgaatgccagcctgcagtgcctgacctacaccccacccctggccaactacatgctgagccgggagcacagccagacctgccaccgccacaagggctgcatgctgtgcaccatgcaggcccacatcacccgggccctgcacaaccctggccacgtgatccagcccagccaggccctggccgccggcttccaccggggcaagcaggaggatgcccacgagttcctgatgttcaccgtggatgccatgaagaaggcctgcctgcccggccacaagcaggtggaccaccccagcaaggacaccaccctcatccaccagatctttggaggctactggaggagccagatcaagtgcctgcactgccacggcatcagtgacacctttgacccctacctggacatcgccctggacatccaggccgcccagagcgtgcagcaggccctggagcagctggtgaagccagaggagctgaatggagaaaatgcctaccactgcggcgtgtgcctgcagagggccccagccagcaagaccctgaccctgcacaccagcgccaaggtgctgatcctggtgctgaagcgcttcagtgatgtgactggaaacaagatcgccaagaatgtgcagtacccagaatgtctggacatgcagccctacatgagccagcagaacacaggccccctggtgtatgtgctgtatgctgtgctggtgcacgccggctggagctgccacaacggccactacttctcctatgtgaaggcccaggagggccagtggtacaagatggatgatgctgaggtgacagctgccagcatcacctctgtgctgagccagcaggcctacgtgctcttctacatccagaagtctgagtgggagcggcacagcgagagcgtgtcccggggccgggagccccgggccctgggcgctgaggacacagacagaagagccacccagggcgagctgaagagggaccacccctgcctgcaggcccctgagctggatgagcacctggtggagcgggccacccaggagagcaccctggaccgctggaagttcctgcaggagcagaacaagaccaagccagagttcaacgtgaggaaggtggagggcaccctgcccccagatgtgctggtgatccaccagagcaagtacaagtgtggcatgaagaaccaccaccctgagcagcagagcagcctgctgaacctgagcagcagcacccccacccaccaggagagcatgaacacaggcaccctggccagcctgcggggccgggcccggcgcagcaagggcaagaacaagcacagcaagagggccctgctggtgtgccagtag

SEQ ID NO: 43044 - DNA, 684 bp, Artificial Sequence
  Description of Artificial Sequence: Synthetic coding sequence
atgggcaactgtgtgggccggcagaggcgggagaggcctgctgcccctggccaccccaggaagagagctggaagaaatgagcccctgaagaaggagcggctgaagtggaagagtgactaccccatgacagatggccagctgcggagcaagagagatgagttctgggacacagccccagcctttgagggcaggaaggagatctgggatgccctgaaggccgccgcctatgctgctgaggccaatgaccacgagctggcccaggccatcctggatggagccagcatcaccctgccccacggcaccctgtgtgagtgctatgatgagctgggcaaccgctaccagctgcccatctactgcctgagcccccctgtgaacctgctgctggagcacacagaggaggagagcctggagcccccagagcccccacccagcgtgcggcgggagttccccctgaaggtgcggctgagcacaggcaaggatgtgcggctgagcgccagcctgcctgacacagtgggccagctgaagaggcagctgcacgcccaggagggcatcgagcccagctggcagcgctggttcttcagcggcaagctgctgacagacaggacccggctgcaggagaccaagatccagaaggactttgtgatccaggtgatcatcaaccagcccccaccaccccaggactag

SEQ ID NO: 43045 - DNA, 3261 bp, Artificial Sequence
  Description of Artificial Sequence: Synthetic coding sequence
atggccaccgtgggggagtggagctgtgtgcgctgcaccttcctgaacccagctggccagaggcagtgcagcatctgtgaggcccccaggcacaagccagacctgaaccacatcctgcggctgtctgtggaggagcagaagtggccctgtgcccgctgcaccttcaggaacttcctgggcaaggaggcctgtgaggtgtgtggcttcaccccagagcccgcccctggagctgccttcctgcctgtgctgaatggagtgctgcccaagcccccagccatcctgggggagcccaagggcagctgccaggaggaggccggccctgtgaggacagctggcctggtggccacagagcccgcccggggccagtgtgaggacaaggatgaggaggagaaggaggagcaggaggaggaggagggcgctgctgagccccggggcggctgggcctgcccccgctgcaccctgcacaacacccctgtggccagcagctgcagcgtgtgtggcggcccccggcggctgagcctgccccgcatccccccagaggccctggtggtgcctgaggtggtggccccagctggcttccacgtggtgcctgctgcccctcctcctggcctgcctggagagggcgctgaggccaaccccccagccaccagccagggccctgctgctgagcctgagcccccccgggtgccccccttcagccccttcagcagcaccctgcagaacaaccctgtgcccaggagccggcgggaggtgcccccccagctgcagccccctgtgcctgaggccgcccagcccagccccagcgctggctgccgcggggccccccagggcagcggctgggccggggccagccggctggccgagctgctgagcggcaagaggctgtctgtgctggaggaggaggccacagaaggaggcaccagccgggtggaggccggcagcagcaccagcggcagtgacatcatcgacctggccggggacacagtgcgctacaccccagccagccccagcagcccagacttcaccacctggagctgtgccaagtgcaccctgaggaaccccaccgtggccccccgctgcagcgcctgtggctgcagcaagctgcacggcttccaggagcacggggagccccccacccactgcccagactgtggggctgacaagcccagcccctgtggccgcagctgtggccgggtgtcctctgcccagaaggccgcccgggtgctgcctgagaggcctggccagtgggcctgcccagcctgcaccctgctgaatgccctgcgggccaagcactgtgccgcctgccacaccccccagctgctggtggcccagaggagaggagctgcccccctgcggcggcgggagagcatgcacgtggagcagaggcggcagacagatgaaggagaggccaaggccctgtgggagaacatcgtggccttctgcagagaaaataatgtgtcctttgtggatgacagcttccccccaggccctgagagcgtgggcttccctgctggggacagcgtgcagcagagggtgcggcagtggctgcggccccaggagatcaactgcagcgtcttccgggaccaccgggccacctggagcgtcttccacaccctgcggcccagcgacatcctgcagggcctgctgggcaactgctggttcctgagcgccctggccgtgctggccgagaggccagacctggtggagcgggtgatggtgaccaggagcctgtgtgccgagggcgcctaccaggtgcggctgtgcaaggatggcacctggaccaccgtgctggtggatgacatgctgccctgtgatgaagctggctgcctgctcttcagccaggcccagaggaagcagctgtgggtggccctgattgagaaggccctggccaagctgcacggcagctactttgccctgcaggccggccgggccatcgagggcctggccaccctgaccggggccccctgtgagagcctggccctgcagctgagcagcaccaacccccgggaggagcctgtggacacagacctgatctgggccaagatgctgagcagcaaggaggccggcttcctgatgggcgccagctgtggcggcggcaacatgaaggtggatgacagcgcctatgagagcctgggcctgcggcccaggcatgcctacagcatcctggatgtgagagatgtgcagggcacccggctgctgcggctgaggaacccctggggccgcttctcctggaatggctcctggagcgatgagtggccccactggccaggccacctgcggggggagctgatgccccacggcagcagcgagggcgtcttctggatggagtatggagactttgtgcgctactttgacagcgtggacatctgcaaggtgcacagcgactggcaggaggcccgggtgcagggctgcttccccagcagcgccagcgcccctgtgggcgtgacagccctgactgtgctggagcgggccagcctggagtttgccctcttccaggagggcagccgccgcagtgatgctgtggacagccacctgctggacctgtgcatcctggtgttccgggccacctttggaagtggcggccacctgagcctgggccgcctgctggcccacagcaagagagctgtgaagaagtttgtgtcctgtgatgtgatgctggagcccggggagtatgctgtggtgtgctgtgccttcaaccactggggcccccccctgcccggcaccccagccccccaggccagcagccccagcgctggggtgccccgggccagccctgagcccccaggccacgtgctggccgtgtacagcagccggctggtgatggtggagcctgtggaggcccagcccaccaccctggctgatgccatcatcctgctgacagagagcagaggagagagacatgagggccgggagggcatgacctgctactacctgacccacggctgggccggcctcatcgtggtggtggagaacagacaccccaaggcctacctgcacgtgcagtgtgactgcacagacagcttcaacgtggtgtccacccggggcagcctgcggacccaggacagcgtgccccccctgcaccggcaggtgctggtgatcctgagccagctggagggcaatgccggcttcagcatcacccaccggctggcccacaggaaggccgcccaggccttcctgagtgactggacagccagcaagggcacccacagcccccccctgaccccagaggtggccggcctgcacggcccccggcccctgtag

SEQ ID NO: 43046 - DNA, 930 bp, Artificial Sequence
  Description of Artificial Sequence: Synthetic coding sequence
atggctgctgctggggccccagatggcatggaggagcccggcatggacacagaagctgagaccgtggccacagaggccccagcccggcctgtgaactgcctggaggccgaggccgccgccggggctgctgctgaagattctggagctgcccggggcagcctgcagcctgccccagcccagcccccaggggaccctgctgcccaggcctctgtgtccaatggagaagatgctgggggcggggccggccgggagctggtggacctgaagatcatctggaacaagaccaagcatgatgtgaagttccccctggacagcacaggcagcgagctgaagcagaagatccacagcatcaccggcctgcccccagccatgcagaaggtgatgtacaagggcctggtgcctgaggacaagaccctgcgggagatcaaggtgaccagcggggccaagatcatggtggtgggcagcaccatcaatgatgtgctggccgtgaacacccccaaggatgctgcccagcaggatgccaaggccgaggagaacaagaaggagcccctgtgccggcagaagcagcacaggaaggtgctggacaagggcaagccagaagatgtgatgcccagcgtgaagggggcccaggagcggctgcccaccgtgcccctgagcggcatgtacaacaagagcggcggcaaggtgcggctgaccttcaagctggagcaggaccagctgtggattggcaccaaggagaggacagagaagctgcccatgggcagcatcaagaatgtggtgtctgagcccatcgagggccacgaggactaccacatgatggccttccagctgggccccacagaggccagctactactgggtgtactgggtgcccacccagtatgtggatgccatcaaggacacagtgctgggcaagtggcagtacttctag

SEQ ID NO: 43047 - DNA, 561 bp, Artificial Sequence
  Description of Artificial Sequence: Synthetic coding sequence
atgcagaaggtgatgtacaagggcctggtgcctgaggacaagaccctgcgggagatcaaggtgaccagcggggccaagatcatggtggtgggcagcaccatcaatgatgtgctggccgtgaacacccccaaggatgctgcccagcaggatgccaaggccgaggagaacaagaaggagcccctgtgccggcagaagcagcacaggaaggtgctggacaagggcaagccagaagatgtgatgcccagcgtgaagggggcccaggagcggctgcccaccgtgcccctgagcggcatgtacaacaagagcggcggcaaggtgcggctgaccttcaagctggagcaggaccagctgtggattggcaccaaggagaggacagagaagctgcccatgggcagcatcaagaatgtggtgtctgagcccatcgagggccacgaggactaccacatgatggccttccagctgggccccacagaggccagctactactgggtgtactgggtgcccacccagtatgtggatgccatcaaggacacagtgctgggcaagtggcagtacttctag

SEQ ID NO: 43048 - DNA, 2127 bp, Artificial Sequence
  Description of Artificial Sequence: Synthetic coding sequence
atgttcaccctgagccagaccagccgggcctggttcatcgaccgggcccggcaggcccgggaggagcggctggtgcagaaggagcgggagagagctgctgtggtgatccaggcccacgtgcgctccttcctgtgccgcagccggctgcagagggacatccggcgggagattgatgacttcttcaaggcagatgatcctgagagcaccaagaggtctgccctgtgcatcttcaagatcgccaggaagctgctcttcctgttccgcatcaaggaggacaatgaaagatttgagaagctgtgccgcagcatcctgagctccatggatgctgaaaatgagcccaaggtgtggtacgtgtccctggcctgcagcaaggacctgaccctgctgtggatccagcagatcaagaacatcctgtggtactgctgtgacttcctgaagcagctgaagccagagatcctgcaggacagccgcctcatcaccctgtacctgaccatgctggtgaccttcacagacaccagcacctggaagatcctgcggggcaaaggagagagcctgcggcctgccatgaaccacatctgtgccaacatcatgggccacctgaaccagcacggcttctacagcgtgctgcagatcctgctgacccggggcctggcccggccccggccctgcctgagcaagggcaccctgacagctgccttcagcctggccctgcggcctgtgattgctgcccagttcagtgacaacctgatccggcccttcctgatccacatcatgtctgtgcctgccctggtgacccacctgagcacagtgaccccagagcggctgactgtgctggagagccatgacatgctgaggaagttcatcatcttcctgcgggaccaggaccgctgcagagatgtgtgtgagagcctggagggctgccacaccctgtgcctgatgggcaacctgctgcacctgggcagcctgagcccccgggtgctggaggaggagacagatggctttgtgtccctgctgacccagaccctgtgctactgcaggaaatatgtgtcccagaagaagagcaacctgacccactggcaccctgtgctgggctggttcagccagagcgtggactatggcctgaatgaatccatgcacctgatcaccaagcagctgcagttcctgtggggcgtgcccctcatccgcatcttcttctgtgacatcctgagcaagaagctgctggagagccaggagcccgcccacgcccagcctgccagcccccagaatgtgctgcctgtgaagagcctgctgaagagggccttccagaagagcgcctctgtgaggaacatcctgcggcctgtgggcggcaagagggtggacagcgctgaggtgcagaaggtgtgcaacatctgtgtgctgtaccagaccagcctgaccaccctgacccagatccggctgcagatcctgaccggcctgacctacctggatgacctgctgcccaagctgtgggccttcatctgtgagctgggcccccatggaggcctgaagctgttcctggagtgcctgaacaatgacacagaggagagcaagcagctgctggccatgctgatgctgttctgtgactgcagccgccacctgatcaccatcctggatgacatcgaggtgtatgaggagcagatctccttcaagctggaggagctggtgaccatcagcagcttcctgaacagctttgtgttcaagatgatctgggatggcatcgtggagaatgccaagggggagaccctggagctgttccagagcgtgcacggctggctgatggtgctgtatgaaagagactgcagaagacgcttcaccccagaggaccactggctgaggaaggacctgaagcccagcgtgctcttccaggagctggaccgggacaggaagagggcccagctgatcctgcagtacatcccccacgtgatcccccacaagaacagagtgctgctcttccgcaccatggtgaccaaggagaaggagaagctgggcctggtggagaccagcagcgccagcccccacgtgacccacatcaccatccgccgcagcaggatgctggagagcctgtttgagtgcccctggcccctggtgatcaatgctgagagctgctag

SEQ ID NO: 43049 - DNA, 735 bp, Artificial Sequence
  Description of Artificial Sequence: Synthetic coding sequence
atgttcaccctgagccagaccagccgggcctggttcatcgaccgggcccggcaggcccgggaggagcggctggtgcagaaggagcgggagagagctgctgtggtgatccaggcccacgtgcgctccttcctgtgccgcagccggctgcagagggacatccggcgggagattgatgacttcttcaaggcagatgatcctgagagcaccaagaggtctgccctgtgcatcttcaagatcgccaggaagctgctcttcctgttccgcatcaaggaggacaatgaaagatttgagaagctgtgccgcagcatcctgagctccatggatgctgaaaatgagcccaaggtgtggtacgtgtccctggcctgcagcaaggacctgaccctgctgtggatccagcagatcaagaacatcctgtggtactgctgtgacttcctgaagcagctgaagccagagatcctgcaggacagccgcctcatcaccctgtacctgaccatgctggtgaccttcacagacaccagcacctggaagatcctgcggggcaaaggagagagcctgcggcctgccatgaaccacatctgtgccaacatcatgggccacctgaaccagcacggcttctacagcgtgctgcagtgctgtgatggcctcttcccagacctggtgtcctatgccccccacaacaaccctgtgcgctggagcgtgggccgctcctggtatgactggcagctgagcaggtag

SEQ ID NO: 43050 - DNA, 3207 bp, Artificial Sequence
  Description of Artificial Sequence: Synthetic coding sequence
atgttcaccctgagccagaccagccgggcctggttcatcgaccgggcccggcaggcccgggaggagcggctggtgcagaaggagcgggagagagctgctgtggtgatccaggcccacgtgcgctccttcctgtgccgcagccggctgcagagggacatccggcgggagattgatgacttcttcaaggcagatgatcctgagagcaccaagaggtctgccctgtgcatcttcaagatcgccaggaagctgctcttcctgttccgcatcaaggaggacaatgaaagatttgagaagctgtgccgcagcatcctgagctccatggatgctgaaaatgagcccaaggtgtggtacgtgtccctggcctgcagcaaggacctgaccctgctgtggatccagcagatcaagaacatcctgtggtactgctgtgacttcctgaagcagctgaagccagagatcctgcaggacagccgcctcatcaccctgtacctgaccatgctggtgaccttcacagacaccagcacctggaagatcctgcggggcaaaggagagagcctgcggcctgccatgaaccacatctgtgccaacatcatgggccacctgaaccagcacggcttctacagcgtgctgcagatcctgctgacccggggcctggcccggccccggccctgcctgagcaagggcaccctgacagctgccttcagcctggccctgcggcctgtgattgctgcccagttcagtgacaacctgatccggcccttcctgatccacatcatgtctgtgcctgccctggtgacccacctgagcacagtgaccccagagcggctgactgtgctggagagccatgacatgctgaggaagttcatcatcttcctgcgggaccaggaccgctgcagagatgtgtgtgagagcctggagggctgccacaccctgtgcctgatgggcaacctgctgcacctgggcagcctgagcccccgggtgctggaggaggagacagatggctttgtgtccctgctgacccagaccctgtgctactgcaggaaatatgtgtcccagaagaagagcaacctgacccactggcaccctgtgctgggctggttcagccagagcgtggactatggcctgaatgaatccatgcacctgatcaccaagcagctgcagttcctgtggggcgtgcccctcatccgcatcttcttctgtgacatcctgagcaagaagctgctggagagccaggagcccgcccacgcccagcctgccagcccccagaatgtgctgcctgtgaagagcctgctgaagagggccttccagaagagcgcctctgtgaggaacatcctgcggcctgtgggcggcaagagggtggacagcgctgaggtgcagaaggtgtgcaacatctgtgtgctgtaccagaccagcctgaccaccctgacccagatccggctgcagatcctgaccggcctgacctacctggatgacctgctgcccaagctgtgggccttcatctgtgagctgggcccccatggaggcctgaagctgttcctggagtgcctgaacaatgacacagaggagagcaagcagctgctggccatgctgatgctgttctgtgactgcagccgccacctgatcaccatcctggatgacatcgaggtgtatgaggagcagatctccttcaagctggaggagctggtgaccatcagcagcttcctgaacagctttgtgttcaagatgatctgggatggcatcgtggagaatgccaagggggagaccctggagctgttccagagcgtgcacggctggctgatggtgctgtatgaaagagactgcagaagacgcttcaccccagaggaccactggctgaggaaggacctgaagcccagcgtgctcttccaggagctggaccgggacaggaagagggcccagctgatcctgcagtacatcccccacgtgatcccccacaagaacagagtgctgctcttccgcaccatggtgaccaaggagaaggagaagctgggcctggtggagaccagcagcgccagcccccacgtgacccacatcaccatccgccgcagcaggatgctggaggatggctatgagcagctgcggcagctgagccagcacgccatgaagggcgtcatccgggtgaagtttgtgaatgacctgggcgtggatgaagctggcatcgaccaggatggagtcttcaaggagttcctggaggagatcatcaagagggtgtttgatcctgccctgaacctcttcaagaccaccagcggagatgagcggctgtaccccagccccaccagctacatccacgagaactacctgcagctgtttgaatttgtgggcaagatgctgggcaaggctgtgtatgagggcatcgtggtggatgtgccctttgccagcttcttcctgagccagctgctgggccaccaccacagcgtcttctacagctctgtggatgagctgcccagcctggacagcgagttctacaagaacctgaccagcatcaagagatatgatggagacatcacagacctgggcctgaccctgtcctatgatgaagatgtgatgggccagctggtgtgccacgagctgatccctgggggcaagaccatccctgtgaccaatgaaaacaagatctcctacatccacctgatggcccacttcaggatgcacacccagatcaagaaccagacagctgccctgatcagcggcttccgcagcatcatcaagccagagtggatccgcatgttcagcaccccagagctgcagaggctcatcagcggggacaatgctgagattgacctggaggacctgaagaagcacacagtgtactatggaggcttccacggcagccacagggtcatcatctggctgtgggacatcctggccagtgacttcaccccagatgagcgggccatgttcctgaagtttgtgaccagctgcagccggccccccctgctgggctttgcctacctgaagccacccttcagcatccgctgtgtggaggtgtctgatgaccaggacacaggagacaccctgggctctgtgctgcggggcttcttcaccatcaggaagcgggagcccggcggccgcctgcccaccagcagcacctgcttcaacctgctgaagctgcccaactacagcaagaagtctgtgctgcgggagaagctgcgctatgccatctccatgaacacaggctttgagctgtcctag

SEQ ID NO: 43051 - DNA, 3207 bp, Artificial Sequence; identical to SEQ ID NO: 43050
  Description of Artificial Sequence: Synthetic coding sequence

SEQ ID NO: 43052 - DNA, 456 bp, Artificial Sequence
  Description of Artificial Sequence: Synthetic coding sequence
atgttcagcaccccagagctgcagaggctcatcagcggggacaatgctgagattgacctggaggacctgaagaagcacacagtgtactacggcggcttccacggcagccacagggtcatcatctggctgtgggacatcctggccagtgacttcaccccagatgagcgggccatgttcctgaagtttgtgaccagctgcagcaggcctcccctgctgggctttgcctacctgaagccacccttcagcatccgctgtgtggaggtgtctgatgaccagcagggccggcagctggaccccagcgagcccagcgaggagggccccaccgtgctgacagctggggagcccgccagcccccgggagacagcccacggcctgagccccctgtctgctgcccccttctccttcctgccccagggccgggtgcctggggtgggcgtgggcacctgctgcttctag

SEQ ID NO: 43053 - DNA, 735 bp, Artificial Sequence; identical to SEQ ID NO: 43049
  Description of Artificial Sequence: Synthetic coding sequence

SEQ ID NO: 43054 - DNA, 1017 bp, Artificial Sequence
  Description of Artificial Sequence: Synthetic coding sequence
atgaagggcgtcatccgggtgaagtttgtgaatgacctgggcgtggatgaggccggcatcgaccaggatggagtcttcaaggagttcctggaggagatcatcaagagggtgtttgatcctgccctgaacctcttcaagaccaccagcggagatgagcggctgtaccccagccccaccagctacatccacgagaactacctgcagctgtttgaatttgtgggcaagatgctgggcaaggctgtgtatgagggcatcgtggtggatgtgccctttgccagcttcttcctgagccagctgctgggccaccaccacagcgtcttctacagctctgtggatgagctgcccagcctggacagcgagttctacaagaacctgaccagcatcaagagatatgatggagacatcacagacctgggcctgaccctgtcctatgatgaagatgtgatgggccagctggtgtgccacgagctgatccctgggggcaagaccatccctgtgaccaatgaaaacaagatctcctacatccacctgatggcccacttcaggatgcacacccagatcaagaaccagacagctgccctgatcagcggcttccgcagcatcatcaagccagagtggatccgcatgttcagcaccccagagctgcagaggctcatcagcggggacaatgctgagattgacctggaggacctgaagaagcacacagtgtactacggcggcttccacggcagccacagggtcatcatctggctgtgggacatcctggccagtgacttcaccccagatgagcgggccatgttcctgaagtttgtgaccagctgcagcaggcctcccctgctgggctttgcctacctgaagccacccttcagcatccgctgtgtggaggtgtctgatgaccaggccgtgcacgtgcaggcccgctgcttcatcagcagcctggccaagggggagggcaagcccagcggcctgcggagctctgtgtgcctgaagccaggccccctgtgggtgctgaagtag

SEQ ID NO: 43055 - DNA, 2619 bp, Artificial Sequence
  Description of Artificial Sequence: Synthetic coding sequence
atgttcaccctgagccagaccagccgggcctggttcatcgaccgggcccggcaggcccgggaggagcggctggtgcagaaggagcgggagagagctgctgtggtgatccaggcccacgtgcgctccttcctgtgccgcagccggctgcagagggacatccggcgggagattgatgacttcttcaaggcagatgatcctgagagcaccaagaggtctgccctgtgcatcttcaagatcgccaggaagctgctcttcctgttccgcatcaaggaggacaatgaaagatttgagaagctgtgccgcagcatcctgagctccatggatgctgaaaatgagcccaaggtgtggtacgtgtccctggcctgcagcaaggacctgaccctgctgtggatccagcagatcaagaacatcctgtggtactgctgtgacttcctgaagcagctgaagccagagatcctgcaggacagccgcctcatcaccctgtacctgaccatgctggtgaccttcacagacaccagcacctggaagatcctgcggggcaaaggagagagcctgcggcctgccatgaaccacatctgtgccaacatcatgggccacctgaaccagcacggcttctacagcgtgctgcagatcctgctgacccggggcctggcccggccccggccctgcctgagcaagggcaccctgacagctgccttcagcctggccctgcggcctgtgattgctgcccagttcagtgacaacctgatccggcccttcctgatccacatcatgtctgtgcctgccctggtgacccacctgagcacagtgaccccagagcggctgactgtgctggagagccatgacatgctgaggaagttcatcatcttcctgcgggaccaggaccgctgcagagatgtgtgtgagagcctggagggctgccacaccctgtgcctgatgggcaacctgctgcacctgggcagcctgagcccccgggtgctggaggaggagacagatggctttgtgtccctgctgacccagaccctgtgctactgcaggaaatatgtgtcccagaagaagagcaacctgacccactggcaccctgtgctgggctggttcagccagagcgtggactatggcctgaatgaatccatgcacctgatcaccaagcagctgcagttcctgtggggcgtgcccctcatccgcatcttcttctgtgacatcctgagcaagaagctgctggagagccaggagcccgcccacgcccagcctgccagcccccagaatgtgctgcctgtgaagagcctgctgaagagggccttccagaagagcgcctctgtgaggaacatcctgcggcctgtgggcggcaagagggtggacagcgctgaggtgcagaaggtgtgcaacatctgtgtgctgtaccagaccagcctgaccaccctgacccagatccggctgcagatcctgaccggcctgacctacctggatgacctgctgcccaagctgtgggccttcatctgtgagctgggcccccatggaggcctgaagctgttcctggagtgcctgaacaatgacacagaggagagcaagcagctgctggccatgctgatgctgttctgtgactgcagccgccacctgatcaccatcctggatgacatcgaggtgtatgaggagcagatctccttcaagctggaggagctggtgaccatcagcagcttcctgaacagctttgtgttcaagatgatctgggatggcatcgtggagaatgccaagggggagaccctggagctgttccagagcgtgcacggctggctgatggtgctgtatgaaagagactgcagaagacgcttcaccccagaggaccactggctgaggaaggacctgaagcccagcgtgctcttccaggagctggaccgggacaggaagagggcccagctgatcctgcagtacatcccccacgtgatcccccacaagaacagagtgctgctcttccgcaccatggtgaccaaggagaaggagaagctgggcctggtggagaccagcagcgccagcccccacgtgacccacatcaccatccgccgcagcaggatgctggaggatggctatgagcagctgcggcagctgagccagcacgccatgaagggcgtcatccgggtgaagtttgtgaatgacctgggcgtggatgaagctggcatcgaccaggatggagtcttcaaggagttcctggaggagatcatcaagagggtgtttgatcctgccctgaacctcttcaagaccaccagcggagatgagcggctgtaccccagccccaccagctacatccacgagaactacctgcagctgtttgaatttgtgggcaagatgctgggcaaggctgtgtatgagggcatcgtggtggatgtgccctttgccagcttcttcctgagccagctgctgggccaccaccacagcgtcttctacagctctgtggatgagctgcccagcctggacagcgagttctacaagaacctgaccagcatcaagagatatgatggagacatcacagacctgggcctgaccctgtcctatgatgaagatgtgatgggccagctggtgtgccacgagctgatccctgggggcaagaccatccctgtgacctag

SEQ ID NO: 43056 - DNA, 735 bp, Artificial Sequence; identical to SEQ ID NO: 43049
  Description of Artificial Sequence: Synthetic coding sequence

SEQ ID NO: 43057 - DNA, 2946 bp, Artificial Sequence
  Description of Artificial Sequence: Synthetic coding sequence
atggccgagggcggcgctgctgacctggacacccagaggagtgacatcgccaccctgctgaagaccagcctgaggaagggggacacctggtacctggtggacagccgctggttcaagcagtggaagaagtatgtgggctttgacagctgggacaagtaccagatgggagaccagaatgtgtacccaggccccatcgacaacagcggcctgctgaaggatggagatgcccagagcctgaaggagcacctgattgatgagctggactacatcctgctgcccacagagggctggaacaagctggtgtcctggtacaccctgatggagggccaggagcccatcgccaggaaggtggtggagcagggcatgtttgtgaagcactgcaaggtggaggtgtacctgacagagctgaagctgtgtgaaaatggaaacatgaacaacgtggtgacccggcgcttcagcaaggctgacaccatcgacaccatcgagaaggagatcaggaagatcttcagcatcccagatgagaaggagacccggctgtggaacaagtacatgagcaacacctttgagcccctgaacaagccagacagcaccatccaggatgctggcctgtaccagggccaggtgctggtgattgagcagaagaatgaagatggcacctggccccggggccccagcacccccaagagccctggggccagcaacttcagcaccctgcccaagatcagccccagcagcctgagcaacaactacaacaacatgaacaacagaaatgtgaagaacagcaactactgcctgcccagctacacagcctacaagaactatgactacagcgagcctggaagaaataatgagcagcccggcctgtgtggcctgagcaacctgggcaacacctgcttcatgaacagcgccatccagtgcctgagcaacaccccacccctgacagagtacttcctgaatgacaagtaccaggaggagctgaactttgacaaccccctgggcatgagaggagagatcgccaagagctatgcagagctgatcaagcagatgtggagcggcaagttctcctatgtgaccccccgggccttcaagacccaggtgggccgctttgccccccagttcagcggctaccagcagcaggactgccaggagctgctggccttcctgctggatggcctgcacgaggacctgaaccgcatcaggaagaagccctacatccagctgaaggatgctgatggccgcccagacaaggtggtggccgaggaggcctgggagaaccacctgaagagaaatgacagcatcatcgtggacatcttccacggcctcttcaagagcaccctggtgtgcccagaatgtgccaagatctctgtgacctttgaccccttctgctacctgaccctgcccctgcccatgaagaaggagaggaccctggaggtgtacctggtgaggatggaccccctgaccaagcccatgcagtacaaggtggtggtgcccaagattggcaacatcctggacctgtgcacagccctgagcgccctgagcggcatcccagctgacaagatgattgtgacagacatctacaaccaccgcttccaccgcatctttgccatggatgagaacctgagcagcatcatggagagagatgacatctacgtgtttgagatcaacatcaacagaacagaggacacagagcacgtgatcatccctgtgtgcctgcgggagaagttccgccacagcagctacacccaccacacaggcagcagcctgtttggccagcccttcctgatggctgtgcccaggaacaacacagaggacaagctgtacaacctgctgctgctgaggatgtgccgctacgtgaagatcagcacagaaacagaggagacagagggcagcctgcactgctgcaaggaccagaacatcaatggaaatggccccaacggcatccacgaggagggcagccccagcgagatggagacagatgagccagatgatgagagcagccaggaccaggagctgcccagtgaaaatgaaaacagccagagtgaagattctgtgggcggggacaatgacagtgaaaatggcctgtgcacagaggacacctgcaagggccagctgaccggccacaagaagaggctcttcaccttccagttcaacaacctgggcaacacagacatcaactacatcaaggatgacaccaggcacatccgctttgatgaccggcagctgcggctggatgagaggagcttcctggccctggactgggaccctgacctgaagaagcgctactttgatgaaaatgctgctgaggactttgagaagcatgaatctgtggagtacaagccacccaagaagccctttgtgaagctgaaggactgcatcgagctgttcaccaccaaggagaagctgggcgctgaggacccctggtactgccccaactgcaaggagcaccagcaggccaccaagaagctggacctgtggagcctgccccctgtgctggtggtgcacctgaagcgcttctcctacagccgctacatgagggacaagctggacaccctggtggacttccccatcaatgacctggacatgtctgagttcctgatcaaccccaatgccggcccctgccgctacaacctgattgctgtgagcaaccactacggcggcatgggcggcggccactacacagcctttgccaagaacaaggatgatggcaagtggtactactttgatgacagctctgtgtccacagccagcgaggaccagatcgtgtccaaggccgcctacgtgctcttctaccagaggcaggacaccttctctggaacaggcttcttccccctggaccgggagaccaagggggccagcgctgccaccggcatccccctggagagtgatgaggacagcaatgacaatgacaatgacattgaaaatgaaaactgcatgcacaccaactag

SEQ ID NO: 43058 - DNA, 2859 bp, Artificial Sequence
  Description of Artificial Sequence: Synthetic coding sequence
atggccgagggcggcgctgctgacctggacacccagaggagtgacatcgccaccctgctgaagaccagcctgaggaagggggacacctggtacctggtggacagccgctggttcaagcagtggaagaagtatgtgggctttgacagctgggacaagtaccagatgggagaccagaatgtgtacccaggccccatcgacaacagcggcctgctgaaggatggagatgcccagagcctgaaggagcacctgattgatgagctggactacatcctgctgcccacagagggctggaacaagctggtgtcctggtacaccctgatggagggccaggagcccatcgccaggaaggtggtggagcagggcatgtttgtgaagcactgcaaggtggaggtgtacctgacagagctgaagctgtgtgaaaatggaaacatgaacaacgtggtgacccggcgcttcagcaaggctgacaccatcgacaccatcgagaaggagatcaggaagatcttcagcatcccagatgagaaggagacccggctgtggaacaagtacatgagcaacacctttgagcccctgaacaagccagacagcaccatccaggatgctggcctgtaccagggccaggtgctggtgattgagcagaagaatgaagatggcacctggccccggggccccagcacccccaacgtgaagaacagcaactactgcctgcccagctacacagcctacaagaactatgactacagcgagcccggcaggaacaatgagcagcccggcctgtgtggcctgagcaacctgggcaacacctgcttcatgaacagcgccatccagtgcctgagcaacaccccacccctgacagagtacttcctgaatgacaagtaccaggaggagctgaactttgacaaccccctgggcatgagaggagaaattgccaagagctatgcagagctgatcaagcagatgtggagcggcaagttctcctatgtgaccccccgggccttcaagacccaggtgggccgctttgccccccagttcagcggctaccagcagcaggactgccaggagctgctggccttcctgctggatggcctgcacgaggacctgaaccgcatcaggaagaagccctacatccagctgaaggatgctgatggccgcccagacaaggtggtggccgaggaggcctgggagaaccacctgaagagaaatgacagcatcatcgtggacatcttccacggcctcttcaagagcaccctggtgtgcccagaatgtgccaagatctctgtgacctttgaccccttctgctacctgaccctgcccctgcccatgaagaaggagaggaccctggaggtgtacctggtgaggatggaccccctgaccaagcccatgcagtacaaggtggtggtgcccaagattggcaacatcctggacctgtgcacagccctgagcgccctgagcggcatcccagctgacaagatgattgtgacagacatctacaaccaccgcttccaccgcatctttgccatggatgagaacctgagcagcatcatggagagagatgacatctacgtgtttgagatcaacatcaacagaacagaggacacagaacatgtgatcatccctgtgtgcctgcgggagaagttccgccacagcagctacacccaccacacaggcagcagcctgtttggccagcccttcctgatggctgtgcccaggaacaacacagaggacaagctgtacaacctgctgctgctgaggatgtgccgctacgtgaagatcagcacagaaacagaggagacagagggcagcctgcactgctgcaaggaccagaacatcaatggaaatggccccaacggcatccacgaggagggcagccccagcgagatggagacagatgagccagatgatgagagcagccaggaccaggagctgcccagtgaaaatgaaaacagccagagcgaggacagcgtgggcggggacaatgattctgaaaatggcctgtgcacagaggacacctgcaagggccagctgaccggccacaagaagaggctcttcaccttccagttcaacaacctgggcaacacagacatcaactacatcaaggatgacaccaggcacatccgctttgatgaccggcagctgcggctggatgagaggagcttcctggccctggactgggaccctgacctgaagaagcgctactttgatgaaaatgctgctgaagattttgagaagcatgagagcgtggagtacaagccacccaagaagccctttgtgaagctgaaggactgcatcgagctgttcaccaccaaggagaagctgggcgctgaggacccctggtactgccccaactgcaaggagcaccagcaggccaccaagaagctggacctgtggagcctgccccctgtgctggtggtgcacctgaagcgcttctcctacagccgctacatgagggacaagctggacaccctggtggacttccccatcaatgacctggacatgtctgagttcctgatcaaccccaatgccggcccctgccgctacaacctgattgctgtgagcaaccactatggaggcatgggcggcggccactacacagcctttgccaagaacaaggatgatggcaagtggtactactttgatgacagctctgtgtccacagccagcgaggaccagatcgtgtccaaggccgcctacgtgctcttctaccagaggcaggacaccttcagcggcaccggcttcttccccctggaccgggagaccaagggggccagcgctgccaccggcatccccctggagagtgatgaggacagcaatgacaatgacaatgacattgaaaatgaaaactgcatgcacaccaactag

SEQ ID NO: 43059 - DNA, 2871 bp, Artificial Sequence
  Description of Artificial Sequence: Synthetic coding sequence
atggccgagggcggcgctgctgacctggacacccagaggagtgacatcgccaccctgctgaagaccagcctgaggaagggggacacctggtacctggtggacagccgctggttcaagcagtggaagaagtatgtgggctttgacagctgggacaagtaccagatgggagaccagaatgtgtacccaggccccatcgacaacagcggcctgctgaaggatggagatgcccagagcctgaaggagcacctgattgatgagctggactacatcctgctgcccacagagggctggaacaagctggtgtcctggtacaccctgatggagggccaggagcccatcgccaggaaggtggtggagcagggcatgtttgtgaagcactgcaaggtggaggtgtacctgacagagctgaagctgtgtgaaaatggaaacatgaacaacgtggtgacccggcgcttcagcaaggctgacaccatcgacaccatcgagaaggagatcaggaagatcttcagcatcccagatgagaaggagacccggctgtggaacaagtacatgagcaacacctttgagcccctgaacaagccagacagcaccatccaggatgctggcctgtaccagggccaggtgctcttcatcgtgctggtgattgagcagaagaatgaagatggcacctggccccggggccccagcacccccaacgtgaagaacagcaactactgcctgcccagctacacagcctacaagaactatgactacagcgagcccggcaggaacaatgagcagcccggcctgtgtggcctgagcaacctgggcaacacctgcttcatgaacagcgccatccagtgcctgagcaacaccccacccctgacagagtacttcctgaatgacaagtaccaggaggagctgaactttgacaaccccctgggcatgagaggagaaattgccaagagctatgcagagctgatcaagcagatgtggagcggcaagttctcctatgtgaccccccgggccttcaagacccaggtgggccgctttgccccccagttcagcggctaccagcagcaggactgccaggagctgctggccttcctgctggatggcctgcacgaggacctgaaccgcatcaggaagaagccctacatccagctgaaggatgctgatggccgcccagacaaggtggtggccgaggaggcctgggagaaccacctgaagagaaatgacagcatcatcgtggacatcttccacggcctcttcaagagcaccctggtgtgcccagaatgtgccaagatctctgtgacctttgaccccttctgctacctgaccctgcccctgcccatgaagaaggagaggaccctggaggtgtacctggtgaggatggaccccctgaccaagcccatgcagtacaaggtggtggtgcccaagattggcaacatcctggacctgtgcacagccctgagcgccctgagcggcatcccagctgacaagatgattgtgacagacatctacaaccaccgcttccaccgcatctttgccatggatgagaacctgagcagcatcatggagagagatgacatctacgtgtttgagatcaacatcaacagaacagaggacacagaacatgtgatcatccctgtgtgcctgcgggagaagttccgccacagcagctacacccaccacacaggcagcagcctgtttggccagcccttcctgatggctgtgcccaggaacaacacagaggacaagctgtacaacctgctgctgctgaggatgtgccgctacgtgaagatcagcacagaaacagaggagacagagggcagcctgcactgctgcaaggaccagaacatcaatggaaatggccccaacggcatccacgaggagggcagccccagcgagatggagacagatgagccagatgatgagagcagccaggaccaggagctgcccagtgaaaatgaaaacagccagagcgaggacagcgtgggcggggacaatgattctgaaaatggcctgtgcacagaggacacctgcaagggccagctgaccggccacaagaagaggctcttcaccttccagttcaacaacctgggcaacacagacatcaactacatcaaggatgacaccaggcacatccgctttgatgaccggcagctgcggctggatgagaggagcttcctggccctggactgggaccctgacctgaagaagcgctactttgatgaaaatgctgctgaagattttgagaagcatgagagcgtggagtacaagccacccaagaagccctttgtgaagctgaaggactgcatcgagctgttcaccaccaaggagaagctgggcgctgaggacccctggtactgccccaactgcaaggagcaccagcaggccaccaagaagctggacctgtggagcctgccccctgtgctggtggtgcacctgaagcgcttctcctacagccgctacatgagggacaagctggacaccctggtggacttccccatcaatgacctggacatgtctgagttcctgatcaaccccaatgccggcccctgccgctacaacctgattgctgtgagcaaccactatggaggcatgggcggcggccactacacagcctttgccaagaacaaggatgatggcaagtggtactactttgatgacagctctgtgtccacagccagcgaggaccagatcgtgtccaaggccgcctacgtgctcttctaccagaggcaggacaccttcagcggcaccggcttcttccccctggaccgggagaccaagggggccagcgctgccaccggcatccccctggagagtgatgaggacagcaatgacaatgacaatgacattgaaaatgaaaactgcatgcacaccaactag

SEQ ID NO: 43060 - DNA, 708 bp, Artificial Sequence
  Description of Artificial Sequence: Synthetic coding sequence
atggccgagggcggcgctgctgacctggacacccagaggagtgacatcgccaccctgctgaagaccagcctgaggaagggggacacctggtacctggtggacagccgctggttcaagcagtggaagaagtatgtgggctttgacagctgggacaagtaccagatgggagaccagaatgtgtacccaggccccatcgacaacagcggcctgctgaaggatggagatgcccagagcctgaaggagcacctgattgatgagctggactacatcctgctgcccacagagggctggaacaagctggtgtcctggtacaccctgatggagggccaggagcccatcgccaggaaggtggtggagcagggcatgtttgtgaagcactgcaaggtggaggtgtacctgacagagctgaagctgtgtgaaaatggaaacatgaacaacgtggtgacccggcgcttcagcaaggctgacaccatcgacaccatcgagaaggagatcaggaagatcttcagcatcccagatgagaaggagacccggctgtggaacaagtacatgagcaacacctttgagcccctgaacaagccagacagcaccatccaggatgctggcctgtaccagggccaggtgctggtgattgagcagaagaatgaagatggcacctggccccggggccccagcacccccaagaagcccctggagcagagctgctag

SEQ ID NO: 43061 - DNA, 2769 bp, Artificial Sequence
  Description of Artificial Sequence: Synthetic coding sequence
atgatcagcctgaaggtgtgtggcttcatccagatctggagccagaagacaggcatgaccaagctgaaggaggccctgattgaaacagtgcagaggcagaaggagatcaagctggtggtgaccttcaagagcggcaagttcatccgcatcttccagctgagcaacaacatccgctctgtggtgctgcggcactgcaagaagaggcagagccacctgcggctgaccctgaagaacaacgtgttcctgttcatcgacaagctgagctacagagatgccaagcagctgaacatgttcctggacatcatccaccagaacaagagccagcagcccatgaagagtgatgatgactggagcgtgtttgagagcaggaacatgctgaaggagattgacaagaccagcttctacagcatctgcaacaagcccagctaccagaagatgcccctcttcatgagcaagagccccacccacgtgaagaagggcatcctggagaaccagggcggcaagggccagaacaccctgagcagtgatgtgcagaccaatgaagacatcctgaaggaggacaaccctgtgcccaacaagaagtacaagacagacagcctgaagtacatccagagcaacaggaagaaccccagcagcctggaggacctggagaaggaccgggacctgaagctgggccccagcttcaacaccaactgcaatggaaaccccaacctggatgaaacagtgctggccacccagaccctgaatgccaagaatggcctgaccagccccctggagcctgagcacagccagggcgacccccgctgcaacaaggcccaggtgcccctggacagccacagccagcagctgcagcagggcttccccaacctgggcaacacctgctacatgaatgctgtgctgcagagcctgtttgccatccccagctttgctgatgacctgctgacccagggcgtgccctgggagtacatcccctttgaggccctgatcatgaccctgacccagctgctggccctgaaggacttctgcagcaccaagatcaagcgggagctgctgggcaatgtgaagaaggtgatctctgctgtggccgagatcttcagcggcaacatgcagaatgatgcccacgagttcctgggccagtgcctggaccagctgaaggaggacatggagaagctgaatgccaccctgaacacaggcaaggaatgtggagatgagaacagcagcccccagatgcacgtgggcagcgctgccaccaaggtgtttgtgtgccctgtggtggccaactttgaatttgagctgcagctgagcctcatctgcaaggcctgtggccatgctgtgctgaaggtggagcccaacaactacctgagcatcaacctgcaccaggagaccaagcccctgcccctgagcatccagaacagcctggacctcttcttcaaggaggaggagctggagtacaactgccagatgtgcaagcagaagagctgtgtggcccggcacaccttcagccggctgagccgggtgctgatcatccacctgaagcgctacagcttcaacaatgcctggctgctggtgaagaacaatgagcaggtgtacatccccaagagcctgagcctgagcagctactgcaatgaaagcaccaagccacccctgcccctgagcagcagcgcccctgtgggcaaatgtgaggtgctggaggtgtcccaggagatgatcagcgagatcaacagccccctgacccccagcatgaagctgaccagcgagagcagtgacagcctggtgctgcctgtggagccagacaagaatgctgacctgcagcgcttccagagggactgtggagatgccagccaggagcagcaccagagggacctggagaatggcagcgccctggagagcgagctggtgcacttccgggaccgggccatcggggagaaggagctgcctgtggccgacagcctgatggaccagggcgacatcagcctgcctgtgatgtatgaagatggcggcaagctgatcagcagcccagacacccggctggtggaggtgcacctgcaggaggtgccccagcaccctgagctgcagaagtatgagaagaccaacacctttgtggagttcaactttgattctgtgacagagagcaccaacggcttctatgactgcaaggagaaccgcatccctgagggcagccagggcatggccgagcagctgcagcagtgcatcgaggagagcatcattgatgagttcctgcagcaggcccctcctcctggggtgaggaagctggatgcccaggagcacacagaggagaccctgaaccagagcacagagctgcggctgcagaaggctgacctgaaccacctgggcgccctgggcagtgacaaccctggcaacaagaacatcctggatgctgagaacaccagaggagaggccaaggagctgaccagaaatgtgaagatgggagaccccctgcaggcctaccgcctcatctctgtggtgagccacatcggcagcagccccaacagcggccactacatcagtgatgtgtatgacttccagaagcaggcctggttcacctacaatgacctgtgtgtgtctgagatcagcgagaccaagatgcaggaggcccggctgcacagcggctacatcttcttctacatgcacaacggcatctttgaggagctgctgaggaaggccgagaacagccggctgcccagcacccaggccggggtcatcccccagggcgagtatgaaggagacagcctgtacagacctgcctag

SEQ ID NO: 43062 - DNA, 786 bp, Artificial Sequence
  Description of Artificial Sequence: Synthetic coding sequence
atgtctggagaaattgccatgtgtgagcctgagtttggaaatgacaaggcccgggagcccagcgtgggcggccgctggagggtgtcctggtatgaaagatttgtgcagccctgcctggtggagctgctgggcagcgccctcttcatcttcatcggctgcctgtctgtgattgaaaatggaacagacaccggcctgctgcagcctgccctggcccacggcctggccctgggcctggtgattgccaccctgggcaacatcagcggcggccacttcaacccagctgtgtccctggccgccatgctgattggaggcctgaacctggtgatgctgctgccctactgggtgtcccagctgctgggcggcatgctgggcgccgccctggccaaggctgtgtccccagaggagcgcttctggaatgccagcggggccgcctttgtgacagtgcaggagcagggccaggtggccggggccctggtggccgagatcatcctgaccaccctgctggccctggccgtgtgcatgggcgccatcaatgagaagaccaagggccccctggcccccttcagcatcggctttgctgtgacagtggacatcctggccggcggccctgtgtctgggggctgcatgaacccagcccgggcctttggacctgctgtggtggccaaccactggaacttccactggatctactggctgggccccctgctggccggcctgctggtgggcctgctgatccgctgcttcatcggagatggcaagaccaggctcatcctgaaggccaggtag

SEQ ID NO: 43063 - DNA, 1332 bp, Artificial Sequence
  Description of Artificial Sequence: Synthetic coding sequence
atgagccagagagatggagtgtgtggcagccatgaggtggccggggccgccagccctggagcagatggcggcctgagcctggccgcctactgcaagaacagcgtggatggcctgtggtactgctttgatgacagtgatgtgcagcagctgtctgaagatgaggtgtgcacccagacagcctacatcctcttctaccagaggagaacagccatccccagctggagcgccaacagctctgtggccggcagcaccagcagcagcctgtgtgagcactgggtgtcccggctgcccggcagcaagccagcctctgtgaccagcgctgccagcagcaggaggaccagcctggccagcctgtctgagagcgtggagatgactggagagaggagtgaagatgatggcggcttcagcacccggccctttgtgcgctctgtgcagaggcagagcctgagcagccgcagctctgtgaccagccccctggccgtgaatgaaaactgcatgaggcccagctggagcctgagcgccaagctgcagatgaggagcaacagccccagccgcttcagcggggacagccccatccacagcagcgccagcaccctggagaagatcggggaggccgcagatgacaaggtgtccatcagctgcttcggcagcctgaggaacctgagcagcagctaccaggagcccagcgacagccacagccggcgggagcacaaggctgtgggccgggcccccctggccgtgatggagggcgtcttcaaggatgaaagtgacacccggcggctgaacagctctgtggtggacacccagagcaagcacagcgcccagggcgaccggctgccccccctgagcggcccctttgacaacaacaaccagatcgcctacgtggaccagagcgacagcgtggacagcagccctgtgaaggaggtgaaggcccccagccaccctggcagcctggccaagaagccagagagcaccaccaagaggagccccagcagcaagggcaccagcgagcctgagaagagcctgaggaagggccgcccagccctggccagccaggagagcagcctgagcagcaccagccccagcagccccctgcctgtgaaggtgtccctgaagcccagccgcagccgcagcaaggctgacagcagcagccggggcagcggccgccacagcagccctgccccagcccagacccagttccccagcggggagcccggccccagccggggcggccagggcggccgggaggcccgggcagagctgctgcacggccagcctgccctgccccagcacaagcaccaggtgtggtttgaggagggccagcaggtgtag

SEQ ID NO: 43064 - DNA, 10185 bp, Artificial Sequence
  Description of Artificial Sequence: Synthetic coding sequence
atgaggaggaagaacagctactacgtgtggcagatcttccagatccagttccccctgtacacagcctacaagcacaacacccaccccaccatcgaggacatcagcacccaggagagcaacatcctgggcgccttctgtgacatgaatgatgtggaggtgcccctgcacctgctgcgctacgtgtgcctcttctgtgggaagaatggcctgagcctgatgaaggactgctttgaatatggcaccccagagaccctgcccttcctgattgcccacgccttcatcaccgtggtgagcaacatccgcatctggctgcacatcccagctgtgatgcagcacatcatccccttccgcacctacgtgatccgctacctgtgcaagctgagtgaccaggagctgcggcagagcgctgccaggaacatggctgacctgatgtggagcacagtgaaggagcccctggacaccaccctgtgctttgacaaggagagcctggacctggccttcaagtacttcatgagccccaccctgaccatgaggctggccggcctgagccagatcaccaaccagctgcacaccttcaatgatgtgtgcaacaatgaaagcctggtgtctgacacagagaccagcatcgccaaggagctggccgactggctgatcagcaacaacgtggtggagcacatcttcggccccaacctgcacatcgagatcatcaagcagtgccaggtgatcctgaacttcctggccgctgagggccgcctgagcacccagcacatcgactgcatctgggccgccgcccagctgaagcactgcagccgctacatccatgacctcttccccagcctcatcaagaacctggaccctgtgcccctgcggcacctgctgaacctggtgtctgccctggagcccagcgtgcacacagagcagaccctgtacctggcctccatgctgatcaaggccctgtggaacaatgccctggccgccaaggcccagctgagcaagcagagcagctttgccagcctgctgaacaccaacatccccatcggcaacaagaaggaggaggaggagctgcggaggacagcccccagcccctggagccctgctgccagcccccagagcagtgacaacagcgacacccaccagagcggcggcagtgacatcgagatggatgagcagctgatcaacagaaccaagcacgtgcagcagaggctgagtgacacagaggagagcatgcagggcagcagtgatgaaacagccaacagcggagaagatggcagcagcggccctggcagcagcagcggccacagtgatggcagcagcaatgaggtgaacagcagccacgccagccagagcgctggcagccctggcagcgaggtgcagagcgaggacattgctgacatcgaggccctgaaggaggaggatgaagatgatgaccacggccacaacccccccaagagcagctgtggcacagacctgaggaacaggaagctggagagccaggccggcatctgcctgggggacagccagggcatgtctgaaagaaatggcaccagcagcggcaccgggaaggacctggtgttcaacacagagagcctgcccagcgtggacaacaggatgaggatgctggatgcctgcagccacagtgaagatcctgagcatgacatcagcggggagatgaatgccacccacatcgcccagggcagccaggagagctgcatcaccaggactggagacttcctgggggagaccatcggaaatgagctgttcaactgccggcagttcatcggcccccagcaccaccaccaccaccaccaccaccaccaccaccatgatggccacatggtggatgacatgctgtctgcagatgatgtgtcctgcagcagcagccaggtgtctgccaagtctgagaagaacatggctgactttgatggagaggagagcggctgtgaggaggagctggtgcagatcaacagccacgccgagctgaccagccacctgcagcagcacctgcccaacctggccagcatctaccacgagcacctgagccagggccctgtggtgcacaagcaccagttcaacagcaatgctgtgacagacatcaacctggacaacgtgtgcaagaagggcaacaccctgctgtgggacatcgtgcaggatgaagatgctgtgaacctgtctgagggcctcatcaatgaagctgagaagctgctgtgcagcctggtgtgctggttcacagaccggcagatccgcatgaggttcatcgagggctgcctggagaacctgggcaacaacagatctgtggtgatcagcctgcggctgctgcccaagctgtttggcaccttccagcagtttggcagcagctatgacacccactggatcaccatgtgggccgagaaggagctgaacatgatgaagctgttctttgacaacctggtgtactacatccagacagtgcgggagggccggcagaagcacgccctgtacagccacagcgctgaggtgcaggtgcggctgcagttcctgacctgtgtgttcagcaccctgggcagcccagaccacttccggctgagcctggagcaggtggacatcctgtggcactgcctggtggaggacagtgaatgttatgatgatgccctgcactggttcctgaaccaggtgcgcagcaaggaccagcacgccatgggcatggagacctacaagcacctgttcctggagaagatgccccagctgaagccagagaccatctccatgacaggcctgaacctcttccagcacctgtgcaacctggcccggctggccaccagcgcctatgatggctgcagcaacagcgagctgtgtggcatggaccagttctggggcatcgccctgcgggcccagagcggagatgtgtcccgggccgccatccagtacatcaacagctactacatcaatggcaagacaggcctggagaaggagcaggagttcatcagcaagtgcatggagagcctgatgattgccagcagcagcctggagcaggagagccacagcagcctgatggtgattgaaagaggcctgctgatgctgaagacccacctggaggccttcagaagaagatttgcctaccacctgcggcagtggcagatcgagggcaccggcatcagcagccacctgaaggccctgagtgacaagcagagcctgcccctgcgggtggtgtgccagcctgctggcctgcctgacaagatgaccatcgagatgtaccccagcgaccaggtggccgacctgcgggcagaggtgacccactggtatgagaacctgcagaaggagcagatcaaccagcaggcccagctgcaggagtttggccagagcaacaggaagggggagttccctgggggcctgatgggccctgtgaggatgatcagcagcggccacgagctgaccacagattatgatgagaaggccctgcacgagctgggcttcaaggacatgcagatggtgtttgtgtccctgggcgccccccggcgggagaggaagggggagggcgtgcagctgcctgccagctgcctgcccccaccccagaaggacaacatccccatgctgctgctgctgcaggagccccacctgaccaccctgtttgacctgctggagatgctggccagcttcaagcccccatctgggaaggtggccgtggatgattctgagagcctgcgctgtgaggagctgcacctgcatgctgagaacctgagccggcgggtgtgggagctgctgatgctgctgcccacctgccccaacatgctgatggccttccagaacatcagtgatgagcagagcaatgatggcttcaactggaaggagctgctgaagatcaagagcgcccacaagctgctgtatgccctggagatcatcgaggccctgggcaagcccaacagacgcatcagaagagagagcacaggcagctacagcgacctgtacccagacagtgatgacagcagcgaggaccaggtggagaacagcaagaacagctggagctgcaagtttgtggccgccggcggcctgcagcagctgctggagatcttcaacagcggcatcctggagcccaaggagcaggagagctggacagtgtggcagctggactgcctggcctgcctgctgaagctgatctgccagtttgctgtggaccccagcgacctggacctggcctaccatgatgtgtttgcctggagcggcattgctgagagccacaggaagaggacctggccaggcaagagcaggaaggctgctggggaccacgccaagggcctgcacatcccccggctgacagaggtgttcctggtgctggtgcagggcaccagcctcatccagaggctgatgtctgtggcctacacctatgacaacctggccccccgggtgctgaaggcccagagcgaccacaggagcagacatgaggtgagccactacagcatgtggctgctggtgtcctgggcccactgctgcagcctggtgaagagcagcctggccgacagcgaccacctgcaggactggctgaagaagctgaccctgctgatccctgagacagctgtgagacatgagagctgcagcggcctgtacaagctgagcctgagcggcctggatggaggagacagcatcaacagaagcttcctgctgctggccgccagcaccctgctgaagttcctgcctgatgcccaggccctgaagcccatcagaattgatgattatgaggaggagcccatcctgaagccaggctgcaaggagtacttctggctgctgtgcaagctggtggacaacatccacatcaaggatgccagccagaccaccctgctggacctggatgccctggcccggcacctggccgactgcatccgcagccgggagatcctggaccaccaggatggaaatgtggaggatgatggcctgaccggcctgctgcggctggccacctctgtggtgaagcacaagccacccttcaagttcagccgggagggccaggagttcctgcgggacatcttcaacctgctcttcctgctgcccagcctgaaggaccggcagcagcccaagtgcaagagccacagcagcagagctgctgcctatgacctgctggtggagatggtgaagggctctgtggagaactaccgcctcatccacaactgggtgatggcccagcacatgcagagccacgccccctacaagtgggactactggccccatgaagatgtgcgggcagagtgccgctttgtgggcctgaccaacctgggcgccacctgctacctggccagcaccatccagcagctgtacatgatccctgaggcccggcaggccgtgttcaccgccaagtacagcgaggacatgaagcacaagaccaccctgctggagctgcagaagatgttcacctacctgatggagagcgagtgcaaggcctacaacccccggcccttctgcaagacctacaccatggacaagcagcccctgaacacaggagagcagaaggacatgacagagttcttcacagacctgatcaccaagattgaggagatgagccctgagctgaagaacacagtgaagagcctgtttggaggagtcatcaccaacaacgtggtgtccctggactgtgagcacgtgtcccagacagctgaggagttctacacagtgcgctgccaggtggccgacatgaagaacatctatgagagcctggatgaggtgaccatcaaggacaccctggagggggacaacatgtacacctgcagccactgcggcaagaaggtgcgggcagagaagagggcctgcttcaagaagctgccccgcatcctgtccttcaacaccatgagatacaccttcaacatggtgaccatgatgaaggagaaggtgaacacccacttctccttccccctgcggctggacatgaccccctacacagaggacttcctgatgggcaagtctgagaggaaggagggcttcaaggaggtgtctgaccacagcaaggacagcgagagctatgaatatgacctgattggagtgacagtgcacactggaacagcagatggcggccactactacagcttcatccgggacatcgtgaacccccacgcctacaagaacaacaagtggtacctgttcaatgatgctgaggtgaagccctttgacagcgcccagctggccagcgagtgcttcggcggggagatgaccaccaagacctatgattctgtgacagacaagttcatggacttctcctttgagaagacccacagcgcctacatgctgttctacaagaggatggagcctgaggaggagaatggccgggagtacaagtttgatgtgtcctctgagctgctggagtggatctggcatgacaacatgcagttcctgcaggacaagaacatctttgagcacacctacttcggcttcatgtggcagctgtgcagctgcatccccagcaccctgcctgaccccaaggctgtgtccctgatgacagccaagctgagcaccagctttgtgctggagaccttcatccacagcaaggagaagcccaccatgctgcagtggattgagctgctgaccaagcagttcaacaacagccaggccgcctgtgagtggttcctggacaggatggctgatgatgactggtggcccatgcagatcctgatcaagtgccccaaccagatcgtgcggcagatgttccagaggctgtgcatccacgtgatccagaggctgcggcctgtgcacgcccacctgtacctgcagcccggcatggaggatggcagtgatgacatggacacctctgtggaggacattggaggccgcagctgtgtgaccaggtttgtgaggaccctgctgctgatcatggagcacggcgtgaagccccacagcaagcacctgacagagtactttgccttcctgtatgaatttgccaagatgggagaggaggagagccagttcctgctgagcctgcaggccatcagcaccatggtgcacttctacatgggcaccaagggccctgagaacccccaggtggaggtgctgtctgaggaggagggggaggaggaggaggaggaggaggacatcctgagcctggccgaggagaagtacagacctgctgccctggagaagatgattgccctggtggccctgctggtggagcagagccgctctgagcggcacctgaccctgagccagacagacatggccgccctgactggaggcaagggcttccccttcctgttccagcacatcagagatggcatcaacatccggcagacctgcaacctgatcttcagcctgtgccgctacaacaaccggctggccgagcacatcgtgtccatgctgttcaccagcatcgccaagctgaccccagaggccgccaaccccttcttcaagctgctgaccatgctgatggagtttgctgggggccccccaggcatgcccccatttgccagctacatcctgcagaggatctgggaggtgattgagtacaaccccagccagtgcctggactggctggccgtgcagacccccaggaacaagctggcccacagctgggtgctgcagaacatggagaactgggtggagcgcttcctgctggcccacaactacccccgggtgaggaccagcgctgcctacctgctggtgtccctcatccccagcaacagcttccggcagatgttccgcagcaccaggagcctgcacatccccacccgggacctgcccctgagcccagacaccaccgtggtgctgcaccaggtgtacaacgtgctgctgggcctgctgagccgggccaagctgtatgtggatgctgctgtgcacggcaccaccaagctggtgccctacttctccttcatgacctactgcctgatcagcaagacagagaagctgatgttcagcacctacttcatggacctgtggaacctcttccagcccaagctgtctgagcccgccatcgccaccaaccacaacaagcaggccctgctgtccttctggtacaacgtgtgtgccgactgcccagagaacatccggctgattgtgcagaaccctgtggtgaccaagaacatcgccttcaactacatcctggccgaccatgatgaccaggatgtggtgctcttcaacagaggcatgctgcctgcctactacggcatcctgcggctgtgctgtgagcagagccctgccttcacccggcagctggccagccaccagaacatccagtgggccttcaagaacctgaccccccacgccagccagtacccaggagctgtggaggagctgttcaacctgatgcagctgttcatcgcccagaggccagacatgagggaggaggagctggaggacatcaagcagttcaagaagaccaccatcagctgctacctgcgctgcctggatggccgcagctgctggaccaccctcatcagcgccttccgcatcctgctggagagtgatgaagatcggctgctggtggtgttcaacagaggcctcatcctgatgacagagagcttcaacaccctgcacatgatgtaccacgaggccacagcctgccacgtgactggagacctggtggagctgctgagcatcttcctgtctgtgctgaagagcacccggccctacctgcagaggaaggatgtgaagcaggccctgatccagtggcaggagcgcatcgagtttgcccacaagctgctgaccctgctgaacagctacagccccccagagctgagaaatgcctgcattgatgtgctgaaggagctggtgctgctgagcccccatgacttcctgcacaccctggtgcccttcctgcagcacaaccactgcacctaccaccacagcaacatccccatgagcctgggcccctacttcccctgccgggagaacatcaagctgattggaggcaagagcaacatccggccccccaggcctgagctgaacatgtgcctgctgcccaccatggtggagaccagcaagggcaaggatgatgtgtatgacaggatgctgctggactacttcttctcctaccaccagttcatccacctgctgtgccgggtggccatcaactgtgagaagttcacagagaccctggtgaagctgtctgtgctggtggcctatgagggcctgcccctgcacctggccctcttccccaagctgtggacagagctgtgccagacccagagcgccatgagcaagaactgcatcaagctgctgtgtgaagatcctgtgtttgctgagtacatcaagtgcatcctgatggatgagaggaccttcctgaacaacaacatcgtgtacaccttcatgacccacttcctgctgaaggtgcagagccaggtgttcagcgaggccaactgtgccaacctgatcagcaccctcatcaccaacctgatcagccagtaccagaacctgcagagcgacttcagcaacagagtggagatcagcaaggccagcgccagcctgaatggagacctgcgggccctggccctgctgctgtctgtgcacacccccaagcagctgaacccagccctgatccccaccctgcaggagctgctgagcaagtgcaggacctgcctgcagcagaggaacagcctgcaggagcaggaggccaaggagaggaagaccaaggatgatgagggcgccacccccatcaagagaagaagagtgtccagtgatgaggagcacacagtggacagctgcatcagtgacatgaagacagagacccgggaggtgctgacccccaccagcaccagtgacaatgagacccgggacagcagcatcatcgaccccggcacagagcaggacctgcccagccctgagaacagctctgtgaaggagtacaggatggaggtgcccagcagcttcagcgaggacatgagcaacatccgcagccagcacgccgaggagcagagcaacaacggccgctatgatgactgcaaggagttcaaggacctgcactgcagcaaggacagcaccctggccgaggaggagagcgagttccccagcaccagcatctctgctgtgctgagtgacctggccgacctgcggagctgtgatggccaggccctgcccagccaggaccctgaggtggccctgagcctgagctgtggccacagccggggcctcttcagccacatgcagcagcacgacatcctggacaccctgtgcaggaccatcgagagcaccatccacgtggtgacccgcatcagcggcaagggcaaccaggccgccagctag

SEQ ID NO: 43065 - DNA, 9936 bp, Artificial Sequence
  Description of Artificial Sequence: Synthetic coding sequence
atgaggaggaagaacagctactacgtgtggcagatcttccagatccagttccccctgtacacagcctacaagcacaacacccaccccaccatcgaggacatcagcacccaggagagcaacatcctgggcgccttctgtgacatgaatgatgtggaggtgcccctgcacctgctgcgctacgtgtgcctcttctgtgggaagaatggcctgagcctgatgaaggactgctttgaatatggcaccccagagaccctgcccttcctgattgcccacgccttcatcaccgtggtgagcaacatccgcatctggctgcacatcccagctgtgatgcagcacatcatccccttccgcacctacgtgatccgctacctgtgcaagctgagtgaccaggagctgcggcagagcgctgccaggaacatggctgacctgatgtggagcacagtgaaggagcccctggacaccaccctgtgctttgacaaggagagcctggacctggccttcaagtacttcatgagccccaccctgaccatgaggctggccggcctgagccagatcaccaaccagctgcacaccttcaatgatgtgtgcaacaatgaaagcctggtgtctgacacagagaccagcatcgccaaggagctggccgactggctgatcagcaacaacgtggtggagcacatcttcggccccaacctgcacatcgagatcatcaagcagtgccaggtgatcctgaacttcctggccgctgagggccgcctgagcacccagcacatcgactgcatctgggccgccgcccagctgaagcactgcagccgctacatccatgacctcttccccagcctcatcaagaacctggaccctgtgcccctgcggcacctgctgaacctggtgtctgccctggagcccagcgtgcacacagagcagaccctgtacctggcctccatgctgatcaaggccctgtggaacaatgccctggccgccaaggcccagctgagcaagcagagcagctttgccagcctgctgaacaccaacatccccatcggcaacaagaaggaggaggaggagctgcggaggacagcccccagcccctggagccctgctgccagcccccagagcagtgacaacagcgacacccaccagagcggcggcagtgacatcgagatggatgagcagctgatcaacagaaccaagcacgtgcagcagaggctgagtgacacagaggagagcatgcagggcagcagtgatgaaacagccaacagcggagaagatggcagcagcggccctggcagcagcagcggccacagtgatggcagcagcaatgaggtgaacagcagccacgccagccagagcgctggcagccctggcagcgaggtgcagagcgaggacattgctgacatcgaggccctgaaggaggaggatgaagatgatgaccacggccacaacccccccaagagcagctgtggcacagacctgaggaacaggaagctggagagccaggccggcatctgcctgggggacagccagggcatgtctgaaagaaatggcaccagcagcggcaccgggaaggacctggtgttcaacacagagagcctgcccagcgtggacaacaggatgaggatgctggatgcctgcagccacagtgaagatcctgagcatgacatcagcggggagatgaatgccacccacatcgcccagggcagccaggagagctgcatcaccaggactggagacttcctgggggagaccatcggaaatgagctgttcaactgccggcagttcatcggcccccagcaccaccaccaccaccaccaccaccaccaccaccatgatggccacatggtggatgacatgctgtctgcagatgatgtgtcctgcagcagcagccaggtgtctgccaagtctgagaagaacatggctgactttgatggagaggagagcggctgtgaggaggagctggtgcagatcaacagccacgccgagctgaccagccacctgcagcagcacctgcccaacctggccagcatctaccacgagcacctgagccagggccctgtggtgcacaagcaccagttcaacagcaatgctgtgacagacatcaacctggacaacgtgtgcaagaagggcaacaccctgctgtgggacatcgtgcaggatgaagatgctgtgaacctgtctgagggcctcatcaatgaagctgagaagctgctgtgcagcctggtgtgctggttcacagaccggcagatccgcatgaggttcatcgagggctgcctggagaacctgggcaacaacagatctgtggtgatcagcctgcggctgctgcccaagctgtttggcaccttccagcagtttggcagcagctatgacacccactggatcaccatgtgggccgagaaggagctgaacatgatgaagctgttctttgacaacctggtgtactacatccagacagtgcgggagggccggcagaagcacgccctgtacagccacagcgctgaggtgcaggtgcggctgcagttcctgacctgtgtgttcagcaccctgggcagcccagaccacttccggctgagcctggagcaggtggacatcctgtggcactgcctggtggaggacagtgaatgttatgatgatgccctgcactggttcctgaaccaggtgcgcagcaaggaccagcacgccatgggcatggagacctacaagcacctgttcctggagaagatgccccagctgaagccagagaccatctccatgacaggcctgaacctcttccagcacctgtgcaacctggcccggctggccaccagcgcctatgatggctgcagcaacagcgagctgtgtggcatggaccagttctggggcatcgccctgcgggcccagagcggagatgtgtcccgggccgccatccagtacatcaacagctactacatcaatggcaagacaggcctggagaaggagcaggagttcatcagcaagtgcatggagagcctgatgattgccagcagcagcctggagcaggagagccacagcagcctgatggtgattgaaagaggcctgctgatgctgaagacccacctggaggccttcagaagaagatttgcctaccacctgcggcagtggcagatcgagggcaccggcatcagcagccacctgaaggccctgagtgacaagcagagcctgcccctgcgggtggtgtgccagcctgctggcctgcctgacaagatgaccatcgagatgtaccccagcgaccaggtggccgacctgcgggcagaggtgacccactggtatgagaacctgcagaaggagcagatcaaccagcaggcccagctgcaggagtttggccagagcaacaggaagggggagttccctgggggcctgatgggccctgtgaggatgatcagcagcggccacgagctgaccacagattatgatgagaaggccctgcacgagctgggcttcaaggacatgcagatggtgtttgtgtccctgggcgccccccggcgggagaggaagggggagggcgtgcagctgcctgccagctgcctgcccccaccccagaaggacaacatccccatgctgctgctgctgcaggagccccacctgaccaccctgtttgacctgctggagatgctggccagcttcaagcccccatctgggaaggtggccgtggatgattctgagagcctgcgctgtgaggagctgcacctgcatgctgagaacctgagccggcgggtgtgggagctgctgatgctgctgcccacctgccccaacatgctgatggccttccagaacatcagtgatgagcagagcaatgatggcttcaactggaaggagctgctgaagatcaagagcgcccacaagctgctgtatgccctggagatcatcgaggccctgggcaagcccaacagacgcatcagaagagagagcacaggcagctacagcgacctgtacccagacagtgatgacagcagcgaggaccaggtggagaacagcaagaacagctggagctgcaagtttgtggccgccggcggcctgcagcagctgctggagatcttcaacagcggcatcctggagcccaaggagcaggagagctggacagtgtggcagctggactgcctggcctgcctgctgaagctgatctgccagtttgctgtggaccccagcgacctggacctggcctaccatgatgtgtttgcctggagcggcattgctgagagccacaggaagaggacctggccaggcaagagcaggaaggctgctggggaccacgccaagggcctgcacatcccccggctgacagaggtgttcctggtgctggtgcagggcaccagcctcatccagaggctgatgtctgtggcctacacctatgacaacctggccccccgggtgctgaaggcccagagcgaccacaggagcagacatgaggtgagccactacagcatgtggctgctggtgtcctgggcccactgctgcagcctggtgaagagcagcctggccgacagcgaccacctgcaggactggctgaagaagctgaccctgctgatccctgagacagctgtgagacatgagagctgcagcggcctgtacaagctgagcctgagcggcctggatggaggagacagcatcaacagaagcttcctgctgctggccgccagcaccctgctgaagttcctgcctgatgcccaggccctgaagcccatcagaattgatgattatgaggaggagcccatcctgaagccaggctgcaaggagtacttctggctgctgtgcaagctggtggacaacatccacatcaaggatgccagccagaccaccctgctggacctggatgccctggcccggcacctggccgactgcatccgcagccgggagatcctggaccaccaggatggaaatgtggaggatgatggcctgaccggcctgctgcggctggccacctctgtggtgaagcacaagccacccttcaagttcagccgggagggccaggagttcctgcgggacatcttcaacctgctcttcctgctgcccagcctgaaggaccggcagcagcccaagtgcaagagccacagcagcagagctgctgcctatgacctgctggtggagatggtgaagggctctgtggagaactaccgcctcatccacaactgggtgatggcccagcacatgcagagccacgccccctacaagtgggactactggccccatgaagatgtgcgggcagagtgccgctttgtgggcctgaccaacctgggcgccacctgctacctggccagcaccatccagcagctgtacatgatccctgaggcccggcaggccgtgttcaccgccaagtacagcgaggacatgaagcacaagaccaccctgctggagctgcagaagatgttcacctacctgatggagagcgagtgcaaggcctacaacccccggcccttctgcaagacctacaccatggacaagcagcccctgaacacaggagagcagaaggacatgacagagttcttcacagacctgatcaccaagattgaggagatgagccctgagctgaagaacacagtgaagagcctgtttggaggagtcatcaccaacaacgtggtgtccctggactgtgagcacgtgtcccagacagctgaggagttctacacagtgcgctgccaggtggccgacatgaagaacatctatgagagcctggatgaggtgaccatcaaggacaccctggagggggacaacatgtacacctgcagccactgcggcaagaaggtgcgggcagagaagagggcctgcttcaagaagctgccccgcatcctgtccttcaacaccatgagatacaccttcaacatggtgaccatgatgaaggagaaggtgaacacccacttctccttccccctgcggctggacatgaccccctacacagaggacttcctgatgggcaagtctgagaggaaggagggcttcaaggaggtgtctgaccacagcaaggacagcgagagctatgaatatgacctgattggagtgacagtgcacactggaacagcagatggcggccactactacagcttcatccgggacatcgtgaacccccacgcctacaagaacaacaagtggtacctgttcaatgatgctgaggtgaagccctttgacagcgcccagctggccagcgagtgcttcggcggggagatgaccaccaagacctatgattctgtgacagacaagttcatggacttctcctttgagaagacccacagcgcctacatgctgttctacaagaggatggagcctgaggaggagaatggccgggagtacaagtttgatgtgtcctctgagctgctggagtggatctggcatgacaacatgcagttcctgcaggacaagaacatctttgagcacacctacttcggcttcatgtggcagctgtgcagctgcatccccagcaccctgcctgaccccaaggctgtgtccctgatgacagccaagctgagcaccagctttgtgctggagaccttcatccacagcaaggagaagcccaccatgctgcagtggattgagctgctgaccaagcagttcaacaacagccaggccgcctgtgagtggttcctggacaggatggctgatgatgactggtggcccatgcagatcctgatcaagtgccccaaccagatcgtgcggcagatgttccagaggctgtgcatccacgtgatccagaggctgcggcctgtgcacgcccacctgtacctgcagcccggcatggaggatggcagtgatgacatggacacctctgtggaggacattggaggccgcagctgtgtgaccaggtttgtgaggaccctgctgctgatcatggagcacggcgtgaagccccacagcaagcacctgacagagtactttgccttcctgtatgaatttgccaagatgggagaggaggagagccagttcctgctgagcctgcaggccatcagcaccatggtgcacttctacatgggcaccaagggccctgagaacccccaggtggaggtgctgtctgaggaggagggggaggaggaggaggaggaggaggacatcctgagcctggccgaggagaagtacagacctgctgccctggagaagatgattgccctggtggccctgctggtggagcagagccgctctgagcggcacctgaccctgagccagacagacatggccgccctgactggaggcaagggcttccccttcctgttccagcacatcagagatggcatcaacatccggcagacctgcaacctgatcttcagcctgtgccgctacaacaaccggctggccgagcacatcgtgtccatgctgttcaccagcatcgccaagctgaccccagaggccgccaaccccttcttcaagctgctgaccatgctgatggagtttgctgggggccccccaggcatgcccccatttgccagctacatcctgcagaggatctgggaggtgattgagtacaaccccagccagtgcctggactggctggccgtgcagacccccaggaacaagctggcccacagctgggtgctgcagaacatggagaactgggtggagcgcttcctgctggcccacaactacccccgggtgaggaccagcgctgcctacctgctggtgtccctcatccccagcaacagcttccggcagatgttccgcagcaccaggagcctgcacatccccacccgggacctgcccctgagcccagacaccaccgtggtgctgcaccaggtgtacaacgtgctgctgggcctgctgagccgggccaagctgtatgtggatgctgctgtgcacggcaccaccaagctggtgccctacttctccttcatgacctactgcctgatcagcaagacagagaagctgatgttcagcacctacttcatggacctgtggaacctcttccagcccaagctgtctgagcccgccatcgccaccaaccacaacaagcaggccctgctgtccttctggtacaacgtgtgtgccgactgcccagagaacatccggctgattgtgcagaaccctgtggtgaccaagaacatcgccttcaactacatcctggccgaccatgatgaccaggatgtggtgctcttcaacagaggcatgctgcctgcctactacggcatcctgcggctgtgctgtgagcagagccctgccttcacccggcagctggccagccaccagaacatccagtgggccttcaagaacctgaccccccacgccagccagtacccaggagctgtggaggagctgttcaacctgatgcagctgttcatcgcccagaggccagacatgagggaggaggagctggaggacatcaagcagttcaagaagaccaccatcagctgctacctgcgctgccaggccctgatccagtggcaggagagaattgaatttgcccacaagctgctgaccctgctgaacagctacagccccccagagctgagaaatgcctgcattgatgtgctgaaggagctggtgctgctgagcccccatgacttcctgcacaccctggtgcccttcctgcagcacaaccactgcacctaccaccacagcaacatccccatgagcctgggcccctacttcccctgccgggagaacatcaagctgattggaggcaagagcaacatccggccccccaggcctgagctgaacatgtgcctgctgcccaccatggtggagaccagcaagggcaaggatgatgtgtatgacaggatgctgctggactacttcttctcctaccaccagttcatccacctgctgtgccgggtggccatcaactgtgagaagttcacagagaccctggtgaagctgtctgtgctggtggcctatgagggcctgcccctgcacctggccctcttccccaagctgtggacagagctgtgccagacccagagcgccatgagcaagaactgcatcaagctgctgtgtgaggaccctgtgtttgctgagtacatcaagtgcatcctgatggatgagaggaccttcctgaacaacaacatcgtgtacaccttcatgacccacttcctgctgaaggtgcagagccaggtgttttctgaggccaactgtgccaacctgatcagcaccctcatcaccaacctgatcagccagtaccagaacctgcagagcgacttcagcaacagagtggagatcagcaaggccagcgccagcctgaatggagacctgcgggccctggccctgctgctgtctgtgcacacccccaagcagctgaacccagccctgatccccaccctgcaggagctgctgagcaaatgtaggacctgcctgcagcagaggaacagcctgcaggagcaggaggccaaggagaggaagaccaaggatgatgaaggagccacccccatcaagagaagaagagtgtccagtgatgaggagcacacagtggacagctgcatcagtgacatgaagacagagacccgggaggtgctgacccccaccagcaccagtgacaatgagacccgggacagcagcatcattgatcctggaacagagcaggacctgcccagccctgagaacagctctgtgaaggagtacaggatggaggtgcccagcagcttcagcgaggacatgagcaacatccgcagccagcacgccgaggagcagagcaacaacggccgctatgatgactgcaaggagttcaaggacctgcactgcagcaaggacagcaccctggccgaggaggagagcgagttccccagcaccagcatctctgctgtgctgagtgacctggccgacctgcggagctgtgatggccaggccctgcccagccaggaccctgaggtggccctgagcctgagctgtggccacagccggggcctcttcagccacatgcagcagcacgacatcctggacaccctgtgcaggaccatcgagagcaccatccacgtggtgacccgcatctctggaaaaggaaaccaggccgccagctag

SEQ ID NO: 43066 - DNA, 10641 bp, Artificial Sequence
  Description of Artificial Sequence: Synthetic coding sequence
atgtgtgagaactgtgccgacctggtggaggtgctgaatgagatcagtgatgtggagggcggagatggcctgcagctgaggaaggagcacaccctgaagatcttcacctacatcaacagctggacccagaggcagtgcctgtgctgcttcaaggagtacaagcacctggagatcttcaaccaggtggtgtgtgccctgatcaacctggtgattgcccaggtgcaggtgctgcgggaccagctgtgcaagcactgcaccaccatcaacatcgacagcacctggcaggatgagagcaaccaggccgaggagcccctgaacatcgaccgggagtgcaatgaaggcagcacagagcggcagaagagcattgagaagaagagcaacagcacccgcatctgcaacctgacagaggaggagagcagcaagagcagtgaccccttcagcctgtggagcacagatgagaaggagaagctgctgctgtgtgtggccaagatcttccagatccagttccccctgtacacagcctacaagcacaacacccaccccaccatcgaggacatcagcacccaggagagcaacatcctgggcgccttctgtgacatgaatgatgtggaggtgcccctgcacctgctgcgctacgtgtgcctcttctgtgggaagaatggcctgagcctgatgaaggactgctttgaatatggcaccccagagaccctgcccttcctgattgcccacgccttcatcaccgtggtgagcaacatccgcatctggctgcacatcccagctgtgatgcagcacatcatccccttccgcacctacgtgatccgctacctgtgcaagctgagtgaccaggagctgcggcagagcgctgccaggaacatggctgacctgatgtggagcacagtgaaggagcccctggacaccaccctgtgctttgacaaggagagcctggacctggccttcaagtacttcatgagccccaccctgaccatgaggctggccggcctgagccagatcaccaaccagctgcacaccttcaatgatgtgtgcaacaatgaaagcctggtgtctgacacagagaccagcatcgccaaggagctggccgactggctgatcagcaacaacgtggtggagcacatcttcggccccaacctgcacatcgagatcatcaagcagtgccaggtgatcctgaacttcctggccgctgagggccgcctgagcacccagcacatcgactgcatctgggccgccgcccagctgaagcactgcagccgctacatccatgacctcttccccagcctcatcaagaacctggaccctgtgcccctgcggcacctgctgaacctggtgtctgccctggagcccagcgtgcacacagagcagaccctgtacctggcctccatgctgatcaaggccctgtggaacaatgccctggccgccaaggcccagctgagcaagcagagcagctttgccagcctgctgaacaccaacatccccatcggcaacaagaaggaggaggaggagctgcggaggacagcccccagcccctggagccctgctgccagcccccagagcagtgacaacagcgacacccaccagagcggcggcagtgacatcgagatggatgagcagctgatcaacagaaccaagcacgtgcagcagaggctgagtgacacagaggagagcatgcagggcagcagtgatgaaacagccaacagcggagaagatggcagcagcggccctggcagcagcagcggccacagtgatggcagcagcaatgaggtgaacagcagccacgccagccagagcgctggcagccctggcagcgaggtgcagagcgaggacattgctgacatcgaggccctgaaggaggaggatgaagatgatgaccacggccacaacccccccaagagcagctgtggcacagacctgaggaacaggaagctggagagccaggccggcatctgcctgggggacagccagggcatgtctgaaagaaatggcaccagcagcggcaccgggaaggacctggtgttcaacacagagagcctgcccagcgtggacaacaggatgaggatgctggatgcctgcagccacagtgaagatcctgagcatgacatcagcggggagatgaatgccacccacatcgcccagggcagccaggagagctgcatcaccaggactggagacttcctgggggagaccatcggaaatgagctgttcaactgccggcagttcatcggcccccagcaccaccaccaccaccaccaccaccaccaccaccatgatggccacatggtggatgacatgctgtctgcagatgatgtgtcctgcagcagcagccaggtgtctgccaagtctgagaagaacatggctgactttgatggagaggagagcggctgtgaggaggagctggtgcagatcaacagccacgccgagctgaccagccacctgcagcagcacctgcccaacctggccagcatctaccacgagcacctgagccagggccctgtggtgcacaagcaccagttcaacagcaatgctgtgacagacatcaacctggacaacgtgtgcaagaagggcaacaccctgctgtgggacatcgtgcaggatgaagatgctgtgaacctgtctgagggcctcatcaatgaagctgagaagctgctgtgcagcctggtgtgctggttcacagaccggcagatccgcatgaggttcatcgagggctgcctggagaacctgggcaacaacagatctgtggtgatcagcctgcggctgctgcccaagctgtttggcaccttccagcagtttggcagcagctatgacacccactggatcaccatgtgggccgagaaggagctgaacatgatgaagctgttctttgacaacctggtgtactacatccagacagtgcgggagggccggcagaagcacgccctgtacagccacagcgctgaggtgcaggtgcggctgcagttcctgacctgtgtgttcagcaccctgggcagcccagaccacttccggctgagcctggagcaggtggacatcctgtggcactgcctggtggaggacagtgaatgttatgatgatgccctgcactggttcctgaaccaggtgcgcagcaaggaccagcacgccatgggcatggagacctacaagcacctgttcctggagaagatgccccagctgaagccagagaccatctccatgacaggcctgaacctcttccagcacctgtgcaacctggcccggctggccaccagcgcctatgatggctgcagcaacagcgagctgtgtggcatggaccagttctggggcatcgccctgcgggcccagagcggagatgtgtcccgggccgccatccagtacatcaacagctactacatcaatggcaagacaggcctggagaaggagcaggagttcatcagcaagtgcatggagagcctgatgattgccagcagcagcctggagcaggagagccacagcagcctgatggtgattgaaagaggcctgctgatgctgaagacccacctggaggccttcagaagaagatttgcctaccacctgcggcagtggcagatcgagggcaccggcatcagcagccacctgaaggccctgagtgacaagcagagcctgcccctgcgggtggtgtgccagcctgctggcctgcctgacaagatgaccatcgagatgtaccccagcgaccaggtggccgacctgcgggcagaggtgacccactggtatgagaacctgcagaaggagcagatcaaccagcaggcccagctgcaggagtttggccagagcaacaggaagggggagttccctgggggcctgatgggccctgtgaggatgatcagcagcggccacgagctgaccacagattatgatgagaaggccctgcacgagctgggcttcaaggacatgcagatggtgtttgtgtccctgggcgccccccggcgggagaggaagggggagggcgtgcagctgcctgccagctgcctgcccccaccccagaaggacaacatccccatgctgctgctgctgcaggagccccacctgaccaccctgtttgacctgctggagatgctggccagcttcaagcccccatctgggaaggtggccgtggatgattctgagagcctgcgctgtgaggagctgcacctgcatgctgagaacctgagccggcgggtgtgggagctgctgatgctgctgcccacctgccccaacatgctgatggccttccagaacatcagtgatgagcagagcaatgatggcttcaactggaaggagctgctgaagatcaagagcgcccacaagctgctgtatgccctggagatcatcgaggccctgggcaagcccaacagacgcatcagaagagagagcacaggcagctacagcgacctgtacccagacagtgatgacagcagcgaggaccaggtggagaacagcaagaacagctggagctgcaagtttgtggccgccggcggcctgcagcagctgctggagatcttcaacagcggcatcctggagcccaaggagcaggagagctggacagtgtggcagctggactgcctggcctgcctgctgaagctgatctgccagtttgctgtggaccccagcgacctggacctggcctaccatgatgtgtttgcctggagcggcattgctgagagccacaggaagaggacctggccaggcaagagcaggaaggctgctggggaccacgccaagggcctgcacatcccccggctgacagaggtgttcctggtgctggtgcagggcaccagcctcatccagaggctgatgtctgtggcctacacctatgacaacctggccccccgggtgctgaaggcccagagcgaccacaggagcagacatgaggtgagccactacagcatgtggctgctggtgtcctgggcccactgctgcagcctggtgaagagcagcctggccgacagcgaccacctgcaggactggctgaagaagctgaccctgctgatccctgagacagctgtgagacatgagagctgcagcggcctgtacaagctgagcctgagcggcctggatggaggagacagcatcaacagaagcttcctgctgctggccgccagcaccctgctgaagttcctgcctgatgcccaggccctgaagcccatcagaattgatgattatgaggaggagcccatcctgaagccaggctgcaaggagtacttctggctgctgtgcaagctggtggacaacatccacatcaaggatgccagccagaccaccctgctggacctggatgccctggcccggcacctggccgactgcatccgcagccgggagatcctggaccaccaggatggaaatgtggaggatgatggcctgaccggcctgctgcggctggccacctctgtggtgaagcacaagccacccttcaagttcagccgggagggccaggagttcctgcgggacatcttcaacctgctcttcctgctgcccagcctgaaggaccggcagcagcccaagtgcaagagccacagcagcagagctgctgcctatgacctgctggtggagatggtgaagggctctgtggagaactaccgcctcatccacaactgggtgatggcccagcacatgcagagccacgccccctacaagtgggactactggccccatgaagatgtgcgggcagagtgccgctttgtgggcctgaccaacctgggcgccacctgctacctggccagcaccatccagcagctgtacatgatccctgaggcccggcaggccgtgttcaccgccaagtacagcgaggacatgaagcacaagaccaccctgctggagctgcagaagatgttcacctacctgatggagagcgagtgcaaggcctacaacccccggcccttctgcaagacctacaccatggacaagcagcccctgaacacaggagagcagaaggacatgacagagttcttcacagacctgatcaccaagattgaggagatgagccctgagctgaagaacacagtgaagagcctgtttggaggagtcatcaccaacaacgtggtgtccctggactgtgagcacgtgtcccagacagctgaggagttctacacagtgcgctgccaggtggccgacatgaagaacatctatgagagcctggatgaggtgaccatcaaggacaccctggagggggacaacatgtacacctgcagccactgcggcaagaaggtgcgggcagagaagagggcctgcttcaagaagctgccccgcatcctgtccttcaacaccatgagatacaccttcaacatggtgaccatgatgaaggagaaggtgaacacccacttctccttccccctgcggctggacatgaccccctacacagaggacttcctgatgggcaagtctgagaggaaggagggcttcaaggaggtgtctgaccacagcaaggacagcgagagctatgaatatgacctgattggagtgacagtgcacactggaacagcagatggcggccactactacagcttcatccgggacatcgtgaacccccacgcctacaagaacaacaagtggtacctgttcaatgatgctgaggtgaagccctttgacagcgcccagctggccagcgagtgcttcggcggggagatgaccaccaagacctatgattctgtgacagacaagttcatggacttctcctttgagaagacccacagcgcctacatgctgttctacaagaggatggagcctgaggaggagaatggccgggagtacaagtttgatgtgtcctctgagctgctggagtggatctggcatgacaacatgcagttcctgcaggacaagaacatctttgagcacacctacttcggcttcatgtggcagctgtgcagctgcatccccagcaccctgcctgaccccaaggctgtgtccctgatgacagccaagctgagcaccagctttgtgctggagaccttcatccacagcaaggagaagcccaccatgctgcagtggattgagctgctgaccaagcagttcaacaacagccaggccgcctgtgagtggttcctggacaggatggctgatgatgactggtggcccatgcagatcctgatcaagtgccccaaccagatcgtgcggcagatgttccagaggctgtgcatccacgtgatccagaggctgcggcctgtgcacgcccacctgtacctgcagcccggcatggaggatggcagtgatgacatggacacctctgtggaggacattggaggccgcagctgtgtgaccaggtttgtgaggaccctgctgctgatcatggagcacggcgtgaagccccacagcaagcacctgacagagtactttgccttcctgtatgaatttgccaagatgggagaggaggagagccagttcctgctgagcctgcaggccatcagcaccatggtgcacttctacatgggcaccaagggccctgagaacccccaggtggaggtgctgtctgaggaggagggggaggaggaggaggaggaggaggacatcctgagcctggccgaggagaagtacagacctgctgccctggagaagatgattgccctggtggccctgctggtggagcagagccgctctgagcggcacctgaccctgagccagacagacatggccgccctgactggaggcaagggcttccccttcctgttccagcacatcagagatggcatcaacatccggcagacctgcaacctgatcttcagcctgtgccgctacaacaaccggctggccgagcacatcgtgtccatgctgttcaccagcatcgccaagctgaccccagaggccgccaaccccttcttcaagctgctgaccatgctgatggagtttgctgggggccccccaggcatgcccccatttgccagctacatcctgcagaggatctgggaggtgattgagtacaaccccagccagtgcctggactggctggccgtgcagacccccaggaacaagctggcccacagctgggtgctgcagaacatggagaactgggtggagcgcttcctgctggcccacaactacccccgggtgaggaccagcgctgcctacctgctggtgtccctcatccccagcaacagcttccggcagatgttccgcagcaccaggagcctgcacatccccacccgggacctgcccctgagcccagacaccaccgtggtgctgcaccaggtgtacaacgtgctgctgggcctgctgagccgggccaagctgtatgtggatgctgctgtgcacggcaccaccaagctggtgccctacttctccttcatgacctactgcctgatcagcaagacagagaagctgatgttcagcacctacttcatggacctgtggaacctcttccagcccaagctgtctgagcccgccatcgccaccaaccacaacaagcaggccctgctgtccttctggtacaacgtgtgtgccgactgcccagagaacatccggctgattgtgcagaaccctgtggtgaccaagaacatcgccttcaactacatcctggccgaccatgatgaccaggatgtggtgctcttcaacagaggcatgctgcctgcctactacggcatcctgcggctgtgctgtgagcagagccctgccttcacccggcagctggccagccaccagaacatccagtgggccttcaagaacctgaccccccacgccagccagtacccaggagctgtggaggagctgttcaacctgatgcagctgttcatcgcccagaggccagacatgagggaggaggagctggaggacatcaagcagttcaagaagaccaccatcagctgctacctgcgctgcctggatggccgcagctgctggaccaccctcatcagcgccttccgcatcctgctggagagtgatgaagatcggctgctggtggtgttcaacagaggcctcatcctgatgacagagagcttcaacaccctgcacatgatgtaccacgaggccacagcctgccacgtgactggagacctggtggagctgctgagcatcttcctgtctgtgctgaagagcacccggccctacctgcagaggaaggatgtgaagcaggccctgatccagtggcaggagcgcatcgagtttgcccacaagctgctgaccctgctgaacagctacagccccccagagctgagaaatgcctgcattgatgtgctgaaggagctggtgctgctgagcccccatgacttcctgcacaccctggtgcccttcctgcagcacaaccactgcacctaccaccacagcaacatccccatgagcctgggcccctacttcccctgccgggagaacatcaagctgattggaggcaagagcaacatccggccccccaggcctgagctgaacatgtgcctgctgcccaccatggtggagaccagcaagggcaaggatgatgtgtatgacaggatgctgctggactacttcttctcctaccaccagttcatccacctgctgtgccgggtggccatcaactgtgagaagttcacagagaccctggtgaagctgtctgtgctggtggcctatgagggcctgcccctgcacctggccctcttccccaagctgtggacagagctgtgccagacccagagcgccatgagcaagaactgcatcaagctgctgtgtgaagatcctgtgtttgctgagtacatcaagtgcatcctgatggatgagaggaccttcctgaacaacaacatcgtgtacaccttcatgacccacttcctgctgaaggtgcagagccaggtgttcagcgaggccaactgtgccaacctgatcagcaccctcatcaccaacctgatcagccagtaccagaacctgcagagcgacttcagcaacagagtggagatcagcaaggccagcgccagcctgaatggagacctgcgggccctggccctgctgctgtctgtgcacacccccaagcagctgaacccagccctgatccccaccctgcaggagctgctgagcaagtgcaggacctgcctgcagcagaggaacagcctgcaggagcaggaggccaaggagaggaagaccaaggatgatgagggcgccacccccatcaagagaagaagagtgtccagtgatgaggagcacacagtggacagctgcatcagtgacatgaagacagagacccgggaggtgctgacccccaccagcaccagtgacaatgagacccgggacagcagcatcatcgaccccggcacagagcaggacctgcccagccctgagaacagctctgtgaaggagtacaggatggaggtgcccagcagcttcagcgaggacatgagcaacatccgcagccagcacgccgaggagcagagcaacaacggccgctatgatgactgcaaggagttcaaggacctgcactgcagcaaggacagcaccctggccgaggaggagagcgagttccccagcaccagcatctctgctgtgctgagtgacctggccgacctgcggagctgtgatggccaggccctgcccagccaggaccctgaggtggccctgagcctgagctgtggccacagccggggcctcttcagccacatgcagcagcacgacatcctggacaccctgtgcaggaccatcgagagcaccatccacgtggtgacccgcatcagcggcaagggcaaccaggccgccagctag

SEQ ID NO: 43067 - DNA, 1815 bp, Artificial Sequence
  Description of Artificial Sequence: Synthetic coding sequence
atgcctggcctgcggcggcgggcctcctggagggtgtccatccctggctcctggcccagccagacccgggcccggctggtgagcagcacctgggccacccacgccatgagcacagccagcttccggccctacagctggaggctgagcagcttccgccactgtgtgctgcggctgacagagaacaacagccagcccctgatgaccaagctgcagtggctgtttggcttcctggagcacagccagaggcctgccatcagccctgagaacttcctgagcgcctcctggaccccctggttcagccctggcacccagcaggactgcagcgagtacctgaagtacctgctggaccggctgcacgaggaggagaagacaggcacccgcatctgccagaagctgaagcagagcagcagccccagccccccagaggagcccccagcccccagcagcacctctgtggagaagatgtttggaggcaagatcgtgacccgcatctgctgcctgtgctgcctgaatgtgagcagccgggaggaggccttcacagacctgagcctggccttccccccacctgagcgctgcagaagaagaaggctgggctctgtgatgaggcccacagaggacatcacagcccgggagctgcccccacccaccagcgcccagggccctggccgggtgggcccccggcggcagaggaagcactgcatcacagaggacaccccacccaccagcctgtacatcgagggcctggacagcaaggaggccggcggccagagcagccaggaggagagaattgagcgggaggaggagggcaaggaggagaggacagagaaggaggaggtgggggaggaggaggagagcaccagaggagagggggagcgggagaaggaggaggaggtggaggaggaggaggagaaggtggagaaggagacagagaaggaggccgagcaggagaaggaggaggacagcctgggcgccggcacccacccagatgctgccatccccagcggggagaggacctgtggcagcgagggcagccgctctgtgctggacctggtgaactacttcctgagccctgagaagctgacagcagaaaatcgctactactgtgagagctgtgccagcctgcaggatgctgagaaggtggtggagctgagccagggcccctgctacctgatcctgaccctgctgcgcttctcctttgacctgcggaccatgagaagaaggaagatcctggatgatgtgtccatccccctgctgctgcggctgcccctggccggcggccggggccaggcctatgacctgtgcagcgtggtggtgcacagcggcgtgagcagcgagagcggccactactactgctacgcccgggagggcgccgcccggcctgctgccagcctgggcacagctgacaggcctgagcctgagaaccagtggtacctgttcaatgacaccagggtgtccttcagcagctttgaatctgtgtccaatgtgaccagcttcttccccaaggacacagcctacgtgctcttctaccggcagaggccccgggagggccctgaggccgagctgggcagcagccgggtgaggacagagcccaccctgcacaaggacctgatggaggccatcagcaaggacaacatcctgtacctgcaggagcaggagaaggaggcccggagcagagctgcctacatcagcgccctgcccaccagcccccactggggccggggctttgatgaggacaaggatgaagatgagggcagccctgggggctgcaacccagctggaggaaatggaggagacttccaccggctggtgttctag

SEQ ID NO: 43068 - DNA, 3057 bp, Artificial Sequence
  Description of Artificial Sequence: Synthetic coding sequence
atggacaagatcctggaggccgtggtgaccagcagctaccctgtgtctgtgaagcagggcctggtgagaagagtgctggaggccgcccggcagcccctggagcgggagcagtgcctggccctgctggccctgggcgcccggctgtatgtgggcggcgctgaggagctgccccggcgggtgggctgccagctgctgcacgtggccggccgccaccacccagatgtgtttgctgagttcttcagcgccaggagagtgctgcggctgctgcagggcggggccggccccccaggcccccgggccctggcctgtgtgcagctgggcctgcagctgctgcctgagggccctgctgctgatgaggtgtttgccctgctgcggcgggaggtgctgaggacagtgtgtgagcggcccggccctgctgcctgtgcccaggtggcccggctgctggcccggcacccccgctgtgtgcctgatggcccccaccggctgctcttctgccagcagctggtgcgctgcctgggccgcttccgctgcccagctgagggggaggagggcgctgtggagttcctggagcaggcccagcaggtgtctggcctgctggcccagctgtggagggcccagcctgctgccatcctgccctgcctgaaggagctgtttgctgtgatcagctgtgccgaggaggagccccccagcagcgccctggcctctgtggtgcagcacctgcccctggagctgatggatggagtggtgaggaacctgagcaatgatgattctgtgacagacagccagatgctgacagccatcagcaggatgattgactgggtgtcctggcccctgggcaagaacatcgacaagtggatcatcgccctgctgaagggcctggccgctgtgaagaagttcagcatcctgattgaggtgtccctgaccaagattgagaaggtgttcagcaagctgctgtaccccatcgtgagaggagctgccctgtctgtgctgaagtacatgctgctgaccttccagcacagccatgaggccttccacctgctgctgccccacatcccccccatggtggccagcctggtgaaggaggacagcaacagcggcaccagctgcctggagcagctggccgagctggtgcactgcatggtgttccgcttccctggcttcccagacctgtatgagcctgtgatggaggccatcaaggacctgcacgtgcccaatgaagatcgcatcaagcagctgctgggccaggatgcctggaccagccagaagtctgagctggccggcttctacccccggctgatggccaagagtgacaccgggaagattggcctcatcaacctgggcaacacctgctacgtgaacagcatcctgcaggccctcttcatggccagtgacttccgccactgtgtgctgcggctgacagagaacaacagccagcccctgatgaccaagctgcagtggctgtttggcttcctggagcacagccagaggcctgccatcagccctgagaacttcctgagcgcctcctggaccccctggttcagccctggcacccagcaggactgcagcgagtacctgaagtacctgctggaccggctgcacgaggaggagaagacaggcacccgcatctgccagaagctgaagcagagcagcagccccagccccccagaggagcccccagcccccagcagcacctctgtggagaagatgtttggaggcaagatcgtgacccgcatctgctgcctgtgctgcctgaatgtgagcagccgggaggaggccttcacagacctgagcctggccttccccccacctgagcgctgcagaagaagaaggctgggctctgtgatgaggcccacagaggacatcacagcccgggagctgcccccacccaccagcgcccagggccctggccgggtgggcccccggcggcagaggaagcactgcatcacagaggacaccccacccaccagcctgtacatcgagggcctggacagcaaggaggccggcggccagagcagccaggaggagagaattgagcgggaggaggagggcaaggaggagaggacagagaaggaggaggtgggggaggaggaggagagcaccagaggagagggggagcgggagaaggaggaggaggtggaggaggaggaggagaaggtggagaaggagacagagaaggaggccgagcaggagaaggaggaggacagcctgggcgccggcacccacccagatgctgccatccccagcggggagaggacctgtggcagcgagggcagccgctctgtgctggacctggtgaactacttcctgagccctgagaagctgacagcagaaaatcgctactactgtgagagctgtgccagcctgcaggatgctgagaaggtggtggagctgagccagggcccctgctacctgatcctgaccctgctgcgcttctcctttgacctgcggaccatgagaagaaggaagatcctggatgatgtgtccatccccctgctgctgcggctgcccctggccggcggccggggccaggcctatgacctgtgcagcgtggtggtgcacagcggcgtgagcagcgagagcggccactactactgctacgcccgggagggcgccgcccggcctgctgccagcctgggcacagctgacaggcctgagcctgagaaccagtggtacctgttcaatgacaccagggtgtccttcagcagctttgaatctgtgtccaatgtgaccagcttcttccccaaggacacagcctacgtgctcttctaccggcagaggccccgggagggccctgaggccgagctgggcagcagccgggtgaggacagagcccaccctgcacaaggacctgatggaggccatcagcaaggacaacatcctgtacctgcaggagcaggagaaggaggcccggagcagagctgcctacatcagcgccctgcccaccagcccccactggggccggggctttgatgaggacaaggatgaagatgagggcagccctgggggctgcaacccagctggaggaaatggaggagacttccaccggctggtgttctag

SEQ ID NO: 43069 - DNA, 3129 bp, Artificial Sequence
  Description of Artificial Sequence: Synthetic coding sequence
atggacaagatcctggagggcctggtgagcagcagccaccccctgcccctgaagagggtgattgtgaggaaggtggtggagagcgctgagcactggctggatgaggcccagtgtgaggccatgtttgacctgaccaccaggctcatcctggagggccaggaccccttccagaggcaggtgggccaccaggtgctggaggcctatgcccgctaccacaggcctgagtttgagagcttcttcaacaagacctttgtgctgggcctgctgcaccagggctaccacagcctggacaggaaggatgtggccatcctggactacatccacaacggcctgaagctgatcatgagctgccccagcgtgctggacctcttcagcctgctgcaggtggaggtgctgaggatggtgtgtgagaggcctgagccccagctgtgtgcccggctgagtgacctgctgacagactttgtgcagtgcatccccaagggcaagctgagcatcaccttctgccagcagctggtgaggaccatcggccacttccagtgtgtgtccacccaggagcgggagctgcgggagtatgtgtcccaggtgaccaaggtgagcaacctgctgcagaacatctggaaggccgagcccgccaccctgctgcccagcctgcaggaggtgtttgccagcatcagcagcacagatgccagctttgagcccagcgtggccctggccagcctggtgcagcacatccccctgcagatgatcaccgtgctgatccgcagcctgaccacagaccccaacgtgaaggatgcctccatgacccaggccctgtgcaggatgattgactggctgtcctggcccctggcccagcacgtggacacctgggtgattgccctgctgaagggcctggccgctgtgcagaagttcaccatcctgattgatgtgaccctgctgaagattgagctggtgttcaaccggctgtggttccccctggtgcggcctggggccctggccgtgctgagccacatgctgctgtccttccagcacagccctgaggccttccacctgattgtgccccacgtggtgaacctggtgcacagcttcaagaatgatggcctgcccagcagcacagccttcctggtgcagctgacagagctgatccactgcatgatgtaccactacagcggcttcccagacctgtatgagcccatcctggaggccatcaaggacttccccaagcccagcgaggagaagatcaagctgatcctgaaccagagcgcctggaccagccagagcaacagcctggccagctgcctgagccggctgagcggcaagtctgagaccgggaagacaggcctcatcaacctgggcaacacctgctacatgaacagcgtcatccaggccctcttcatggccacagacttccggcggcaggtgctgagcctgaacctgaatggctgcaacagcctgatgaagaagctgcagcacctgtttgccttcctggcccacacccagcgggaggcctatgccccccgcatcttctttgaggccagccggcccccctggttcacccccaggagccagcaggactgcagcgagtacctgcgcttcctgctggaccggctgcacgaggaggagaagatcctgaaggtgcaggccagccacaagcccagcgagatcctggagtgcagcgagaccagcctgcaggaggtggccagcaaggctgctgtgctgacagagacccccaggaccagtgatggagagaagaccctcatcgagaagatgtttggaggcaagctgcggacccacatccgctgcctgaactgccgcagcaccagccagaaggtggaggccttcacagacctgagcctggccttctgccccagcagcagcctggagaacatgtctgtgcaggaccctgccagcagccccagcatccaggacggcggcctgatgcaggcctctgtgcccggccccagcgaggagcctgtggtgtacaaccccaccacagctgccttcatctgtgacagcctggtgaatgagaagaccatcggcagccccccaaatgagttctactgcagcgagaacacctctgtgcccaatgaaagcaacaagatcctggtgaacaaggatgtgccccagaagccaggaggagagaccaccccatctgtgacagacctgctgaactacttcctggcccctgagatcctgaccggggacaaccagtactactgtgagaactgtgccagcctgcagaatgctgagaagaccatgcagatcacagaggagcctgagtacctgatcctgaccctgctgcgcttctcctatgaccagaagtaccacgtgcggaggaagatcctggacaacgtgtccctgcccctggtgctggagctgcctgtgaagaggatcaccagcttcagcagcctgtctgagagctggagcgtggatgtggacttcacagacctgtctgagaacctggccaagaagctgaagcccagcggcacagatgaggccagctgcaccaagctggtgccctacctgctgagctctgtggtggtgcacagcggcatcagcagcgagagcggccactactacagctatgccaggaacatcaccagcacagacagcagctaccagatgtaccaccagagcgaggccctggccctggccagcagccagagccacctgctgggccgggacagccccagcgctgtgtttgagcaggacctggagaacaaggagatgagcaaggagtggttcctgttcaatgacagccgggtgaccttcaccagcttccagagcgtgcagaagatcaccagccgcttccccaaggacacagcctacgtgctgctgtacaagaagcagcacagcaccaacggcctgagcggcaacaaccccaccagcggcctgtggatcaatggagacccccccctgcagaaggagctgatggatgccatcaccaaggacaacaagctgtacctgcaggagcaggagctgaatgcccgggcccgggccctgcaggccgccagcgccagctgcagcttccggcccaacggctttgatgacaatgaccccccaggcagctgtggccccaccggcggcggcggcggcggcggcttcaacacagtgggccgcctggtgttctag

SEQ ID NO: 43070 - DNA, 3708 bp, Artificial Sequence
  Description of Artificial Sequence: Synthetic coding sequence
atgtttggagacctgtttgaggaggagtacagcacagtgagcaacaaccagtatggcaagggcaagaagctgaagaccaaggccctggagcccccagccccccgggagttcaccaacctgagcggcatccggaaccagggcggcacctgctacctgaacagcctgctgcagaccctgcacttcaccccagagttccgggaggccctcttcagcctgggccctgaggagctgggcctgtttgaggacaaggacaagccagatgccaaggtgcgcatcatccccctgcagctgcagaggctgtttgcccagctgctgctgctggaccaggaggccgccagcacagctgacctgacagacagctttggctggaccagcaatgaggagatgaggcagcatgatgtgcaggagctgaaccgcatcctcttcagcgccctggagaccagcctggtgggcaccagcggccatgacctgatctaccgcctgtaccacggcaccatcgtgaaccagatcgtgtgcaaggagtgcaagaatgtgtctgagcggcaggaggacttcctggacctgactgtggccgtgaagaatgtgtctggcctggaggatgccctgtggaacatgtatgtggaggaggaggtgtttgactgtgacaacctgtaccactgcggcacctgtgaccggctggtgaaggccgccaagagcgccaagctgaggaagctgccccccttcctgactgtgtccctgctgcgcttcaactttgattttgtgaagtgtgagcgctacaaggagaccagctgctacaccttccccctgcgcatcaacctgaagcccttctgtgagcagagcgagctggatgacctggagtacatctatgacctcttcagcgtcatcatccacaagggcggctgctacggcggccactaccacgtgtacatcaaggatgtggaccacctgggcaactggcagttccaggaggagaagagcaagccagatgtgaacctgaaggacctgcagagcgaggaggagattgaccaccccctgatgatcctgaaggccatcctgctggaggagaacaacctgatccctgtggaccagctgggccagaagctgctgaagaagattggcatctcctggaacaagaagtacaggaagcagcacggccccctgaggaagttcctgcagctgcacagccagatcttcctgctgagcagtgatgagagcacagtgcggctgctgaagaacagcagcctgcaggccgagagtgacttccagagaaatgaccagcagatcttcaagatgctgcccccagagagccctggcctgaacaacagcatcagctgcccccactggtttgacatcaatgacagcaaggtgcagcccatccgggagaaggacatcgagcagcagttccagggcaaggagagcgcctacatgctgttctacaggaagagccagctgcagaggcctcctgaggcccgggccaaccccaggtatggagtgccctgccacctgctgaatgagatggatgctgccaacatcgagctgcagaccaagagagcagaatgtgacagcgccaacaacacctttgagctgcacctgcacctgggcccccagtaccacttcttcaatggagccctgcaccctgtggtgtcccagacagaatctgtgtgggacctgacctttgacaagaggaagaccctgggggacctgcggcagagcatcttccagctgctggagttctgggagggggacatggtgctgtctgtggccaagctggtgcctgctggcctgcacatctaccagagcctgggcggagatgagctgaccctgtgtgaaacagaaattgctgatggagaggacatctttgtgtggaatggagtggaggtgggcggcgtgcacatccagacaggcatcgactgtgagcccctgctgctgaatgtgctgcacctggacaccagcagtgatggagagaagtgctgccaggtgattgagagcccccacgtgtttcctgccaatgctgaggtgggcaccgtgctgacagccctggccatcccagctggggtcatcttcatcaacagcgctggctgccctggaggagagggctggacagccatccccaaggaggacatgaggaagaccttccgggagcagggcctgagaaatggcagcagcatcctgatccaggacagccatgatgacaacagcctgctgaccaaggaggagaagtgggtgacctccatgaatgaaattgactggctgcacgtgaagaacctgtgccagctggagagcgaggagaagcaggtgaagatcagcgccaccgtgaacaccatggtgtttgacatccgcatcaaggccatcaaggagctgaagctgatgaaggagctggccgacaacagctgcctgcggcccatcgacagaaatggcaagctgctgtgccctgtgcctgacagctacaccctgaaggaggccgagctgaagatgggcagcagcctgggcctgtgcctgggcaaggcccccagcagcagccagctgttcctgttctttgccatgggcagtgatgtgcagcccggcacagagatggagatcgtggtggaggagaccatctctgtgcgggactgcctgaagctgatgctgaagaagagcggcctgcagggagatgcctggcacctgaggaagatggactggtgctatgaagctggggagcccctgtgtgaggaggatgccaccctgaaggagctgctgatctgcagcggggacaccctgctgctgattgagggccagctgccccccctgggcttcctgaaggtgcccatctggtggtaccagctgcagggccccagcggccactgggagagccaccaggaccagaccaactgcaccagctcctggggccgggtgtggagggccaccagcagccagggcgccagcggaaatgagcccgcccaggtgtccctgctgtacctgggggacatcgagatcagtgaagatgccaccctggccgagctgaagagccaggccatgaccctgccccccttcctggagtttggagtgcccagccctgcccacctgcgggcctggacagtggagaggaagaggcctggccgcctgctgaggacagaccggcagcccctgcgggagtacaagctgggcagaagaattgagatctgcctggagcccctgcagaagggggagaacctgggcccccaggatgtgctgctgcggacccaggtgcgcatccctggagagaggacctacgccccagccctggacctggtgtggaatgctgcccagggcggcacagctggcagcctgcggcagagggtggccgacttctaccgcctgcctgtggagaagattgaaattgccaagtacttccctgagaagtttgagtggctgcccatcagctcctggaaccagcagatcaccaagaggaagaagaagaagaagcaggactacctgcagggcgccccctactacctgaaggatggagacaccatcggcgtgaagaacctgctgattgatgatgatgatgacttcagcaccatcagagatgacaccgggaaggagaagcagaagcagagggccctgggccgcaggaagagccaggaggccctgcacgagcagagcagctacatcctgagcagcgctgagaccccagcccggccccgggcccctgagaccagcctgagcatccacgtgggcagcttcagatag

SEQ ID NO: 43071 - DNA, 492 bp, Artificial Sequence
  Description of Artificial Sequence: Synthetic coding sequence
atgggcagcagcctgggcctgtgcctgggcaaggcccccagcagcagccagctgttcctgttctttgccatgggcagtgatgtgcagcccggcacagagatggagatcgtggtggaggagaccatctctgtgcgggactgcctgaagctgatgctgaagaagagcggcctgcagggagatgcctggcacctgaggaagatggactggtgctatgaagctggggagcccctgtgtgaggaggatgccaccctgaaggagctgctgatctgcagcggggacaccctgctgctgattgagggccagctgccccccctgggcttcctgaaggtgcccatctggtggtaccagctgcagggccccagcggccactgggagagccaccaggaccagaccaactgcaccagctcctggggccgggtgtggagggccaccagcagccagggagaaaataggatgggcttccagcagcctgtgcaccacaaggagaagtag

SEQ ID NO: 43072 - DNA, 3708 bp, Artificial Sequence; identical to SEQ ID NO: 43070
  Description of Artificial Sequence: Synthetic coding sequence

SEQ ID NO: 43073 - DNA, 987 bp, Artificial Sequence
  Description of Artificial Sequence: Synthetic coding sequence
atgtttggagacctgtttgaggaggagtacagcacagtgagcaacaaccagtatggcaagggcaagaagctgaagaccaaggccctggagcccccagccccccgggagttcaccaacctgagcggcatccggaaccagggcggcacctgctacctgaacagcctgctgcagaccctgcacttcaccccagagttccgggaggccctcttcagcctgggccctgaggagctgggcctgtttgaggacaaggacaagccagatgccaaggtgcgcatcatccccctgcagctgcagaggctgtttgcccagctgctgctgctggaccaggaggccgccagcacagctgacctgacagacagctttggctggaccagcaatgaggagatgaggcagcatgatgtgcaggagctgaaccgcatcctcttcagcgccctggagaccagcctggtgggcaccagcggccatgacctgatctaccgcctgtaccacggcaccatcgtgaaccagatcgtgtgcaaggagtgcaagaatgtgtctgagcggcaggaggacttcctggacctgactgtggccgtgaagaatgtgtctggcctggaggatgccctgtggaacatgtatgtggaggaggaggtgtttgactgtgacaacctgtaccactgcggcacctgtgaccggctggtgaaggccgccaagagcgccaagctgaggaagctgccccccttcctgactgtgtccctgctgcgcttcaactttgattttgtgaagtgtgagcgctacaaggagaccagctgctacaccttccccctgcgcatcaacctgaagcccttctgtgagcagagcgagctggatgacctggagtacatgaccagcagccagctgctgtacaccaaggtggccgccacagaggccatcaccatgtacatcctgaagatgctgatcatctgggagaccggcagcttcaagaggaagaaggtgaaccagatgtag

SEQ ID NO: 43074 - DNA, 3744 bp, Artificial Sequence
  Description of Artificial Sequence: Synthetic coding sequence
atgagcctcttcctgcgggtggtgttctccttcaccatgtttggagacctgtttgaggaggagtacagcacagtgagcaacaaccagtatggcaagggcaagaagctgaagaccaaggccctggagcccccagccccccgggagttcaccaacctgagcggcatccggaaccagggcggcacctgctacctgaacagcctgctgcagaccctgcacttcaccccagagttccgggaggccctcttcagcctgggccctgaggagctgggcctgtttgaggacaaggacaagccagatgccaaggtgcgcatcatccccctgcagctgcagaggctgtttgcccagctgctgctgctggaccaggaggccgccagcacagctgacctgacagacagctttggctggaccagcaatgaggagatgaggcagcatgatgtgcaggagctgaaccgcatcctcttcagcgccctggagaccagcctggtgggcaccagcggccatgacctgatctaccgcctgtaccacggcaccatcgtgaaccagatcgtgtgcaaggagtgcaagaatgtgtctgagcggcaggaggacttcctggacctgactgtggccgtgaagaatgtgtctggcctggaggatgccctgtggaacatgtatgtggaggaggaggtgtttgactgtgacaacctgtaccactgcggcacctgtgaccggctggtgaaggccgccaagagcgccaagctgaggaagctgccccccttcctgactgtgtccctgctgcgcttcaactttgattttgtgaagtgtgagcgctacaaggagaccagctgctacaccttccccctgcgcatcaacctgaagcccttctgtgagcagagcgagctggatgacctggagtacatctatgacctcttcagcgtcatcatccacaagggcggctgctacggcggccactaccacgtgtacatcaaggatgtggaccacctgggcaactggcagttccaggaggagaagagcaagccagatgtgaacctgaaggacctgcagagcgaggaggagattgaccaccccctgatgatcctgaaggccatcctgctggaggagaacaacctgatccctgtggaccagctgggccagaagctgctgaagaagattggcatctcctggaacaagaagtacaggaagcagcacggccccctgaggaagttcctgcagctgcacagccagatcttcctgctgagcagtgatgagagcacagtgcggctgctgaagaacagcagcctgcaggccgagagtgacttccagagaaatgaccagcagatcttcaagatgctgcccccagagagccctggcctgaacaacagcatcagctgcccccactggtttgacatcaatgacagcaaggtgcagcccatccgggagaaggacatcgagcagcagttccagggcaaggagagcgcctacatgctgttctacaggaagagccagctgcagaggcctcctgaggcccgggccaaccccaggtatggagtgccctgccacctgctgaatgagatggatgctgccaacatcgagctgcagaccaagagagcagaatgtgacagcgccaacaacacctttgagctgcacctgcacctgggcccccagtaccacttcttcaatggagccctgcaccctgtggtgtcccagacagaatctgtgtgggacctgacctttgacaagaggaagaccctgggggacctgcggcagagcatcttccagctgctggagttctgggagggggacatggtgctgtctgtggccaagctggtgcctgctggcctgcacatctaccagagcctgggcggagatgagctgaccctgtgtgaaacagaaattgctgatggagaggacatctttgtgtggaatggagtggaggtgggcggcgtgcacatccagacaggcatcgactgtgagcccctgctgctgaatgtgctgcacctggacaccagcagtgatggagagaagtgctgccaggtgattgagagcccccacgtgtttcctgccaatgctgaggtgggcaccgtgctgacagccctggccatcccagctggggtcatcttcatcaacagcgctggctgccctggaggagagggctggacagccatccccaaggaggacatgaggaagaccttccgggagcagggcctgagaaatggcagcagcatcctgatccaggacagccatgatgacaacagcctgctgaccaaggaggagaagtgggtgacctccatgaatgaaattgactggctgcacgtgaagaacctgtgccagctggagagcgaggagaagcaggtgaagatcagcgccaccgtgaacaccatggtgtttgacatccgcatcaaggccatcaaggagctgaagctgatgaaggagctggccgacaacagctgcctgcggcccatcgacagaaatggcaagctgctgtgccctgtgcctgacagctacaccctgaaggaggccgagctgaagatgggcagcagcctgggcctgtgcctgggcaaggcccccagcagcagccagctgttcctgttctttgccatgggcagtgatgtgcagcccggcacagagatggagatcgtggtggaggagaccatctctgtgcgggactgcctgaagctgatgctgaagaagagcggcctgcagggagatgcctggcacctgaggaagatggactggtgctatgaagctggggagcccctgtgtgaggaggatgccaccctgaaggagctgctgatctgcagcggggacaccctgctgctgattgagggccagctgccccccctgggcttcctgaaggtgcccatctggtggtaccagctgcagggccccagcggccactgggagagccaccaggaccagaccaactgcaccagctcctggggccgggtgtggagggccaccagcagccagggcgccagcggaaatgagcccgcccaggtgtccctgctgtacctgggggacatcgagatcagtgaagatgccaccctggccgagctgaagagccaggccatgaccctgccccccttcctggagtttggagtgcccagccctgcccacctgcgggcctggacagtggagaggaagaggcctggccgcctgctgaggacagaccggcagcccctgcgggagtacaagctgggcagaagaattgagatctgcctggagcccctgcagaagggggagaacctgggcccccaggatgtgctgctgcggacccaggtgcgcatccctggagagaggacctacgccccagccctggacctggtgtggaatgctgcccagggcggcacagctggcagcctgcggcagagggtggccgacttctaccgcctgcctgtggagaagattgaaattgccaagtacttccctgagaagtttgagtggctgcccatcagctcctggaaccagcagatcaccaagaggaagaagaagaagaagcaggactacctgcagggcgccccctactacctgaaggatggagacaccatcggcgtgaagaacctgctgattgatgatgatgatgacttcagcaccatcagagatgacaccgggaaggagaagcagaagcagagggccctgggccgcaggaagagccaggaggccctgcacgagcagagcagctacatcctgagcagcgctgagaccccagcccggccccgggcccctgagaccagcctgagcatccacgtgggcagcttcagatag

SEQ ID NO: 43075 - DNA, 1074 bp, Artificial Sequence
  Description of Artificial Sequence: Synthetic coding sequence
atggatggagtgctcttccgggcccaccagtgccagtatgtgcacccctgtgtgcacgtgtatgtgacagtgggcctgatggaccccctgtgcctgcagaggcacaaggagcacgccaagggccgggagcccccctgcccagccctgagcaccagcggcctggtgggcctgcacaacatcggccagacctgctgcctgaacagcctcatccaggtgtttgtgatgaatgtggactttgcccgcatcctgaagaggatcaccgtgcccagaggagcagatgagcagaggagatctgtgcccttccagatgctgctgctgctggagaagatgcaggacagccggcagaaggctgtgtggcccctggagctggcctactgcctgcagaagtacaacgtgcccctgtttgtgcagcatgatgctgcccagctgtacctgaagctgtggaacctgatcaaggaccagattgctgatgtgcacctggtggagcggctgcaggccctgtacatgatccgcatgaaggacagcctcatctgcctggactgtgccatggagagcagcaggaacagctccatgctgaccctgcggctgtccttctttgatgtggacagcaagcccctgaagaccctggaggatgccctgcactgcttcttccagccccgggagctgagcagcaagagcaagtgcttctgtgagaactgtgggaagaagacccggggcaagcaggtgctgaagctgacccacctgccccagaccctgaccatccacctgatgaggttcagcatccggaacagccagaccaggaagatctgccacagcctgtacttcccccagagcctggacttcagccagatcctgcccatgaagcgggagagctgtgatgctgaggagcagagcggcggccagtatgagctgtttgctgtgattgcccacgtgggcatggctgacagcggccactactgtgtgtacatcagaaatgctgtggatggcaagtggttctgcttcaatgacagcaacatctgcctggtgtcctgggaggacatccagtgcacctacggcaaccccaactaccactag

SEQ ID NO: 43076 - DNA, 3951 bp, Artificial Sequence
  Description of Artificial Sequence: Synthetic coding sequence
atgaccatcgtggacaaggccagcgagagcagtgaccccagcgcctaccagaaccagcccggcagcagcgaggccgtgtcccctggggacatggatgctggcagcgcctcctggggcgctgtgagcagcctgaatgatgtgagcaaccacaccctgagcctgggccctgtgcctggagctgtggtgtacagcagcagctctgtgcctgacaagagcaagcccagcccccagaaggaccaggccctgggagatggcatcgccccaccccagaaggtgctcttccccagcgagaagatctgcctgaagtggcagcagacccaccgggtgggcgccggcctgcagaacctgggcaacacctgctttgccaatgctgccctgcagtgcctgacctacaccccacccctggccaactacatgctgagccatgagcacagcaagacctgccacgccgagggcttctgcatgatgtgcaccatgcaggcccacatcacccaggccctgagcaaccctggagatgtgatcaagcccatgtttgtgatcaatgagatgaggcgcatcgcccggcacttccgcttcggcaaccaggaggatgcccacgagttcctgcagtacacagtggatgccatgcagaaggcctgcctgaatggcagcaacaagctggacagacacacccaggccaccaccctggtgtgccagatctttggaggctacctgcggagccgggtgaagtgcctgaactgcaagggcgtgtctgacacctttgacccctacctggacatcaccctggagatcaaggccgcccagagcgtgaacaaggccctggagcagtttgtgaagccagagcagctggatggagagaacagctacaagtgcagcaagtgcaagaagatggtgcctgccagcaagcgcttcaccatccacaggagcagcaatgtgctgaccctgagcctgaagagatttgccaacttcaccggcggcaagatcgccaaggatgtgaagtacccagagtacctggacatccggccctacatgagccagcccaacggggagcccatcgtgtatgtgctgtatgctgtgctggtgcacacaggcttcaactgccacgccggccactacttctgctacatcaaggccagcaatggcctgtggtaccagatgaatgacagcatcgtgtccaccagtgacatccgctctgtgctgagccagcaggcctacgtgctcttctacatccgcagccatgatgtgaagaatggaggagagctgacccaccccacccacagccctggccagagcagccccaggcctgtgatcagccagagggtggtgaccaacaagcaggccgcccctggcttcatcggcccccagctgcccagccacatgatcaagaaccccccccacctgaatggcaccggccccctgaaggacacccccagcagctccatgagcagccccaatggaaacagctctgtgaacagagccagccctgtgaatgccagcgcctctgtgcagaactggagcgtgaacagaagcagcgtcatccctgagcaccccaagaagcagaagatcaccatcagcatccacaacaagctgcctgtgcggcagtgccagagccagcccaacctgcacagcaacagcctggagaaccccaccaagcctgtgcccagcagcaccatcaccaacagcgctgtgcagagcaccagcaatgccagcaccatgtctgtgagcagcaaggtgaccaagcccatccccaggtctgagagctgcagccagcctgtgatgaatggcaagagcaagctgaacagctctgtgctggtgccctatggagctgagagcagtgaagattctgatgaggagagcaagggcctgggcaaggaaaatggcatcggcaccatcgtgagcagccacagccctggccaggatgctgaagatgaggaggccacccctcatgagctgcaggagcccatgaccctgaatggagccaacagcgctgacagcgacagcgaccccaaggaaaatggcctggccccagatggagccagctgccagggccagcctgccctgcacagcgagaacccctttgccaaggccaacggcctgcccgggaagctgatgcctgcccccctgctgagcctgcctgaggacaagatcctggagaccttccggctgagcaacaagctgaagggcagcacagatgagatgtctgcccctggagctgagcggggccccccagaggacagagatgctgagccccagcccggcagccctgctgctgagagcctggaggagccagatgctgctgctggcctgagcagcaccaagaaggcccccccaccccgggaccccggcaccccagccaccaaggagggcgcctgggaggccatggctgtggcccctgaggagcccccacccagcgctggagaagatattgtgggggacacagcccccccagacctgtgtgaccccggcagcctgactggagatgccagccccctgagccaggatgccaagggcatgattgctgagggcccccgggacagcgccctggccgaggcccctgagggcctgagccctgcccccccagcccggtctgaggagccctgtgagcagcccctgctggtgcaccccagcggggaccacgccagagatgcccaggaccccagccagagcctgggcgcccctgaggccgctgagcggcccccagcccctgtgctggacatggccccagctggccacccagaaggagatgctgagcccagccctggagagcgggtggaggatgctgctgcccccaaggcccctggccccagccctgccaaggagaagattggcagcctgaggaaggtggaccggggccactaccgcagccggcgggagaggagcagcagcggggagcccgcccgggagagccgcagcaagacagagggccaccgccacagaagaagaaggacctgcccccgggagcgggaccggcaggacagacatgcccctgagcaccaccctggccacggggaccggctgagccctggagagaggaggagcctgggccgctgcagccaccaccacagccgccacagaagtggagtggagctggactgggtgcgccaccactacacagaaggagagcggggctggggccgggagaagttctacccagaccggccccgctgggaccgctgccgctactaccatgacagatatgccctgtatgctgcccgggactggaagcccttccacggcggccgggagcacgagcgggccggcctgcacgagcggccccacaaggaccacaacagaggccggcggggctgtgagcccgcccgggagcgggagcggcaccggcccagcagccccagggctggggcccctcatgccctggccccccacccagaccgcttcagccatgacagaacagccctggtggccggggacaactgcaacctgagtgaccgcttccacgagcatgaaaatggcaagagcaggaagagaagacatgacagcgtggagaacagcgacagccacgtggagaagaaggccaggagaagtgagcagaaggaccccctggaggagcccaaggccaagaagcacaagaagagcaagaagaagaagaagagcaaggacaagcaccgggaccgggacagccgccaccagcaggacagcgacctgtctgctgcctgcagtgatgctgacctgcaccgccacaagaagaagaagaagaagaagaagaggcacagcaggaagtctgaggactttgtgaaggacagcgagctgcacctgccccgggtgaccagcctggagaccgtggcccagttcagaagagcccagggcggcttccccctgagcggcggcccccccctggagggcgtgggccccttccgggagaagaccaagcacctgaggatggagagcagagatgaccgctgccgcctgtttgaatatggccagggcgactag

SEQ ID NO: 43077 - DNA, 3372 bp, Artificial Sequence
  Description of Artificial Sequence: Synthetic coding sequence
atggacctgggccctggagatgctgctgggggcggccccctggccccccggcccaggagaagaagaagcctgcggcggctcttcagccgcttcctgctggccctgggcagccgcagcaggcctggggacagccccccccggccccagcccggccactgtgatggagatggagagggcggctttgcctgtgcccctggccctgtgcctgctgcccctggcagccctggagaggagcggcccccaggcccccagccccagctgcagctgcctgctggagatggagcccggcccccaggggcccagggcctgaagaaccacggcaacacctgcttcatgaatgctgtggtgcagtgcctgagcaacacagacctgctggccgagttcctggccctgggccgctaccgggccgcccctggccgggcagaggtgacagagcagctggccgccctggtgcgggccctgtggacccgggagtacaccccccagctgtctgctgagttcaagaatgctgtgtccaaatatggcagccagttccagggcaacagccagcatgatgccctggagttcctgctgtggctgctggacagagtgcatgaggacctggagggcagcagccggggccctgtgtctgagaagctgcccccagaggccaccaagaccagcgagaactgcctgagccccagcgcccagctgcccctgggccagagctttgtgcagagccacttccaggcccagtaccgcagcagcctgacctgcccccactgcctgaagcagagcaacacctttgaccccttcctgtgtgtgtccctgcccatccccctgcggcagacccgcttcctgtctgtgaccctggtgttccccagcaagagccagcgcttcctgcgggtgggcctggccgtgcccatcctgagcacagtggccgccctgaggaagatggtggccgaggagggcggcgtgcctgcagatgaggtgatcctggtggagctgtaccccagcggcttccagaggagcttctttgatgaggaggacctgaacaccatcgccgagggggacaacgtgtatgccttccaggtgccccccagccccagccagggcaccctgagcgcccaccccctgggcctgagcgccagcccccggctggccgcccgggagggccagcgcttcagcctgagcctgcacagcgagagcaaggtgctgatcctcttctgcaacctggtgggcagcggccagcaggccagcagatttggaccacccttcctgatcagagaagatagagctgtgtcctgggcccagctgcagcagagcatcctgagcaaggtgcgccacctgatgaagtctgaggcccctgtgcagaacctgggcagcctcttcagcatccgggtggtgggcctgtctgtggcctgcagctacctgagccccaaggacagccggcccctgtgccactgggccgtggacagagtgctgcacctgcggcggcctgggggccccccccacgtgaagctggccgtggagtgggacagctctgtgaaggagcggctgtttggcagcctgcaggaggagcgggcccaggatgctgacagcgtgtggcagcagcagcaggcccaccagcagcacagctgcaccctggatgagtgcttccagttctacaccaaggaggagcagctggcccaggatgatgcctggaagtgcccccactgccaggtgctgcagcagggcatggtgaagctgagcctgtggaccctgcctgacatcctgatcatccacctgaagcgcttctgccaggtgggggagaggaggaacaagctgagcaccctggtgaagttccccctgagcggcctgaacatggccccccacgtggcccagaggagcaccagccctgaggccggcctgggcccctggcccagctggaagcagcctgactgcctgcccaccagctaccccctggacttcctgtatgacctgtatgctgtgtgcaaccaccacggcaacctgcagggcggccactacacagcctactgcaggaacagcctggatggccagtggtacagctatgatgacagcacagtggagcccctgcgggaggatgaggtgaacaccaggggggcctacatcctcttctaccagaagaggaacagcatccccccctggagcgccagcagctccatgaggggcagcaccagcagcagcctgagtgaccactggctgctgcggctgggcagccacgccggcagcacccggggcagcctgctgtcctggagcagcgccccctgccccagcctgccccaggtgcctgacagccccatcttcaccaacagcctgtgcaaccaggagaagggcggcctggagccccggcggctggtgcggggcgtgaagggccgcagcatctccatgaaggcccccaccaccagccgggccaagcagggccccttcaagaccatgcccctgcgctggagctttggcagcaaggagaagcccccaggggcctctgtggagctggtggagtacctggagagcagaagaagacccaggagcaccagccagagcatcgtgtccctgctgaccggcacagctggagaagatgagaagagcgccagccccaggagcaatgtggccctgcctgccaacagtgaagatggcggccgggccatcgagcggggccctgctggggtgccctgccccagcgcccagcccaaccactgcctggcccctggcaacagtgatggccccaacacagccaggaagctgaaggaaaatgccggccaggacatcaagctgcccaggaagtttgacctgcccctgactgtgatgcccagcgtggagcacgagaagccagcccggcctgagggccagaaggccatgaactggaaggagagcttccagatgggcagcaagagcagcccccccagcccctacatgggcttcagcggcaacagcaaggacagccggcggggcaccagcgagctggaccggcccctgcagggcaccctgaccctgctgcggtctgtgttcaggaagaaggaaaatagaagaaatgaaagagctgaggtgagcccccaggtgccccctgtgtccctggtgtctgggggcctgagccctgccatggatggccaggcccctggcagccccccagccctgcgcatccctgagggcctggcccggggcctgggcagccggctggagagagatgtgtggagcgcccccagcagcctgcggctgcccaggaaggccagccgggccccccggggcagcgccctgggcatgagccagaggacagtgcctggagagcaggccagctatggcaccttccagagggtgaagtaccacaccctgagcctgggcaggaagaagaccctgcctgagagcagcttctag

SEQ ID NO: 43078 - DNA, 3357 bp, Artificial Sequence
  Description of Artificial Sequence: Synthetic coding sequence
atggacctgggccctggagatgctgctgggggcggccccctggccccccggcccaggagaagaagaagcctgcggcggctcttcagccgcttcctgctggccctgggcagccgcagcaggcctggggacagccccccccggccccagcccggccactgtgatggagatggagagggcggctttgcctgtgcccctggccctgtgcctgctgcccctggcagccctggagaggagcggcccccaggcccccagccccagctgcagctgcctgctggagatggagcccggcccccaggggcccagggcctgaagaaccacggcaacacctgcttcatgaatgctgtggtgcagtgcctgagcaacacagacctgctggccgagttcctggccctgggccgctaccgggccgcccctggccgggcagaggtgacagagcagctggccgccctggtgcgggccctgtggacccgggagtacaccccccagctgtctgctgagttcaagaatgctgtgtccaaatatggcagccagttccagggcaacagccagcatgatgccctggagttcctgctgtggctgctggacagagtgcatgaggacctggagggcagcagccggggccctgtgtctgagaagctgcccccagaggccaccaagaccagcgagaactgcctgagccccagcgcccagctgcccctgggccagagctttgtgcagagccacttccaggcccagtaccgcagcagcctgacctgcccccactgcctgaagcagagcaacacctttgaccccttcctgtgtgtgtccctgcccatccccctgcggcagacccgcttcctgtctgtgaccctggtgttccccagcaagagccagcgcttcctgcgggtgggcctggccgtgcccatcctgagcacagtggccgccctgaggaagatggtggccgaggagggcggcgtgcctgcagatgaggtgatcctggtggagctgtaccccagcggcttccagaggagcttctttgatgaggaggacctgaacaccatcgccgagggggacaacgtgtatgccttccaggtgccccccagccccagccagggcaccctgagcgcccaccccctgggcctgagcgccagcccccggctggccgcccgggagggccagcgcttcagcctgagcctgcacagcgagagcaaggtgctgatcctcttctgcaacctggtgggcagcggccagcaggccagcagatttggaccacccttcctgatcagagaagatagagctgtgtcctgggcccagctgcagcagagcatcctgagcaaggtgcgccacctgatgaagtctgaggcccctgtgcagaacctgggcagcctcttcagcatccgggtggtgggcctgtctgtggcctgcagctacctgagccccaaggacagccggcccctgtgccactgggccgtggacagagtgctgcacctgcggcggcctgggggccccccccacgtgaagctggccgtggagtgggacagctctgtgaaggagcggctgtttggcagcctgcaggaggagcgggcccaggatgctgacagcgtgtggcagcagcagcaggcccaccagcagcacagctgcaccctggatgagtgcttccagttctacaccaaggaggagcagctggcccaggatgatgcctggaagtgcccccactgccaggtgctgcagcagggcatggtgaagctgagcctgtggaccctgcctgacatcctgatcatccacctgaagcgcttctgccaggtgggggagaggaggaacaagctgagcaccctggtgaagttccccctgagcggcctgaacatggccccccacgtggcccagaggagcaccagccctgaggccggcctgggcccctggcccagctggaagcagcctgactgcctgcccaccagctaccccctggacttcctgtatgacctgtatgctgtgtgcaaccaccacggcaacctgcaggcctactgcaggaacagcctggatggccagtggtacagctatgatgacagcacagtggagcccctgagagaagatgaggtgaacaccaggggggcctacatcctcttctaccagaagagaaattccatccccccctggagcgccagcagctccatgaggggcagcaccagcagcagcctgagtgaccactggctgctgcggctgggcagccatgctggcagcacccggggcagcctgctgtcctggagcagcgccccctgccccagcctgccccaggtgcctgacagccccatcttcaccaacagcctgtgcaaccaggagaagggcggcctggagccccggcggctggtgcggggcgtgaagggccgcagcatctccatgaaggcccccaccaccagccgggccaagcagggccccttcaagaccatgcccctgcgctggagctttggcagcaaggagaagcccccaggggcctctgtggagctggtggagtacctggagagcagaagaagacccaggagcaccagccagagcatcgtgtccctgctgactggaacagctggggaggatgagaagagcgccagccccaggagcaatgtggccctgcctgccaacagtgaagatggcggccgggccatcgagcggggccctgctggggtgccctgccccagcgcccagcccaaccactgcctggcccctggcaacagtgatggccccaacacagccaggaagctgaaggaaaatgccggccaggacatcaagctgcccaggaagtttgacctgcccctgactgtgatgcccagcgtggagcacgagaagccagcccggcctgagggccagaaggccatgaactggaaggagagcttccagatgggcagcaagagcagcccccccagcccctacatgggcttcagcggcaacagcaaggacagcagaagaggcaccagcgagctggaccggcccctgcagggcaccctgaccctgctgcggagcgtcttcaggaagaaggagaacagaagaaatgaaagagctgaggtgagcccccaggtgccccctgtgtccctggtgtctgggggcctgagccctgccatggatggccaggcccctggcagccccccagccctgcgcatccctgagggcctggcccggggcctgggcagccggctggagagagatgtgtggagcgcccccagcagcctgcggctgcccaggaaggccagccgggccccccggggcagcgccctgggcatgagccagaggacagtgcctggagagcaggccagctatggcaccttccagagggtgaagtaccacaccctgagcctgggcaggaagaagaccctgcctgagagcagcttctag

SEQ ID NO: 43079 - DNA, 2445 bp, Artificial Sequence
  Description of Artificial Sequence: Synthetic coding sequence
atgagggtgaaggaccccaccaaggccctgcctgagaaggccaagaggagcaagaggcccaccgtgccccatgatgaggacagcagtgatgacattgctgtgggcctgacctgccagcacgtgtcccatgccatctctgtgaaccacgtgaagagggccatcgccgagaacctgtggagcgtgtgcagcgagtgcctgaaggagcggcgcttctatgatggccagctggtgctgaccagtgacatctggctgtgcctgaagtgtggcttccagggctgcggcaagaacagcgagagccagcacagcctgaagcacttcaagagcagcaggacagagccccactgcatcatcatcaacctgagcacctggatcatctggtgctatgaatgtgatgagaagctgagcacccactgcaacaagaaggtgctggcccagatcgtggacttcctgcagaagcacgccagcaagacccagaccagcgccttcagccgcatcatgaagctgtgtgaggagaagtgtgaaacagatgagatccagaagggcggcaaatgtagaaacctgtctgtgcggggcatcaccaacctgggcaacacctgcttcttcaatgctgtgatgcagaacctggcccagacctacaccctgacagacctgatgaatgagatcaaggagagcagcaccaagctgaagatcttccccagcagtgacagccagctggaccccctggtggtggagctgagccggcccggccccctgaccagcgccctcttcctgttcctgcacagcatgaaggagacagagaagggccccctgagccccaaggtgctcttcaaccagctgtgccagaaggccccccgcttcaaggacttccagcagcaggacagccaggagctgctgcactacctgctggatgctgtgaggacagaggagaccaagaggatccaggccagcatcctgaaggccttcaacaaccccaccaccaagacagcagatgatgagaccaggaagaaggtgaaggcctacggcaaggagggcgtgaagatgaacttcatcgaccgcatcttcatcggggagctgaccagcacagtgatgtgtgaggagtgtgccaacatcagcacagtgaaggaccccttcatcgacatcagcctgcccatcatcgaggagcgggtgtccaagcccctgctgtggggccgcatgaacaagtaccgcagcctgcgggagacagaccatgaccgctacagcggaaatgtgaccatcgagaacatccaccagccccgggccgccaagaagcacagcagcagcaaggacaagagccagctgattcatgacaggaagtgcatcaggaagctgagcagtggagagaccgtgacctaccagaagaatgaaaacctggagatgaatggagacagcctgatgtttgccagcctgatgaacagcgagagccggctgaatgaaagccccacagatgacagcgagaaggaggccagccacagcgagagcaatgtggatgctgacagcgagcccagcgagagcgagagcgccagcaagcagacaggcctcttccgcagcagcagcggcagcggcgtgcagccagatggccccctgtaccccctgtctgctgggaagctgctgtacaccaaggagacagacagcggggacaaggagatggccgaggccatcagcgagctgcggctgagcagcacagtgactggagaccaggactttgaccgggagaaccagcccctgaacatcagcaacaacctgtgcttcctggagggcaagcacctgcggagctacagcccccagaatgccttccagaccctgagccagagctacatcaccaccagcaaagaatgttccatccagagctgcctgtaccagttcacctccatggagctgctgatgggcaacaacaagctgctgtgtgagaactgcaccaagaacaagcagaagtaccaggaggagaccagctttgctgagaagaaggtggagggcgtgtacaccaatgccaggaagcagctgctgatctctgctgtgcctgctgtgctgatcctgcacctgaagcgcttccaccaggccggcctgagcctgaggaaggtgaacagacatgtggacttccccctgatgctggacctggcccccttctgcagcgccacctgcaagaatgcctctgtgggggacaaggtgctgtatggcctgtatggaattgtggagcacagcggctccatgagggagggccactacacagcctacgtgaaggtgaggacccccagcaggaagctgtctgagcacaacaccaagaagaagaatgtgcccggcctgaaggctgctgacaatgaatctgctggccagtgggtgcacgtgtctgacacctacctgcaggtggtgcctgagagccgggccctgagcgcccaggcctacctgctcttctatgaaagagtgctgtag

SEQ ID NO: 43080 - DNA, 870 bp, Artificial Sequence
  Description of Artificial Sequence: Synthetic coding sequence
atgagggtgaaggaccccaccaaggccctgcctgagaaggccaagaggagcaagaggcccaccgtgccccatgatgaggacagcagtgatgacattgctgtgggcctgacctgccagcacgtgtcccatgccatctctgtgaaccacgtgaagagggccatcgccgagaacctgtggagcgtgtgcagcgagtgcctgaaggagcggcgcttctatgatggccagctggtgctgaccagtgacatctggctgtgcctgaagtgtggcttccagggctgcggcaagaacagcgagagccagcacagcctgaagcacttcaagagcagcaggacagagccccactgcatcatcatcaacctgagcacctggatcatctggtgctatgaatgtgatgagaagctgagcacccactgcaacaagaaggtgctggcccagatcgtggacttcctgcagaagcacgccagcaagacccagaccagcgccttcagccgcatcatgaagctgtgtgaggagaagtgtgaaacagatgagatccagaagggcggcaaatgtagaaacctgtctgtgcggggcatcaccaacctgggcaacacctgcttcttcaatgctgtgatgcagaacctggcccagacctacaccctgacagacctgatgaatgagatcaaggagagcagcaccaagctgaagatcttccccagcagtgacagccagctggaccccctggtggtggagctgagccggcccggccccctgaccagcgccctcttcctgttcctgcacagcatgaaggagacagagaagggccccctgagccccaaggtgctcttcaaccagctgtgccagaagtgggtgcacctgcacctgatctag

SEQ ID NO: 43081 - DNA, 549 bp, Artificial Sequence
  Description of Artificial Sequence: Synthetic coding sequence
atgagggtgaaggaccccaccaaggccctgcctgagaaggccaagaggagcaagaggcccaccgtgccccatgatgaggacagcagtgatgacattgctgtgggcctgacctgccagcacgtgtcccatgccatctctgtgaaccacgtgaagagggccatcgccgagaacctgtggagcgtgtgcagcgagtgcctgaaggagcggcgcttctatgatggccagctggtgctgaccagtgacatctggctgtgcctgaagtgtggcttccagggctgcggcaagaacagcgagagccagcacagcctgaagcacttcaagagcagcaggacagagccccactgcatcatcatcaacctgagcacctggatcatctggtgctatgaatgtgatgagaagctgagcacccactgcaacaagaaggtgctggcccagatcgtggacttcctgcagaagcacgccagcaagacccagaccaggcctggccccatcctgatccacctgttcagcatcaactgcctgggcgcccacagcgagagcgtgtgctag

SEQ ID NO: 43082 - DNA, 1485 bp, Artificial Sequence
  Description of Artificial Sequence: Synthetic coding sequence
atgaggagcaagaaggtggtgcagaacagccgcttcttcctgccccagaccctgtcctgggccccccgcttcaaggacttccagcagcaggacagccaggagctgctgcactacctgctggatgctgtgaggacagaggagaccaagatcagcacagtgaaggaccccttcatcgacatcagcctgcccatcatcgaggagcgggtgtccaagcccctgctgtggggccgcatgaacaagtaccgcagcctgcgggagacagaccatgaccgctacagcggaaatgtgaccatcgagaacatccaccagccccgggccgccaagaagcacagcagcagcaaggacaagagccagctgattcatgacaggaagtgcatcaggaagctgagcagtggagagaccgtgacctaccagaagaatgaaaacctggagatgaatggagacagcctgatgtttgccagcctgatgaacagcgagagccggctgaatgaaagccccacagatgacagcgagaaggaggccagccacagcgagagcaatgtggatgctgacagcgagcccagcgagagcgagagcgccagcaagcagacaggcctcttccgcagcagcagcggcagcggcgtgcagccagatggccccctgtaccccctgtctgctgggaagctgctgtacaccaaggagacagacagcggggacaaggagatggccgaggccatcagcgagctgcggctgagcagcacagtgactggagaccaggactttgaccgggagaaccagcccctgaacatcagcaacaacctgtgcttcctggagggcaagcacctgcggagctacagcccccagaatgccttccagaccctgagccagagctacatcaccaccagcaaagaatgttccatccagagctgcctgtaccagttcacctccatggagctgctgatgggcaacaacaagctgctgtgtgagaactgcaccaagaacaagcagaagtaccaggaggagaccagctttgctgagaagaaggtggagggcgtgtacaccaatgccaggaagcagctgctgatctctgctgtgcctgctgtgctgatcctgcacctgaagcgcttccaccaggccggcctgagcctgaggaaggtgaacagacatgtggacttccccctgatgctggacctggcccccttctgcagcgccacctgcaagaatgcctctgtgggggacaaggtgctgtatggcctgtatggaattgtggagcacagcggctccatgagggagggccactacacagcctacgtgaaggtgaggacccccagcaggaagctgtctgagcacaacaccaagaagaagaatgtgcccggcctgaaggctgctgacaatgaatctgctggccagtgggtgcacgtgtctgacacctacctgcaggtggtgcctgagagccgggccctgagcgcccaggcctacctgctcttctatgaaagagtgctgtag

SEQ ID NO: 43083 - DNA, 870 bp, Artificial Sequence; identical to SEQ ID NO: 43080
  Description of Artificial Sequence: Synthetic coding sequence

SEQ ID NO: 43084 - DNA, 2445 bp, Artificial Sequence; identical to SEQ ID NO: 43079
  Description of Artificial Sequence: Synthetic coding sequence

SEQ ID NO: 43085 - DNA, 159 bp, Artificial Sequence
  Description of Artificial Sequence: Synthetic coding sequence
atgagggtgaaggaccccaccaaggccctgcctgagaaggccaagaggagcaagaggcccaccgtgccccatgatgaggacagcagtgatgacattgctgtgggcctgacctgccagcacgtgtcccatgccatctctgtgaaccacgtgaagaggtag

SEQ ID NO: 43086 - DNA, 324 bp, Artificial Sequence
  Description of Artificial Sequence: Synthetic coding sequence
atgctggacctggcccccttctgcagcgccacctgcaagaatgcctctgtgggggacaaggtgctgtatggcctgtatggcatcgtggagcacagcggctccatgagggagggccactacacagcctacgtgaaggtgaggacccccagcaggaagctgtctgagcacaacaccaagaagaagaatgtgcccggcctgaaggctgctgacaatgaatctgctggccagtgggtgcacgtgtctgacacctacctgcaggtggtgcctgagagccgggccctgagcgcccaggcctacctgctcttctatgagcgggtgctgtag

SEQ ID NO: 43087 - DNA, 1923 bp, Artificial Sequence
  Description of Artificial Sequence: Synthetic coding sequence
atggaccgctgcaagcacgtgggccgcctgcggctggcccaggaccacagcatcctgaacccccagaagtggtgctgcctggagtgtgccaccacagagagcgtgtgggcctgcctgaagtgcagccacgtggcctgtggccgctacattgaagatcatgccctgaagcactttgaggagaccggccaccccctggccatggaggtgcgggacctgtatgtgttctgctacctgtgcaaggactatgtgctgaatgacaaccctgagggggacctgaagctgctgcggagcagcctgctggccgtgcggggccagaagcaggacacccctgtgcggcggggccgcaccctgcgctccatggccagcggggaggatgtggtgctgccccagagggccccccagggccagccccagatgctgacagccctgtggtaccgccggcagaggctgctggcccggaccctgcggctgtggtttgagaagagcagccggggccaggccaagctggagcagaggcggcaggaggaggccctggagaggaagaaggaggaggccaggagaagaagaagagaggtgaagaggcggctgctggaggagctggccagcaccccacccaggaagagcgcccggctgctgctgcacaccccaagagatgctggccctgctgccagcaggcctgctgccctgcccaccagcagaagagtgcctgctgccaccctgaagctgcggcggcagcctgccatggcccctggggtgacaggcctgaggaacctgggcaacacctgctacatgaacagcatcctgcaggtgctgagccacctgcagaagttccgggagtgcttcctgaacctggaccccagcaagacagagcacctgttccccaaggccaccaacgggaagacccagctgagcggcaagcccaccaacagcagcgccacagagctgagcctgagaaatgacagagctgaggcctgtgagcgggagggcttctgctggaatggccgggccagcatcagccgcagcctggagctgatccagaacaaggagcccagcagcaagcacatcagcctgtgccgggagctgcacaccctcttccgggtgatgtggagcggcaagtgggccctggtgagcccctttgccatgctgcacagcgtgtggagcctcatcccagccttccggggctatgaccagcaggatgcccaggagttcctgtgtgagctgctgcacaaggtgcagcaggagctggagagcgagggcaccacccggcgcatcctgatccccttcagccagaggaagctgaccaagcaggtgctgaaggtggtgaacaccatcttccacggccagctgctgagccaggtgacctgcatcagctgcaactacaagagcaacaccatcgagcccttctgggacctgagcctggagttccctgagcgctaccactgcatcgagaagggctttgtgcccctgaaccagacagaatgtctgctgacagagatgctggccaagttcacagaaacagaggccctggagggccgcatctatgcctgtgaccagtgcaacagcaagaggaggaagagcaaccccaagcccctggtgctgtctgaggccaggaagcagctgatgatctaccgcctgccccaggtgctgcggctgcacctgaagcgcttccgctggagcggcaggaaccaccgggagaagattggagtgcacgtggtgtttgaccaggtgctgaccatggagccctactgctgccgggacatgctgagcagcctggacaaggagacctttgcctatgacctgtctgctgtggtgatgcaccacggcaaaggatttggaagtggccactacacagcctactgctacaacacagaaggaggagcctgtgccctgctgtgtggggtgggggacacagagcggggctag

SEQ ID NO: 43088 - DNA, 1923 bp, Artificial Sequence; identical to SEQ ID NO: 43087
  Description of Artificial Sequence: Synthetic coding sequence

SEQ ID NO: 43089 - DNA, 2067 bp, Artificial Sequence
  Description of Artificial Sequence: Synthetic coding sequence
atggaccgctgcaagcacgtgggccgcctgcggctggcccaggaccacagcatcctgaacccccagaagtggtgctgcctggagtgtgccaccacagagagcgtgtgggcctgcctgaagtgcagccacgtggcctgtggccgctacattgaagatcatgccctgaagcactttgaggagaccggccaccccctggccatggaggtgcgggacctgtatgtgttctgctacctgtgcaaggactatgtgctgaatgacaaccctgagggggacctgaagctgctgcggagcagcctgctggccgtgcggggccagaagcaggacacccctgtgcggcggggccgcaccctgcgctccatggccagcggggaggatgtggtgctgccccagagggccccccagggccagccccagatgctgacagccctgtggtaccgccggcagaggctgctggcccggaccctgcggctgtggtttgagaagagcagccggggccaggccaagctggagcagaggcggcaggaggaggccctggagaggaagaaggaggaggccaggagaagaagaagagaggtgaagaggcggctgctggaggagctggccagcaccccacccaggaagagcgcccggctgctgctgcacaccccaagagatgctggccctgctgccagcaggcctgctgccctgcccaccagcagaagagtgcctgctgccaccctgaagctgcggcggcagcctgccatggcccctggggtgacaggcctgaggaacctgggcaacacctgctacatgaacagcatcctgcaggtgctgagccacctgcagaagttccgggagtgcttcctgaacctggaccccagcaagacagagcacctgttccccaaggccaccaacgggaagacccagctgagcggcaagcccaccaacagcagcgccacagagctgagcctgagaaatgacagagctgaggcctgtgagcgggagggcttctgctggaatggccgggccagcatcagccgcagcctggagctgatccagaacaaggagcccagcagcaagcacatcagcctgtgccgggagctgcacaccctcttccgggtgatgtggagcggcaagtgggccctggtgagcccctttgccatgctgcacagcgtgtggagcctcatcccagccttccggggctatgaccagcaggatgcccaggagttcctgtgtgagctgctgcacaaggtgcagcaggagctggagagcgagggcaccacccggcgcatcctgatccccttcagccagaggaagctgaccaagcaggtgctgaaggtggtgaacaccatcttccacggccagctgctgagccaggtgacctgcatcagctgcaactacaagagcaacaccatcgagcccttctgggacctgagcctggagttccctgagcgctaccactgcatcgagaagggctttgtgcccctgaaccagacagaatgtctgctgacagagatgctggccaagttcacagaaacagaggccctggagggccgcatctatgcctgtgaccagtgcaacagcaagaggaggaagagcaaccccaagcccctggtgctgtctgaggccaggaagcagctgatgatctaccgcctgccccaggtgctgcggctgcacctgaagcgcttccgctggagcggcaggaaccaccgggagaagattggagtgcacgtggtgtttgaccaggtgctgaccatggagccctactgctgccgggacatgctgagcagcctggacaaggagacctttgcctatgacctgtctgctgtggtgatgcaccacggcaaaggatttggaagtggccactacacagcctactgctacaacacagaaggaggcttctgggtgcactgcaatgacagcaagctgaatgtgtgcagcgtggaggaggtgtgcaagacccaggcctacatcctcttctacacccagaggacagtgcagggcaatgcccgcatcagcgagacccacctgcaggcccaggtgcagagcagcaacaatgatgagggccggccccagaccttctcctag

SEQ ID NO: 43090 - DNA, 2067 bp, Artificial Sequence; identical to SEQ ID NO: 43089
  Description of Artificial Sequence: Synthetic coding sequence

SEQ ID NO: 43091 - DNA, 48 bp, Artificial Sequence
  Description of Artificial Sequence: Synthetic coding sequence
atggaccgctgcaagcacgtgggccgcctgcggctggcccaggactag

SEQ ID NO: 43092 - DNA, 114 bp, Artificial Sequence
  Description of Artificial Sequence: Synthetic coding sequence
atggaccgctgcaagcacgtgggccgcctgcggctggcccaggaccacagcatcctgaacccccagaagtggtgctgcctggagtgtgccaccacagagagcgtgtgggcctag

SEQ ID NO: 43093 - DNA, 1005 bp, Artificial Sequence
  Description of Artificial Sequence: Synthetic coding sequence
atgaccagccagcccagcctgcctgcagatgactttgacatctaccacgtgctggccgagtgcacagactactatgacaccctgcctgtgaaggaggctgatggcaaccagccccacttccagggcgtgacaggcctgtggaacctgggcaacacctgctgcgtgaatgccatcagccagtgcctgtgcagcatcctgcccctggtggagtacttcctgaccgggaagtacatcacagccctgcagaatgactgcagcgaggtggccacagcctttgcctacctgatgacagacatgtggctgggggacagcgactgtgtgtccccagagatcttctggagcgccctgggcaacctgtacccagccttcaccaagaagatgcagcaggatgcccaggagttcctgatctgtgtgctgaatgagctgcacgaggccctgaagaagtaccactacagcagaagaagaagctatgagaagggcagcacccagcgctgctgcaggaagtggatcaccacagagaccagcatcatcacccagctgtttgaggagcagctgaactacagcatcgtgtgcctgaagtgtgagaagtgcacctacaagaatgaggtgttcaccgtcttcagcctgcccatccccagcaaatatgagtgcagcctgcgggactgcctgcagtgcttcttccagcaggatgccctgacctggaacaatgagatccactgcagcttctgtgagaccaagcaggagacagctgtgcgggccagcatcagcaaggcccccaagatcatcatcttccacctgaagagatttgacatccagggcaccaccaagaggaagctgaggacagacatccactaccccctgaccaacctggacctgaccccctacatctgcagcatcttcaggaagtaccccaagtacaacctgtgtgctgtggtgaaccactttggagacctggatggcggccactacacagccttctgcaagaacagcgtgacccaggcctag

SEQ ID NO: 43094 - DNA, 2136 bp, Artificial Sequence
  Description of Artificial Sequence: Synthetic coding sequence
atggcccaggtgcgggagaccagcctgcccagcggcagcggcgtgcgctggatcagcggcggcggcggcggggccagccctgaggaggccgtggagaaggccggcaagatggaggaggccgccgccggggccaccaaggccagcagccggcgggaggccgaggagatgaagctggagcccctgcaggagcgggagcccgcccctgaggagaacctgacctggagcagcagtggaggagatgagaaggtgctgcccagcatccccctgcgctgccacagcagcagcagccctgtgtgccccaggaggaagccccggccccggccccagccccgggcccggagccgcagccagcccggcctgagcgcccctcctcctcctccagcccggcccccacctcctcctcctcctcctcctcctccagccccccggccccgggcctggaggggcagcagaagaagaagccggcccggcagccggccccagaccaggaggagctgcagcggggacctggatggcagcggggaccccggcggcctgggggactggctgctggaggtggagtttggccagggccccaccggctgcagccacgtggagagcttcaaggtgggcaagaactggcagaagaacctgcggctcatctaccagagatttgtgtggagcggcaccccagagaccaggaagaggaaggccaagagctgcatctgccacgtgtgcagcacccacatgaaccggctgcacagctgcctgagctgtgtgttcttcggctgcttcacagagaagcacatccacaagcatgctgagaccaagcagcaccacctggccgtggacctgtaccacggcgtcatctactgcttcatgtgcaaggactatgtgtatgacaaggacatcgagcagatcgccaaggagaccaaggagaagatcctgcggctgctgaccagcaccagcacagatgtgagccaccagcagttcatgaccagcggctttgaggacaagcagagcacctgtgagaccaaggagcaggagcccaagctggtgaagcccaagaagaagaggaggaagaagtctgtgtacacagtgggcctgcggggcctcatcaacctgggcaacacctgcttcatgaactgcatcgtgcaggccctgacccacatccccctgctgaaggacttcttcctgagtgacaagcacaagtgcatcatgaccagccccagcctgtgcctggtgtgtgagatgagcagcctcttccacgccatgtacagcggcagcaggaccccccacatcccctacaagctgctgcacctgatctggattcatgctgagcacctggccggctaccggcagcaggatgcccacgagttcctgattgccatcctggatgtgctgcaccgccacagcaaggatgattctgggggccaggaggccaacaaccccaactgctgcaactgcatcatcgaccagatcttcaccggcggcctgcagagtgatgtgacctgccaggcctgccacagcgtgtccaccaccatcgacccctgctgggacatcagcctggacctgcccggcagctgtgccacctttgacagccagaaccctgagagagctgacagcacagtgtccagagatgaccacatccctggcatccccagcctgacagactgcctgcagtggttcaccaggcctgagcacctgggcagcagcgccaagatcaagtgcaacagctgccagagctaccaggagagcaccaagcagctgaccatgaagaagctgcccatcgtggcctgcttccacctgaagagatttgaacatgtgggcaagcagaggaggaagatcaacaccttcatctccttccccctggagctggacatgacccccttcctggccagcaccaaggagagcaggatgaaggagggccagcccccaacagactgtgtgcccaatgaaaacaagtacagcctgtttgctgtgatcaaccaccacggcaccctggagagcggccactacaccagcttcatccggcagcagaaggaccagtggttcagctgtgatgatgccatcatcaccaaggccaccatcgaggacctgctgtacagcgagggctacctgctcttctaccacaagcagggcctggagaaggactag

SEQ ID NO: 43095 - DNA, 3222 bp, Artificial Sequence
  Description of Artificial Sequence: Synthetic coding sequence
atggcctgggtgaagttcctgaggaagccaggcggcaacctgggcaaggtgtaccagcccggctccatgctgagcctggcccccaccaagggcctgctgaatgagcccggccagaacagctgcttcctgaacagcgctgtgcaggtgctgtggcagctggacatcttcagaagaagcctgcgggtgctgaccggccacgtgtgccagggagatgcctgcatcttctgtgccctgaagaccatctttgcccagttccagcacagccgggagaaggccctgcccagcgacaacatcagacatgccctggccgagagcttcaaggatgagcagcgcttccagctgggcctgatggatgatgctgctgagtgctttgagaacatgctggagcgcatccacttccacatcgtgcccagcagagatgctgacatgtgcaccagcaagagctgcatcacccaccagaagtttgccatgaccctgtatgagcagtgtgtgtgccgcagctgtggggccagcagtgaccccctgcccttcacagaatttgtgcgctacatcagcaccacagccctgtgcaatgaggtggagaggatgctggagagacatgagcgcttcaagccagagatgtttgctgagctgctgcaggccgccaacaccacagatgactacagaaaatgtcccagcaactgtggccagaagatcaagatcagaagagtgctgatgaactgcccagagatcgtgaccatcggcctggtgtgggacagcgagcacagcgacctgacagaagctgtggtgaggaacctggccacccacctgtacctgcccggcctcttctacagagtgacagatgaaaatgccaagaacagcgagctgaacctggtgggcatgatctgctacaccagccagcactactgtgcctttgccttccacaccaagagcagcaagtgggtgttctttgatgatgccaacgtgaaggagatcggcacccgctggaaggatgtggtgtccaagtgcatccgctgccacttccagcccctgctgctcttctacgccaacccagatggaacagctgtgtccacagaagatgccctgcggcaggtgatctcctggagccactacaagtctgtggccgagaacatgggctgtgagaagcctgtgatccacaagagtgacaacctgaaggaaaatggatttggagaccaggccaagcagcgggagaaccagaagttccccacagacaacatcagcagcagcaacagaagccacagccacactggagtgggcaaaggacctgccaagctgagccacatcgaccagcgggagaagatcaaggacatcagcagagaatgtgccctgaaggccatcgagcagaagaacctgctgagcagccagaggaaggacctggagaagggccagaggaaggacctgggccgccaccgggacctggtggatgaggacctgagccacttccagagcggcagccccccagccccaaatggcttcaagcagcacggcaacccccacctgtaccacagccagggcaagggcagctacaagcatgacagagtggtgccccagagccgggccagcgcccagatcatcagcagcagcaagagccagatcctggcccctggagagaagatcaccgggaaggtgaagagtgacaatggcaccggctatgacacagacagcagccaggacagccgggaccggggcaacagctgtgacagcagcagcaagagcaggaacagaggctggaagcccatgagggagaccctgaatgtggacagcatcttcagcgagagcgagaagaggcagcacagccccaggcacaagcccaacatcagcaacaagcccaagagcagcaaggaccccagcttcagcaactggcccaaggagaaccccaagcagaagggcctgatgaccatctatgaagatgagatgaagcaggagatcggcagccgcagcagcctggagagcaatggaaaaggagctgagaagaacaagggcctggtggagggcaaggtgcatggagacaactggcagatgcagaggacagagagcggctatgagagcagtgaccacatcagcaatggcagcaccaacctggacagccctgtgattgatggaaatggaacagtgatggacatcagcggcgtgaaggagaccgtgtgcttcagtgaccagatcaccaccagcaacctgaacaaggagcggggggactgcaccagcctgcagagccagcaccacctggagggcttcaggaaggagctgaggaacctggaggccggctacaagagccatgagttccaccctgagagccacctgcagatcaagaaccacctgatcaagaggagccacgtgcatgaggacaacgggaagctgttccccagcagcagcctgcagatccccaaggaccacaatgcccgggagcacatccaccagagtgatgagcagaagctggagaagcccaatgaatgcaagttcagcgagtggctgaacatcgagaacagcgagaggacaggcctgcccttccacgtggacaacagcgccagcggcaagagggtgaacagcaatgagcccagcagcctgtggagcagccacctgaggacagtgggcctgaagccagagacagcccccctcatccagcagcagaacatcatggaccagtgctactttgagaacagcctgagcacagagtgcatcatccgcagcgccagcagaagtgatggctgccagatgcccaagctgttctgccagaacctgcccccacccctgccccccaagaagtatgccatcacctctgtgccccagagcgagaagtctgagagcaccccagatgtgaagctgacagaggtgttcaaggccaccagccacctgcccaagcacagcctgagcacagccagcgagcccagcctggaggtgtccacccacatgaatgatgagcggcacaaggagaccttccaggtgcgggagtgcttcggcaacacccccaactgccccagcagcagcagcaccaatgacttccaggccaacagcggggccattgatgccttctgccagcctgagctggacagcatcagcacctgccccaatgagaccgtgtccctgaccacctacttctctgtggacagctgcatgacagacacctaccgcctgaagtaccaccagaggcccaagctgtccttccctgagagcagcggcttctgcaacaacagcctgtcctag

SEQ ID NO: 43096 - DNA, 3222 bp, Artificial Sequence; identical to SEQ ID NO: 43095
  Description of Artificial Sequence: Synthetic coding sequence

SEQ ID NO: 43097 - DNA, 2235 bp, Artificial Sequence
  Description of Artificial Sequence: Synthetic coding sequence
atgtcctggaagaggaactacttcagcggcggccggggctctgtgcagggcatgtttgcccccaggagcagcaccagcatcgcccccagcaagggcctgagcaatgaacctggccagaacagctgcttcctgaacagcgccctgcaggtgctgtggcacctggacatcttccgccgctccttccggcagctgaccacccacaagtgcatgggagacagctgcatcttctgtgccctgaagggcatcttcaaccagttccagtgcagcagcgagaaggtgctgcccagcgacaccctgcggagcgccctggccaagaccttccaggatgagcagcgcttccagctgggcatcatggatgatgctgctgaatgttttgagaacctgctgatgaggatccacttccacatcgcagatgagaccaaggaggacatctgcacagcccagcactgcatcagccaccagaagtttgccatgaccctgtttgagcagtgtgtgtgcaccagctgtggggccaccagtgaccccctgcccttcatccagatggtgcactacatcagcaccaccagcctgtgcaaccaggccatctgcatgctggagcggcgggagaagcccagccccagcatgtttggagagctgctgcagaatgccagcaccatgggagacctgaggaactgccccagcaactgtggggagcgcatccgcatccggcgggtgctgatgaatgccccccagatcatcaccatcggcctggtgtgggacagcgaccacagcgacctggctgaagatgtgatccacagcctgggcacctgcctgaagctgggggacctcttcttccgggtgacagatgaccgggccaagcagagcgagctgtacctggtgggcatgatctgctactacggcaagcactacagcaccttcttcttccagaccaagatcaggaagtggatgtactttgatgatgcccacgtgaaggagatcggccccaagtggaaggatgtggtgaccaagtgcatcaagggccactaccagcccctgctgctgctgtatgctgacccccagggcacccctgtgtccacccaggacctgcccccccaggccgagttccagagctacagcaggacctgctatgacagtgaagattctggccgggagcccagcatcagcagtgacaccaggacagacagcagcacagagagctacccctacaagcacagccaccatgaatctgtggtgagccacttcagcagtgacagccagggcaccgtcatctacaacgtggagaatgacagcatgagccagagcagccgggacaccggccacctgacagacagcgagtgcaaccagaagcacaccagcaagaagggcagcctcatcgagaggaagaggagcagcggccgggtgcggaggaaaggagatgagccccaggccagcggctaccacagcgagggggagaccctgaaggagaagcaggcccccagaaatgccagcaagcccagcagcagcaccaaccggctgcgggacttcaaggagaccgtgagcaacatgatccacaaccggcccagcctggccagccagaccaacgtgggcagccactgccggggccggggcggggaccagcctgacaagaagccacccaggaccctgcccctgcacagccgggactgggagattgagagcaccagcagcgagagcaagagcagcagcagcagcaagtaccggcccacctggaggcccaagcgggagagcctgaacatcgacagcatcttcagcaaggacaagaggaagcactgcggctacacccagctgagccccttctctgaagattctgccaaggagttcatcccagatgagcccagcaagcccccatcctatgacatcaagtttggaggccccagcccccagtacaagcgctggggccctgcccggcccggcagccacctgctggagcagcaccccaggctcatccagaggatggagagcggctatgagagcagcgagaggaacagcagcagccctgtgtccctggatgctgccctgcctgagagcagcaatgtgtaccgctactgcctggcctttgagcagcagcactgcctgctgcagcagtgtgagccccccacctggggcttccaggcctggctgcggcaggtggagggctggcccctgctgctgagcctgtgtgccctgagcaccagctacaacaacagcaccctgtgctggaagaacagaggcacctag

SEQ ID NO: 43098 - DNA, 5055 bp, Artificial Sequence
  Description of Artificial Sequence: Synthetic coding sequence
atgtcctggaagaggaactacttcagcggcggccggggctctgtgcagggcatgtttgcccccaggagcagcaccagcatcgcccccagcaagggcctgagcaatgaacctggccagaacagctgcttcctgaacagcgccctgcaggtgctgtggcacctggacatcttccgccgctccttccggcagctgaccacccacaagtgcatgggagacagctgcatcttctgtgccctgaagggcatcttcaaccagttccagtgcagcagcgagaaggtgctgcccagcgacaccctgcggagcgccctggccaagaccttccaggatgagcagcgcttccagctgggcatcatggatgatgctgctgaatgttttgagaacctgctgatgaggatccacttccacatcgcagatgagaccaaggaggacatctgcacagcccagcactgcatcagccaccagaagtttgccatgaccctgtttgagcagtgtgtgtgcaccagctgtggggccaccagtgaccccctgcccttcatccagatggtgcactacatcagcaccaccagcctgtgcaaccaggccatctgcatgctggagcggcgggagaagcccagccccagcatgtttggagagctgctgcagaatgccagcaccatgggagacctgaggaactgccccagcaactgtggggagcgcatccgcatccggcgggtgctgatgaatgccccccagatcatcaccatcggcctggtgtgggacagcgaccacagcgacctggctgaagatgtgatccacagcctgggcacctgcctgaagctgggggacctcttcttccgggtgacagatgaccgggccaagcagagcgagctgtacctggtgggcatgatctgctactacggcaagcactacagcaccttcttcttccagaccaagatcaggaagtggatgtactttgatgatgcccacgtgaaggagatcggccccaagtggaaggatgtggtgaccaagtgcatcaagggccactaccagcccctgctgctgctgtatgctgacccccagggcacccctgtgtccacccaggacctgcccccccaggccgagttccagagctacagcaggacctgctatgacagtgaagattctggccgggagcccagcatcagcagtgacaccaggacagacagcagcacagagagctacccctacaagcacagccaccatgaatctgtggtgagccacttcagcagtgacagccagggcaccgtcatctacaacgtggagaatgacagcatgagccagagcagccgggacaccggccacctgacagacagcgagtgcaaccagaagcacaccagcaagaagggcagcctcatcgagaggaagaggagcagcggccgggtgcggaggaaaggagatgagccccaggccagcggctaccacagcgagggggagaccctgaaggagaagcaggcccccagaaatgccagcaagcccagcagcagcaccaaccggctgcgggacttcaaggagaccgtgagcaacatgatccacaaccggcccagcctggccagccagaccaacgtgggcagccactgccggggccggggcggggaccagcctgacaagaagccacccaggaccctgcccctgcacagccgggactgggagattgagagcaccagcagcgagagcaagagcagcagcagcagcaagtaccggcccacctggaggcccaagcgggagagcctgaacatcgacagcatcttcagcaaggacaagaggaagcactgcggctacacccagctgagccccttctctgaagattctgccaaggagttcatcccagatgagcccagcaagcccccatcctatgacatcaagtttggaggccccagcccccagtacaagcgctggggccctgcccggcccggcagccacctgctggagcagcaccccaggctcatccagaggatggagagcggctatgagagcagcgagaggaacagcagcagccctgtgtccctggatgctgccctgcctgagagcagcaatgtgtacagagaccccagcgccaagaggtctgctggcctggtgcccagctggaggcacatccccaagagccacagcagcagcatcctggaggtggacagcacagcctccatgggcggctggaccaagagccagcccttctctggagaggagatcagcagcaagtctgagctggatgagctgcaggaggaggtggcccggcgggcccaggagcaggagctgcggaggaagcgggagaaggagctggaggccgccaagggcttcaacccccaccccagccgcttcatggacctggatgagctgcagaaccagggccgcagtgatggctttgagaggagcctgcaggaggccgagagcgtgtttgaggagagcctgcacctggagcagaagggggactgtgccgccgccctggccctgtgcaatgaggccatcagcaagctgcggctggccctgcatggagccagctgcagcacccacagccgggccctggtggacaagaagctgcagatcagcatcaggaaggcccggagcctgcaggacaggatgcagcagcagcagagcccccagcagcccagccagcccagcgcctgcctgcccacccaggccggcaccctgagccagcccaccagcgagcagcccatccccctgcaggtgctgctgagccaggaggcccagctggagagcggcatggacacagaatttggagccagcagcttcttccacagccctgccagctgccacgagagccacagcagcctgagccctgagagcagcgccccccagcacagcagccccagccgcagcgccctgaagctgctgacctctgtggaggtggacaacatcgagcccagcgccttccaccggcagggcctgcccaaggcccctggctggacagagaagaacagccaccacagctgggagcccctggatgcccctgagggcaagctgcagggcagccgctgtgacaacagcagctgcagcaagctgcccccccaggagggccggggcatcgcccaggagcagctgttccaggagaagaaggaccctgccaaccccagccctgtgatgcctggcatcgccaccagcgagagaggagatgagcacagcctgggctgcagccccagcaacagcagcgcccagcccagcctgcccctgtaccgcacctgccaccccatcatgcctgtggccagcagctttgtgctgcactgcccagaccctgtgcagaagaccaaccagtgcctgcagggccagagcctgaagaccagcctgaccctgaaggtggaccggggcagcgaggagacctacagacctgagttccccagcaccaagggcctggtgcgcagcctggccgagcagttccagaggatgcagggcgtgtccatgagggacagcacaggcttcaaggacaggagcctgagcggcagcctgaggaagaacagcagccccagcgacagcaagccacccttcagccagggccaggagaagggccactggccctgggccaagcagcagagcagcctggagggcggggaccggcccctgtcctgggaggagagcacagagcacagcagcctggccctgaacagcggcctgcccaacggggagaccagcagcggcggccagccccggctggccgagccagacatctaccaggagaagctgagccaggtgagagatgtgcgcagcaaggacctgggcagcagcacagacctgggcaccagcctgcccctggacagctgggtgaacatcacccgcttctgtgacagccagctgaagcacggggcccccaggcctggcatgaagagcagcccccatgacagccacacctgtgtgacctacccagagaggaaccacatcctgctgcacccccactggaaccaggacacagagcaggagaccagcgagctggagagcctgtaccaggccagcctgcaggccagccaggccggctgcagcggctggggccagcaggacacagcctggcaccccctgagccagacaggcagcgcagatggcatgggccggcggctgcacagcgcccatgaccccggcctgagcaagaccagcacagctgagatggagcacggcctgcacgaggccaggacagtgaggaccagccaggccaccccctgccggggcctgagccgggagtgtggagaagatgagcagtacagcgctgagaacctgcggcgcatcagccgcagcctgagcggcaccgtggtgtctgagcgggaggaggcccctgtgagcagccacagctttgacagcagcaatgtgaggaagcccctggagaccggccaccgctgcagcagcagcagcagcctgcctgtgattcatgaccccagcgtcttcctgctgggcccccagctgtacctgccccagccccagttcctgagcccagatgtgctgatgcccaccatggccggggagcccaaccggctgcccggcaccagccgctctgtgcagcagttcctggccatgtgtgacagaggagagaccagccagggcgccaagtacacaggccgcaccctgaactaccagagcctgccccacaggagcaggacagacaacagctgggccccctggagcgagaccaaccagcacatcggcacccgcttcctgaccaccccaggctgcaacccccagctgacctacacagccaccctgcctgagaggagcaagggcctgcaggtgccccacacccagagctggagcgacctcttccacagccccagccacccccccatcgtgcaccctgtgtacccacccagcagcagcctgcacgtgcccctgcggagcgcctggaacagcgaccctgtgcccggcagcaggaccccaggcccccggcgggtggacatgcccccagatgatgactggaggcagagcagctatgccagccacagcggccacagaagaacagtgggggagggcttcctgtttgtgctgagtgatgccccccggcgggagcagatccgggcccgggtgctgcagcacagccagtggtag

SEQ ID NO: 43099 - DNA, 2178 bp, Artificial Sequence
  Description of Artificial Sequence: Synthetic coding sequence
atggacacagaatttggagccagcagcttcttccacagccctgccagctgccacgagagccacagcagcctgagccctgagagcagcgccccccagcacagcagccccagccgcagcgccctgaagctgctgacctctgtggaggtggacaacatcgagcccagcgccttccaccggcagggcctgcccaaggcccctggctggacagagaagaacagccaccacagctgggagcccctggatgcccctgagggcaagctgcagggcagccgctgtgacaacagcagctgcagcaagctgcccccccaggagggccggggcatcgcccaggagcagctgttccaggagaagaaggaccctgccaaccccagccctgtgatgcctggcatcgccaccagcgagagaggagatgagcacagcctgggctgcagccccagcaacagcagcgcccagcccagcctgcccctgtaccgcacctgccaccccatcatgcctgtggccagcagctttgtgctgcactgcccagaccctgtgcagaagaccaaccagtgcctgcagggccagagcctgaagaccagcctgaccctgaaggtggaccggggcagcgaggagacctacagacctgagttccccagcaccaagggcctggtgcgcagcctggccgagcagttccagaggatgcagggcgtgtccatgagggacagcacaggcttcaaggacaggagcctgagcggcagcctgaggaagaacagcagccccagcgacagcaagccacccttcagccagggccaggagaagggccactggccctgggccaagcagcagagcagcctggagggcggggaccggcccctgtcctgggaggagagcacagagcacagcagcctggccctgaacagcggcctgcccaacggggagaccagcagcggcggccagccccggctggccgagccagacatctaccaggagaagctgagccaggtgagagatgtgcgcagcaaggacctgggcagcagcacagacctgggcaccagcctgcccctggacagctgggtgaacatcacccgcttctgtgacagccagctgaagcacggggcccccaggcctggcatgaagagcagcccccatgacagccacacctgtgtgacctacccagagaggaaccacatcctgctgcacccccactggaaccaggacacagagcaggagaccagcgagctggagagcctgtaccaggccagcctgcaggccagccaggccggctgcagcggctggggccagcaggacacagcctggcaccccctgagccagacaggcagcgcagatggcatgggccggcggctgcacagcgcccatgaccccggcctgagcaagaccagcacagctgagatggagcacggcctgcacgaggccaggacagtgaggaccagccaggacagcagcaatgtgaggaagcccctggagaccggccaccgctgcagcagcagcagcagcctgcccgtcatccatgaccccagcgtcttcctgctgggcccccagctgtacctgccccagccccagttcctgagcccagatgtgctgatgcccaccatggccggggagcccaaccggctgcccggcaccagccgctctgtgcagcagttcctggccatgtgtgacagaggagagaccagccagggcgccaagtacacaggccgcaccctgaactaccagagcctgccccacaggagcaggacagacaacagctgggccccctggagcgagaccaaccagcacatcggcacccgcttcctgaccaccccaggctgcaacccccagctgacctacacagccaccctgcctgagaggagcaagggcctgcaggtgccccacacccagagctggagcgacctcttccacagccccagccacccccccatcgtgcaccctgtgtacccacccagcagcagcctgcacgtgcccctgcggagcgcctggaacagcgaccctgtgcccggcagcaggaccccaggccccaggagagtggacatgcccccagatgatgactggaggcagagcagctatgccagccacagcggccacagaagaacagtgggggagggcttcctgtttgtgctgagtgatgccccccggcgggagcagatccgggcccgggtgctgcagcacagccagtggtag

SEQ ID NO: 43100 - DNA, 5055 bp, Artificial Sequence; identical to SEQ ID NO: 43098
  Description of Artificial Sequence: Synthetic coding sequence

SEQ ID NO: 43101 - DNA, 462 bp, Artificial Sequence
  Description of Artificial Sequence: Synthetic coding sequence
atgtcctggaagaggaactacttcagcggcggccggggctctgtgcagggcatgtttgcccccaggagcagcaccagcatcgcccccagcaagggcctgagcaatgaacctggccagaacagctgcttcctgaacagcgccctgcaggtgctgtggcacctggacatcttccgccgctccttccggcagctgaccacccacaagtgcatgggagacagctgcatcttctgtgccctgaagggcatcttcaaccagttccagtgcagcagcgagaaggtgctgcccagcgacaccctgcggagcgccctggccaagaccttccaggatgagcagcgcttccagctgggcatcatggatgatgctgctgaatgttttgagaacctgctgatgaggatccacttccacatcgcagatgagaccaaggaggacatctgcacagcccagcactgcatcagccactag

SEQ ID NO: 43102 - DNA, 2460 bp, Artificial Sequence
  Description of Artificial Sequence: Synthetic coding sequence
atggacctggatgagctgcagaaccaggccaagctgcggctggccctgcatggagccagctgcagcacccacagccgggccctggtggacaagaagctgcagatcagcatcaggaaggcccggagcctgcaggacaggatgcagcagcagcagagcccccagcagcccagccagcccagcgcctgcctgcccacccaggccggcaccctgagccagcccaccagcgagcagcccatccccctgcaggtgctgctgagccaggaggcccagctggagagcggcatggacacagaatttggagccagcagcttcttccacagccctgccagctgccacgagagccacagcagcctgagccctgagagcagcgccccccagcacagcagccccagccgcagcgccctgaagctgctgacctctgtggaggtggacaacatcgagcccagcgccttccaccggcagggcctgcccaaggcccctggctggacagagaagaacagccaccacagctgggagcccctggatgcccctgagggcaagctgcagggcagccgctgtgacaacagcagctgcagcaagctgcccccccaggagggccggggcatcgcccaggagcagctgttccaggagaagaaggaccctgccaaccccagccctgtgatgcctggcatcgccaccagcgagagaggagatgagcacagcctgggctgcagccccagcaacagcagcgcccagcccagcctgcccctgtaccgcacctgccaccccatcatgcctgtggccagcagctttgtgctgcactgcccagaccctgtgcagaagaccaaccagtgcctgcagggccagagcctgaagaccagcctgaccctgaaggtggaccggggcagcgaggagacctacagacctgagttccccagcaccaagggcctggtgcgcagcctggccgagcagttccagaggatgcagggcgtgtccatgagggacagcacaggcttcaaggacaggagcctgagcggcagcctgaggaagaacagcagccccagcgacagcaagccacccttcagccagggccaggagaagggccactggccctgggccaagcagcagagcagcctggagggcggggaccggcccctgtcctgggaggagagcacagagcacagcagcctggccctgaacagcggcctgcccaacggggagaccagcagcggcggccagccccggctggccgagccagacatctaccaggagaagctgagccaggtgagagatgtgcgcagcaaggacctgggcagcagcacagacctgggcaccagcctgcccctggacagctgggtgaacatcacccgcttctgtgacagccagctgaagcacggggcccccaggcctggcatgaagagcagcccccatgacagccacacctgtgtgacctacccagagaggaaccacatcctgctgcacccccactggaaccaggacacagagcaggagaccagcgagctggagagcctgtaccaggccagcctgcaggccagccaggccggctgcagcggctggggccagcaggacacagcctggcaccccctgagccagacaggcagcgcagatggcatgggccggcggctgcacagcgcccatgaccccggcctgagcaagaccagcacagctgagatggagcacggcctgcacgaggccaggacagtgaggaccagccaggacagcagcaatgtgaggaagcccctggagaccggccaccgctgcagcagcagcagcagcctgcccgtcatccatgaccccagcgtcttcctgctgggcccccagctgtacctgccccagccccagttcctgagcccagatgtgctgatgcccaccatggccggggagcccaaccggctgcccggcaccagccgctctgtgcagcagttcctggccatgtgtgacagaggagagaccagccagggcgccaagtacacaggccgcaccctgaactaccagagcctgccccacaggagcaggacagacaacagctgggccccctggagcgagaccaaccagcacatcggcacccgcttcctgaccaccccaggctgcaacccccagctgacctacacagccaccctgcctgagaggagcaagggcctgcaggtgccccacacccagagctggagcgacctcttccacagccccagccacccccccatcgtgcaccctgtgtacccacccagcagcagcctgcacgtgcccctgcggagcgcctggaacagcgaccctgtgcccggcagcaggaccccaggccccaggagagtggacatgcccccagatgatgactggaggcagagcagctatgccagccacagcggccacagaagaacagtgggggagggcttcctgtttgtgctgagtgatgccccccggcgggagcagatccgggcccgggtgctgcagcacagccagtggtag

SEQ ID NO: 43103 - DNA, 4605 bp, Artificial Sequence
  Description of Artificial Sequence: Synthetic coding sequence
atgtcctggaagaggaactacttcagcggcggccggggctctgtgcagggcatgtttgcccccaggagcagcaccagcatcgcccccagcaagggcctgagcaatgaacctggccagaacagctgcttcctgaacagcgccctgcaggtgctgtggcacctggacatcttccgccgctccttccggcagctgaccacccacaagtgcatgggagacagctgcatcttctgtgccctgaagggcatcttcaaccagttccagtgcagcagcgagaaggtgctgcccagcgacaccctgcggagcgccctggccaagaccttccaggatgagcagcgcttccagctgggcatcatggatgatgctgctgagtgcttcctgttcttccgggtgacagatgaccgggccaagcagagcgagctgtacctggtgggcatgatctgctactacggcaagcactacagcaccttcttcttccagaccaagatcaggaagtggatgtactttgatgatgcccacgtgaaggagatcggccccaagtggaaggatgtggtgaccaagtgcatcaagggccactaccagcccctgctgctgctgtatgctgacccccagggcacccctgtgtccacccaggacctgcccccccaggccgagttccagagctacagcaggacctgctatgacagtgaagattctggccgggagcccagcatcagcagtgacaccaggacagacagcagcacagagagctacccctacaagcacagccaccatgaatctgtggtgagccacttcagcagtgacagccagggcaccgtcatctacaacgtggagaatgacagcatgagccagagcagccgggacaccggccacctgacagacagcgagtgcaaccagaagcacaccagcaagaagggcagcctcatcgagaggaagaggagcagcggccgggtgcggaggaaaggagatgagccccaggccagcggctaccacagcgagggggagaccctgaaggagaagcaggcccccagaaatgccagcaagcccagcagcagcaccaaccggctgcgggacttcaaggagaccgtgagcaacatgatccacaaccggcccagcctggccagccagaccaacgtgggcagccactgccggggccggggcggggaccagcctgacaagaagccacccaggaccctgcccctgcacagccgggactgggagattgagagcaccagcagcgagagcaagagcagcagcagcagcaagtaccggcccacctggaggcccaagcgggagagcctgaacatcgacagcatcttcagcaaggacaagaggaagcactgcggctacacccagctgagccccttctctgaagattctgccaaggagttcatcccagatgagcccagcaagcccccatcctatgacatcaagtttggaggccccagcccccagtacaagcgctggggccctgcccggcccggcagccacctgctggagcagcaccccaggctcatccagaggatggagagcggctatgagagcagcgagaggaacagcagcagccctgtgtccctggatgctgccctgcctgagagcagcaatgtgtacagagaccccagcgccaagaggtctgctggcctggtgcccagctggaggcacatccccaagagccacagcagcagcatcctggaggtggacagcacagcctccatgggcggctggaccaagagccagcccttctctggagaggagatcagcagcaagtctgagctggatgagctgcaggaggaggtggcccggcgggcccaggagcaggagctgcggaggaagcgggagaaggagctggaggccgccaagggcttcaacccccaccccagccgcttcatggacctggatgagctgcagaaccagggccgcagtgatggctttgagaggagcctgcaggaggccgagagcgtgtttgaggagagcctgcacctggagcagaagggggactgtgccgccgccctggccctgtgcaatgaggccatcagcaagctgcggctggccctgcatggagccagctgcagcacccacagccgggccctggtggacaagaagctgcagatcagcatcaggaaggcccggagcctgcaggacaggatgcagcagcagcagagcccccagcagcccagccagcccagcgcctgcctgcccacccaggccggcaccctgagccagcccaccagcgagcagcccatccccctgcaggtgctgctgagccaggaggcccagctggagagcggcatggacacagaatttggagccagcagcttcttccacagccctgccagctgccacgagagccacagcagcctgagccctgagagcagcgccccccagcacagcagccccagccgcagcgccctgaagctgctgacctctgtggaggtggacaacatcgagcccagcgccttccaccggcagggcctgcccaaggcccctggctggacagagaagaacagccaccacagctgggagcccctggatgcccctgagggcaagctgcagggcagccgctgtgacaacagcagctgcagcaagctgcccccccaggagggccggggcatcgcccaggagcagctgttccaggagaagaaggaccctgccaaccccagccctgtgatgcctggcatcgccaccagcgagagaggagatgagcacagcctgggctgcagccccagcaacagcagcgcccagcccagcctgcccctgtaccgcacctgccaccccatcatgcctgtggccagcagctttgtgctgcactgcccagaccctgtgcagaagaccaaccagtgcctgcagggccagagcctgaagaccagcctgaccctgaaggtggaccggggcagcgaggagacctacagacctgagttccccagcaccaagggcctggtgcgcagcctggccgagcagttccagaggatgcagggcgtgtccatgagggacagcacaggcttcaaggacaggagcctgagcggcagcctgaggaagaacagcagccccagcgacagcaagccacccttcagccagggccaggagaagggccactggccctgggccaagcagcagagcagcctggagggcggggaccggcccctgtcctgggaggagagcacagagcacagcagcctggccctgaacagcggcctgcccaacggggagaccagcagcggcggccagccccggctggccgagccagacatctaccaggagaagctgagccaggtgagagatgtgcgcagcaaggacctgggcagcagcacagacctgggcaccagcctgcccctggacagctgggtgaacatcacccgcttctgtgacagccagctgaagcacggggcccccaggcctggcatgaagagcagcccccatgacagccacacctgtgtgacctacccagagaggaaccacatcctgctgcacccccactggaaccaggacacagagcaggagaccagcgagctggagagcctgtaccaggccagcctgcaggccagccaggccggctgcagcggctggggccagcaggacacagcctggcaccccctgagccagacaggcagcgcagatggcatgggccggcggctgcacagcgcccatgaccccggcctgagcaagaccagcacagctgagatggagcacggcctgcacgaggccaggacagtgaggaccagccaggccaccccctgccggggcctgagccgggagtgtggagaagatgagcagtacagcgctgagaacctgcggcgcatcagccgcagcctgagcggcaccgtggtgtctgagcgggaggaggcccctgtgagcagccacagctttgacagcagcaatgtgaggaagcccctggagaccggccaccgctgcagcagcagcagcagcctgcctgtgattcatgaccccagcgtcttcctgctgggcccccagctgtacctgccccagccccagttcctgagcccagatgtgctgatgcccaccatggccggggagcccaaccggctgcccggcaccagccgctctgtgcagcagttcctggccatgtgtgacagaggagagaccagccagggcgccaagtacacaggccgcaccctgaactaccagagcctgccccacaggagcaggacagacaacagctgggccccctggagcgagaccaaccagcacatcggcacccgcttcctgaccaccccaggctgcaacccccagctgacctacacagccaccctgcctgagaggagcaagggcctgcaggtgccccacacccagagctggagcgacctcttccacagccccagccacccccccatcgtgcaccctgtgtacccacccagcagcagcctgcacgtgcccctgcggagcgcctggaacagcgaccctgtgcccggcagcaggaccccaggcccccggcgggtggacatgcccccagatgatgactggaggcagagcagctatgccagccacagcggccacagaagaacagtgggggagggcttcctgtttgtgctgagtgatgccccccggcgggagcagatccgggcccgggtgctgcagcacagccagtggtag

SEQ ID NO: 43104 - DNA, 243 bp, Artificial Sequence
  Description of Artificial Sequence: Synthetic coding sequence
atgtcctggaagaggaactacttcagcggcggccggggctctgtgcagggcatgtttgcccccaggagcagcaccagcatcgcccccagcaagggcctgagcaatgaacctggccagaacagctgcttcctgaacagcgccctgcaggtgctgtggcacctggacatcttccgccgctccttccggcagctgaccacccacaagtgcatgggagacagctgcatcttctgtgccctgaagtag

SEQ ID NO: 43105 - DNA, 3279 bp, Artificial Sequence
  Description of Artificial Sequence: Synthetic coding sequence
atgatggacagccccaagattggaaatggcctgcccgtcatcggccctggaacagacatcggcatcagcagcctgcacatggtgggctacctgggcaagaactttgattctgccaaggtgcccagtgatgagtactgcccagcctgccgggagaagggcaagctgaaggccctgaagacctaccgcatctccttccaggagagcatcttcctgtgtgaggacctgcagtgcatctaccccctgggcagcaagagcctgaacaacctgatcagcccagacctggaggagtgccacaccccccacaagccccagaagaggaagagcctggagagcagctacaaggacagcctgctgctggccaacagcaagaagaccaggaactacatcgccattgatggcggcaaggtgctgaacagcaagcacaacggggaggtgtatgatgagaccagcagcaacctgcctgacagcagcggccagcagaaccccatcagaacagctgacagcctggagagaaatgagatcctggaggccgacacagtggacatggccaccaccaaggaccctgccaccgtggatgtgtctggcaccggccggcccagcccccagaatgaaggctgcaccagcaagctggagatgcccctggagagcaagtgcaccagcttcccccaggccctgtgtgtgcagtggaagaatgcctatgccctgtgctggctggactgcatcctgagcgccctggtgcacagcgaggagctgaagaacacagtgacaggcctgtgcagcaaggaggagagcatcttctggaggctgctgaccaagtacaaccaggccaacaccctgctgtacaccagccagctgagcggcgtgaaggatggagactgcaagaagctgaccagcgagatctttgctgagattgagacctgcctgaatgaggtgagagatgagatcttcatcagcctgcagccccagctgcgctgcaccctgggggacatggagagccctgtgtttgccttccccctgctgctgaagctggagacccacatcgagaagctgttcctgtacagcttctcctgggactttgagtgcagccagtgtggccaccagtaccagaacagacacatgaagagcctggtgaccttcaccaacgtcatccctgagtggcaccccctgaatgctgcccacttcggcccctgcaacaactgcaacagcaagagccagatcaggaagatggtgctggagaaggtgagccccatcttcatgctgcactttgtggagggcctgccccagaatgacctgcagcactacgccttccactttgagggctgcctgtaccagatcaccagcgtcatccagtaccgggccaacaaccacttcatcacctggatcctggatgctgatggctcctggctggagtgtgatgacctgaagggcccctgcagcgagcggcacaagaagtttgaggtgcctgccagcgagatccacatcgtcatctgggagaggaagatcagccaggtgacagacaaggaggccgcctgcctgcccctgaagaagaccaatgaccagcacgccctgagcaatgagaagcctgtgtccctgaccagctgcagcgtgggagatgctgccagcgctgagacagcctctgtgacccaccccaaggacatctctgtggcccccaggaccctgagccaggacacagctgtgacccacggggaccacctgctgagcggccccaagggcctggtggacaacatcctgcccctgaccctggaggagaccatccagaagacagcctctgtgtcccagctgaacagcgaggccttcctgctggagaacaagcctgtggctgaaaatacaggcatcctgaagaccaacaccctgctgagccaggagagcctgatggccagctctgtgtctgccccctgcaatgagaagctgatccaggaccagtttgtggacatctccttccccagccaggtggtgaacaccaacatgcagagcgtgcagctgaacacagaagatactgtgaacaccaagtctgtgaacaacacagatgccaccggcctcatccagggcgtgaagtctgtggagattgagaaggatgcccagctgaagcagttcctgacccccaagacagagcagctgaagccagagcgggtgaccagccaggtgagcaacctgaagaagaaggagaccacagctgacagccagaccaccaccagcaagagcctgcagaaccagagcctgaaggagaaccagaagaagccctttgtgggctcctgggtgaagggcctcatcagcagaggagccagcttcatgcccctgtgtgtgtctgcccacaacagaaacaccatcacagacctgcagcccagcgtgaagggcgtgaacaactttggaggcttcaagaccaagggcatcaaccagaaggccagccacgtgtccaagaaggccaggaagagcgccagcaagcccccacccatcagcaagcccccagctggcccccccagcagcaatggaacagctgcccacccccacgcccacgccgccagcgaggtgctggagaagagcggcagcaccagctgtggggcccagctgaaccacagcagctatggaaatggcatcagcagcgccaaccacgaggacctggtggagggccagatccacaagctgcggctgaagctgaggaagaagctgaaggccgagaagaagaagctggccgccctgatgagcagcccccagagcaggacagtgcgctctgagaacctggagcaggtgccccaggacggcagccccaatgactgtgagagcattgaggacctgctgaatgagctgccctaccccatcgacatcgccagcgagagcgcctgcaccaccgtgcctggggtgtccctgtacagcagccagacccatgaggagatcctggccgagctgctgagccccacccctgtgtccacagagctgtctgaaaatggagagggggacttccgctacctgggcatgggagacagccacatccccccacctgtgcccagcgagttcaatgatgtgtcccagaacacccacctgcggcaggaccacaactactgcagccccaccaagaagaacccctgtgaggtgcagcctgacagcctgaccaacaatgcctgtgtgaggaccctgaacctggagagccccatgaagacagacatctttgatgagttcttcagcagcagcgccctgaatgccctggccaatgacaccctggacctgccccactttgatgagtacctgtttgagaactactag

SEQ ID NO: 43106 - DNA, 357 bp, Artificial Sequence
  Description of Artificial Sequence: Synthetic coding sequence
atgttccactggcaggccaccatcatgggccccaatgacagcccctaccagggcggcgtcttcttcctgaccatccacttccccacagactaccccttcaagccacccaaggtggccttcaccacccgcatctaccaccccaacatcaacagcaatggcagcatctgcctggacatcctgcggagccagtggagccctgccctgaccatcagcaaggtgctgctgagcatctgcagcctgctgtgtgaccccaacccagatgaccccctggtgcctgagatcgcccgcatctacaagacagaccgggagaagtacaaccgcatcgcccgggagtggacccagaagtatgccatgtag

SEQ ID NO: 43107 - DNA, 444 bp, Artificial Sequence
  Description of Artificial Sequence: Synthetic coding sequence
atggccctgaagaggatccacaaggagctgaatgacctggcccgggaccccccagcccagtgcagcgctggccctgtgggagatgacatgttccactggcaggccaccatcatgggccccaatgacagcccctaccagggcggcgtcttcttcctgaccatccacttccccacagactaccccttcaagccacccaaggtggccttcaccacccgcatctaccaccccaacatcaacagcaatggcagcatctgcctggacatcctgcggagccagtggagccctgccctgaccatcagcaaggtgctgctgagcatctgcagcctgctgtgtgaccccaacccagatgaccccctggtgcctgagatcgcccgcatctacaagacagaccgggagaagtacaacagaattgcccgggagtggacccagaagtatgccatgtag

SEQ ID NO: 43108 - DNA, 444 bp, Artificial Sequence; identical to SEQ ID NO: 43107
  Description of Artificial Sequence: Synthetic coding sequence

SEQ ID NO: 43109 - DNA, 357 bp, Artificial Sequence; identical to SEQ ID NO: 43106
  Description of Artificial Sequence: Synthetic coding sequence

SEQ ID NO: 43110 - DNA, 5361 bp, Artificial Sequence
  Description of Artificial Sequence: Synthetic coding sequence
atgggcctgctgcagctgctggccttctccttcctggccctgtgccgggcccgggtgcgggcccaggagcctgagttctcctatggctgtgccgagggcagctgctacccagccactggagacctgctgattggccgggcccagaagctgtctgtgaccagcacctgtggcctgcacaagccagagccctactgcatcgtgagccacctgcaggaggacaagaagtgcttcatctgcaacagccaggacccctaccacgagaccctgaacccagacagccacctgattgaaaatgtggtgaccacctttgcccccaaccggctgaagatctggtggcagagtgaaaatggagtggagaatgtgaccatccagctggacctggaggccgagttccacttcacccacctgatcatgaccttcaagaccttccggcctgctgccatgctgattgaaagaagcagtgactttgggaagacctggggcgtgtaccgctactttgcctatgactgtgaggccagcttccctggcatcagcacaggccccatgaagaaggtggatgacatcatctgtgacagccgctacagcgacatcgagcccagcacagaaggagaggtgatcttccgggccctggaccctgccttcaagattgaggacccctacagcccccgcatccagaacctgctgaagatcaccaacctgcgcatcaagtttgtgaagctgcacaccctgggggacaacctgctggacagcaggatggagatccgggagaagtactactatgctgtgtatgacatggtggtgcggggcaactgcttctgctacggccacgcctctgaatgtgcccctgtggatggcttcaatgaggaggtggagggcatggtgcacggccactgcatgtgccgccacaacaccaagggcctgaactgtgagctgtgcatggacttctaccatgacctgccctggaggcctgctgagggcaggaacagcaatgcctgcaagaagtgcaactgcaatgagcacagcatcagctgccactttgacatggctgtgtacctggccactggaaatgtgtctgggggcgtgtgtgatgactgccagcacaacaccatgggcaggaactgtgagcagtgcaagcccttctactaccagcaccctgagcgggacatccgggaccccaacttctgtgagcgctgcacctgtgaccctgctggcagccagaatgaaggcatctgtgacagctacacagacttcagcacaggcctgattgctggccagtgccgctgcaagctgaatgtggagggggagcactgtgatgtgtgcaaggagggcttctatgacctgagcagcgaggaccccttcggctgcaagagctgtgcctgcaaccccctgggcaccatccctgggggcaacccctgtgacagcgagaccggccactgctactgcaagaggctggtgacaggccagcactgtgaccagtgcctgcctgagcactggggcctgagcaatgacctggatggctgccggccctgtgactgtgacctgggcggggccctgaacaacagctgctttgctgagagcggccagtgcagctgccggccccacatgattggccggcagtgcaatgaggtggagcccggctactactttgccaccctggaccactacctgtatgaagctgaggaggccaacctgggccctggggtgtccatcgtggagcggcagtacatccaggaccgcatccccagctggacaggagctggctttgtgcgggtgcctgagggcgcctacctggagttcttcatcgacaacatcccctacagcatggagtatgacatcctgatccgctatgagccccagctgcctgaccactgggagaaggctgtgatcaccgtgcagaggcctggccgcatccccaccagcagccgctgtggcaacaccatcccagatgatgacaaccaggtggtgtccctgagccctggcagccgctacgtggtgctgcccaggcctgtgtgctttgagaagggcaccaactacacagtgcggctggagctgccccagtacaccagcagtgacagtgatgtggagagcccctacaccctgattgacagcctggtgctgatgccctactgcaagagcctggacatcttcaccgtgggcggcagcggagatggagtggtgaccaacagcgcctgggagaccttccagcgctaccgctgcctggagaacagccgctctgtggtgaagacccccatgacagatgtgtgcaggaacatcatcttcagcatcagcgccctgctgcaccagacaggcctggcctgtgaatgtgacccccagggcagcctgagctctgtgtgtgaccccaacggcggccagtgccagtgccggcccaacgtggtgggccgcacctgcaacagatgtgcccctggcacctttggatttggccccagcggctgcaagccctgtgagtgccacctgcagggctctgtgaatgccttctgcaaccctgtgacaggccagtgccactgcttccagggcgtgtatgcccggcagtgtgaccgctgcctgcccggccactggggcttccccagctgccagccctgccagtgcaatggacatgctgatgactgtgaccctgtgactggagagtgcctgaactgccaggactacaccatgggccacaactgtgagcgctgcctggccggctactatggagaccccatcatcggcagcggggaccactgccggccctgcccctgcccagatggcccagattctggccggcagtttgcccggagctgctaccaggaccctgtgaccctgcagctggcctgtgtgtgtgaccccggctacatcggcagccgctgtgatgactgtgccagcggctactttggaaaccccagcgaggtgggcggcagctgccagccctgccagtgccacaacaacatcgacaccacagatcctgaggcctgtgacaaggagaccggccgctgcctgaagtgcctgtaccacacagaaggagagcactgccagttctgccgcttcggctactatggagatgccctgcagcaggactgcaggaaatgtgtgtgcaactacctgggcaccgtgcaggagcactgcaatggaagtgactgccagtgtgacaaggccaccggccagtgcctgtgcctgcccaacgtgattggccagaactgtgacagatgtgcccccaacacctggcagctggccagcggcaccggctgtgacccctgcaactgcaatgctgcccacagctttggccccagctgcaatgagttcaccggccagtgccagtgcatgcctggctttggaggccgcacctgcagcgagtgccaggagctgttctggggagaccctgatgtggagtgccgggcctgtgactgtgacccccggggcatcgagaccccccagtgtgaccagagcacaggccagtgtgtgtgtgtggagggcgtggagggcccccgctgtgacaagtgcacccggggctacagcggggtcttcccagactgcaccccctgccaccagtgctttgccctgtgggatgtgatcatcgccgagctgaccaacagaacccaccgcttcctggagaaggccaaggccctgaagatcagcggcgtgattggcccctaccgggagaccgtggacagcgtggagaggaaggtgtctgagatcaaggacatcctggcccagagccctgctgctgagcccctgaagaacatcggcaacctgtttgaggaggccgagaagctgatcaaggatgtgacagagatgatggcccaggtggaggtgaagctgagtgacaccaccagccagagcaacagcacagccaaggagctggacagcctgcagacagaggccgagagcctggacaacacagtgaaggagctggccgagcagctggagttcatcaagaacagcgacatccggggggccctggacagcatcaccaagtacttccagatgagcctggaggccgaggagcgggtgaatgccagcaccacagagcccaacagcacagtggagcagagcgccctgatgagggacagagtggaggatgtgatgatggagcgggagagccagttcaaggagaagcaggaggagcaggcccggctgctggatgagctggccggcaagctgcagagcctggacctgtctgctgctgctgagatgacctgtggcaccccacctggggccagctgcagcgagacagaatgtggcggccccaactgcaggacagatgaaggagagaggaaatgtggcggccctggctgcggcggcctggtgacagtggcccacaatgcctggcagaaggccatggacctggaccaggatgtgctgagcgccctggccgaggtggagcagctgagcaagatggtgtctgaggccaagctgcgggcagatgaggccaagcagagcgctgaggacatcctgctgaagaccaatgccaccaaggagaagatggacaagagcaatgaggagctgaggaacctgatcaagcagatccggaacttcctgacccaggacagcgctgacctggacagcattgaagctgtggccaatgaggtgctgaagatggagatgcccagcaccccccagcagctgcagaacctgacagaggacatccgggagcgggtggagagcctgagccaggtggaggtgatcctgcagcacagcgctgctgacatcgcccgggcagagatgctgctggaggaggccaagagggccagcaagagcgccacagatgtgaaggtgacagctgacatggtgaaggaggccctggaggaggccgagaaggcccaggtggccgctgagaaggccatcaagcaggctgatgaggacatccagggcacccagaacctgctgaccagcattgagagcgagacagctgccagcgaggagaccctcttcaatgccagccagaggatcagcgagctggagagaaatgtggaggagctgaagaggaaggccgcccagaacagcggggaggccgagtacatcgagaaggtggtgtacacagtgaagcagagcgcagaagatgtgaagaagaccctggatggagagctggatgagaagtacaagaaggtggagaacctgattgccaagaagacagaggagagcgcagatgcccggaggaaggccgagatgctgcagaatgaggccaagaccctgctggcccaggccaacagcaagctgcagctgctgaaggacctggagaggaaatatgaggacaaccagcgctacctggaggacaaggcccaggagctggcccggctggagggggaggtgcgcagcctgctgaaggacatcagccagaaggtggccgtgtacagcacctgcctgtag

SEQ ID NO: 43111 - DNA, 330 bp, Artificial Sequence
  Description of Artificial Sequence: Synthetic coding sequence
atgaccaatgacagcccctaccagggcggcgtcttcttcctgaccatccacttccccacagactaccccttcaagccacccaaggtggccttcaccaccaagatctaccaccccaacatcaacagcaatggcagcatctgcctggacatcctgcggagccagtggagccctgccctgactgtgtccaaggtgctgctgagcatctgcagcctgctgtgtgaccccaacccagatgaccccctggtgcctgagatcgcccacacctacaaggctgaccgggagaagtacaaccggctggcccgggagtggacccagaagtatgccatgtag

SEQ ID NO: 43112 - DNA, 558 bp, Artificial Sequence
  Description of Artificial Sequence: Synthetic coding sequence
atgctgaccctggccagcaagctgaagagagatgatggcctgaagggcagcaggacagctgccacagccagtgacagcacccggcgggtgtctgtgcgggacaagctgctggtgaaggaggtggccgagctggaggccaacctgccctgcacctgcaaggtgcacttcccagaccccaacaagctgcactgcttccagctgactgtgaccccagatgagggctactaccagggcggcaagttccagtttgaaacagaggtgcctgatgcctacaacatggtgccccccaaggtgaagtgcctgaccaagatctggcaccccaacatcacagagaccggggagatctgcctgagcctgctgcgggagcacagcattgatggcaccggctgggcccccaccaggaccctgaaggatgtggtgtggggcctgaacagcctcttcacagacctgctgaactttgatgaccccctgaacattgaagctgctgagcaccacctgcgggacaaggaggacttcaggaacaaggtggatgactacatcaagagatatgccaggtag

SEQ ID NO: 43113 - DNA, 462 bp, Artificial Sequence
  Description of Artificial Sequence: Synthetic coding sequence
atgctgaccctggccagcaagctgaagagagatgatggcctgaagggcagcaggacagctgccacagccagtgacagcacccggcgggtgtctgtgcgggacaagctgctggtgaaggatgagggctactaccagggcggcaagttccagtttgaaacagaggtgcctgatgcctacaacatggtgccccccaaggtgaagtgcctgaccaagatctggcaccccaacatcacagagaccggggagatctgcctgagcctgctgcgggagcacagcattgatggcaccggctgggcccccaccaggaccctgaaggatgtggtgtggggcctgaacagcctcttcacagacctgctgaactttgatgaccccctgaacattgaagctgctgagcaccacctgcgggacaaggaggacttcaggaacaaggtggatgactacatcaagagatatgccaggtag

SEQ ID NO: 43114 - DNA, 516 bp, Artificial Sequence
  Description of Artificial Sequence: Synthetic coding sequence
atgctgaccctggccagcaagctgaagagagatgatggcctgaagggcagcaggacagctgccacagccagtgacagcacccggcgggtgtctgtgcgggacaagctgctggtgaaggaggtggccgagctggaggccaacctgccctgcacctgcaaggtgcacttcccagaccccaacaagctgcactgcttccagctgactgtgaccccagatgagggctactaccagggcggcaagttccagtttgaaacagaggtgcctgatgcctacaacatggtgccccccaaggtgaagtgcctgaccaagatctggcaccccaacatcacagagaccggggagatctgcctgagcctgctgcgggagcacagcattgatggcaccggctgggcccccaccaggaccctgaaggatgtggtgtggggcctgaacagcctcttcacagacctgctgaactttgatgaccccctgaacattgaagctgctgagcaccacctgcgggacaaggaggactag

SEQ ID NO: 43115 - DNA, 513 bp, Artificial Sequence
  Description of Artificial Sequence: Synthetic coding sequence
atgacagagctgcagagcgccctgctgctgcggcggcagctggccgagctgaacaagaaccctgtggagggcttctctgctggcctgattgatgacaatgacctgtaccgctgggaggtgctgatcatcggccccccagacaccctgtatgagggcggcgtcttcaaggcccacctgaccttccccaaggactaccccctgcggccccccaagatgaagttcatcacagagatctggcaccccaacgtggacaagaatggagatgtgtgcatcagcatcctgcacgagcctggagaggacaagtatggctatgagaagccagaggagcgctggctgcccatccacacagtggagaccatcatgatcagcgtcatctccatgctggccgaccccaacggggacagccctgccaacgtggatgctgccaaggagtggagagaagatagaaatggagagttcaagaggaaggtggcccgctgtgtgaggaagagccaggagacagcctttgaatag

SEQ ID NO: 43116 - DNA, 552 bp, Artificial Sequence
  Description of Artificial Sequence: Synthetic coding sequence
atgatcaagctgttcagcctgaagcagcagaagaaggaggaggagagcgctgggggcaccaagggcagcagcaagaaggccagcgctgcccagctgcgcatccagaaggacatcaatgagctgaacctgcccaagacctgtgacatctccttcagtgaccctgatgacctgctgaacttcaagctggtgatctgcccagatgagggcttctacaagagcggcaagtttgtgttctccttcaaggtgggccagggctacccccatgacccccccaaggtgaagtgtgagaccatggtgtaccaccccaacatcgacctggagggcaatgtgtgcctgaacatcctgcgggaggactggaagcctgtgctgaccatcaacagcatcatctacggcctgcagtacctgttcctggagcccaaccctgaggaccccctgaacaaggaggccgctgaggtgctgcagaacaacagaagactctttgagcagaatgtgcagaggtccatgaggggcggctacatcggcagcacctactttgagcgctgcctgaagtag

SEQ ID NO: 43117 - DNA, 3879 bp, Artificial Sequence
  Description of Artificial Sequence: Synthetic coding sequence
atggctgaccctgctgcccccaccccagctgccccagccccagcccaggccccagccccagcccctgaggccgtgcctgccccagctgctgcccctgtgcctgccccagccccagccagtgacagcgccagcggccccagcagtgacagcggccctgaggccggcagccagaggctgctcttcagccatgacctggtgtctggccgctaccggggctctgtgcacttcggcctggtgcggctcatccatggagaagattctgattctgagggggaggaggagggccggggcagcagcggctgcagcgaggccggcggggccggccacgaggagggccgggccagccccctgcggcggggctacgtgcgggtgcagtggtacccagagggcgtgaagcagcacgtgaaggagaccaagctgaagctggaggacagatctgtggtgcccagagatgtggtgcgccacatgaggagcacagacagccagtgtggcaccgtgattgatgtgaacatcgactgtgctgtgaagctgattggcaccaactgcatcatctaccctgtgaacagcaaggacctgcagcacatctggcccttcatgtacggggactacatcgcctatgactgctggctgggcaaggtgtatgacctgaagaaccagatcatcctgaagctgagcaatggagcccgctgcagcatgaacacagaagatggagccaagctgtatgatgtgtgcccccacgtgtctgacagcggcctcttctttgatgacagctatggcttctacccaggccaggtgctgattggccctgccaagatcttcagctctgtgcagtggctgagcggcgtgaagcctgtgctgagcaccaagagcaagttccgggtggtggtggaggaggtgcaggtggtggagctgaaggtgacctggatcaccaagagcttctgccctgggggcacagacagcgtgtccccaccacccagcgtcatcacccaggagaacctgggccgggtgaagaggctgggctgctttgaccacgcccagaggcagctgggggagcgctgcctgtatgtgtttcctgccaaggtggagcccgccaagatcgcctgggagtgcccagagaagaactgtgcccagggcgagggctccatggccaagaaggtgaagaggctgctgaagaagcaggtggtgcgcatcatgagctgcagcccagacacccagtgcagccgggaccacagcatggaggaccctgacaagaagggggagagcaagaccaagtctgaggccgagagcgccagccctgaggagaccccagatggcagcgccagccctgtggagatgcaggatgaaggagctgaggagccccatgaggccggggagcagctgccccccttcctgctgaaggagggcagagatgaccggctgcacagcgctgagcaggatgctgatgatgaggccgcagatgacacagatgacaccagctctgtgaccagcagcgccagcagcaccaccagcagccagagcggcagcggcaccagcaggaagaagagcatccccctgagcatcaagaacctgaagaggaagcacaagaggaagaagaacaagatcacccgggacttcaagccaggggacagagtggccgtggaggtggtgaccaccatgaccagcgcagatgtgatgtggcaggacggctctgtggagtgcaacatccgcagcaatgacctcttccctgtgcaccacctggacaacaatgagttctgccctggggactttgtggtggacaagagggtgcagagctgcccagaccctgctgtgtatggagtggtgcagagcggggaccacatcggccgcacctgcatggtgaagtggttcaagctgcggcccagcggagatgatgtggagctgattggagaggaggaggatgtgtctgtgtatgacattgctgaccacccagacttccgcttccgcaccacagacatcgtcatccgcatcggcaacacagaagatggagccccccacaaggaggatgagcccagcgtgggccaggtggcccgggtggatgtgagcagcaaggtggaggtggtgtgggccgacaacagcaagaccatcatcctgccccagcacctgtacaacatcgagagcgagattgaggagagtgactatgattctgtggagggcagcaccagcggggccagcagtgatgagtgggaggatgacagcgacagctgggagacagacaatggcctggtggaggatgagcaccccaagattgaggagccccccatcccccccctggagcagcctgtggcccctgaggacaagggcgtggtgatcagcgaggaggccgccacagctgctgtgcagggcgctgtggccatggccgcccccatggccggcctgatggagaaggccggcaaggatggcccccccaagagcttccgggagctgaaggaggccatcaagatcctggagagcctgaagaacatgacagtggagcagctgctgaccggcagccccaccagccccaccgtggagcctgagaagcccacccgggagaagaagttcctggatgacatcaagaagctgcaggagaacctgaagaagaccctggacaacgtggccatcgtggaggaggagaagatggaggccgtgcctgatgtggagaggaaagaagacaagccagagggccagagccctgtgaaggccgagtggcccagcgagacccctgtgctgtgccagcagtgtggcggcaagccaggagtgaccttcaccagcgccaagggggaggtgttttctgtgctggagtttgcccccagcaaccacagcttcaagaagattgagttccagcccccagaggccaagaagttcttcagcacagtgaggaaggagatggccctgctggccaccagcctgcctgagggcatcatggtgaagacctttgaggacaggatggacctcttcagcgccctgatcaagggccccaccaggaccccctatgaagatggcctgtacctgtttgacatccagctgcccaacatctacccagctgtgcccccccacttctgctacctgagccagtgcagcggccgcctgaaccccaacctgtatgacaacgggaaggtgtgtgtgtccctgctgggcacctggattggcaagggcacagagcgctggaccagcaagagcagcctgctgcaggtgctgatcagcatccagggcctcatcctggtgaatgagccctactacaatgaggccggctttgacagcgaccggggcctgcaggagggctatgagaacagccgctgctacaatgagatggccctgatccgggtggtgcagagcatgacccagctggtgagaagacctcctgaggtgtttgagcaggagatccggcagcacttcagcactggaggctggaggctggtgaaccgcatcgagagctggctggagacccacgccctgctggagaaggcccaggccctgcccaacggggtgcccaaggccagcagcagccctgagcccccagctgtggccgagctgagtgacagcggccagcaggagccagaagatggcggccctgcccctggagaggccagccagggcagtgacagcgagggcggggcccagggcctggccagcgccagccgggaccacacagaccagaccagcgagacagccccagatgcctctgtgcccccatctgtgaagcccaagaagaggaggaagagctaccgctccttcctgcctgagaagagcggctacccagacatcggcttccccctcttccccctgagcaagggcttcatcaagagcatccggggcgtgctgacccagttccgggccgccctgctggaggccggcatgccagaatgtacagaggacaagtag

SEQ ID NO: 43118 - DNA, 1269 bp, Artificial Sequence
  Description of Artificial Sequence: Synthetic coding sequence
atgcagcagccccagccccagggccagcagcagcccggccctggccagcagctgggcggccagggcgccgcccctggagctgggggcggccctgggggcggccctggccctggcccctgcctgcggcgggagctgaagctgctggagagcatcttccaccggggccacgagcgcttcagaattgccagcgcctgcctggatgagctgagctgtgagttcctgctggccggggccggcggggccggggccggggccgcccctggcccccacctgcccccccggggctctgtgcctggggaccctgtgcgcatccactgcaacatcacagagagctacccagctgtgccccccatctggagcgtggagagtgatgaccccaacctggccgctgtgctggagcggctggtggacatcaagaagggcaacaccctgctgctgcagcacctgaagaggatcatcagtgacctgtgcaagctgtacaacctgccccagcacccagatgtggagatgctggaccagcccctgcctgctgagcagtgcacccaggaggatgtgtccagtgaagatgaagatgaggagatgcctgaggacacagaggacctggaccactatgagatgaaggaggaggagcctgctgagggcaagaagtcagaagatgatggcatcggcaaggagaacctggccatcctggagaagatcaagaagaaccagaggcaggactacctgaatggagctgtgtctggctctgtgcaggccacagaccggctgatgaaggagctgcgggacatctaccgcagccagagcttcaagggcggcaactatgctgtggagctggtgaatgacagcctgtatgactggaatgtgaagctgctgaaggtggaccaggacagcgccctgcacaatgacctgcagatcctgaaggagaaggagggcgctgacttcatcctgctgaacttctccttcaaggacaacttcccctttgatcctccatttgtgcgggtggtgtcccctgtgctgagcggcggctacgtgctgggcggcggggccatctgcatggagctgctgaccaagcagggctggagcagcgcctacagcattgagagcgtcatcatgcagatcagcgccaccctggtgaagggcaaggcccgggtgcagtttggagccaacaagagccagtacagcctgacccgggcccagcagagctacaagagcctggtgcagatccacgagaagaatggctggtacaccccacccaaggaggatggatag

SEQ ID NO: 43119 - DNA, 486 bp, Artificial Sequence
  Description of Artificial Sequence: Synthetic coding sequence
atgaaggagctgcaggacatcgcccggctgagtgaccgcttcatctctgtggagctggtggatgagagcctgtttgactggaatgtgaagctgcaccaggtggacaaggacagcgtgctgtggcaggacatgaaggagaccaacacagagttcatcctgctgaacctgaccttcccagacaacttccccttcagcccccccttcatgagggtgctgagcccccggctggagaatggctacgtgctggatggaggagccatctgcatggagctgctgaccccccggggctggagcagcgcctacacagtggaggccgtgatgaggcagtttgctgccagcctggtgaagggccagggccgcatctgcaggaaggccggcaagagcaagaagagcttcagcaggaaggaggccgaggccaccttcaagagcctggtgaagacccatgagaagtatggctgggtgaccccacctgtgtctgatggatag

SEQ ID NO: 43120 - DNA, 681 bp, Artificial Sequence
  Description of Artificial Sequence: Synthetic coding sequence
atgcacggccgggcctacctgctgctgcaccgggacttctgtgacctgaaggagaacaactacaagggcatcacagccaagcctgtgtctgaggacatgatggagtgggaggtggagattgagggcctgcagaacagcgtgtggcagggcctggtgttccagctgaccatccacttcaccagcgagtacaactatgcccctcctgtggtgaagttcatcaccatccccttccaccccaacgtggacccccacacaggccagccctgcatcgacttcctggacaaccctgagaagtggaacaccaactacaccctgagcagcatcctgctggccctgcaggtgatgctgagcaaccctgtgctggagaaccctgtgaacctggaggccgcccgcatcctggtgaaggatgagagcctgtaccgcaccatcctgcggctcttcaaccggcccctgcagatgaaggatgacagccaggagctgcccaaggaccccaggaagtgcatccggcccatcaagaccaccagcttcagtgactactaccagacctggagccgcatcgccaccagcaaggccacagagtactaccgcacccccctgctgaaggtgcccaacttcatcggccagtactacaagtggaagaagatggacctgcagcaccagaaggagtggaacctgaagtag

SEQ ID NO: 43121 - DNA, 966 bp, Artificial Sequence
  Description of Artificial Sequence: Synthetic coding sequence
atgcacggccgggcctacctgctgctgcaccgggacttctgtgacctgaaggagaacaactacaagggcatcacagccaagcctgtgtctgaggacatgatggagtgggaggtggagattgagggcctgcagaacagcgtgtggcagggcctggtgttccagctgaccatccacttcaccagcgagtacaactatgcccctcctgtggtgaagttcatcaccatccccttccaccccaacgtggacccccacacaggccagccctgcatcgacttcctggacaaccctgagaagtggaacaccaactacaccctgagcagcatcctgctggccctgcaggtgatgctgagcaaccctgtgctggagaaccctgtgaacctggaggccgcccgcatcctggtgaaggatgagagcctgtaccgcaccatcctgcggctcttcaaccggcccctgcagatgaaggatgacagccaggagctgcccaaggaccccaggaagtgcatccggcccatcaagaccaccagcttcagtgactactaccagacctggagccgcatcgccaccagcaaggccacagagtactaccgcacccccctgctgaaggtgcccaacttcatcggccagtactacaagtggaagaagatggacctgcagcaccagaaggagtggaacctgaagtacagcgtcatcaagtgctggctggccaggaagaggatgcctcatgaggtgacccacagcatggaggagatcaagctgtgccccaccctcatccccaccacagatgagatcttcctggagagccccacagccatcaacagcatcacagacatctatgaaacagaggaggagggctggaagagtgacaccagcctgtatgaaaatgacacagatgagccccgggaggaggaggtggaggacctgatctcctggaccaacaccctgaacaccaacaccagcgaggactag

SEQ ID NO: 43122 - DNA, 504 bp, Artificial Sequence
  Description of Artificial Sequence: Synthetic coding sequence
atggctgatgaggccaccaggagagtggtgtctgagatccctgtgctgaagaccaatgccggcccccgggaccgggagctgtgggtgcagaggctgaaggaggagtaccagagcctcatccgctacgtggagaacaacaagaatgctgacaatgactggttccggctggagagcaacaaggagggcacccgctggtttgggaagtgctggtacatccatgacctgctgaagtatgaatttgacatcgagtttgacatccccatcacctaccccaccacagcccctgagattgctgtgcctgagctggatggcaagacagccaagatgtaccggggcggcaagatctgcctgacagaccacttcaagcccctgtgggccagaaatgtgcccaagtttggcctggcccacctgatggccctgggcctgggcccctggctggccgtggagatcccagacctgatccagaagggcgtcatccagcacaaggagaagtgcaaccagtag

SEQ ID NO: 43123 - DNA, 3177 bp, Artificial Sequence
  Description of Artificial Sequence: Synthetic coding sequence
atgagcagcagccccctgagcaagaagagaagagtgtctggccctgaccccaagccaggcagcaactgcagccctgcccagagcgtgctgtctgaggtgcccagcgtgcccaccaacggcatggccaagaatggcagcgaggccgacattgatgagggcctgtacagccggcagctgtatgtgctgggccacgaggccatgaagaggctgcagaccagctctgtgctggtgtctggcctgcggggcctgggcgtggagatcgccaagaacatcatcctgggcggcgtgaaggctgtgaccctgcatgaccagggcacagcccagtgggccgacctgagcagccagttctacctgcgggaggaggacatcggcaagaacagagctgaggtgtcccagccccggctggccgagctgaacagctatgtgcctgtgacagcctacacaggccccctggtggaggacttcctgagcggcttccaggtggtggtgctgaccaacacccccctggaggaccagctgcgggtgggggagttctgccacaacagaggcatcaagctggtggtggccgacacccggggcctgtttggccagctgttctgtgactttggagaggagatgatcctgacagacagcaatggagagcagcccctgagcgccatggtgtccatggtgaccaaggacaaccctggggtggtgacctgcctggatgaggcccggcacggctttgagagcggggactttgtgtccttcagcgaggtgcagggcatggtggagctgaatggaaaccagcccatggagatcaaggtgctgggcccctacaccttcagcatctgtgacaccagcaacttcagtgactacatccggggcggcatcgtgtcccaggtgaaggtgcccaagaagatctccttcaagagcctggtggccagcctggccgagccagactttgtggtgacagactttgccaagttcagcaggcctgcccagctgcacatcggcttccaggccctgcaccagttctgtgcccagcacggccggcccccccggcccagaaatgaagaagatgctgctgagctggtggccctggcccaggccgtgaatgcccgggccctgcctgctgtgcagcagaacaacctggatgaggacctgatcaggaagctggcctacgtggccgccggggacctggcccccatcaatgccttcatcggcggcctggccgcccaggaggtgatgaaggcctgcagcggcaagttcatgcccatcatgcagtggctgtactttgatgccctggagtgcctgcctgaggacaaggaggtgctgacagaggacaagtgcctgcagaggcagaacagatatgatggccaggtggccgtgtttggaagtgacctgcaggagaagctgggcaagcagaagtacttcctggtgggcgctggggccatcggctgtgagctgctgaagaactttgccatgattggcctgggctgtggggagggcggggagatcatcgtgacagacatggacaccatcgagaagagcaacctgaaccggcagttcctgttccggccctgggatgtgaccaagctgaagagtgacacagctgctgctgctgtgcggcagatgaacccccacatccgggtgaccagccaccagaacagagtgggccctgacacagagcgcatctatgatgatgacttcttccagaacctggatggagtggccaatgccctggacaacgtggatgccaggatgtacatggaccggcgctgtgtgtactacaggaagcccctgctggagagcggcaccctgggcaccaagggaaatgtgcaggtggtgatccccttcctgacagagagctacagcagcagccaggaccccccagagaagagcatccccatctgcaccctgaagaacttccccaatgccatcgagcacaccctgcagtgggccagagatgaatttgagggcctcttcaagcagcctgcagaaaatgtgaaccagtacctgacagaccccaagtttgtggagaggaccctgcggctggccggcacccagcccctggaggtgctggaggccgtgcagaggagcctggtgctgcagaggccccagacctgggccgactgtgtgacctgggcctgccaccactggcacacccagtacagcaacaacatccggcagctgctgcacaacttccccccagaccagctgaccagcagcggggcccccttctggagcggccccaagcgctgcccccaccccctgacctttgatgtgaacaaccccctgcacctggactatgtgatggccgccgccaacctgtttgcccagacctacggcctgaccggcagccaggacagagctgctgtggccaccttcctgcagagcgtgcaggtgcctgagttcacccccaagtctggagtgaagatccacgtgtctgaccaggagctgcagagcgccaatgcctctgtggatgacagccggctggaggagctgaaggccaccctgcccagcccagacaagctgcccggcttcaagatgtaccccatcgactttgagaaggatgatgacagcaacttccacatggacttcatcgtggccgccagcaacctgcgggcagaaaattatgacatccccagcgctgacagacacaagagcaagctgattgctgggaagatcatcccagccatcgccaccaccacagctgctgtggtgggcctggtgtgcctggagctgtacaaggtggtgcagggccaccggcagctggacagctacaagaatggcttcctgaacctggccctgcccttcttcggcttcagcgagcccctggccgcccccaggcaccagtactacaaccaggagtggaccctgtgggacagatttgaggtgcagggcctgcagcccaacggggaggagatgaccctgaagcagttcctggactacttcaagacagagcacaagctggagatcaccatgctgagccagggcgtgtccatgctgtacagcttcttcatgcctgctgccaagctgaaggagcggctggaccagcccatgacagagatcgtgtcccgggtgtccaagaggaagctgggccgccacgtgcgggccctggtgctggagctgtgctgcaatgatgagagcggggaggatgtggaggtgccctacgtgcgctacaccatcagatag

SEQ ID NO: 43124 - DNA, 1521 bp, Artificial Sequence
  Description of Artificial Sequence: Synthetic coding sequence
atgggcttccaccacgtgggccaggccggcctggagcccctgaccagcggggaccccagcgccctggccagccagagcgctggcatcaccggggtgtcctactgtgcctggccaggcttcagcattgaggtgggggagtggggccgcctggagggcttccccaccagccgggtggccgtgcggctggtgctggccctcttcacagatggccccagcaacaatgcctgtggcaaccccttctgccagctgtggccccacgtgatctgcctgctgtgcctgcagtgggccagagatgaatttgagggcctcttcaagcagcctgcagaaaatgtgaaccagtacctgacagaccccaagtttgtggagaggaccctgcggctggccggcacccagcccctggaggtgctggaggccgtgcagaggagcctggtgctgcagaggccccagacctgggccgactgtgtgacctgggcctgccaccactggcacacccagtacagcaacaacatccggcagctgctgcacaacttccccccagaccagctgaccagcagcggggcccccttctggagcggccccaagcgctgcccccaccccctgacctttgatgtgaacaaccccctgcacctggactatgtgatggccgccgccaacctgtttgcccagacctacggcctgaccggcagccaggacagagctgctgtggccaccttcctgcagagcgtgcaggtgcctgagttcacccccaagtctggagtgaagatccacgtgtctgaccaggagctgcagagcgccaatgcctctgtggatgacagccggctggaggagctgaaggccaccctgcccagcccagacaagctgcccggcttcaagatgtaccccatcgactttgagaaggatgatgacagcaacttccacatggacttcatcgtggccgccagcaacctgcgggcagaaaattatgacatccccagcgctgacagacacaagagcaagctgattgctgggaagatcatcccagccatcgccaccaccacagctgctgtggtgggcctggtgtgcctggagctgtacaaggtggtgcagggccaccggcagctggacagctacaagaatggcttcctgaacctggccctgcccttcttcggcttcagcgagcccctggccgcccccaggcaccagtactacaaccaggagtggaccctgtgggacagatttgaggtgcagggcctgcagcccaacggggaggagatgaccctgaagcagttcctggactacttcaagacagagcacaagctggagatcaccatgctgagccagggcgtgtccatgctgtacagcttcttcatgcctgctgccaagctgaaggagcggctggaccagcccatgacagagatcgtgtcccgggtgtccaagaggaagctgggccgccacgtgcgggccctggtgctggagctgtgctgcaatgatgagagcggggaggatgtggaggtgccctacgtgcgctacaccatcagatag

SEQ ID NO: 43125 - DNA, 3177 bp, Artificial Sequence; identical to SEQ ID NO: 43123
  Description of Artificial Sequence: Synthetic coding sequence

SEQ ID NO: 43126 - DNA, 816 bp, Artificial Sequence
  Description of Artificial Sequence: Synthetic coding sequence
atgagcagcagccccctgagcaagaagagaagagtgtctggccctgaccccaagccaggcagcaactgcagccctgcccagagcgtgctgtctgaggtgcccagcgtgcccaccaacggcatggccaagaatggcagcgaggccgacattgatgagggcctgtacagccggcagctgtatgtgctgggccacgaggccatgaagaggctgcagaccagctctgtgctggtgtctggcctgcggggcctgggcgtggagatcgccaagaacatcatcctgggcggcgtgaaggctgtgaccctgcatgaccagggcacagcccagtgggccgacctgagcagccagttctacctgcgggaggaggacatcggcaagaacagagctgaggtgtcccagccccggctggccgagctgaacagctatgtgcctgtgacagcctacacaggccccctggtggaggacttcctgagcggcttccaggtggtggtgctgaccaacacccccctggaggaccagctgcgggtgggggagttctgccacaacagaggcatcaagctggtggtggccgacacccggggcctgtttggccagctgttctgtgactttggagaggagatgatcctgacagacagcaatggagagcagcccctgagcgccatggtgtccatggtgaccaaggacaaccctggggtggtgacctgcctggatgaggcccggcacggctttgagagcggggactttgtgtccttcagcgaggtgcagggcatggtggagctgaatggaaaccagcccatggagatcaaggtgctgggctag

SEQ ID NO: 43127 - DNA, 522 bp, Artificial Sequence
  Description of Artificial Sequence: Synthetic coding sequence
atgctgtgtgtgatctaccacctggacaaccctgtgggcaagatgagcagcagccccctgagcaagaagagaagagtgtctggccctgaccccaagccaggcagcaactgcagccctgcccagagcgtgctgtctgaggtgcccagcgtgcccaccaacggcatggccaagaatggcagcgaggccgacattgatgagggcctgtacagccggcagctgtatgtgctgggccacgaggccatgaagaggctgcagaccagctctgtgctggtgtctggcctgcggggcctgggcgtggagatcgccaagaacatcatcctgggcggcgtgaaggctgtgaccctgcatgaccagggcacagcccagtgggccgacctgagcagccagttctacctgcgggaggaggacatcggcaagaacagagctgaggtgtcccagccccggctggccgagctgaacagctatgtgcctgtgacagcctacacaggccccctggtggaggacttcctgagcggcttctag

SEQ ID NO: 43128 - DNA, 855 bp, Artificial Sequence
  Description of Artificial Sequence: Synthetic coding sequence
atgctgtgtgtgatctaccacctggacaaccctgtgggcaagatgagcagcagccccctgagcaagaagagaagagtgtctggccctgaccccaagccaggcagcaactgcagccctgcccagagcgtgctgtctgaggtgcccagcgtgcccaccaacggcatggccaagaatggcagcgaggccgacattgatgagggcctgtacagccggcagctgtatgtgctgggccacgaggccatgaagaggctgcagaccagctctgtgctggtgtctggcctgcggggcctgggcgtggagatcgccaagaacatcatcctgggcggcgtgaaggctgtgaccctgcatgaccagggcacagcccagtgggccgacctgagcagccagttctacctgcgggaggaggacatcggcaagaacagagctgaggtgtcccagccccggctggccgagctgaacagctatgtgcctgtgacagcctacacaggccccctggtggaggacttcctgagcggcttccaggtggtggtgctgaccaacacccccctggaggaccagctgcgggtgggggagttctgccacaacagaggcatcaagctggtggtggccgacacccggggcctgtttggccagctgttctgtgactttggagaggagatgatcctgacagacagcaatggagagcagcccctgagcgccatggtgtccatggtgaccaaggacaaccctggggtggtgacctgcctggatgaggcccggcacggctttgagagcggggactttgtgtccttcagcgaggtgcagggcatggtggagctgaatggaaaccagcccatggagatcaaggtgctgtag

SEQ ID NO: 43129 - DNA, 705 bp, Artificial Sequence
  Description of Artificial Sequence: Synthetic coding sequence
atgagcaagccccacttccccccagccctgcctgccccagctgccatccctggcatcaagggggaggagaatggctgcctgctgctgcccacctacagcgtgcccggctccatgctgtgtgtgatctaccacctggacaaccctgtgggcaagatgagcagcagccccctgagcaagaagagaagagtgtctggccctgaccccaagccaggcagcaactgcagccctgcccagagcgtgctgtctgaggtgcccagcgtgcccaccaacggcatggccaagaatggaagtgaagctgacattgatgagggcctgtacagccggcagctgtatgtgctgggccacgaggccatgaagaggctgcagaccagctctgtgctggtgtctggcctgcggggcctgggcgtggagatcgccaagaacatcatcctgggcggcgtgaaggctgtgaccctgcatgaccagggcacagcccagtgggccgacctgagcagccagttctacctgcgggaggaggacatcggcaagaacagagctgaggtgtcccagccccggctggccgagctgaacagctatgtgcctgtgacagcctacacaggccccctggtggaggacttcctgagcggcttccaggtggtggtgctgaccaacacccccctggaggaccagctgcgggtgggggagttctgccacaacagaggatag

SEQ ID NO: 43130 - DNA, 588 bp, Artificial Sequence
  Description of Artificial Sequence: Synthetic coding sequence
atgagcaagccccacttccccccagccctgcctgccccagctgccatccctggcatcaagggggaggagaatggctgcctgctgctgcccacctacagcgtgcccggctccatgctgtgtgtgatctaccacctggacaaccctgtgggcaagatgagcagcagccccctgagcaagaagagaagagtgtctggccctgaccccaagccaggcagcaactgcagccctgcccagagcgtgctgtctgaggtgcccagcgtgcccaccaacggcatggccaagaatggaagtgaagctgacattgatgagggcctgtacagccggcagctgtatgtgctgggccacgaggccatgaagaggctgcagaccagctctgtgctggtgtctggcctgcggggcctgggcgtggagatcgccaagaacatcatcctgggcggcgtgaaggctgtgaccctgcatgaccagggcacagcccagtgggccgacctgagcagccagttctacctgcgggaggaggacatcggcaagaacagagctgaggtgtcccagccccggctggccgagctgaacagctatgtgcctgtgtag

SEQ ID NO: 43131 - DNA, 843 bp, Artificial Sequence
  Description of Artificial Sequence: Synthetic coding sequence
atggccacagaggcccctgtgaacatcgcccccccagaatgttccacagtggtgtccacagctgtggacagcctcatctggcagcccaacagcctgaacatgcacatgatccggcccaagagcgccaagggccgcacccggcccagcctgcagaagagccagggcgtggaggtgtgtgcccaccacatccccagccccccaccagccatcccctatgagctgcccagcagccagaagccaggggcctgtgcccccaagagccccaaccagggcgccagtgatgagatccctgagctgcagcagcaggtgcccactggagccagcagcagcctgaacaagtaccctgtgctgcccagcatcaacaggaagaacctggaggaggaggccgtggagaccgtggccaagaaggccagcagcctgcagctgagcagcatccgggccctgtaccaggatgaaacaggcaccatgaagaccagcgaggaggacagccgggcccgggcctgtgctgtggagaggaagttcatcgtgaggaccaagaagcagggcagcagccgggccggcaacctggaggagcccagcgaccaggagccccggctgctgctggccgtgcgcagccccaccggccagagatttgtgcgccacttccggcccacagatgacctgcagaccatcgtggccgtggccgagcagaagaacaagaccagctaccgccactgcagcattgagaccatggaggtgccccggcggcgcttcagtgacctgaccaagagcctgcaggagtgccgcatcccccacaagtctgtgctgggcatcagcctggaggatggagagggctggccctag

SEQ ID NO: 43132 - DNA, 1155 bp, Artificial Sequence
  Description of Artificial Sequence: Synthetic coding sequence
atggccttcccctgccgccgcagcctgacagccaagaccctggcctgcctgctggtgggcgtgtccttcctggccctgcagcagtggttcctgcaggcccccaggagcccccgggaggagaggagcccccaggaggagaccccagagggccccacagatgccccagctgctgatgagccccccagcgagctggtgcccggccccccctgtgtggccaatgccagcgccaatgccacagctgactttgagcagctgcctgcccgcatccaggacttcctgcgctaccgccactgccgccacttccccctgctgtgggatgccccagccaagtgtgccggcggccggggcgtcttcctgctgctggccgtgaagagcgcccctgagcactatgaaagaagagagctgatccggaggacctggggccaggagaggagctatggaggccggcctgtgcggcggctcttcctgctgggcaccccaggcccagaagatgaggcccgggcagagcggctggccgagctggtggccctggaggcccgggagcacggagatgtgctgcagtgggcctttgctgacaccttcctgaacctgaccctgaagcacctgcacctgctggactggctggccgcccgctgcccccacgcccgcttcctgctgtctggagatgatgatgtgtttgtgcacacagccaacgtggtgcgcttcctgcaggcccagcccccaggccgccacctgttcagcggccagctgatggagggctctgtgcccatccgggacagctggagcaagtactttgtgcccccccagctgtttcctggcagcgcctaccctgtgtactgcagcggcggcggcttcctgctgagcggccccacagcccgggccctgcgggccgccgcccggcacacccccctcttccccattgatgatgcctacatgggcatgtgcctggagagagctggcctggcccccagcggccacgagggcatctggcccttcggcgtgcagctgcccggggcccagcagagcagctttgacccctgcatgtaccgggagctgctgctggtgcacagatttgccccctatgagatgctgctgatgtggaaggccctgcacagccctgccctgagctgtgaccggggccaccgggtgtcctag

SEQ ID NO: 43133 - DNA, 792 bp, Artificial Sequence
  Description of Artificial Sequence: Synthetic coding sequence
atggccttcccctgccgccgcagcctgacagccaagaccctggcctgcctgctggtgggcgtgtccttcctggccctgcagcagaggcggcggcagagggtgccccccaccctgcccaggcctgcccgggcccaccctggcctgcctgctgtgccccaggagaggagctatggaggccggcctgtgagaagactcttcctgctgggcaccccaggcccagaagatgaggcccgggcagagcggctggccgagctggtggccctggaggcccgggagcacggagatgtgctgcagtgggcctttgctgacaccttcctgaacctgaccctgaagcacctgcacctgctggactggctggccgcccgctgcccccacgcccgcttcctgctgtctggagatgatgatgtgtttgtgcacacagccaacgtggtgcgcttcctgcaggcccagcccccaggccgccacctgttcagcggccagctgatggagggctctgtgcccatccgggacagctggagcaagtactttgtgcccccccagctgtttcctggcagcgcctaccctgtgtactgcagcggcggcggcttcctgctgagcggcctggcccccagcggccacgagggcatccccagcgcctgcagcctgcccggggcccagcagagcagctttgacccctgcatgtaccgggagctgctgctggtgcacagatttgccccctatgagatgctgctgatgtggaaggccctgcacagccctgccctgagctgtgaccggggccaccgggtgtcctag

SEQ ID NO: 43134 - DNA, 366 bp, Artificial Sequence
  Description of Artificial Sequence: Synthetic coding sequence
atggccttcccctgccgccgcagcctgacagccaagaccctggcctgcctgctggtgggcgtgtccttcctggccctgcagcagtggttcctgcaggcccccaggagcccccgggaggagaggagcccccaggaggagaccccagagggccccacagatgccccagctgctgatgagccccccagcgagctggtgcccggccccccctgtgtggccaatgccagcgccaatgccacagctgactttgagcagctgcctgcccgcatccaggacttcctgcgctaccgccactgccgccacttccccctgctgtgggatgccccagccaagtgtgccggcggccggggcgtcttcctgctgctgtag

SEQ ID NO: 43135 - DNA, 1158 bp, Artificial Sequence
  Description of Artificial Sequence: Synthetic coding sequence
atggccttcccctgccgccgcagcctgacagccaagaccctggcctgcctgctggtgggcgtgtccttcctggccctgcagcagtggttcctgcaggcccccaggagcccccgggaggagaggagcccccaggaggagaccccagagggccccacagatgccccagctgctgatgagccccccagcgagctggtgcccggccccccctgtgtggccaatgccagcgccaatgccacagctgactttgagcagctgcctgcccgcatccaggacttcctgcgctaccgccactgccgccacttccccctgctgtgggatgccccagccaagtgtgccggcggccggggcgtcttcctgctgctggccgtgaagagcgcccctgagcactatgaaagaagagagctgatccggaggacctggggccaggagaggagctatggaggccggcctgtgcggcggctcttcctgctgggcaccccaggcccagaagatgaggcccgggcagagcggctggccgagctggtggccctggaggcccgggagcacggagatgtgctgcagtgggcctttgctgacaccttcctgaacctgaccctgaagcacctgcacctgctggactggctggccgcccgctgcccccacgcccgcttcctgctgtctggagatgatgatgtgtttgtgcacacagccaacgtggtgcgcttcctgcaggcccagcccccaggccgccacctgttcagcggccagctgatggagggctctgtgcccatccgggacagctggagcaagtactttgtgcccccccagctgtttcctggcagcgcctaccctgtgtactgcagcggcggcggcttcctgctgagcggccccacagcccgggccctgcgggccgccgcccggcacacccccctcttccccattgatgatgcctacatgggcatgtgcctgggcgcccggcggcctggggcccagaggccccggggccaccctggccccagcgcctgcagcctgcccggggcccagcagagcagctttgacccctgcatgtaccgggagctgctgctggtgcacagatttgccccctatgagatgctgctgatgtggaaggccctgcacagccctgccctgagctgtgaccggggccaccgggtgtcctag

SEQ ID NO: 43136 - DNA, 1086 bp, Artificial Sequence
  Description of Artificial Sequence: Synthetic coding sequence
atgtctggggccggcgtgggcggggccagcgaggagagccaggccatgcaggcccacgtgtccatcatcctgcctgtgcacaatgctgagccctggctggatgaatgtctgcggtctgtgctgcagcaggactttgagggcaccatggagctgagcgtcttcaatgatgccagcaaggacaagagcggggccatcatcgagaagtggagggtgaagctggaggacagcggcgtgcacgtgatcatcggcggccatgacagccccagcccccggggcgtgggctacgccaagaaccaggccgtggcccagagcagcggcagctacctgtgcttcctggacagtgatgatgtgatgatgccccagagggtgcggctgcagcatgaagctgctgtgcagcaccccagcagcatcatcggctgccgggtgagaagagacccccccaacagcacagagcgctacacccgctggatcaaccagctgaccccagagcagctgctgacccaggtgttcaccagcaatggccccaccgtcatcatgcccacctggttctgcagccgggcctggttcagccacgtgggccccttcaatgaaggaggccagggcgtgcctgaggacctgctcttcttctatgagcacctgaggaaaggaggcggcgtcatccgggtggaccagagcctgctgctgtaccgccaccacccccaggccgccacccactgtgtgctggagaccaccatctggacccaccgggtgcgcttcctggaggagcaggccctgccccgctgggccgccttcaccatctggaatgccggcaagcagggccggcggctgtaccgcagcctgacagctggcagccagaggaaggtggtggccttctgtgatgtggatgagaacaagatcaggaagggcttctactgccacgaggacagccaggagcggcccaagccccgcatccccatcctgcacttccgggccgcccggcccccatttgtgatctgtgtgaagctggacctgaccggcggggcctttgaggacaacctgcggagcctgcacctgcaggagggccaggacttcctgcacttctcctag

SEQ ID NO: 43137 - DNA, 1812 bp, Artificial Sequence
  Description of Artificial Sequence: Synthetic coding sequence
atggctgtggccaggaagatccgcaccctgctgactgtgaacatcctggtgtttgtgggcatcgtgctcttctctgtgtactgccgcctgcagggccgcagccaggagctggtgcgcatcgtgtctggggacagaagagtgcgcagcagacatgccaaggtgggcaccctgggggaccgggaggccatcctgcagaggctggaccacctggaggaggtggtgtacaaccagctgaatggcctggccaagcccatcggcctggtggagggccctgggggcctgggccagggcggcctggccgccaccctgagagatgatggccaggaggccgagggcaagtatgaggagtatggctacaatgcccagctgagtgaccgcatcagcctggacaggagcatcccagactaccggcccaggaagtgccggcagatgtcctatgcccaggacctgccccaggtgtctgtggtgttcatctttgtgaatgaggccctgagcgtcatcctgcggtctgtgcacagcgtggtgaaccacacccccagccagctgctgaaggaggtgatcctggtggatgacaacagcgacaacgtggagctgaagttcaacctggaccagtatgtgaacaagcgctacccaggcctggtgaagatcgtgaggaacagcagaagagagggcctcatccgggcccggctgcagggctggaaggccgccacagcccctgtggtgggcttctttgatgcccacgtggagttcaacacaggctgggccgagcccgccctgagccgcatccgggaggacagaagaagaattgtgctgcctgccatcgacaacatcaagtacagcacctttgaggtgcagcagtatgccaatgctgcccacggctacaactggggcctgtggtgcatgtacatcatccccccccaggactggctggacagaggagatgagagcgcccccatccgcaccccagccatgattggctgcagctttgtggtggaccgggagtactttggagacatcggcctgctggaccccggcatggaggtgtatggaggagaaaatgtggagctgggcatgagggtgtggcagtgtggcggctccatggaggtgctgccctgcagccgggtggcccacatcgagaggaccaggaagccctacaacaatgacatcgactactatgccaagagaaatgccctgcgggctgctgaggtgtggatggatgacttcaagagccacgtgtacatggcctggaacatccccatgagcaaccctggggtggactttggagatgtgtctgagcggctggccctgcggcagaggctgaagtgccgctccttcaagtggtacctggagaatgtgtacccagagatgagggtgtacaacaacaccctgacctatggagaggtgaggaacagcaaggccagcgcctactgcctggaccagggcgcagaagatggagaccgggccatcctgtacccctgccacggcatgagcagccagctggtgcgctacagcgcagatggcctgctgcagctgggccccctgggcagcacagccttcctgcctgacagcaagtgcctggtggatgatggcactggaaggatgcccaccctgaagaagtgtgaagatgtggcccggcccacccagaggctgtgggacttcacccagagcggccccatcgtgtcccgggccaccggccgctgcctggaggtggagatgagcaaggatgccaactttggcctgcggctggtggtgcagcgctgcagcggccagaagtggatgatccggaactggatcaagcacgcccggcactag

SEQ ID NO: 43138 - DNA, 714 bp, Artificial Sequence
  Description of Artificial Sequence: Synthetic coding sequence
atggaggtgctgccctgcagccgggtggcccacatcgagaggaccaggaagccctacaacaatgacatcgactactatgccaagagaaatgccctgcgggctgctgaggtgtggatggatgacttcaagagccacgtgtacatggcctggaacatccccatgagcaaccctggggtggactttggagatgtgtctgagcggctggccctgcggcagaggctgaagtgccgctccttcaagtggtacctggagaatgtgtacccagagatgagggtgtacaacaacaccctgacctatggagaggtgaggaacagcaaggccagcgcctactgcctggaccagggcgcagaagatggagaccgggccatcctgtacccctgccacggcatgagcagccagctggtgcgctacagcgcagatggcctgctgcagctgggccccctgggcagcacagccttcctgcctgacagcaagtgcctggtggatgatggcactggaaggatgcccaccctgaagaagtgtgaagatgtggcccggcccacccagaggctgtgggacttcacccagagcggccccatcgtgtcccgggccaccggccgctgcctggaggtggagatgagcaaggatgccaactttggcctgcggctggtggtgcagcgctgcagcggccagaagtggatgatccggaactggatcaagcacgcccggcactag

SEQ ID NO: 43139 - DNA, 1065 bp, Artificial Sequence
  Description of Artificial Sequence: Synthetic coding sequence
atgattggctgcagctttgtggtggaccgggagtactttggagacatcggcctgctggaccccggcatggaggtgtatggaggagaaaatgtggagctgggcatgagggagacagagggcttccagcaggacaaggtgaactacaagcagaacaagaggggcaggaagacccggcagagggtgaagaggagccgctctgaggcccaccgggcccagcccagccctggggccacccatggagcccacagccgggcccctggccccaggacagagcccacagctgagccctggggccacgcccggcccacagctgccctgcctgccactggagtgtggcagtgtggcggctccatggaggtgctgccctgcagccgggtggcccacattgaaagaaccaggaagccctacaacaatgacatcgactactatgccaagagaaatgccctgcgggctgctgaggtgtggatggatgacttcaagagccacgtgtacatggcctggaacatccccatgagcaaccctggggtggactttggagatgtgtctgagcggctggccctgcggcagaggctgaagtgccgctccttcaagtggtacctggagaatgtgtacccagagatgagggtgtacaacaacaccctgacctacggggaggtgaggaacagcaaggccagcgcctactgcctggaccagggcgcagaagatggagaccgggccatcctgtacccctgccacggcatgagcagccagctggtgcgctacagcgcagatggcctgctgcagctgggccccctgggcagcacagccttcctgcctgacagcaagtgcctggtggatgatggcaccggccgcatgcccaccctgaagaagtgtgaagatgtggcccggcccacccagaggctgtgggacttcacccagagcggccccatcgtgtcccgggccaccggccgctgcctggaggtggagatgagcaaggatgccaactttggcctgcggctggtggtgcagcgctgcagcggccagaagtggatgatccggaactggatcaagcacgcccggcactag

SEQ ID NO: 43140 - DNA, 294 bp, Artificial Sequence
  Description of Artificial Sequence: Synthetic coding sequence
atggaggtgctgccctgcagccgggtggcccacatcgagaggaccaggaagccctacaacaatgacatcgactactatgccaagagaaatgccctgcgggctgctgaggtgtggatggatgacttcaagagccacgtgtacatggcctggaacatccccatgagcaaccctggggtggactttggagatgtgtctgagcggctggccctgcggcagaggctgaagtgccgctccttcaagtggtacctggagaatgtgtacccagagatgagggtgtacaacaacaccctgtag

SEQ ID NO: 43141 - DNA, 714 bp, Artificial Sequence; identical to SEQ ID NO: 43138
  Description of Artificial Sequence: Synthetic coding sequence

SEQ ID NO: 43142 - DNA, 165 bp, Artificial Sequence
  Description of Artificial Sequence: Synthetic coding sequence
atggaggtgctgccctgcagccgggtggcccacatcgagaggaccaggaagccctacaacaatgacatcgactactatgccaagagaaatgccctgcgggctgctgaggtgtggatggatgacttcaagagccacgtgtacatggcctggaacatccccatgtag

SEQ ID NO: 43143 - DNA, 714 bp, Artificial Sequence; identical to SEQ ID NO: 43138
  Description of Artificial Sequence: Synthetic coding sequence

SEQ ID NO: 43144 - DNA, 1812 bp, Artificial Sequence; identical to SEQ ID NO: 43137
  Description of Artificial Sequence: Synthetic coding sequence

SEQ ID NO: 43145 - DNA, 1155 bp, Artificial Sequence
  Description of Artificial Sequence: Synthetic coding sequence
atgggccctggccccagccccaactggaccctggaccctgagccccgctgccgcctgtggagcgagccccggctgcctgctggccctggggtgctggccgccggcagcccccggctgccctgccgctacgtgatgaccagcgagttcaccctgggccccacagctgagttcttccgggagcacaacttcttccacctggaccctgccaacgtggtgatgtttgagcagaggctgctgcctgctgtgacctttgatggcaaggtgatcctggagaggaaggacaaggtggccatggccccagatggaaatggaggcctgtactgtgccctggaggaccacaagatcctggaggacatggagaggagaggagtggagtttgtgcacgtgtactgtgtggacaacatcctggtgcggctggccgaccccgtcttcatcggcttctgtgtgctgcagggcgctgactgtggggccaaggtggtggagaaggcctacccagaggagcctgtgggcgtggtgtgccaggtggatggagtgccccaggtggtggagtacagcgagatcagccctgagacagcccagctgcgggccagtgatggcagcctgctgtacaatgccggcaacatctgcaaccacttcttcacccggggcttcctgaaggctgtgacccgggagtttgagcccctgctgaagccccacgtggccgtgaagaaggtgccctacgtggatgaggagggcaacctggtgaagcccctgaagcccaacggcatcaagatggagaagtttgtgtttgatgtgttccgctttgccaagaactttgctgccctggaggtgctgcgggaggaggagttcagccccctgaagaatgctgagcctgctgaccgggacagccccaggacagcccggcaggccctgctgacccagcactaccgctgggccctgcgggccggggcccgcttcctggatgcccatggagcctggctgcctgagctgcccagcctgccccccaacggggaccccccagccatctgtgagatcagccccctggtgtcctacagcggggagggcctggaggtgtacctgcagggccgggagttccagagccccctcatcctggatgaggaccaggcccgggagccccagctgcaggagagctag

SEQ ID NO: 43146 - DNA, 1524 bp, Artificial Sequence
  Description of Artificial Sequence: Synthetic coding sequence
atggccagcgagcaggatgtgcgggcccggctgcagagagctggccaggagcacctgctgcgcttctgggccgagctggcccctgagccccgggccgccctgctggccgagctggccctgctggagcctgaggccctgcgggagcactgcagaagagctgctgaggcctgtgcccggccccacggccccccaccagacctggccgcccggctgcggcccctgcccccagagcgggtgggccgggccagcagaagtgaccctgagacccggcggcgctgggaggaggagggcttccggcagatcagcctgaacaaggtggccgtgctgctgctggccggcggccagggcacccggctgggcgtgacctaccccaagggcatgtacagagtgggcctgcccagcaggaagaccctgtaccagctgcaggccgagcgcatcagaagagtggagcagctggccggggagagacatggcacccgctgcaccgtgccctggtacgtgatgaccagcgagttcaccctgggccccacagctgagttcttccgggagcacaacttcttccacctggaccctgccaacgtggtgatgtttgagcagaggctgctgcctgctgtgacctttgatggcaaggtgatcctggagaggaaggacaaggtggccatggccccagatggaaatggaggcctgtactgtgccctggaggaccacaagatcctggaggacatggagcggcggggcgtggagtttgtgcacgtgtactgtgtggacaacatcctggtgcggctggccgaccctgtgttcatcggcttctgtgtgctgcagggcgctgactgtggggccaaggtggtggagaaggcctacccagaggagcctgtgggcgtggtgtgccaggtggatggagtgccccaggtggtggagtacagcgagatcagccctgagacagcccagctgcgggccagtgatggcagcctgctgtacaatgccggcaacatctgcaaccacttcttcacccggggcttcctgaaggctgtgacccgggagtttgagcccctgctgaagccccacgtggccgtgaagaaggtgccctacgtggatgaggagggcaacctggtgaagcccctgaagcccaacggcatcaagatggagaagtttgtgtttgatgtgttccgctttgccaagaactttgctgccctggaggtgctgcgggaggaggagttcagccccctgaagaatgctgagcctgctgaccgggacagccccaggacagcccggcaggccctgctgacccagcactaccgctgggccctgcgggccggggcccgcttcctggatgcccacggggcctggctgcctgagctgcccagcctgcccccaaatggagaccccccagccatctgtgagatcagccccctggtgtcctacagcggggagggcctggaggtgtacctgcagggccgggagttccagagccccctcatcctggatgaggaccaggcccgggagccccagctgcaggagagctag

SEQ ID NO: 43147 - DNA, 4323 bp, Artificial Sequence
  Description of Artificial Sequence: Synthetic coding sequence
atggccggcatcatcaagaagcagatcctgaagcacctgagccgcttcaccaagaacctgagcccagacaagatcaacctgagcaccctgaagggggagggccagctgaccaacctggagctggatgaggaggtgctgcagaatgtgctggagctgcccacctggctggccatcaccagggtgtactgcaacagagccagcatccgcatccagtggaccaagctgaagacccaccccatctgcctgtgcctggacaaggtggaggtggagatgaagacctgtgaggacccccggcccccaaatggccagagccccatcgccctggccagcggccagagtgaatatggctttgctgagaaggtggtggagggcatgttcatcatcgtgaacagcatcaccatcaagatccacagcaaggccttccacgccagctttgagctgtggcagctgcagggctacagcgtgaaccccaactggcagcagagcgacctgcggctgacccgcatcacagacccctgccgcggggaggtgctgaccttcaaggagatcacctggcagaccctgcgcatcgaggctgatgccacagacaatggagaccaggaccctgtgaccacccccctgcggctcatcaccaaccagggccgcatccagatcgccctgaagaggaggaccaaggactgcaacgtcatcagcagcaagctgatgttcctgctggatgacctgctgtgggtgctgacagacagccagctgaaggccatgatgaagtatgcagagagcctgtctgaggccatggagaagagcgcccaccagaggaagagcctggcccctgagcctgtgcagatcaccccaccagcccccagcgcccagcagagctgggcccaggccttcggcggcagccagggcaacagcaacagcagcagcagccggctgagccagtactttgagaagtttgatgtgaaggagagcagctaccacctgctgatcagccggctggacctgcacatctgtgatgacagccagagccgggagcccggggtgtctgccaaccggctgatgggcggggccatgcagctgaccttcaggaagatggcctttgactactaccccttccactgggccggggacagctgcaagcactgggtgcgccactgtgaggccatggagacccggggccagtgggcccagaagctggtgatggagttccagagcaagatggagaagtggcatgaggagaccggcctgaagccaccctggcacctgggcgtggacagcctcttccggaggaaggctgacagcctgagcagccccaggaagaaccccctggagaggagccccagccagggccggcagcctgccttccagcccccagcctggaaccggctgcggagcagctgcatggtggtgcgggtggatgacctggacatccaccaggtgtccacagctggccagcccagcaagaagcccagcaccctgctgagctgcagcaggaagctgcacaacctgcccacccaggtgtctgccatccacatcgagttcacagagtactacttcccagacaaccaggagctgcctgtgccctgccccaacctgtacatccagctgaatggcctgaccttcaccatggaccctgtgtccctgctgtggggcaacctcttctgcctggacctgtaccgcagcctggagcagttcaaggccatctacaagctggaggacagcagccagaaggatgagcacctggacatccggctggatgccttctggctgaaggtgtccttccccctggagaagcgggagcgggcagagctgcaccggccccaggccctggtgttttctgccagcggcatgattgccaccaacaccaggcatgccccccactgcagctgcagcgacctgcagagcctcttccggggctttgctgctgctgagttcttccacagcaactatgaccacttccccaaggtgcctgggggcttcagcctgctgcacatgctgttcctgcaccacgccttccagatggacagctgcctgccccagcccaacaccctgcccccccagaggcccaaggcctcctgggacctgtggagcgtgcacttcacccagatcagcctggactttgagggcacagagaacttcaagggccacaccctgaactttgtggcccccttccccctgagcatctgggcctgcctgcccctgcgctggcagcaggcccaggccaggaagctgctgctggccagcgagggccgcctgaagcccagcgccagctttggcagccctgtgcagagcgaggccctggccccagacagcatgagccaccccaggagcaagacagaacatgacctgaagagcctgagcggcctgacagaggtgatggagatcctgaaggagggcagcagcggcatggacaacaagggccccctgacagagctggaggatgtggctgatgtgcacatgctggtgcacagccctgcccacgtgcgggtgcggctggaccactaccagtacctggccctgctgcggctgaaggaggtgctgcagaggctgcaggagcagctgaccaaggacacagagagcatgacaggcagccccctgcagaaccagacagcctgcattggagtgctcttccccagcgctgaggtggccctgctgatgcacccagcccctggagctgtggatgctgacagcgctggcagtgacagcaccagcctggtggacagcgagctgagccccagcgaggaccgggagctgaagagtgatgccagcagtgaccagggccctgccagccctgagaaggtgctggaggagagcagcattgagaaccaggatgtgtcccaggagcggccccacagcaatggagagctgcaggacagcggccccctggcccagcagctggccgggaaaggacatgaagctgtggagagcctgcaggccaagaagctgagcaggacccaggccagcagcagccctgctgccctgaagcccccagctggccgggagacagctgtgaatggccagggcgagctgatccccctgaagaacatcgagggggagctgagcagcgccatccacatgaccaaggatgccaccaaggaggccctgcacgccaccatggacctgaccaaggaggccgtgtccctgaccaaggatgccttcagcctgggccgggacaggatgaccagcaccatgcacaagatgctgagcctgcccccagccaaggagcccatggccaagacagatgaaggagtggccgcccctgtgtctggaggagctgcccggctgcgcttcttctccatgaagaggacagtgtcccagcagagctttgatggagtgtccctggacagcagcggccctgaggaccgcatctctgtggacagtgatggcagtgacagctttgtgatgctgctggagagcgagagcggccctgagagcgtgcccccaggcagcctgagcaatgtgtctgacaatgctggggtgcagggcagccccctggtgaacaactacggccagggcagccctgctgccaacagctctgtgagccccagcggagaagatctcatcttccaccctgtgtctgtgctggtgctgaaggtgaatgaggtgtcctttggcatcgaggtgagaggagaggacctgactgtggccctgcaggccgaggagctgaccctgcagcagctgggcaccgtgggcctgtggcagttcctgcacggccagtgccccggcacctgcttccaggagagcagcaccctgaagacaggccacatccggcctgctgtgggcctgcgctttgaggtgggccctggagctgctgtgcacagccccctggccagccagaatggcttcctgcacctgctgctgcacggctgtgacctggagctgctgacctctgtgctgagcggcctgggccccttcctggaggatgaggagatccctgtggtggtgcccatgcagatcgagctgctgaacagcagcatcaccctgaaggatgacatcccccccatctaccccaccagccctggccccatccccatcaccctggccatggagcacgtggtgctgaagagaagtgatgatggagtcttccacatcggggctgctgcccaggacaagcccagcgctgaggtgctgaagtctgagaagaggcagccccccaaggagcaggtgttcctggtgcccaccggggaggtgtttgagcagcaggtgaaggagctgcccatcctgcagaaggagctgattgagaccaagcaggccctggccaatgccaaccaggacaaggagaagctgctgcaggagatcaggaagtacaaccccttctttgagctgtag

SEQ ID NO: 43148 - DNA, 4203 bp, Artificial Sequence
  Description of Artificial Sequence: Synthetic coding sequence
atggccggcatcatcaagaagcagatcctgaagcacctgagccgcttcaccaagaacctgagcccagacaagatcaacctgagcaccctgaagggggagggccagctgaccaacctggagctggatgaggaggtgctgcagaatgtgctggagctgcccacctggctggccatcaccagggtgtactgcaacagagccagcatccgcatccagtggaccaagctgaagacccaccccatctgcctgtgcctggacaaggtggaggtggagatgaagacctgtgaggacccccggcccccaaatggccagagccccatcgccctggccagcggccagagtgaatatggctttgctgagaaggtggtggagggcatgttcatcatcgtgaacagcatcaccatcaagatccacagcaaggccttccacgccagctttgagctgtggcagctgcagggctacagcgtgaaccccaactggcagcagagcgacctgcggctgacccgcatcacagacccctgccgcggggaggtgctgaccttcaaggagatcacctggcagaccctgcgcatcgaggctgatgccacagacaatggagaccaggaccctgtgaccacccccctgcggctcatcaccaaccagggccgcatccagatcgccctgaagaggaggaccaaggactgcaacgtcatcagcagcaagctgatgttcctgctggatgacctgctgtgggtgctgacagacagccagctgaaggccatgatgaagtatgcagagagcctgtctgaggccatggagaagagcgcccaccagaggaagagcctggcccctgagcctgtgcagatcaccccaccagcccccagcgcccagcagagctgggcccaggccttcggcggcagccagggcaacagcaacagcagcagcagccggctgagccagtactttgagaagtttgatgtgaaggagagcagctaccacctgctgatcagccggctggacctgcacatctgtgatgacagccagagccgggagcccggggtgtctgccaaccggctgatgggcggggccatgcagctgaccttcaggaagatggcctttgactactaccccttccactgggccggggacagctgcaagcactgggtgcgccactgtgaggccatggagacccggggccagtgggcccagaagctggtgatggagttccagagcaagatggagaagtggcatgaggagaccggcctgaagccaccctggcacctgggcgtggacagcctcttccggaggaaggctgacagcctgagcagccccaggaagaaccccctggagaggagccccagccagggccggcagcctgccttccagcccccagcctggaaccggctgcggagcagctgcatggtggtgcgggtggatgacctggacatccaccaggtgtccacagctggccagcccagcaagaagcccagcaccctgctgagctgcagcaggaagctgcacaacctgcccacccaggtgtctgccatccacatcgagttcacagagtactacttcccagacaaccaggagctgcctgtgccctgccccaacctgtacatccagctgaatggcctgaccttcaccatggaccctgtgtccctgctgtggggcaacctcttctgcctggacctgtaccgcagcctggagcagttcaaggccatctacaagctggaggacagcagccagaaggatgagcacctggacatccggctggatgccttctggctgaaggtgtccttccccctggagaagcgggagcgggcagagctgcaccggccccaggccctggtgttttctgccagcggcatgattgccaccaacaccaggcatgccccccactgcagctgcagcgacctgcagagcctcttccggggctttgctgctgctgagttcttccacagcaactatgaccacttccccaaggtgcctgggggcttcagcctgctgcacatgctgttcctgcaccacgccttccagatggacagctgcctgccccagcccaacaccctgcccccccagaggcccaaggcctcctgggacctgtggagcgtgcacttcacccagatcagcctggactttgagggcacagagaacttcaagggccacaccctgaactttgtggcccccttccccctgagcatctgggcctgcctgcccctgcgctggcagcaggcccaggccaggaagctgctgctggccagcgagggccgcctgaagcccagcgccagctttggcagccctgtgcagagcgaggccctggccccagacagcatgagccaccccaggagcaagacagaacatgacctgaagagcctgagcggcctgacagaggtgatggagatcctgaaggagggcagcagcggcatggacaacaagggccccctgacagagctggaggatgtggctgatgtgcacatgctggtgcacagccctgcccacgtgcgggtgcggctggaccactaccagtacctggccctgctgcggctgaaggaggtgctgcagaggctgcaggagcagctgaccaaggacacagagagcatgacaggcagccccctgcagaaccagacagcctgcattggagtgctcttccccagcgctgaggtggccctgctgatgcacccagcccctggagctgtggatgctgacagcgctggcagtgacagcaccagcctggtggacagcgagctgagccccagcgaggaccgggagctgaagagtgatgccagcagtgaccagggccctgccagccctgagaaggtgctggaggagagcagcattgagaaccaggatgtgtcccaggagcggccccacagcaatggagagctgcaggacagcggccccctggcccagcagctggccgggaaaggacatgaagctgtggagagcctgcaggccaagaagctgagcaggacccaggccagcagcagccctgctgccctgaagcccccagctggccgggagacagctgtgaatggccagggcgagctgatccccctgaagaacatcgagggggagctgagcagcgccatccacatgaccaaggatgccaccaaggaggccctgcacgccaccatggacctgaccaaggaggccgtgtccctgaccaaggatgccttcagcctgggccgggacaggatgaccagcaccatgcacaagatgctgagcctgcccccagccaaggagcccatggccaagacagatgaaggagtggccgcccctgtgtctggaggagctgcccggctgcgcttcttctccatgaagaggacagtgtcccagcagagctttgatggagtgtccctggacagcagcggccctgaggaccgcatctctgtggacagtgatggcagtgacagctttgtgatgctgctggagagcgagagcggccctgagagcgtgcccccaggcagcctgagcaatgtgtctgacaatgctggggtgcagggcagccccctggtgaacaactacggccagggcagccctgctgccaacagctctgtgagccccagcggagaagatctcatcttccaccctgtgtctgtgctggtgctgaaggtgaatgaggtgtcctttggcatcgaggtgagaggagaggacctgactgtggccctgcaggccgaggagctgaccctgcagcagctgggcaccgtgggcctgtggcagttcctgcacggccagtgccccggcacctgcttccaggagagcagcaccctgaagacaggccacatccggcctgctgtgggcctgcgctttgaggtgggccctggagctgctgtgcacagccccctggccagccagaatggcttcctgcacctgctgctgcacggctgtgacctggagctgctgacctctgtgctgagcggcctgggccccttcctggaggatgaggagatccctgtggtggtgcccatgcagatcgagctgctgaacagcagcatcaccctgaaggatgacatcccccccatctaccccaccagccctggccccatccccatcaccctggccatggagcacgtggtgctgaagagaagtgatgatggagtcttccacatcggggctgctgcccaggacaagcccagcgctgaggtgctgaagtctgagaagaggcagccccccaaggagcaggtgttcctggtgcccaccggggaggtgtttgagcagcagacctag

SEQ ID NO: 43149 - DNA, 4395 bp, Artificial Sequence
  Description of Artificial Sequence: Synthetic coding sequence
atggccggcatcatcaagaagcagatcctgaagcacctgagccgcttcaccaagaacctgagcccagacaagatcaacctgagcaccctgaagggggagggggagctgaagaacctggagctggatgaggaggtgctgcagaacatgctggacctgcccacctggctggccatcaacaaggtgttctgcaacaaggccagcatccgcatcccctggaccaagctgaagacccaccccatctgcctgagcctggacaaggtgatcatggagatgagcacctgtgaggagcccaggagccccaacggccccagccccatcgccacagccagcggccagagtgaatatggctttgctgagaaggtggtggagggcatctctgtgtctgtgaacagcatcgtcatccgcatcggggccaaggccttcaatgccagctttgagctgagccagctgcgcatctacagcgtgaatgcccactgggagcacggggacctgcgcttcacccgcatccaggacccccagagaggagaggtgctgaccttcaaggagatcaactggcagatgatccgcatcgaggctgatgccacccagagcagccacctggagatcatgtgtgcccctgtgcggctcatcaccaaccagagcaagatccgggtgaccctgaagaggcggctgaaggactgcaacgtcatcgccaccaagctggtgctgatcctggatgacctgctgtgggtgctgacagacagccagctgaaggccatggtgcagtatgccaagagcctgtctgaggccatcgagaagagcacagagcagaggaagtccatggcccctgagcccacccagagcagcacagtggtggccagcgcccagcaggtgaagaccacccagaccagcaatgccccagatgtgaatgatgccatcgtgaagctgttcaatgactttgatgtgaaggagaccagccaccacctggtgatcagccacctggacctgcacatctgtgatgacatccacgccaaggagaaggagagcaacagacgcatcactggaggagccatgcagctgtccttcacccagctgaccatcgactactacccctaccacaaggccggggacagctgcaaccactggatgtacttcagtgatgccaccaagaccaagaatggctgggccaatgagctgctgcacgagtttgaatgtaatgtggagatgctgaagcaggccgtgaaggaccacaacgtgggcagcccccccaagagccccacccacgccagcccccagcacacccagacagagaaggactaccccctgaagggcacctgcaggaccccatctgtgctgagccagcagagcaaggccaagctgatgagcagctctgtggtggtgcggctggccgacttcaacatctaccaggtgtccacagctgagcagtgccgcagcagccccaagtccatgatctgctgcaacaagaagagcctgtacctgccccaggagatgtctgctgtgtacatcgagttcacagagtactactacccagatggcaaggacttccccatccccagccccaacctgtacagccagctgaatgccctgcagttcaccgtggatgagaggagcatcctgtggctgaaccagttcctgctggacctgaagcagagcctgaaccagttcatggctgtgtacaagctgaatgacaacagcaagagtgatgagcacgtggatgtgcgggtggatggcctgatgctgaagtttgtgatccccagcgaggtgaagtctgagtgccaccaggaccagccccgggccatcagcatccagagcagcgagatgattgccaccaacaccaggcactgccccaactgccgccacagcgacctggaggccctcttccaggacttcaaggactgtgacttcttcagcaagacctacaccagcttccccaagagctgtgacaacttcaacctgctgcaccccatcttccagagacatgcccacgagcaggacaccaagatgcatgagatctacaagggcaacatcaccccccagctgaacaagaacaccctgaagaccagcgctgccacagatgtgtgggccgtgtacttcagccagttctggattgattatgagggcatgaagagcggcaagggccggcccatcagctttgtggacagcttccccctgagcatctggatctgccagcccaccaggtatgcagagagccagaaggagccccagacctgcaaccaggtgtccctgaacaccagccagagcgagagcagtgacctggccggccgcctgaagaggaagaagctgctgaaggagtactacagcacagaaagtgagcccctgaccaacggcggccagaagcccagcagcagtgacaccttcttccgcttcagccccagcagcagcgaggccgacatccacctgctggtgcacgtgcacaagcacgtgtccatgcagatcaaccactaccagtacctgctgctgctcttcctgcacgagagcctcatcctgctgtctgagaacctgaggaaggatgtggaggccgtgacaggcagccctgccagccagaccagcatctgcatcggcatcctgctgcggtctgctgagctggccctgctgctgcaccctgtggaccaggccaacaccctgaagagccctgtgtctgagagcgtgtcccctgtggtgcctgactacctgcccacagaaaatggagacttcctgagcagcaagaggaagcagatcagccgggacatcaaccgcatccgctctgtgacagtgaaccacatgtctgacaacagatccatgtctgtggacctgagccacatccccctgaaggaccccctgctcttcaagagcgccagtgacaccaacctgcagaagggcatctccttcatggactacctgagtgacaagcacctgggcaagatcagtgaagatgagagcagcggcctggtgtacaagagcggcagcggggagatcggcagcgagaccagtgacaagaaggacagcttctacacagacagcagcagcatcctgaactaccgggaggacagcaacatcctgagctttgacagtgatggcaaccagaacatcctgagcagcaccctgaccagcaaaggaaatgagaccatcgagagcatcttcaaggccgaggacctgctgcctgaggccgccagcctgtctgagaacctggacatcagcaaggaggagaccccacctgtgaggaccctgaagagccagagcagcctgagcggcaagcccaaggagcgctgcccccccaacctggcccccctgtgtgtgtcctacaagaacatgaagaggagcagcagccagatgagcctggacaccatcagcctggacagcatgatcctggaggagcagctgctggagagtgatggcagtgacagccacatgttcctggagaagggcaacaagaagaacagcaccaccaactaccggggcacagctgagagcgtgaatgctggggccaacctgcagaactatggagagaccagcccagatgccatcagcaccaacagcgagggcgcccaggagaaccatgatgacctgatgtctgtggtggtgttcaagatcaccggggtgaatggagaaattgacatcagaggagaggacacagagatctgcctgcaggtgaaccaggtgaccccagaccagctgggcaacatcagcctgcggcactacctgtgcaacagacctgtgggcagtgaccagaaggctgtgatccacagcaagagcagccctgagatcagcctgcgctttgaaagtggccctggagctgtgatccacagcctgctggccgagaagaatggcttcctgcagtgccacatcgagaacttcagcacagagttcctgaccagcagcctgatgaacatccagcacttcctggaggatgaaacagtggccaccgtgatgcccatgaagatccaggtgagcaacaccaagatcaacctgaaggatgacagccccaggagcagcacagtgtccctggagcccgcccctgtgacagtgcacatcgaccacctggtggtggagaggagtgatgatggcagcttccacatccgggacagccacatgctgaacacaggaaatgacctgaaggaaaatgtgaagagtgacagcgtgctgctgaccagcggcaagtatgacctgaagaagcagaggtctgtgacccaggccacccagaccagccctggggtgccctggcccagccagagcgccaacttccctgagttctcctttgacttcacccgggagcagctgatggaggagaatgaaagcctgaagcaggagctggccaaggccaagatggccctggccgaggcccacctggagaaggatgccctgctgcaccacatcaagaagatgacagtggagtag

SEQ ID NO: 43150 - DNA, 1569 bp, Artificial Sequence
  Description of Artificial Sequence: Synthetic coding sequence
atggccggcatcatcaagaagcagatcctgaagcacctgagccgcttcaccaagaacctgagcccagacaagatcaacctgagcaccctgaagggggagggggagctgaagaacctggagctggatgaggaggtgctgcagaacatgctggacctgcccacctggctggccatcaacaaggtgttctgcaacaaggccagcatccgcatcccctggaccaagctgaagacccaccccatctgcctgagcctggacaaggtgatcatggagatgagcacctgtgaggagcccaggagccccaacggccccagccccatcgccacagccagcggccagagtgaatatggctttgctgagaaggtggtggagggcatctctgtgtctgtgaacagcatcgtcatccgcatcggggccaaggccttcaatgccagctttgagctgagccagctgcgcatctacagcgtgaatgcccactgggagcacggggacctgcgcttcacccgcatccaggacccccagagaggagaggtgctgaccttcaaggagatcaactggcagatgatccgcatcgaggctgatgccacccagagcagccacctggagatcatgtgtgcccctgtgcggctcatcaccaaccagagcaagatccgggtgaccctgaagaggcggctgaaggactgcaacgtcatcgccaccaagctggtgctgatcctggatgacctgctgtgggtgctgacagacagccagctgaaggccatggtgcagtatgccaagagcctgtctgaggccatcgagaagagcacagagcagaggaagtccatggcccctgagcccacccagagcagcacagtggtggccagcgcccagcaggtgaagaccacccagaccagcaatgccccagatgtgaatgatgccatcgtgaagctgttcaatgactttgatgtgaaggagaccagccaccacctggtgatcagccacctggacctgcacatctgtgatgacatccacgccaaggagaaggagagcaacagacgcatcactggaggagccatgcagctgtccttcacccagctgaccatcgactactacccctaccacaaggccggggacagctgcaaccactggatgtacttcagtgatgccaccaagaccaagaatggctgggccaatgagctgctgcacgagtttgaatgtaatgtggagatgctgaagcaggccgtgaaggaccacaacgtgggcagcccccccaagagccccacccacgccagcccccagcacacccagacagagaaggactaccccctgaagggcacctgcaggaccccatctgtgctgagccagcagagcaaggccaagctgatgagcagctctgtggtggtgcggctggccgacttcaacatctaccaggtgtccacagctgagcagtgccgcagcagccccaagtccatgatctgctgcaacaagaagagcctgtacctgccccaggagatgtctgctgtgtacatcgagttcacagagtactactacccagatggcaaggacttccccacagccttcctgagcaggtag

SEQ ID NO: 43151 - DNA, 756 bp, Artificial Sequence
  Description of Artificial Sequence: Synthetic coding sequence
atgagcggcagcaaccccaaggctgctgctgctgccagcgctgctggccctgggggcctggtggccggcaaggaggagaagaagaaggccggcggcggcgtgctgaaccggctgaaggcccggcggcaggccccccaccacgccgcagatgatggagtgggcgctgctgtgacagagcaggagctgctggccctggacaccatccggcctgagcacgtgctgcggctgagccgggtgacagagaactacctgtgcaagccagaggacaacatctacagcattgacttcacccgcttcaagatccgggacctggagaccggcaccgtgctgtttgaaattgccaagccctgtgtgtctgaccaggaggaggatgaggaggagggcggcggagatgtggacatctctgctggccgctttgtgcgctaccagttcaccccagccttcctgcggctgaggacagtgggcgccaccgtggagttcaccgtgggggacaagcctgtgagcaacttcaggatgattgagcggcactacttccgggagcacctgctgaagaactttgattttgattttggcttctgcatccccagcagcaggaacacctgtgagcacatctatgagttcccccagctgtctgaagatgtgatccggctgatgattgagaacccctatgagaccaggagtgacagcttctactttgtggacaacaagctgatcatgcacaacaaggctgactatgcctacaacggcggccagtag

SEQ ID NO: 43152 - DNA, 756 bp, Artificial Sequence; identical to SEQ ID NO: 43151
  Description of Artificial Sequence: Synthetic coding sequence

SEQ ID NO: 43153 - DNA, 3828 bp, Artificial Sequence
  Description of Artificial Sequence: Synthetic coding sequence
atggagaacttcatcctgtatgaggagatcggccggggcagcaagacagtggtgtacaagggccgcaggaagggcaccatcaactttgtggccatcctgtgcacagacaagtgcaagaggcctgagatcaccaactgggtgcggctgacccgggagatcaagcacaagaacatcgtgaccttccacgagtggtatgagaccagcaaccacctgtggctggtggtggagctgtgcacaggaggcagcctgaagacagtgattgcccaggatgagaacctgcctgaagatgtggtgcgggagtttggaattgacctgatcagcggcctgcaccacctgcacaagctgggcatcctcttctgtgacatcagccccaggaagatcctgctggagggccctggcaccctgaagttcagcaacttctgcctggccaaggtggagggggagaacctggaggagttctttgccctggtggccgctgaggagggcggcggggacaacggggagaatgtgctgaagaagtccatgaagagccgggtgaagggcagccctgtgtacacagcccctgaggtggtgagaggagctgacttcagcatcagcagtgacctgtggagcctgggctgcctgctgtatgagatgttcagcggcaagccacccttcttcagcgagagcatcagcgagctgacagagaagatcctgtgtgaggaccccctgccccccatccccaaggacagcagccggcccaaggccagcagtgacttcatcaacctgctggatggcctgctgcagagggacccccagaagaggctgacctggacccggctgctgcagcacagcttctggaagaaggcctttgctggagctgaccaggagagctctgtggaggacctgagcctgagcaggaacaccatggagtgcagcggcccccaggacagcaaggagctgctgcagaacagccagagccggcaggccaagggccacaagagcggccagcccctgggccacagcttccggctggagaaccccacagagttccggcccaagagcaccctggagggccagctgaatgaatccatgttcctgctgagcagccggcccacccccaggaccagcacagctgtggaggtgtccccaggagaggacatgacccactgcagcccccagaagaccagccccctgaccaagatcaccagcggccacctgagccagcaggacctggagagccagatgagggagctgatctacacagacagcgacctggtggtgacccccatcatcgacaaccccaagatcatgaagcagccccctgtgaagtttgatgccaagatcctgcacctgcccacctacagcgtggacaagctgctcttcctgaaggaccaggactggaatgacttcctgcagcaggtgtgcagccagattgacagcacagagaagtccatgggcgccagccgggccaagctgaacctgctgtgctacctgtgtgtggtggccggccaccaggaggtggccacccggctgctgcacagccccctcttccagctgctgatccagcacctgcgcatcgcccccaactgggacatccgggccaaggtggcccacgtgattggcctgctggccagccacacagctgagctgcaggagaacacccctgtggtggaggccatcgtgctgctgacagagctgatccgggagaacttcaggaacagcaagctgaagcagtgcctgctgcccaccctgggggagctgatctacctggtggccacccaggaggagaagaagaagaacccccgggagtgctgggccgtgcccctggccgcctacacagtgctgatgcgctgcctgcgggagggggaggagcgggtggtgaaccacatggccgccaagatcattgaaaatgtgtgcaccaccttcagcgcccagagccagggcttcatcactggagagatcggccccatcctgtggtacctgttccgccacagcacagctgacagcctgcgcatcacagctgtgtctgccctgtgccgcatcaccaggcacagccccacagccttccagaatgtgattgagaaggtgggcctgaacagcgtcatcaacagcctggccagcgccatctgcaaggtgcagcagtacatgctgaccctgtttgctgccatgctgagctgtggcatccacctgcagaggctcatccaggagaagggctttgtgtccaccatcatccggctgctggacagccccagcacctgcatccgggccaaggccttcctggtgctgctgtacatcctgatctacaaccgggagatgctgctgctgagctgccaggcccggctggtgatgtacatcgagcgggacagcaggaagaccacccctgggaaggagcagcagagcggaaatgagtacctgagcaagtgcctggacctgctgatctgccacatcgtgcaggagctgccccgcatcctgggggacatcctgaacagcctggccaacgtgtctggcaggaagcaccccagcacagtgcaggtgaagcagctgaagctgtgcctgcccctgatgcctgtggtgctgcacctggtgaccagccaggtgttccggccccaggtggtgacagaggagttcctgttctcctatggcaccatcctgagccacatcaagtctgtggacagcggggagaccaacattgatggagccatcggcctgacagccagcgaggagttcatcaagatcaccctgagcgcctttgaggccatcatccagtaccccatcctgctgaaggactaccgcagcacagtggtggactacatcctgccccccctggtgtccctggtgcagagccagaatgtggagtggaggctcttcagcctgcggctgctgtctgagaccaccagcctgctggtgaaccaggagtttggagatggcaaggagaaggcctctgtggacagcgacagcaacctgctggccctgatcagagatgtgctgctgccccagtatgagcacatcctgctggagccagaccctgtgcctgcctatgccctgaagctgctggtggccatgacagagcacaaccccaccttcacccggctggtggaggagagcaagctgatccccctcatctttgaggtgaccctggagcaccaggagagcatcctgggcaacaccatgcagagcgtgattgccctgctgagcaacctggtggcctgcaaggacagcaacatggagctgctgtatgagcagggcctggtgagccacatctgcaacctgctgacagaaacagccaccctgtgcctggatgtggacaacaagaacaacaatgagatggccgcccccctgctcttcagcctgctggacatcctgcacagcatgctgacctacaccagcggcatcgtgcggctggccctgcaggcccagaagagcggcagcggggaggacccccaggccgctgaggacctgctgctgctgaaccggcccctgacagacctgatcagcctgctgatccccctgctgcccaatgaagatcctgagatctttgatgtgagcagcaagtgcctgagcatcctggtgcagctgtatggaggagagaacccagacagcctgagcccagaaaatgtggagatctttgcccacctgctgaccagcaaagaagaccccaaggagcagaagctgctgctgcgcatcctgcggaggatgatcaccagcaatgagaagcacctggagagcctgaagaatgccggcagcctgctgcgggccctggagcggctggcccctggcagcggcagctttgctgacagcgctgtggcccccctggccctggagatcctgcaggccgtgggccactag

SEQ ID NO: 43154 - DNA, 210 bp, Artificial Sequence
  Description of Artificial Sequence: Synthetic coding sequence
atgcagaagtactgcatctaccagcacttccagttccagctgctgatccagcacctgtggattgctgccaactgtgacatctgggccaaggtggcccgggtgattggcctgctggccagccacaagacagacctgcaggagaacacccctgtggtggaggccttccccaacagccccaggacccccaccctgcccggggtgctgacctag

SEQ ID NO: 43155 - DNA, 210 bp, Artificial Sequence; identical to SEQ ID NO: 43154
  Description of Artificial Sequence: Synthetic coding sequence

SEQ ID NO: 43156 - DNA, 7377 bp, Artificial Sequence
  Description of Artificial Sequence: Synthetic coding sequence
atgatcagcaccctggccaccttcccccccttcctgcacaaggacatcatcgagtacctgagcaccagcttcctgcccatggccatcctgggcagcagccggcgggagggcgtgcctgcccacgtgaacctgagcgccagctccatgctgatgattgccatgcagtacaccagcaaccctgtgtaccactgccagctgctggagtgcctgatgaagtacaagcaggaggtgtggaaggacctgctgtatgtgattgcctacggccccagccaggtgaagcccccagctgtgcagatgctgttccactactggcccaacctgaagcccccaggggccatcagcgagtaccggggcctgcagtacacagcctggaaccccatccactgccagcacatcgagtgccacaatgccatcaacaagccagctgtgaagatgtgcatcgaccccagcctgtctgtggccctgggggacaagcccccacccctgtacctgtgtgaagaatgttctgaaagaattgctggggaccacagcgagtggctgattgatgtgctgctgccccaggccgagatcagcgccatctgccagaagaagaactgcagcagccacgtgcggcgggctgtggtgacctgcttctctgctggctgctgcggcagacatggcaacagacctgtgcgctactgcaagcgctgccacagcaaccaccacagcaatgaggtgggcgctgctgctgagacccacctgtaccagaccagccccccacccatcaacaccagagaatgtggggctgaggagctggtgtgtgctgtggaggccgtcatcagcctgctgaaggaggccgagttccacgccgagcagcgggagcacgagctgaacagaagacggcagctgggcctgagcagcagccaccacagcctggacaatgctgactttgacaacaaggatgatgacaagcatgaccagaggctgctgagccagtttggcatctggttcctggtgtccctgtgcacccccagcgagaacacccccacagagagcctggcccggctggtggccatggtgttccagtggttccacagcacagcctacatgatggatgatgaggtgggcagcctggtggagaagctgaagccccagtttgtgaccaagtggctgaagacagtgtgtgatgtgcgctttgatgtgatggtgatgtgcctgctgcccaagcccatggagtttgcccgggtgggcggctactgggacaagagctgcagcacagtgacccagctgaaggagggcctgaaccgcatcctgtgcctgatcccctacaacgtcatcaaccagagcgtgtgggagtgcatcatgcctgagtggctggaggccatcagaacagaggtgcctgacaaccagctgaaggagttccgggaggtgctgagcaagatgtttgatattgagctgtgccccctgcccttctccatggaggagatgtttggcttcatcagctgccgcttcaccggctaccccagctctgtgcaggagcaggccctgctgtggctgcacgtgctgtctgagctggacatcatggtgcccctgcagctgctgatctccatgttcagtgatggagtgaacagcgtgaaggagctggccaaccagaggaagagccgggtgtctgagctggccggcaacctggccagcagaagagtgtctgtggccagtgaccctggaagaagagtgcagcacaacatgctgagccccttccacagccccttccagagccccttccgcagccccctgcggagccccttccgcagccccttcaagaactttggccaccctgggggccgcaccatcgactttgactgtgaagatgatgagatgaacctgaactgcttcatcctgatgtttgacctgctgctgaagcagatggagctgcaggatgatggcatcaccatgggcctggagcacagcctgagcaaggacatcatcagcatcatcaacaacgtgttccaggccccctggggcggcagccacacctgccagaaggatgagaaggccatcgagtgcaacctgtgccagagcagcatcctgtgctaccagctggcctgtgagctgctggagcggctggcccccaaggaggagagccggctggtggagcccacagacagcctggaggacagcctgctgagcagcaggcctgagttcatcatcggccctgagggggaggaggaggagaacccagccagcaagcatggagaaaatcctggcaactgcacagagcctgtggagcacgccgctgtgaagaatgacacagagaggaagttctgctaccagcagctgcctgtgaccctgcggctcatctacaccatcttccaggagatggccaagtttgaggagccagacatcctcttcaacatgctgaactgcctgaagatcctgtgcctgcacggggagtgcctgtacatcgccaggaaggaccacccccagttcctggcctacatccaggaccacatgctgattgccagcctgtggagggtggtgaagtctgagttcagccagctgagcagcctggccgtgcccctgctgctgcacgccctgagcctgccccacggggctgacatcttctggaccatcatcaatggaaacttcaacagcaaggactggaagatgagatttgaggccgtggagaaggtggccgtcatctgccgcttcctggacatccacagcgtgaccaagaaccacctgctgaagtacagcctggcccacgccttctgctgcttcctgacagctgtggaggatgtgaacccagctgtggccacccgggccggcctgctgctggacaccatcaagaggcctgccctgcagggcctgtgcctgtgcctggacttccagtttgacacagtggtgaaggaccggcccaccatcctgagcaagctgctgctgctgcacttcctgaagcaggacatcccagccctgtcctgggagttctttgtgaacagatttgagaccctgagcctggaggcccagctgcacctggactgcaacaaggagttccccttccccaccaccatcacagctgtgaggaccaacgtggccaacctgagtgatgctgccctgtggaagatcaagagggccaggtttgccaggaaccggcagaagtctgtgcgcagcctgcgggacagcgtgaagggccctgtggagagcaagagggccctgagcctgcctgagaccctgaccagcaagatccggcagcagagcccagaaaatgacaacaccatcaaggacctgctgcctgaagatgctggcatcgaccaccagacagtgcaccagctgatcaccgtgctgatgaagttcatggccaaggatgagagcagcgctgagagtgacatcagcagcgccaaggccttcaacacagtgaagaggcacctgtatgtgctgctgggctatgaccagcaggagggctgcttcatgattgccccccagaagatgaggctgagcacctgcttcaatgccttcatcgccggcatcgcccaggtgatggactacaacatcaacctgggcaagcacctgctgcccctggtggtgcaggtgctgaagtactgcagctgcccccagctgcggcactacttccagcagcccccacgctgcagcctgtggagcctgaagccccacatccggcagatgtggctgaaggccctgctggtgatcctgtacaagtacccctacagagactgtgacatcagcaagatcctgctgcacctgatccacatcaccgtgaacaccctgaatgcccagtaccacagctgcaagccccacgccacagctggccccctgtacagcgacaacagcaacatcagccgctacagcgagaaggagaagggggagattgagctggccgagtaccgggagaccggggccctgcaggacagcctgctgcactgtgtgcgggaggagagcatccccaagaagaagctgcgctccttcaagcagaagagcctggacattggaaatgctgacagcctgctcttcaccctggatgagcacaggaggaagagctgcatcgacagatgtgacatcgagaagccacccacccaggccgcctacatcgcccagaggcccaatgaccccggccgcagccggcagaacagcgccaccaggccagacaacagcgagatccctgagaacccagccatggagggcttcccagatgcccggcggcctgtgattcctgaggtgcggctgaactgcatggagacctttgaggtgaaggtggacagccctgtgaagccagcccccaaggaggacctggacctgattgacctgagcagtgacagcaccagcggccctgagaagcacagcatcctgagcaccagtgacagcgacagcctggtgtttgagcccctgccccccctgagaattgtggagagtgatgaggaggaggagaccatgaaccagggagatgatggccccagcggcaagaatgctgccagcagccccagcgtgcccagccaccccagcgtgctgagcctgagcacagcccccctggtgcaggtgtctgtggaggactgcagcaaggacttcagcagcaaggacagcggcaacaaccagagcgctggcaacacagattctgccctgatcaccctggaggaccccatggatgctgagggcagcagcaagccagaggagctgcctgagttcagctgtggcagccccctgaccctgaagcagaagagggacctgctgcagaagagctttgccctgcctgagatgagcctggatgaccacccagaccccggcacagaaggagagaagccaggagagctgatgcccagcagcggggccaagacagtgctgctgaaggtgcctgaagatgctgagaaccccacagaaagtgagaagccagacaccagcgctgagagtgacacagagcagaaccctgagaggaaggtggaggaggatggagctgaggagagcgagttcaagatccagatcgtgccccggcagaggaagcagaggaagattgctgtgtctgccatccagcgggagtacctggacatctccttcaacatcctggacaagctgggggagcagaaggaccctgaccccagcaccaagggcctgagcaccctggagatgccccgggagagcagcagcgcccccaccctggatgctggggtgcctgagaccagcagccacagcagcatcagcacccagtaccggcagatgaagaggggcagcctgggcgtgctgaccatgagccagctgatgaagaggcagctggagcaccagagcagcgccccccacaacatcagcaactgggacacagagcagatccagcccgggaagaggcagtgcaatgtgcccacctgcctgaacccagacctggagggccagcccctgaggatgagaggagccaccaagagcagcctgctgagcgcccccagcatcgtgtccatgtttgtgcctgcccctgaggagttcacagatgagcagcccaccgtgatgacagacaagtgccacgactgtggggccatcctggaggagtatgatgaggagaccctgggcctggccatcgtggtgctgagcaccttcatccacctgagcccagacctggccgcccccctgctgctggacatcatgcagagcgtgggccgcctggccagcagcaccaccttcagcaaccaggccgagagcatgatggtgcctggaaatgctgctggggtggccaagcagttcctgcgctgcatcttccaccagctggccccaaatggcatcttcccccagctgttccagagcaccatcaaggatggcaccttcctgcggaccctggccagcagcctgatggacttcaatgagctgagcagcattgctgccctgagccagctgctggagggcctgaacaacaagaagaacctgcctgctgggggcgccatgatccgctgcctggagaacatcgccaccttcatggaggccctgcccatggacagccccagcagcctgtggaccaccatcagcaaccagttccagaccttctttgccaagctgccctgtgtgctgcccctgaagtgcagcctggacagcagcctgcgcatcatgatctgcctgctgaagatccccagcaccaatgccaccaggagcctgctggagcccttcagcaagctgctgagctttgtgatccagaatgctgtgttcaccctggcctacctggtggagctgtgtggcctgtgctaccgggccttcaccaaggagcgggacaagttctacctgagccgctctgtggtgctggagctgctgcaggccctgaagctgaagagccccctgcctgacaccaacctgctgctgctggtgcagttcatctgtgctgatgctggcaccaagctggccgagagcaccatcctgagcaagcagatgattgcctctgtgcccggctgcggcacagctgccatggagtgtgtgcggcagtacatcaatgaggtgctggacttcatggctgacatgcacaccctgaccaagctgaagagccacatgaagacctgcagccagcccctgcacgaggacaccttcggcggccacctgaaggtgggcctggcccagattgctgccatggacatcagccggggcaaccaccgggacaacaaggccgtcatccgctacctgccctggctgtaccaccccccatctgccatgcagcagggccccaaggagttcattgaatgtgtgagccacatccggctgctgtcctggctgctgctgggcagcctgacccacaatgctgtgtgccccaatgccagcagcccctgcctgcccatccccctggatgctggcagccacgtggccgaccacctgattgtcatcctgattggcttccctgagcagagcaagacctctgtgctgcacatgtgcagcctcttccacgccttcatctttgcccagctgtggacagtgtactgtgagcagagcgctgtggccaccaacctgcagaaccagaatgagttctccttcaccgccatcctgacagccctggagttctggagccgggtgacccccagcatcctgcagctgatggcccacaacaaggtgatggtggagatggtgtgcctgcacgtgatcagcctgatggaggccctgcaggagtgcaacagcaccatctttgtgaagctgatccccatgtggctgcccatgatccagagcaacatcaagcacctgtctgctggcctgcagctgcggctgcaggccatccagaaccacgtgaaccaccacagcctgcggaccctgcccggcagcggccagagcagcgctggcctggccgccctgaggaagtggctgcagtgcacccagttcaagatggcccaggtggagatccagagcagcgaggccgccagccagttctaccccctgtag

SEQ ID NO: 43157 - DNA, 7908 bp, Artificial Sequence
  Description of Artificial Sequence: Synthetic coding sequence
atgagcaccaaggccgagcagtttgccagcaagatccgctacctgcaggagtaccacaacagagtgctgcacaacatctaccctgtgcccagcggcacagacatcgccaacaccctgaagtacttcagccagaccctgctgagcatcctgagcaggacaggcaagaaggagaaccaggatgccagcaacctgactgtgcccatgaccatgtgcctcttccctgtgcccttccccctgacccccagcctgcggccccaggtgagcagcatcaaccccaccgtgaccaggagcctgctgtacagcgtgctgagagatgcccccagcgagcggggcccccagagcagagatgcccagctgagtgactaccccagcctggactaccagggcctgtatgtgaccctggtgaccctgctggacctggtgcccctgctgcagcacggccagcacgacctgggccagagcatcttctacaccaccacctgcctgctgcccttcctgaatgatgacatcctgagcaccctgccctacaccatgatcagcaccctggccaccttcccccccttcctgcacaaggacatcatcgagtacctgagcaccagcttcctgcccatggccatcctgggcagcagcagaagagagggcgtgcctgcccacgtgaacctgagcgccagctccatgctgatgattgccatgcagtacaccagcaaccctgtgtaccactgccagctgctggagtgcctgatgaagtacaagcaggaggtgtggaaggacctgctgtatgtgattgcctacggccccagccaggtgaagcccccagctgtgcagatgctgttccactactggcccaacctgaagcccccaggggccatcagcgagtaccggggcctgcagtacacagcctggaaccccatccactgccagcacatcgagtgccacaatgccatcaacaagccagctgtgaagatgtgcatcgaccccagcctgtctgtggccctgggggacaagcccccacccctgtacctgtgtgaggagtgcagcgagagaattgctggggaccacagcgagtggctgattgatgtgctgctgccccaggccgagatcagcgccatctgccagaagaagaactgcagcagccacgtgagaagagctgtggtgacctgcttctctgctggctgctgcggccgccacggcaacagacctgtgcgctactgcaagcgctgccacagcaaccaccacagcaatgaggtgggcgctgctgctgagacccacctgtaccagaccagccccccacccatcaacacccgggagtgtggggctgaggagctggtgtgtgctgtggaggccgtcatcagcctgctgaaggaggccgagttccacgccgagcagcgggagcacgagctgaacagaagacggcagctgggcctgagcagcagccaccacagcctggacaatgctgactttgacaacaaggatgatgacaagcatgaccagaggctgctgagccagtttggcatctggttcctggtgtccctgtgcaccccatctgagaacacccccacagagagcctggcccggctggtggccatggtgttccagtggttccacagcacagcctacatgatggatgatgaggtgggcagcctggtggagaagctgaagccccagtttgtgaccaagtggctgaagacagtgtgtgatgtgcgctttgatgtgatggtgatgtgcctgctgcccaagcccatggagtttgcccgggtgggcggctactgggacaagagctgcagcacagtgacccagctgaaggagggcctgaaccgcatcctgtgcctgatcccctacaacgtcatcaaccagagcgtgtgggagtgcatcatgcctgagtggctggaggccatcagaacagaggtgcctgacaaccagctgaaggagttccgggaggtgctgagcaagatgtttgacatcgagctgtgccccctgcccttctccatggaggagatgtttggcttcatcagctgccgcttcaccggctaccccagctctgtgcaggagcaggccctgctgtggctgcacgtgctgtctgagctggacatcatggtgcccctgcagctgctgatctccatgttcagtgatggagtgaacagcgtgaaggagctggccaaccagaggaagagccgggtgtctgagctggccggcaacctggccagccggcgggtgtctgtggccagtgaccccggccggcgggtgcagcacaacatgctgagccccttccacagccccttccagagccccttccgcagccccctgcggagccccttccgcagccccttcaagaactttggccaccctgggggccgcaccatcgactttgactgtgaagatgatgagatgaacctgaactgcttcatcctgatgtttgacctgctgctgaagcagatggagctgcaggatgatggcatcaccatgggcctggagcacagcctgagcaaggacatcatcagcatcatcaacaacgtgttccaggccccctggggcggcagccacacctgccagaaggatgagaaggccatcgagtgcaacctgtgccagagcagcatcctgtgctaccagctggcctgtgagctgctggagcggctggcccccaaggaggagagccggctggtggagcccacagacagcctggaggacagcctgctgagcagcaggcctgagttcatcatcggccctgagggggaggaggaggagaacccagccagcaagcacggggagaaccctggcaactgcacagagcctgtggagcacgccgctgtgaagaatgacacagagaggaagttctgctaccagcagctgcctgtgaccctgcggctcatctacaccatcttccaggagatggccaagtttgaggagccagacatcctcttcaacatgctgaactgcctgaagatcctgtgcctgcatggagaatgtctgtacatcgccaggaaggaccacccccagttcctggcctacatccaggaccacatgctgattgccagcctgtggagggtggtgaagtctgagttcagccagctgagcagcctggccgtgcccctgctgctgcacgccctgagcctgccccatggagctgacatcttctggaccatcatcaatggaaacttcaacagcaaggactggaagatgagatttgaagctgtggagaaggtggccgtcatctgccgcttcctggacatccacagcgtgaccaagaaccacctgctgaagtacagcctggcccacgccttctgctgcttcctgacagctgtggaggatgtgaacccagctgtggccaccagggctggcctgctgctggacaccatcaagaggcctgccctgcagggcctgtgcctgtgcctggacttccagtttgacacagtggtgaaggaccggcccaccatcctgagcaagctgctgctgctgcacttcctgaagcaggacatcccagccctgtcctgggagttctttgtgaacagatttgagaccctgagcctggaggcccagctgcacctggactgcaacaaggagttccccttccccaccaccatcacagctgtgaggaccaacgtggccaacctgagtgatgctgccctgtggaagatcaagagggccaggtttgccaggaaccggcagaagtctgtgcgcagcctgcgggacagcgtgaagggccctgtggagagcaagagggccctgagcctgcctgagaccctgaccagcaagatccggcagcagagcccagaaaatgacaacaccatcaaggacctgctgcctgaagatgctggcatcgaccaccagacagtgcaccagctgatcaccgtgctgatgaagttcatggccaaggatgagagcagcgctgagagtgacatcagcagcgccaaggccttcaacacagtgaagaggcacctgtatgtgctgctgggctatgaccagcaggagggctgcttcatgattgccccccagaagatgaggctgagcacctgcttcaatgccttcatcgccggcatcgcccaggtgatggactacaacatcaacctgggcaagcacctgctgcccctggtggtgcaggtgctgaagtactgcagctgcccccagctgcggcactacttccagcagcccccacgctgcagcctgtggagcctgaagccccacatccggcagatgtggctgaaggccctgctggtgatcctgtacaagtacccctacagagactgtgacatcagcaagatcctgctgcacctgatccacatcaccgtgaacaccctgaatgcccagtaccacagctgcaagccccacgccacagctggccccctgtacagcgacaacagcaacatcagccgctacagcgagaaggagaagggggagattgagctggccgagtaccgggagactggagccctgcaggacagcctgctgcactgtgtgcgggaggagagcatccccaagaagaagctgcggagcttcaagcagaagagcctggacattggaaatgctgacagcctgctcttcaccctggatgagcacaggaggaagagctgcatcgacagatgtgacatcgagaagccacccacccaggccgcctacatcgcccagaggcccaatgaccccggccgcagccggcagaacagcgccaccaggccagacaacagcgagatcccagaaaatcctgccatggagggcttcccagatgcccggcggcctgtgattcctgaggtgcggctgaactgcatggagacctttgaggtgaaggtggacagccctgtgaagccagcccccaaggaggacctggacctgattgacctgagcagtgacagcaccagcggccctgagaagcacagcatcctgagcaccagtgacagcgacagcctggtgtttgagcccctgccccccctgcgcatcgtggagagtgatgaggaggaggagaccatgaaccagggagatgatggccccagcggcaagaatgctgccagcagccccagcgtgcccagccaccccagcgtgctgagcctgagcacagcccccctggtgcaggtgtctgtggaggactgcagcaaggacttcagcagcaaggacagcggcaacaaccagagcgctggcaacacagacagcgccctgatcaccctggaggaccccatggatgctgagggcagcagcaagccagaggagctgcctgagttcagctgtggcagccccctgaccctgaagcagaagagggacctgctgcagaagagctttgccctgcctgagatgagcctggatgaccacccagaccctggaacagaaggagagaagccaggagagctgatgcccagcagcggggccaagacagtgctgctgaaggtgcctgaagatgctgagaaccccacagagagcgagaagccagacaccagcgctgagagtgacacagagcagaaccctgagaggaaggtggaggaggatggagctgaggagagcgagttcaagatccagatcgtgccccggcagaggaagcagaggaagattgctgtgtctgccatccagcgggagtacctggacatctccttcaacatcctggacaagctgggggagcagaaggaccctgaccccagcaccaagggcctgagcaccctggagatgccccgggagagcagcagcgcccccaccctggatgctggggtgcctgagaccagcagccacagcagcatcagcacccagtaccggcagatgaagaggggcagcctgggcgtgctgaccatgagccagctgatgaagaggcagctggagcaccagagcagcgccccccacaacatcagcaactgggacacagagcagatccagcccgggaagaggcagtgcaatgtgcccacctgcctgaacccagacctggagggccagcccctgaggatgagaggagccaccaagagcagcctgctgagcgcccccagcatcgtgtccatgtttgtgcctgcccctgaggagttcacagatgagcagcccaccgtgatgacagacaagtgccacgactgtggggccatcctggaggagtatgatgaggagaccctgggcctggccatcgtggtgctgagcaccttcatccacctgagcccagacctggccgcccccctgctgctggacatcatgcagagcgtgggccgcctggccagcagcaccaccttcagcaaccaggccgagagcatgatggtgcctggaaatgctgctggggtggccaagcagttcctgcgctgcatcttccaccagctggcccccaacggcatcttcccccagctgttccagagcaccatcaaggatggcaccttcctgcggaccctggccagcagcctgatggacttcaatgagctgagcagcattgctgccctgagccagctgctggagggcctgaacaacaagaagaacctgcctgctggaggagccatgatccgctgcctggagaacatcgccaccttcatggaggccctgcccatggacagccccagcagcctgtggaccaccatcagcaaccagttccagaccttctttgccaagctgccctgtgtgctgcccctgaagtgcagcctggacagcagcctgcgcatcatgatctgcctgctgaagatccccagcaccaatgccaccaggagcctgctggagcccttcagcaagctgctgagctttgtgatccagaatgctgtgttcaccctggcctacctggtggagctgtgtggcctgtgctaccgggccttcaccaaggagcgggacaagttctacctgagccgctctgtggtgctggagctgctgcaggccctgaagctgaagagccccctgcctgacaccaacctgctgctgctggtgcagttcatctgtgctgatgctggcaccaagctggccgagagcaccatcctgagcaagcagatgattgcctctgtgcccggctgcggcacagctgccatggagtgtgtgcggcagtacatcaatgaggtgctggacttcatggctgacatgcacaccctgaccaagctgaagagccacatgaagacctgcagccagcccctgcacgaggacacctttggaggccacctgaaggtgggcctggcccagattgctgccatggacatcagccggggcaaccaccgggacaacaaggctgtgatccgctacctgccctggctgtaccacccccccagcgccatgcagcagggccccaaggagttcattgaatgtgtgagccacatccggctgctgtcctggctgctgctgggcagcctgacccacaatgctgtgtgccccaatgccagcagcccctgcctgcccatccccctggatgctggcagccacgtggccgaccacctgattgtcatcctgattggcttccctgagcagagcaagacctctgtgctgcacatgtgcagcctcttccacgccttcatctttgcccagctgtggacagtgtactgtgagcagagcgctgtggccaccaacctgcagaaccagaatgagttctccttcaccgccatcctgacagccctggagttctggagccgggtgacccccagcatcctgcagctgatggcccacaacaaggtgatggtggagatggtgtgcctgcacgtgatcagcctgatggaggccctgcaggagtgcaacagcaccatctttgtgaagctgatccccatgtggctgcccatgatccagagcaacatcaagcacctgtctgctggcctgcagctgcggctgcaggccatccagaaccacgtgaaccaccacagcctgcggaccctgcccggcagcggccagagcagcgctggcctggccgccctgaggaagtggctgcagtgcacccagttcaagatggcccaggtggagatccagagcagcgaggccgccagccagttctaccccctgtag

SEQ ID NO: 43158 - DNA, 7974 bp, Artificial Sequence
  Description of Artificial Sequence: Synthetic coding sequence
atgaacagcaagaggcacaagatcgccagcaagatccgctacctgcaggagtaccacaacagagtgctgcacaacatctaccctgtgcccagcggcacagacatcgccaacaccctgaagtacttcagccagaccctgctgagcatcctgagcaggacaggcaagaaggagaaccaggatgccagcaacctgactgtgcccatgaccatgtgcctcttccctgtgcccttccccctgacccccagcctgcggccccaggtgagcagcatcaaccccaccgtgaccaggagcctgctgtacagcgtgctgagagatgcccccagcgagcggggcccccagagcagagatgcccagctgagtgactaccccagcctggactaccagggcctgtatgtgaccctggtgaccctgctggacctggtgcccctgctgcagcacggccagcacgacctgggccagagcatcttctacaccaccacctgcctgctgcccttcctgaatgatgacatcctgagcaccctgccctacaccatgatcagcaccctggccaccttcccccccttcctgcacaaggacatcatcgagtacctgagcaccagcttcctgcccatggccatcctgggcagcagcagaagagagggcgtgcctgcccacgtgaacctgagcgccagctccatgctgatgattgccatgcagtacaccagcaaccctgtgtaccactgccagctgctggagtgcctgatgaagtacaagcaggaggtgtggaaggacctgctgtatgtgattgcctacggccccagccaggtgaagcccccagctgtgcagatgctgttccactactggcccaacctgaagcccccaggggccatcagcgagtaccggggcctgcagtacacagcctggaaccccatccactgccagcacatcgagtgccacaatgccatcaacaagccagctgtgaagatgtgcatcgaccccagcctgtctgtggccctgggggacaagcccccacccctgtacctgtgtgaggagtgcagcgagagaattgctggggaccacagcgagtggctgattgatgtgctgctgccccaggccgagatcagcgccatctgccagaagaagaactgcagcagccacgtgagaagagctgtggtgacctgcttctctgctggctgctgcggccgccacggcaacagacctgtgcgctactgcaagcgctgccacagcaaccaccacagcaatgaggtgggcgctgctgctgagacccacctgtaccagaccagccccccacccatcaacacccgggagtgtggggctgaggagctggtgtgtgctgtggaggccgtcatcagcctgctgaaggaggccgagttccacgccgagcagcgggagcacgagctgaacagaagacggcagctgggcctgagcagcagccaccacagcctggacaatgctgactttgacaacaaggatgatgacaagcatgaccagaggctgctgagccagtttggcatctggttcctggtgtccctgtgcaccccatctgagaacacccccacagagagcctggcccggctggtggccatggtgttccagtggttccacagcacagcctacatgatggatgatgaggtgggcagcctggtggagaagctgaagccccagtttgtgaccaagtggctgaagacagtgtgtgatgtgcgctttgatgtgatggtgatgtgcctgctgcccaagcccatggagtttgcccgggtgggcggctactgggacaagagctgcagcacagtgacccagctgaaggagggcctgaaccgcatcctgtgcctgatcccctacaacgtcatcaaccagagcgtgtgggagtgcatcatgcctgagtggctggaggccatcagaacagaggtgcctgacaaccagctgaaggagttccgggaggtgctgagcaagatgtttgacatcgagctgtgccccctgcccttctccatggaggagatgtttggcttcatcagctgccgcttcaccggctaccccagctctgtgcaggagcaggccctgctgtggctgcacgtgctgtctgagctggacatcatggtgcccctgcagctgctgatctccatgttcagtgatggagtgaacagcgtgaaggagctggccaaccagaggaagagccgggtgtctgagctggccggcaacctggccagccggcgggtgtctgtggccagtgaccccggccggcgggtgcagcacaacatgctgagccccttccacagccccttccagagccccttccgcagccccctgcggagccccttccgcagccccttcaagaactttggccaccctgggggccgcaccatcgactttgactgtgaagatgatgagatgaacctgaactgcttcatcctgatgtttgacctgctgctgaagcagatggagctgcaggatgatggcatcaccatgggcctggagcacagcctgagcaaggacatcatcagcatcatcaacaacgtgttccaggccccctggggcggcagccacacctgccagaaggatgagaaggccatcgagtgcaacctgtgccagagcagcatcctgtgctaccagctggcctgtgagctgctggagcggctggcccccaaggaggagagccggctggtggagcccacagacagcctggaggacagcctgctgagcagcaggcctgagttcatcatcggccctgagggggaggaggaggagaacccagccagcaagcacggggagaaccctggcaactgcacagagcctgtggagcacgccgctgtgaagaatgacacagagaggaagttctgctaccagcagctgcctgtgaccctgcggctcatctacaccatcttccaggagatggccaagtttgaggagccagacatcctcttcaacatgctgaactgcctgaagatcctgtgcctgcatggagaatgtctgtacatcgccaggaaggaccacccccagttcctggcctacatccaggaccacatgctgattgccagcctgtggagggtggtgaagtctgagttcagccagctgagcagcctggccgtgcccctgctgctgcacgccctgagcctgccccatggagctgacatcttctggaccatcatcaatggaaacttcaacagcaaggactggaagatgagatttgaagctgtggagaaggtggccgtcatctgccgcttcctggacatccacagcgtgaccaagaaccacctgctgaagtacagcctggcccacgccttctgctgcttcctgacagctgtggaggatgtgaacccagctgtggccaccagggctggcctgctgctggacaccatcaagaggcctgccctgcagggcctgtgcctgtgcctggacttccagtttgacacagtggtgaaggaccggcccaccatcctgagcaagctgctgctgctgcacttcctgaagcaggacatcccagccctgtcctgggagttctttgtgaacagatttgagaccctgagcctggaggcccagctgcacctggactgcaacaaggagttccccttccccaccaccatcacagctgtgaggaccaacgtggccaacctgagtgatgctgccctgtggaagatcaagagggccaggtttgccaggaaccggcagaagtctgtgcgcagcctgcgggacagcgtgaagggccctgtggagagcaagagggccctgagcctgcctgagaccctgaccagcaagatccccatgaggctgaccaggcatgagcagagcgccccagccctgggcggcaccccagagcagaccccaggccagcagagcccagaaaatgacaacaccatcaaggacctgctgcctgaagatgctggcatcgaccaccagacagtgcaccagctgatcaccgtgctgatgaagttcatggccaaggatgagagcagcgctgagagtgacatcagcagcgccaaggccttcaacacagtgaagaggcacctgtatgtgctgctgggctatgaccagcaggagggctgcttcatgattgccccccagaagatgaggctgagcacctgcttcaatgccttcatcgccggcatcgcccaggtgatggactacaacatcaacctgggcaagcacctgctgcccctggtggtgcaggtgctgaagtactgcagctgcccccagctgcggcactacttccagcagcccccacgctgcagcctgtggagcctgaagccccacatccggcagatgtggctgaaggccctgctggtgatcctgtacaagtacccctacagagactgtgacatcagcaagatcctgctgcacctgatccacatcaccgtgaacaccctgaatgcccagtaccacagctgcaagccccacgccacagctggccccctgtacagcgacaacagcaacatcagccgctacagcgagaaggagaagggggagattgagctggccgagtaccgggagactggagccctgcaggacagcctgctgcactgtgtgcgggaggagagcatccccaagaagaagctgcggagcttcaagcagaagagcctggacattggaaatgctgacagcctgctcttcaccctggatgagcacaggaggaagagctgcatcgacagatgtgacatcgagaagccacccacccaggccgcctacatcgcccagaggcccaatgaccccggccgcagccggcagaacagcgccaccaggccagacaacagcgagatcccagaaaatcctgccatggagggcttcccagatgcccggcggcctgtgattcctgaggtgcggctgaactgcatggagacctttgaggtgaaggtggacagccctgtgaagccagcccccaaggaggacctggacctgattgacctgagcagtgacagcaccagcggccctgagaagcacagcatcctgagcaccagtgacagcgacagcctggtgtttgagcccctgccccccctgcgcatcgtggagagtgatgaggaggaggagaccatgaaccagggagatgatggccccagcggcaagaatgctgccagcagccccagcgtgcccagccaccccagcgtgctgagcctgagcacagcccccctggtgcaggtgtctgtggaggactgcagcaaggacttcagcagcaaggacagcggcaacaaccagagcgctggcaacacagacagcgccctgatcaccctggaggaccccatggatgctgagggcagcagcaagccagaggagctgcctgagttcagctgtggcagccccctgaccctgaagcagaagagggacctgctgcagaagagctttgccctgcctgagatgagcctggatgaccacccagaccctggaacagaaggagagaagccaggagagctgatgcccagcagcggggccaagacagtgctgctgaaggtgcctgaagatgctgagaaccccacagagagcgagaagccagacaccagcgctgagagtgacacagagcagaaccctgagaggaaggtggaggaggatggagctgaggagagcgagttcaagatccagatcgtgccccggcagaggaagcagaggaagattgctgtgtctgccatccagcgggagtacctggacatctccttcaacatcctggacaagctgggggagcagaaggaccctgaccccagcaccaagggcctgagcaccctggagatgccccgggagagcagcagcgcccccaccctggatgctggggtgcctgagaccagcagccacagcagcatcagcacccagtaccggcagatgaagaggggcagcctgggcgtgctgaccatgagccagctgatgaagaggcagctggagcaccagagcagcgccccccacaacatcagcaactgggacacagagcagatccagcccgggaagaggcagtgcaatgtgcccacctgcctgaacccagacctggagggccagcccctgaggatgagaggagccaccaagagcagcctgctgagcgcccccagcatcgtgtccatgtttgtgcctgcccctgaggagttcacagatgagcagcccaccgtgatgacagacaagtgccacgactgtggggccatcctggaggagtatgatgaggagaccctgggcctggccatcgtggtgctgagcaccttcatccacctgagcccagacctggccgcccccctgctgctggacatcatgcagagcgtgggccgcctggccagcagcaccaccttcagcaaccaggccgagagcatgatggtgcctggaaatgctgctggggtggccaagcagttcctgcgctgcatcttccaccagctggcccccaacggcatcttcccccagctgttccagagcaccatcaaggatggcaccttcctgcggaccctggccagcagcctgatggacttcaatgagctgagcagcattgctgccctgagccagctgctggagggcctgaacaacaagaagaacctgcctgctggaggagccatgatccgctgcctggagaacatcgccaccttcatggaggccctgcccatggacagccccagcagcctgtggaccaccatcagcaaccagttccagaccttctttgccaagctgccctgtgtgctgcccctgaagtgcagcctggacagcagcctgcgcatcatgatctgcctgctgaagatccccagcaccaatgccaccaggagcctgctggagcccttcagcaagctgctgagctttgtgatccagaatgctgtgttcaccctggcctacctggtggagctgtgtggcctgtgctaccgggccttcaccaaggagcgggacaagttctacctgagccgctctgtggtgctggagctgctgcaggccctgaagctgaagagccccctgcctgacaccaacctgctgctgctggtgcagttcatctgtgctgatgctggcaccaagctggccgagagcaccatcctgagcaagcagatgattgcctctgtgcccggctgcggcacagctgccatggagtgtgtgcggcagtacatcaatgaggtgctggacttcatggctgacatgcacaccctgaccaagctgaagagccacatgaagacctgcagccagcccctgcacgaggacacctttggaggccacctgaaggtgggcctggcccagattgctgccatggacatcagccggggcaaccaccgggacaacaaggctgtgatccgctacctgccctggctgtaccacccccccagcgccatgcagcagggccccaaggagttcattgaatgtgtgagccacatccggctgctgtcctggctgctgctgggcagcctgacccacaatgctgtgtgccccaatgccagcagcccctgcctgcccatccccctggatgctggcagccacgtggccgaccacctgattgtcatcctgattggcttccctgagcagagcaagacctctgtgctgcacatgtgcagcctcttccacgccttcatctttgcccagctgtggacagtgtactgtgagcagagcgctgtggccaccaacctgcagaaccagaatgagttctccttcaccgccatcctgacagccctggagttctggagccgggtgacccccagcatcctgcagctgatggcccacaacaaggtgatggtggagatggtgtgcctgcacgtgatcagcctgatggaggccctgcaggagtgcaacagcaccatctttgtgaagctgatccccatgtggctgcccatgatccagagcaacatcaagcacctgtctgctggcctgcagctgcggctgcaggccatccagaaccacgtgaaccaccacagcctgcggaccctgcccggcagcggccagagcagcgctggcctggccgccctgaggaagtggctgcagtgcacccagttcaagatggcccaggtggagatccagagcagcgaggccgccagccagttctaccccctgtag

SEQ ID NO: 43159 - DNA, 7974 bp, Artificial Sequence
  Description of Artificial Sequence: Synthetic coding sequence
atgagcaccaaggccgagcagtttgccagcaagatccgctacctgcaggagtaccacaacagagtgctgcacaacatctaccctgtgcccagcggcacagacatcgccaacaccctgaagtacttcagccagaccctgctgagcatcctgagcaggacaggcaagaaggagaaccaggatgccagcaacctgactgtgcccatgaccatgtgcctcttccctgtgcccttccccctgacccccagcctgcggccccaggtgagcagcatcaaccccaccgtgaccaggagcctgctgtacagcgtgctgagagatgcccccagcgagcggggcccccagagcagagatgcccagctgagtgactaccccagcctggactaccagggcctgtatgtgaccctggtgaccctgctggacctggtgcccctgctgcagcacggccagcacgacctgggccagagcatcttctacaccaccacctgcctgctgcccttcctgaatgatgacatcctgagcaccctgccctacaccatgatcagcaccctggccaccttcccccccttcctgcacaaggacatcatcgagtacctgagcaccagcttcctgcccatggccatcctgggcagcagcagaagagagggcgtgcctgcccacgtgaacctgagcgccagctccatgctgatgattgccatgcagtacaccagcaaccctgtgtaccactgccagctgctggagtgcctgatgaagtacaagcaggaggtgtggaaggacctgctgtatgtgattgcctacggccccagccaggtgaagcccccagctgtgcagatgctgttccactactggcccaacctgaagcccccaggggccatcagcgagtaccggggcctgcagtacacagcctggaaccccatccactgccagcacatcgagtgccacaatgccatcaacaagccagctgtgaagatgtgcatcgaccccagcctgtctgtggccctgggggacaagcccccacccctgtacctgtgtgaggagtgcagcgagagaattgctggggaccacagcgagtggctgattgatgtgctgctgccccaggccgagatcagcgccatctgccagaagaagaactgcagcagccacgtgagaagagctgtggtgacctgcttctctgctggctgctgcggccgccacggcaacagacctgtgcgctactgcaagcgctgccacagcaaccaccacagcaatgaggtgggcgctgctgctgagacccacctgtaccagaccagccccccacccatcaacacccgggagtgtggggctgaggagctggtgtgtgctgtggaggccgtcatcagcctgctgaaggaggccgagttccacgccgagcagcgggagcacgagctgaacagaagacggcagctgggcctgagcagcagccaccacagcctggacaatgctgactttgacaacaaggatgatgacaagcatgaccagaggctgctgagccagtttggcatctggttcctggtgtccctgtgcaccccatctgagaacacccccacagagagcctggcccggctggtggccatggtgttccagtggttccacagcacagcctacatgatggatgatgaggtgggcagcctggtggagaagctgaagccccagtttgtgaccaagtggctgaagacagtgtgtgatgtgcgctttgatgtgatggtgatgtgcctgctgcccaagcccatggagtttgcccgggtgggcggctactgggacaagagctgcagcacagtgacccagctgaaggagggcctgaaccgcatcctgtgcctgatcccctacaacgtcatcaaccagagcgtgtgggagtgcatcatgcctgagtggctggaggccatcagaacagaggtgcctgacaaccagctgaaggagttccgggaggtgctgagcaagatgtttgacatcgagctgtgccccctgcccttctccatggaggagatgtttggcttcatcagctgccgcttcaccggctaccccagctctgtgcaggagcaggccctgctgtggctgcacgtgctgtctgagctggacatcatggtgcccctgcagctgctgatctccatgttcagtgatggagtgaacagcgtgaaggagctggccaaccagaggaagagccgggtgtctgagctggccggcaacctggccagccggcgggtgtctgtggccagtgaccccggccggcgggtgcagcacaacatgctgagccccttccacagccccttccagagccccttccgcagccccctgcggagccccttccgcagccccttcaagaactttggccaccctgggggccgcaccatcgactttgactgtgaagatgatgagatgaacctgaactgcttcatcctgatgtttgacctgctgctgaagcagatggagctgcaggatgatggcatcaccatgggcctggagcacagcctgagcaaggacatcatcagcatcatcaacaacgtgttccaggccccctggggcggcagccacacctgccagaaggatgagaaggccatcgagtgcaacctgtgccagagcagcatcctgtgctaccagctggcctgtgagctgctggagcggctggcccccaaggaggagagccggctggtggagcccacagacagcctggaggacagcctgctgagcagcaggcctgagttcatcatcggccctgagggggaggaggaggagaacccagccagcaagcacggggagaaccctggcaactgcacagagcctgtggagcacgccgctgtgaagaatgacacagagaggaagttctgctaccagcagctgcctgtgaccctgcggctcatctacaccatcttccaggagatggccaagtttgaggagccagacatcctcttcaacatgctgaactgcctgaagatcctgtgcctgcatggagaatgtctgtacatcgccaggaaggaccacccccagttcctggcctacatccaggaccacatgctgattgccagcctgtggagggtggtgaagtctgagttcagccagctgagcagcctggccgtgcccctgctgctgcacgccctgagcctgccccatggagctgacatcttctggaccatcatcaatggaaacttcaacagcaaggactggaagatgagatttgaagctgtggagaaggtggccgtcatctgccgcttcctggacatccacagcgtgaccaagaaccacctgctgaagtacagcctggcccacgccttctgctgcttcctgacagctgtggaggatgtgaacccagctgtggccaccagggctggcctgctgctggacaccatcaagaggcctgccctgcagggcctgtgcctgtgcctggacttccagtttgacacagtggtgaaggaccggcccaccatcctgagcaagctgctgctgctgcacttcctgaagcaggacatcccagccctgtcctgggagttctttgtgaacagatttgagaccctgagcctggaggcccagctgcacctggactgcaacaaggagttccccttccccaccaccatcacagctgtgaggaccaacgtggccaacctgagtgatgctgccctgtggaagatcaagagggccaggtttgccaggaaccggcagaagtctgtgcgcagcctgcgggacagcgtgaagggccctgtggagagcaagagggccctgagcctgcctgagaccctgaccagcaagatccccatgaggctgaccaggcatgagcagagcgccccagccctgggcggcaccccagagcagaccccaggccagcagagcccagaaaatgacaacaccatcaaggacctgctgcctgaagatgctggcatcgaccaccagacagtgcaccagctgatcaccgtgctgatgaagttcatggccaaggatgagagcagcgctgagagtgacatcagcagcgccaaggccttcaacacagtgaagaggcacctgtatgtgctgctgggctatgaccagcaggagggctgcttcatgattgccccccagaagatgaggctgagcacctgcttcaatgccttcatcgccggcatcgcccaggtgatggactacaacatcaacctgggcaagcacctgctgcccctggtggtgcaggtgctgaagtactgcagctgcccccagctgcggcactacttccagcagcccccacgctgcagcctgtggagcctgaagccccacatccggcagatgtggctgaaggccctgctggtgatcctgtacaagtacccctacagagactgtgacatcagcaagatcctgctgcacctgatccacatcaccgtgaacaccctgaatgcccagtaccacagctgcaagccccacgccacagctggccccctgtacagcgacaacagcaacatcagccgctacagcgagaaggagaagggggagattgagctggccgagtaccgggagactggagccctgcaggacagcctgctgcactgtgtgcgggaggagagcatccccaagaagaagctgcggagcttcaagcagaagagcctggacattggaaatgctgacagcctgctcttcaccctggatgagcacaggaggaagagctgcatcgacagatgtgacatcgagaagccacccacccaggccgcctacatcgcccagaggcccaatgaccccggccgcagccggcagaacagcgccaccaggccagacaacagcgagatcccagaaaatcctgccatggagggcttcccagatgcccggcggcctgtgattcctgaggtgcggctgaactgcatggagacctttgaggtgaaggtggacagccctgtgaagccagcccccaaggaggacctggacctgattgacctgagcagtgacagcaccagcggccctgagaagcacagcatcctgagcaccagtgacagcgacagcctggtgtttgagcccctgccccccctgcgcatcgtggagagtgatgaggaggaggagaccatgaaccagggagatgatggccccagcggcaagaatgctgccagcagccccagcgtgcccagccaccccagcgtgctgagcctgagcacagcccccctggtgcaggtgtctgtggaggactgcagcaaggacttcagcagcaaggacagcggcaacaaccagagcgctggcaacacagacagcgccctgatcaccctggaggaccccatggatgctgagggcagcagcaagccagaggagctgcctgagttcagctgtggcagccccctgaccctgaagcagaagagggacctgctgcagaagagctttgccctgcctgagatgagcctggatgaccacccagaccctggaacagaaggagagaagccaggagagctgatgcccagcagcggggccaagacagtgctgctgaaggtgcctgaagatgctgagaaccccacagagagcgagaagccagacaccagcgctgagagtgacacagagcagaaccctgagaggaaggtggaggaggatggagctgaggagagcgagttcaagatccagatcgtgccccggcagaggaagcagaggaagattgctgtgtctgccatccagcgggagtacctggacatctccttcaacatcctggacaagctgggggagcagaaggaccctgaccccagcaccaagggcctgagcaccctggagatgccccgggagagcagcagcgcccccaccctggatgctggggtgcctgagaccagcagccacagcagcatcagcacccagtaccggcagatgaagaggggcagcctgggcgtgctgaccatgagccagctgatgaagaggcagctggagcaccagagcagcgccccccacaacatcagcaactgggacacagagcagatccagcccgggaagaggcagtgcaatgtgcccacctgcctgaacccagacctggagggccagcccctgaggatgagaggagccaccaagagcagcctgctgagcgcccccagcatcgtgtccatgtttgtgcctgcccctgaggagttcacagatgagcagcccaccgtgatgacagacaagtgccacgactgtggggccatcctggaggagtatgatgaggagaccctgggcctggccatcgtggtgctgagcaccttcatccacctgagcccagacctggccgcccccctgctgctggacatcatgcagagcgtgggccgcctggccagcagcaccaccttcagcaaccaggccgagagcatgatggtgcctggaaatgctgctggggtggccaagcagttcctgcgctgcatcttccaccagctggcccccaacggcatcttcccccagctgttccagagcaccatcaaggatggcaccttcctgcggaccctggccagcagcctgatggacttcaatgagctgagcagcattgctgccctgagccagctgctggagggcctgaacaacaagaagaacctgcctgctggaggagccatgatccgctgcctggagaacatcgccaccttcatggaggccctgcccatggacagccccagcagcctgtggaccaccatcagcaaccagttccagaccttctttgccaagctgccctgtgtgctgcccctgaagtgcagcctggacagcagcctgcgcatcatgatctgcctgctgaagatccccagcaccaatgccaccaggagcctgctggagcccttcagcaagctgctgagctttgtgatccagaatgctgtgttcaccctggcctacctggtggagctgtgtggcctgtgctaccgggccttcaccaaggagcgggacaagttctacctgagccgctctgtggtgctggagctgctgcaggccctgaagctgaagagccccctgcctgacaccaacctgctgctgctggtgcagttcatctgtgctgatgctggcaccaagctggccgagagcaccatcctgagcaagcagatgattgcctctgtgcccggctgcggcacagctgccatggagtgtgtgcggcagtacatcaatgaggtgctggacttcatggctgacatgcacaccctgaccaagctgaagagccacatgaagacctgcagccagcccctgcacgaggacacctttggaggccacctgaaggtgggcctggcccagattgctgccatggacatcagccggggcaaccaccgggacaacaaggctgtgatccgctacctgccctggctgtaccacccccccagcgccatgcagcagggccccaaggagttcattgaatgtgtgagccacatccggctgctgtcctggctgctgctgggcagcctgacccacaatgctgtgtgccccaatgccagcagcccctgcctgcccatccccctggatgctggcagccacgtggccgaccacctgattgtcatcctgattggcttccctgagcagagcaagacctctgtgctgcacatgtgcagcctcttccacgccttcatctttgcccagctgtggacagtgtactgtgagcagagcgctgtggccaccaacctgcagaaccagaatgagttctccttcaccgccatcctgacagccctggagttctggagccgggtgacccccagcatcctgcagctgatggcccacaacaaggtgatggtggagatggtgtgcctgcacgtgatcagcctgatggaggccctgcaggagtgcaacagcaccatctttgtgaagctgatccccatgtggctgcccatgatccagagcaacatcaagcacctgtctgctggcctgcagctgcggctgcaggccatccagaaccacgtgaaccaccacagcctgcggaccctgcccggcagcggccagagcagcgctggcctggccgccctgaggaagtggctgcagtgcacccagttcaagatggcccaggtggagatccagagcagcgaggccgccagccagttctaccccctgtag

SEQ ID NO: 43160 - DNA, 399 bp, Artificial Sequence
  Description of Artificial Sequence: Synthetic coding sequence
atgagggagggccaggagatgggccccacccctgtgcccagcaaccccctgctgcaccgctccttcccctgctggccccggggctggagccaccctgtgcccacccgggagctgctgctggagcccgcccagcctgctgacctgctgcccccagcccccacagctggcccctgcagcctggcctcctggatgctgagccagcccggccggggcagccaggtgaagacaggaggcacccccacagccacagcccaggatgctgaggcccccctgcctgactgtgacctgtgcctgagccctgcccctgtgggcacctggcagccccgggccaaggccggctgggccggggaccccaggaacctgagcggcaacaccttcagccctggctgggagcagtag

SEQ ID NO: 43161 - DNA, 1803 bp, Artificial Sequence
  Description of Artificial Sequence: Synthetic coding sequence
atgttcaccctgagcctgctgagccggggccacggcaagctgggccaggacaagcagaagctggaggtgtactttgagcctgaggactacctgaactggaggagcccagaagattatgtgcctgtgtccaagccccaggacaagaacaatgccagccagcacagctggagcctcttcctgcccaagaccttcagcaccaggaagggggccctgatcctgtacagcgagggctttgccatcagcgcctggacccccaaggagaggaggaagggcccctactgcccccggggcccctggaggaagctggacctggagctgcacaccctgcaggacctgaaggaggccatcctggcctacggccggcagcagctgaacctgcccatgggagatgctgggaagaggctggagcgggagaagaagaggaagaccaccgtcttcctgcccagccacagcgccagcagcgagaagaagcacctgcactacctgtgtgacacagccctgaaccggcaggcccactatgacccccagctgctgcagggcgagcaggaccgggcctggcagccctacctgcacttccgcagccagctggagagccaggcccagaggcagatccagcccggccacagcgccaagcgctacctgcggggcctgctgcggacctggcccccagatgccatgtaccgcctgtggtgtgccggctacatcaaggacagcgtgctgctgcaggacagccagctgaatgtgcccaagaagctgcggccccagcaggacctgtctggagtgccccccaagtaccacctgctgcctgtgttccccagcttctggatccagcagggcaagagctttgagcagaggcagcagggcctggatgaaggagaggccggggctgctggccacgtggaccagggccccctggccaagaaccacggcagccagggcacccggctgccccccaggaggaagcagccctggcaggaggatgagacccaggccgaggacaccagcattgagaaccacctgtgcctgtatgccagcaaggagagctacaatgagaagacccagcagaccagcaggaaggcctttggacatggaagaattgaccacagctggctgcccagcgacaagagccacatcaccttctgtggcggggccttccccaacaggaaggctgacctgagtgacaagcagagaaatgtgaagctgcacaaggcccggagcagccacctgctgcaggtgctgcctgctgagaggagcctcttcccccctgtggccagcgccaccggcagccgcatcatcaccccaggagaggtgaagaagaagaaggcccccaaggccctgaagctgccccccatcagcgaggagcccccccgggtgctggagcccctgaagagccagttcaaggccaatgaaccacccacagagctgttcatcctgcctgtggagatccactaccacaccaagcagccccccaaggagaaggcccaccggcggggggccccccaccctgagagcgagcctgagagcagcgaggagagcacccctgtgtggaggcctcccctgaagcacgccagcctggagaccccctgggagctgactgtgcacctgcctgtggatgccagccgggacaccctgagcccccagggcagcagcagcctgcccccagccagcctgggcaacctgaccctgaagggcagcaaggcccggcacaccagggtgcacagccagggcaaaggagtgtggaagggagatgatgatgcccctcctcatgatgtggccccacccctggacctgctgcccccatag

SEQ ID NO: 43162 - DNA, 360 bp, Artificial Sequence
  Description of Artificial Sequence: Synthetic coding sequence
atgagcggcagcccccaggccagctacccccagacccacagcttcaccctgaagcaccaggagatccgcaccttctggaacctgaacatgaggggcctgggcggggagggcggcacagaggaggagagcagcctgggccaggccggcggcaagctgaagacagctgcctggcccagctgggtggccgaggtgggcgctgctggggccctggccgaccccggcggccagaagagcggcagcttcctgcccagccagcagctgcagtgcatccctggccctggcctgtatgctggggaggccagcaaggaccctgtgctgaggaagctgcccttccagtgtggccgcacccacaacccctag

SEQ ID NO: 43163 - DNA, 405 bp, Artificial Sequence
  Description of Artificial Sequence: Synthetic coding sequence
atgctggtggtgggcgccggccccctgggcgccgccgcctggagccagaggctggactggggccgctgccagctgaagctgctgggccagcacggccaggatgtgctgcacaccaacctgggggaggagaatgtgtgcatcgccggccccctgctgctgccctgcccagacagccagccctgcctgaccccaccccacccagcccaggccctggtgcagctgtgggtgccctgcccctgcctgtgcccccgggtgggcgccagcacagcctggctggagggggacaccccagccctgccccagcacctgggccccagcatcaccaccaccggccgctgggccacccccaagaagatccctggcctgactgtgcccccagagaacatggacagcatgtggggctag

SEQ ID NO: 43164 - DNA, 447 bp, Artificial Sequence
  Description of Artificial Sequence: Synthetic coding sequence
atggactgtgtgccccccatccagtgcagctgcagcatgggcggccgctaccaccaccctgctggggaggccttctggacaggagagcgctgtgagcagttctgccactgccaggccagcacccatgctgtgtgctgcagccccagcagctgtggccctggccagagatgtgagaccctgcggggcatcttcggctgccaccccctgagccctggcatctaccaggccaccatgcacagccacgtggccagctttgacaggaagtctgtggagttccctggcacctgtgccagcgccttcaccaagagctgtggcagcagcagcagcctgcggctcttcaaggtggagatcggcaaggagaagcaggtgcagcagagccactgtgtgcacttcaaggatgtgggctcctgggaccccggcctgtctgctgagcgggcccccacctag

SEQ ID NO: 43165 - DNA, 615 bp, Artificial Sequence
  Description of Artificial Sequence: Synthetic coding sequence
atgggcccccagcacggcactggaccagaccccccacccctgtgccactgcccccacacagctgggggcggggccggcggcaccggggccccagccttcggcctgcagggcatctgggtgcccctggccgtgggggacagaagaggcccctgtggccagggcgcctccatgggcgcccctggccagccccggcagggcggccggggcaagggccaggaggccagcgcccagaccaggtatggaggcaacagcccccacggccggggccagaaccggctggagggccctggggtgcaggtgtgctgcaacagagcccggcgggcccggggctgcccccaccctggccagaggcaccacgtggtgctgagccagtggagcggcagcggcctggtgggcggcatcgaggacacagctgacctggcccctcctcctggggccggcctgagccccctggcccacagcaagggccgggaccagagaggaggcggcctgcacccccccagcccccgctgcagccccccaccctaccaccctgtgcagcgctgcccccggcgctgggagagctgtgagggccggccccacctggcctgcagcggctgcccagccagctgctag

SEQ ID NO: 43166 - DNA, 543 bp, Artificial Sequence
  Description of Artificial Sequence: Synthetic coding sequence
atgcagaggggccccctgagccccagccccagtgatggcctgggcgccctgggcaccacctacccaggagtgcaccggggccagagcatggccggcctgcgggtgcctgccttcaatgccggcctgcgggccatcacccccagcagagctgagacccagcaccctgagaccaccagcagcggcatgcaccgggagcccctgagcagcacccccatcgcccactgggagggcgcccagagccctggggcccagagcgtgctggccatgctggtgcacaggacagctgcctacaccctgcaggtgctggagcccaagaaggaccccggccgggagctgcctgccacccccaggtcctgggccccagcccggcagcccagccccctgcacagcatccggcagaccatgcctgccaagcccagcctggtgaagcgggagaggaggaaccaggccctggcccgggaggccccctggttcccccagaggacccagtggaagaccagcgagggccctggcagcagcagcggccggcggggcagaagatag

SEQ ID NO: 43167 - DNA, 456 bp, Artificial Sequence
  Description of Artificial Sequence: Synthetic coding sequence
atgccctatgagaccaggtcctggatcaccctgctgcggacccagaggcgggaggagtgtggcctgcactgcaccagcctgcccagcctggcccgggacctgaagttccacaccacagagcccaacaccagccggcccagcagcaatgacctgaggaacaggaagctgtgcctggccgctgacaagctgagccagtgcccctgggacctgcaggatgtgtggaatgaggagcggcagctgagccagtgtgagctgagcggcggcccccagaagaatgtgggcagaagagtcttccccatccggcagacagtgctgcagcccaggcctcccaagaggagcaaccctggcctgctcttcagcggcacagaatgtggctgcatcctgcccttcctgtgcttcctgagccgctacctgctgactgtgcacatgaggggcctgggcaagctgtctgtgtag

SEQ ID NO: 43168 - DNA, 369 bp, Artificial Sequence
  Description of Artificial Sequence: Synthetic coding sequence
atgacctggctggacaagggcgtgtggacccaggaggatgagaacagctgcagcttcagcgagagtgacttccctggctgccgggaccagatcaaccccagcatccccagcatctggacagctgtgtctggcatgatgatcagcctggaggtgcgctggtggatcaagggcaagcagggctacgtgatcagcctgggccacgccctgagcccccggctggagtgcagcggcaccttcagcgcccactgcatcctgggcctgcccggcggcagcagctaccccccagcctctgtgtcccaggtggtgggcaccacagccctgtacctggtggaggaggcctgggccgaggccggcaagatgaggagctag

SEQ ID NO: 43169 - DNA, 660 bp, Artificial Sequence
  Description of Artificial Sequence: Synthetic coding sequence
atggccgcccggtctgtggatgacatcagcatcaagctgctgcacgagaagggccctgccacagaccatggagtgaatgtgctgcccagcacagtgcccggccgggaggagggcatgacagacaggaagcactggttctcctttggcacccagcccaacgtgcccggcctgcaggagcccctggactacagagctgccaaccaggcctggcaggccgtgctggccgaggtgccccggggcggccctggctgtgccgccctgcgggacctgggccgctgtggcggcccagatgtgtccacccggcggcagtggaggcccctgcccttcagctgccccctgagccacaccacccagccccccctgggcggccactgccggggcagcagcgctggccgcttccacggccgggaccagaccagccctggcaccgtgcagcagctgcccagcgcccacgtgctgaagccaggctgcacccagcacggggacctgagccctggccaggccagccccccacctgctgctgccctgggccccagccccaaggcctggacccacaccctgggccggccccagctgtgggccggcctgggcagccacagatttggagtgcccggccctggcaccaggaacaccctggccgcctgctgcgtgcaggagtag

SEQ ID NO: 43170 - DNA, 471 bp, Artificial Sequence
  Description of Artificial Sequence: Synthetic coding sequence
atggccaccccaccagcccctggagctggaacagctgcccccagcgcccccaggcctcctccaccccggcccagctggctgcggctggaccctgctgcccggggggcccggctgcccttccctggcagccctggcaccacccggcgggccccccgggagagcgcccccctggccccagccctgcggagtgaccccggccagcccctggccgcctgcaatggacctcctggagagcccagggctgaccccggggtgtccacccgctgtgccgccaccatgatcccccagggcaagctgaccggcggccgcagctgtggcagccggcccaggatgggccgcggggagagagctgagctgtccttccctgctgctgccccccggctgaagaggggcctgggcttctggttcttcttctgtggcaacagctctgtggagatcctgctggcctgccacaccacccaccccttctag

SEQ ID NO: 43171 - DNA, 435 bp, Artificial Sequence
  Description of Artificial Sequence: Synthetic coding sequence
atgagcctgaagagcctcttctgcaacagcgaggccaaggacaacaagtgctaccacacctacagcgagagctcctggagcgagaccaagaagatcgtcatcgccaccaagatccacagcttccagaccttcagcagctgctacagcgactgccacggcatcctgggcgtgctgctgcaccagctggagacctctgtggccggcggcaccttctgcctgagcatcgcccacgcctggtgggccaggtttgcccacagctcctggaaggccgccctgggcagctgctaccagcccggcttccacacctgccagggccaggcccggctgggctctgtgcggggcgtgtgggccagcgagcacggcgtgcagccccagaggacaggccgccacacaggctgctgcggccgggtgggcagcttccgccactgcagctag

SEQ ID NO: 43172 - DNA, 750 bp, Artificial Sequence
  Description of Artificial Sequence: Synthetic coding sequence
atgagggtgcgctggctgcgcttctggctgctcttctggctgctgctgggcttcatcagccaccagcccacccctgtgatcaacaccctggccgaccaccgccaccgggagacagactttggaggcagcccctggatcatcatcatcatcgtgttcctgggccgctacaagttcaccatcctcttctgcaccatctacctgtgtgtgcccttcctgaagaccatcttctggagcagaaatggacatgacaggagcagagatgtgcagcagagggcccggcgcagcaacagaagacggcaggagggcatcaagattggcctggaggacatctgcaccctgtggaagcaggccgagaccaaggtgcaggccaagatcaggaagatgaaggtgaccaagaaggtgaaccaccactacaagatcaatggcaagaggaagacagccaaggagcagaagatgttccagagggcccaggagctgcgctggagggctgaggactaccacaagtgcaagatcacccccagcgccaggaagcccctgtgcaactgggtgtccctgtttgtgttcctggccttcggcagcctgcccggccaggacatggacaccttcttcagcctgcagctgtgtgcccaggccctgcagcgggagatggccgagaggaaggccgcctacaagcaccacagccccatccctgtgggcaacagagtggtgcagaagcacctgcacccccaccctgtgggccccctcatctag

SEQ ID NO: 43173 - DNA, 402 bp, Artificial Sequence
  Description of Artificial Sequence: Synthetic coding sequence
atggcctgtgccatccagctggccagcagcgaggcccgggaccgggcccggccccgggacaggaccttcctgcagaagaggcagctgggcgccggcgtgtggctgctgggggagaggaccagcaacaccatgctgaactggaatggagagcggggccacccctgcctggtgctggtgttcaagaggaacatcgaggccgacttcaagagcagcttcagcagcgagcacttcttcttcatccccctggatgactgcaactgcaaggaggagctggccgtcatcagtgatggccgcaccatcgtgtgctaccaccacagcgtggacatctcctatgagcacaccaagcagaccctgaaccagatcctgtgcatgatcatgaagaagcacatgttcaagtgctag

SEQ ID NO: 43174 - DNA, 1851 bp, Artificial Sequence
  Description of Artificial Sequence: Synthetic coding sequence
atgccacccctggagacccagagcagcctggccccacccagcctgcagaccccaccagccagcctgaccaccccacccctggagaacctgcccagcctggcccccccacccctgcagacagccagcgcccccctgaccaccccccacctggagaccccaccctgcccagccccctgccccctgcaggccccacccagccccctgaccaccccacctcctgagacccccagcagcatcgccaccccaccaccccaggcccccccagccctggccagcccccccctgcagggcctgcccagcccccccctgagccccctggccaccccaccaccccaggcccccccagccctggccctgccccccctgcaggccccacccagccccccagccagcccccccctgagccccctggccacccccagcccccaggccccaaatgccctggccgtgcacctgctgcaggcccccttcagccccccacccagcccccctgtgcaggcccccttcagccccccagccagcccccctgtgagccccagcgccaccccacccagccaggccccacccagcctggccgccccacccctgcaggtgccccccagccccccagccagcccccccatgagccccagcgccaccccaccaccccaggcccccccacccctggccgccccacccctgcaggtgccccccagccccccagccagcccccccatgagccccagcgccaccccaccaccccgggtgccccccctgctggccgccccacccctgcaggtgccccccagccccccagccagcctgcccatgagccccctggccaagcccccaccccaggcccccccagccctggccaccccacccctgcaggccctgcccagccccccagccagcttccctggccaggcccccttcagccccagcgccagcctgcccatgagccccctggccaccccaccaccccaggcccctcctgtgctggccgcccccctgctgcaggtgccccccagccccccagccagccccaccctgcaggccccccggcggccccccaccccaggccctgacacctctgtgtctggcccccggctgaccctggccctggcccctggccccccacctccacccagccgcagccccagcagcaccctgagcggccctgacctggccggccacagcagcagcgccaccagcaccccagaggagctgcggggctatgacagcggccctgagggcggcgctgctgccagccccccaccagatgctgagctggccgcctgccaccctgctgcctggagccggggccctgccccacccctggccttccggggggcccctggggcccccctgccctggcccccagccaccggccctggcagcgcagatggcctgtgcaccatctatgaaacagagggccctgagagcgccaccccagcccctggggccctggaccccggccccagccctggcaccagcggcggcaaggctgctgctggggccggggccggggccagcagccgcagccccaagcaggcccggctgggggagctgcccctgggcgccctgcaggcctctgtggtgcagcacctgctgagcaggaccctgctgctggccgctgctgagggcgccgccggcggcagcggcggcggccctggaggagctgagggcggcggcgtgactggaggagcccgggccgccctgagtgatgctgagctgggccgctgggccgagctgctgagccccctggatgagagccgggccagcatcacctctgtgaccagcttctccccagatgatgtggccagcccccagggcgactggacagtggtggaggtggagaccttccactag

SEQ ID NO: 43175 - DNA, 549 bp, Artificial Sequence
  Description of Artificial Sequence: Synthetic coding sequence
atgttctgctgcctgggctatgagtggctgagcggcggctgcaagacctggcacagcgcctgggtgatcaacaccctggccgaccaccgccaccggggcacagactttggaggcagcccctggctgctgatcatcaccgtcttcctgcggagctacaagtttgccatcagcctgtgcaccagctacctgtgtgtgtccttcctgaagaccatcttccccagccagaatggacatgatggcagcacagatgtgcagcagagggcccggcgcagcaacagaagacggcaggagggcatcaagatcgtgctggaggacatcttcaccctgtggaggcaggtggagaccaaggtgcgggccaagatctgcaagatgaaggtgaccaccaaggtgaacagacatgacaagatcaatggcaagaggaagacagccaaggagcacctgaggaagctgtccatgaaggagcgggagcacggggagaaggagcggcaggtgtctgaggccgaggagaatggcaagctggacatgaaggagatccacacctacatgtag

SEQ ID NO: 43176 - DNA, 1224 bp, Artificial Sequence
  Description of Artificial Sequence: Synthetic coding sequence
atgtacaatgccttctggaaccacctgaaggagcagctgctgagcaccccaccagacttcacctgtgccctggagctgctgaaggatgtgaaggagaaccggctgagaaatgaaattgaggaggccctggacacagacctgctgaagcaggaggccgagcacggggccctggatgtgccccacctgagcaactacatcctgaacctgatggccctgctgtgtgcccctgtgagagatgaggccatccagaagctggagaccatccgggaccctgtgcagctgctgcggggcatcctgcgggtgctgggcctgatgaagatggacatggtgaactacaccatccagagcttccggccctacctgcaggagcacagcatccagtatgagcaggccaagttccaggagctgctggacaagcagcccagcctgctggactacaccaccaagtggctgaccaaggccgccacagacatcaccaccctgtgccccagcagcccagacagccccagcagcagctgcagcatggcctgcagcctgcccagcggggccggcaacaacagcgagccccccagccccaccatggtgctgtaccagggctacctgaacctgctgctgtgggacctggagaatgtggagttccctgagaccctgctgatggaccgcatccggctgcaggagctggccttccagctgcaccagctgactgtgctggcctctgtgctgctggtggcccggagcttcagcggggaggtgctcttccgcagccctgagtttgtggaccggctgaagtgcaccaccaaggccctgacagaggagttcatcagcaggcctgaggagaccatgctgtctgtgtctgagcaggtgtcccaggaggtgcaccagggcctgaaggacatgggcctgaccaccctgagcagtgaaaatacagccagcctgctgggccagctgcagaacatcaccaagaaggagaactgcatccgcagcatcgtggaccagtggatccgcttcttcctgaagtgctgcctgctgcacggcatgcaggagagcctgctgcacttccctgggggcctcatcctgattgagaaggagctggccgagctgggctggaagttcctgaacctgatgcaccacaaccagcaggtgtttggcccctactatgcagagatcctgaagcacatcatccacccagcccaggcccaggagacagatgtggagcccaactag

SEQ ID NO: 43177 - DNA, 432 bp, Artificial Sequence
  Description of Artificial Sequence: Synthetic coding sequence
atgctgaggaagacctgtggcggccagcaggaggacagccggggcatgggcccccacctgccccgggtgcctgatggagtggtgctgggcgtggaggagcctgagggcaaggcccagggccgggtgcggggggagctgtgccctggggccctggcccgcatccacatgggccacagctgcacccggctgtctgctgagggcatcgccatgctgctgggcacagctggccccagccggctgcctgctgccccagatgccagccaggcccccctgcggagcccctgggccctgtctgtggccgccgccctgtgcagccctgtgtcctgccacccctgtggcagacatgtggtgaccttcggccactgcccagcccagggcccctggggcctgggcaccttcggccacagcttcttcggctgcctgtgcaagtag

SEQ ID NO: 43178 - DNA, 486 bp, Artificial Sequence
  Description of Artificial Sequence: Synthetic coding sequence
atgggccaccggcccaacctgggccagcccccccaccccaatgctgtggccgccgccctgcacgccagcctgtgcccagccaactggggcacctgccccctgggcaagccaggctacccaggctgcctgtggttccagcccctgctgctcttccctggctgcctgtgcagcccagatggccccttccccagggctgtgttcaccagcgctgggaagggccccctgcagacagacctgggccggggccgggtgcccccccgggaccagcagacccccaagagccggccctgcccccgggcccctgtggccagcaaccggcagagcggcggcagcgctgtgtctgcccccctgagcggggcccggcgggcctggaagagcgcctttgctgccccacccaggagccggctgcggccccagaagggcgtgccctggacagagaagagggcccggggcggcggccgggccggcccctgcagaagaacatag

SEQ ID NO: 43179 - DNA, 690 bp, Artificial Sequence
  Description of Artificial Sequence: Synthetic coding sequence
atggctgctgccccagatgtgggcaatggaggcagcaagaatgtgaggaagcccaggcctgggaagtgccagcccaagagccgccacagcctgccccagacccagaagccagaggaggtgaggaaatgtggcggcatctgcctgcctgtgtgcctgcaggaccccggggcctgccccagctggctgcccctggaggagggcctgcggcggcctgccttcggccacaggacagaagctggcccccggggcaagggcttcggccgccaccggggcaacagcggcctgcgggctgctgaggtgacccacggcccctgctgggaggccgcagatgtgccctgcctgcggctgaccaagccccacggcctgcgggtgacagctggctgcagcgagtggaggagaaatgtggtggcccggcaggtgcctgaggccagcgctgagctgtgcagcaggaaccagccctgggccgccgccaccccaggcagcctgcaccccagcccccagcccggggtgctggagggcacccccaccaacctgaacagaaccctgcccagcggcatccggggcagccagcccctgccccagggccagccccccctgcccggccgcagctcctgggagaccaagacccgggagcccatccccccacctgtgcggctggaggcccgggaggtgggcggcgtgtccctgtag

SEQ ID NO: 43180 - DNA, 480 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagcccttcggcagctacaacaacaacatcgaccacttcggcatgcagcatgaaacagagctgccccccctgacagcccgggaggtgaagcagatcagaagagagatcagcaggaagagcaagtgggtgaagatgctgggggagtgggacacctacaagaacagcaggaagctgattgaccgggcctaccagggcatccccatgaacatccggggccccatgtggagcgtgctgctgaacatcgaggagatcaagctgaagaaccctggccgctaccagatcatgaaggagaagggcaagaggagcagcgagcacatccagcagatggacctggatgctgctggcaccaccctgcaccccccaggagtgtag

SEQ ID NO: 43181 - DNA, 462 bp, Artificial Sequence; identical to SEQ ID NO: 40425
  Description of Artificial Sequence: Synthetic coding sequence

SEQ ID NO: 43182 - DNA, 1116 bp, Artificial Sequence
  Description of Artificial Sequence: Synthetic coding sequence
atgggcggccctgtgctgggccactggtggcacagcggcggcatgagcctggccgtgcccagcctgcccccacctgggaagagctctgtgttcctgttcctgcaggagaagaaggccaacaacaagaagcagaaggccaagagggtgctggaggtgcagctgcagaccctgaacatccagaaggaggagctgaacacagacctgtaccacatgaagaggagcctgcgctactttgaggagaagagcaaggacctggccgtgcggctgcagcacagcctgcagaggaagggggagctggagagcgtgctgagtgatgtgatggccacccagaagaagaaggccaaccagctgagcagccccagcaaggccggcacagagtggaagctggagcagagcatgagggaggaggccctgctgaaggtgcagctgacccagctgaaggagagcttccagcaggtgcagctggagagagatgagtacagcgagcacctgaagggggagcgggcccgctggcagcagaggatgaggaagatgagccaggagatctgcaccctgaagaaggagaagcagcaggacatgagaagagtggagaagctggagaggagcctgagcaagctgaagaaccagatggccgagcccctgcccccagagcccccagctgtgcccagcgaggtggagctgcagcacctgaggaaggagctggagcgggtggccggggagctgcaggcccaggtgaagaacaaccagaggatcagcctgctgaaccagaggcaggaggagcgcatccgggagcaggaggagcggctgaggaagcaggaggagcgcatccaggagcagcacaagagcctgcagcagctggccaagccccagagcgtgtttgaggagcccaacaatgaaaacaagagcaccctgcagctggagcagcaggtgaaggagctgcaggagaagctgggggaggtgaaggagagcgagaccagcacccccagcaagaagggctgggaggccggcagcagcctgtggggcggggaggtgcccggccagaggcagctgcctgcctggggcctggtgaccacagccccacccagggctgtgctcttcctggccagctgcctgtag

SEQ ID NO: 43183 - DNA, 384 bp, Artificial Sequence
  Description of Artificial Sequence: Synthetic coding sequence
atgggcaacctgtgtggctgcatccagggcgacagcaagaagcccagcaagaagagggtgaagaggaagccctacagcaccaccaaggtgaccagcggcagcaccttcaatgaaaacaccaggagatatgctgtgcacaccaaccagtgcagaagaccccacggcagccgggtgaagaagaagcgctacccccaggaggatgacttccaccacacagtgttcagcaacctggagcggctggacaagctgcagcccaccctggaggccagcgaggagagcctggtgcacaaggacagaggagatggagagaggcctgtgaatgtgcgggtggtgcaggtggcccccctgcggcgggagagccgggccatcgacacaggagagtag

SEQ ID NO: 43184 - DNA, 2265 bp, Artificial Sequence
  Description of Artificial Sequence: Synthetic coding sequence
atgaaggtgattgtcatccacaggaagatgttccagagggcccaggagctgcggaggagagctgaggactaccacaagtgcaagatcccccccagcgccaggaaggccctgtgcaactgggtgaggatggctgctgctgagcaccgccacagcagcggcctgccctactggccctacctgacagctgagaccctgaagaacaggatgggccaccagcccccaccacccacccagcagcacagcatcacagacaacagcctgagcctgaagaccccaccagaatgtgtgctgacccccctgcccccatctgcagatgacaacctgaagaccccaccagaatgtgtgctgacccccctgccccccagcgcagatgacaacctgaagaccccacctgagtgcctgctgacccccctgcccccatctgcagatgacaacctgaagaccccaccagaatgtctgctgacccccctgccccccagcgcagatgacaacctgaagaccccacctgagtgcctgctgacccccctgcccccatctgcccctccttctgcccctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagccttccacccccagaggatgatcatcagccgccacctgcccagcgtgagcagcctgcccttccacccccagctgcacagccagcagatgatcatcagccgctacctgctgtctgtgtgtggcttccgcttccaccaccagcccatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggggagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 43185 - DNA, 810 bp, Artificial Sequence
  Description of Artificial Sequence: Synthetic coding sequence
atggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacagcgagtacctgactgtgaaggtgatcagcctgcacctggtgttccagattggagtcatcttcctgcagtag

SEQ ID NO: 43186 - DNA, 570 bp, Artificial Sequence
  Description of Artificial Sequence: Synthetic coding sequence
atggtgcagggcagcagcaggacagcccggcccctgcctgccccagcctgtggcctgagccctggccctgactgcaatgcctcctggcaggacagagctgctgacttctgccctgtgcgggctgtgtgcaaggtgggcccctgcccctgctgccagctgaagacagacccccggctgggcaagaggacaggcctggacctcttctctgtgtggagccgcagcgccatgctggccccagctggctctgtgctggccatgcccaccctgcggcccccaagaaattctgtgggggacagcggggcctgctgcctgcggaccaccggcctggacatcagcaaggtgctgcctgagagcttcctgagctgccccctgctggagctgccctggcacctgagctcctgggtgctgaaccctggcctgcccaccctgcggacccctcatgccagctacagctgctttgctgcccaggcccggagccctgagagagctgctgggggcgcctggcccctgaccgggaagccctggcccaggacaggcatcctgagccccagccacagcgagatcctgtag

SEQ ID NO: 43187 - DNA, 684 bp, Artificial Sequence
  Description of Artificial Sequence: Synthetic coding sequence
atgagccaccacaccaggaccctgggcgtggtgctgagcccccagcagggcgccccagctggccctgggggcggcctgggcaccccctaccacagccacccctgcaagccccggcaggtgcctgtgtctgagagccagcccccaccccacaccatgcaggtgggccgctgggccggcctgggcgtgggccaggccgaggccacctctgtgcggctgggcctgcacggcctggaggccgtgttcccctacctgggccatgacctgcagggccctgctgtgtcccatggagatggcctggccggcgtgggccgggagctggccctgctgctgggcggccctgagcagagaggagccaagcaccgggccaaggtggtgcagggccacctgattgactgcctgctgctgtgccaccctgtggaggacaggagccggggctgctgcttcaatgccaccacccggcgggaggccgagggcctgtgccgggcccgggtgctgcgggagggcgtgaccagcaccctggccgtgctgcaggccgacagcagcctgggcgtgagcagcaccaggagaacagctgctgggggcgccgcccgggctgctgcccacggccagagctgcccccgggccaccccagccaccacccccagccctggcagcccccggcagggccgcctgtccatggagtag

SEQ ID NO: 43188 - DNA, 1023 bp, Artificial Sequence
  Description of Artificial Sequence: Synthetic coding sequence
cctgtgcccggccccaccagcagcgccaccaacgtgtccatggtggtgtctgctggccccctgagcagcgagaaggccgagatgaacatcctggagatcaatgagaagctgcacccccagctggccgagaagaagcagcagttcaggaacctgaaggagcgctgctttgtgacccagctggccggcttcctggccaaccagcagaagaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggagctggccgagaaggtgcagaagagcagcgccccccgggagatgcagaaggccgaggagaaggaggtgcctgaggacagccaggaggagtgtgccatcacctacagcaacagccacggcccctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgacctctgtgggcagcagcgagaagggcggcccccggggcaacagaagccaggcccagcagggcgctgctggatag

SEQ ID NO: 43189 - DNA, 11424 bp, Artificial Sequence
  Description of Artificial Sequence: Synthetic coding sequence
tgaccaggccccaccagcagcgccaccaacgtgtccatggtggtgtctgctggccccctgagcagcgagaaggccgagatgaacatcctggagatcaatgagaagctgcacccccagctggccgagaagaagcagcagttcaggaacctgaaggagcgctgctttgtgacccagctggccggcttcctggccaaccagcagaagaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggagctggccgagaaggtgcagaagagcagcgccccccgggagatgcagaaggccgaggagaaggaggtgcctgaggacagccaggaggagtgtgccatcacctacagcaacagccacggcccctatgacagcaaccagccccacaggaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagaattggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggacaggagctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggacaggagctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggatggagagtacctgtccatgaaggtgatccgcatccactag

SEQ ID NO: 43190 - DNA, 258 bp, Artificial Sequence
  Description of Artificial Sequence: Synthetic coding sequence
gagatgcagaaggccgaggagaaggaggtgcctgaggacagccaggaggagtgtgccatcacctacagcaacagccacggcccctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagcccctag

SEQ ID NO: 43191 - DNA, 753 bp, Artificial Sequence
  Description of Artificial Sequence: Synthetic coding sequence
gagattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgcagcaagaaggagaggagaagaggaaggaaggagggggaggaggaccagaaccccccctgcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtggacatggatggagagtacctgtccatgtag

SEQ ID NO: 43192 - DNA, 300 bp, Artificial Sequence
  Description of Artificial Sequence: Synthetic coding sequence
atgaggcccaagaccctgagaaattctgctgcccggagcaggaaggagcccggcttcctgaaccaccacatggagggcagctgcctgcagctgggggagctgagctctgtgggctactggatggagagccacagcgtgacccaggccggcgtgcagtggtgcagctttggcagcctgcagcccccaccaccccgcttcaagcccttcagctgcctgagcctgcccagctcctgggactacagaaggaagaagggctcctggctgggcagcaagctggagttccccatgctgtgtggctag

SEQ ID NO: 43193 - DNA, 300 bp, Artificial Sequence; identical to SEQ ID NO: 43192
  Description of Artificial Sequence: Synthetic coding sequence

SEQ ID NO: 43194 - DNA, 321 bp, Artificial Sequence
  Description of Artificial Sequence: Synthetic coding sequence
atgaggcccaagaccctgagaaattctgctgcccggagcaggaaggagcccggcttcctgaaccaccacatggagggcagctgcctgcagctgggggagctgagctctgtgggctactggtggcccttcggccaccctggccctgcccagggccacctgcctgtggccgtgtgggcctcctgggtggtggccggcatcagcatcgccctgtacctgcccccccaccctgagggccgctatgagggccccttcaagaggcacaccaagaccttccgcagcgcccagtgtgccgactgcctgacctgtgccctggagccctag

SEQ ID NO: 43195 - DNA, 453 bp, Artificial Sequence
  Description of Artificial Sequence: Synthetic coding sequence
atggagaacaaccccagccacaaccctgtgagccccagccccttccccacccgcatcagcgcccccctgaacatgagccagagccacttccgggagaactggctgatgctgaagaagagcctggagggcaagctgtgccccagcagctgtggcagcctgaagtgccgggccagccgcagccccagcgtgggcaccggccccagcctgcccatcgagtgcttcctgtacatgaagacctggagcagcctgcagatgacagtggccagcgaggaggacaagaggcgggagaagacccagaatgccggcctgcccctcttctttgccagcacagtgggcaccgtgaccctgcccagcttccaccacctgcagctgcacacccacacccacaccctggtgccccagagcctgtttggcacctgcctgacagcccacctggagacccgctggagctag

SEQ ID NO: 43196 - DNA, 486 bp, Artificial Sequence
  Description of Artificial Sequence: Synthetic coding sequence
atgggccaccggcccaacctgggccagcccccccaccccaatgctgtggccgccgccctgcacgccagcctgtgcccagccaacagaggcacctgccccctgggcaagccaggctacccaggctgcctgtggttccagcccctgctgctcttccctggctgcctgtgcagcccagatggccccttccccagggctgtgttcaccagcgctgggaagggccccctgcagacagacctgggccggggccgggtgcccccccgggaccagcagacccccaagagccggccctgcccccgggcccctgtggccagcaaccggcagagcggcggcagcgctgtgtctgcccccctgagcggggcccggcgggcctggaagagcgcctttgctgccccacccaggagccggctgcggccccagaagggcgtgccctggacagagaagagggcccggggcggcggccgggccggcccctgcagaagaacatag

SEQ ID NO: 43197 - DNA, 321 bp, Artificial Sequence
  Description of Artificial Sequence: Synthetic coding sequence
atgcacagccggccctgggcctggggcgccagcgagatgtgcttctgcttctttgagatgggcagcttctgctgccccagccgcagcacagtggcccggagccagctgacagctgccagcacctcctgggcccaggtgatcctgcccccccagcccccagagtgcctgctgctggtgttcatgatgacctggggccctggcatcctgcacctgtgctgcagcggggccagccctgcccctggggcccaccagccccagctgcggcgggaggccctgatctgccgggccaagcagctgtgcttccacgtggaccctgcctag

SEQ ID NO: 43198 - DNA, 246 bp, Artificial Sequence
  Description of Artificial Sequence: Synthetic coding sequence
atgtgctcctgggaggtgaccaccccccagggcctgggcaccagcagcgccagcgaggagagcctgacagatgaccaccggctgctgaaggtgatcagccagggcagctttgctgaggtgaaggctgctggccctgcccacagccactgggaccaggacggctgcggcggccaccccaacagagctgctggcctgctgcagcccccaggctctgtgctgcagggcccctatgatgagggcccctag

SEQ ID NO: 43199 - DNA, 720 bp, Artificial Sequence
  Description of Artificial Sequence: Synthetic coding sequence
atgtctgaccctgagggggagaccctgcggagcaccttccccagctacatggccgagggggagcggctgtacctgtgtggggagttcagcaaggccgcccagagcttcagcaatgccctgtacctgcaggatggagacaagaactgcctggtggcccggagcaagtgcttcctgaagatgggagacctggagaggagcctgaaggatgctgaggccagcctgcagagcgaccctgccttctgcaagggcatcctgcagaaggccgagaccctgtacaccatgggagactttgaatttgccctggtgttctaccaccggggctacaagctgcggccagaccgggagttccgggtgggcatccagaaggcccaggaggccatcaacaacagcgtgggcagccccagcagcatcaagctggagaacaagggggacctgtccttcctgagcaagcaggccgagaacatcaaggcccagcagaagccccagcccatgaagcacctgctgcaccccaccaagggggagcccaagtggaaggccagcctgaagtctgagaagacagtgcggcagctgctgggggagctgtatgtggacaaggagtacctggagaagctgctgctggatgaggtgaccttcctgatgcagaaccgggagcccctgaccaccctggccgagttcctgcctgagctgggcaacagcagcaagcccctgacccgggagtag

SEQ ID NO: 43200 - DNA, 516 bp, Artificial Sequence
  Description of Artificial Sequence: Synthetic coding sequence
atgctgaccagcaagctgcggagcaccctgcagaccctgcagggcctgggcctgaccagcagctgcctgctggacatcttcagctctgtgtccacccacatccggaacctgccctgcctgaacctgaccctggccagcagctgcctgcagaggatccagatcatgcagggcgccggcaggaagaggaacagaggccgggcagagaagcagaaggcctgtgccatctccttccaggtggacttcagcaagctgcacatcctgggcgccggccggggccgcatcctggaggagaagcagggcatcctggtgcggcaggccaatgctgactgcctgcgggacctgggcctgaagagcgcctttgagctggccttcagaagaagcagcctggtgttcagcccccgggccaagggcctgaagagcagcgcagaagatcggcgctggcccctcttctggcagaacatggtgtccatctttggagcccgctgcaaggccagcagcgcccagaccagctgctag

SEQ ID NO: 43201 - DNA, 1218 bp, Artificial Sequence
  Description of Artificial Sequence: Synthetic coding sequence
atgcacatcaacagcctgcacatgcagctgaacagccaccgcatctgcaacagcacccacacagtgtatgccaaccagctggccctgaggatgcagctgaacagccactgtgtgtgcaacagcaccaggacagcctatgccaaccccctgacagcctatgccacccagctggccctgaggatgcagctgagcagcctgtgtgtgtgcaacccagcccggagcgcctatgccacccaggtggccctgaggatgcagctgagcagcctgtgtgtgtgcaacagcgccaggacagcctatgccacccagctggccctgaggatgcaggtgagcagcctgtgtgtgtgcaacagcgcccggagcgcctatgccacccagctggccctgaggatgcagctgagcagccactgtgtgtgcaacagcgcccggagcgcctatgccacccagctggccctgaggatgcagctgagcagcctgtgtgtgtgcaacagcgccaggacagcctatgccaccaggacagcctatgccacccagctggccctgaggatgcagctgaacagccactgtgtgtgcaacagcaccaggacagcctgtgccacccagctgaccctgaggatgcagctgagcctgctgtgtgtgtgcaacagcaccaggacagcctatgccaaccagctgacagcctatgccacccagctggccctgcacatgcagaggaacagcacccacacagcctatgccacccagctgaccctgtatgccacccagctggccctgcacatgcagttcaacagccactgtgtgtgcaagagcacctactgcatctgcaacagcacccactgtgtgtgcaacagcaccaggacagcctatgccacccagctggccctgaggatgcagctgaacagccactgtgtgtgcaacagcgccaggacagcctatgccacccagctgctgcaggtgctgatcagcggccacttcctgttcctgaccaccacccccagccagtacttcagcagcctgaagagcgcccaggatgaggccctggacagcaggacctgctgcatgcccctgggcctgctggaggtgtgccgcctggccagcccccggctgcacccagccctgagctgcctgagctgtgagaaccctgtggccagcgccagccctggcagtgacttctgcctgctgcccagcagcgctgcccccctgggcccctgcctggagtag

SEQ ID NO: 43202 - DNA, 411 bp, Artificial Sequence
  Description of Artificial Sequence: Synthetic coding sequence
atgaggcaggaggtggagggccggggccggggcagccatgagctgatcatcacagacaagagatgtggggtgtgtggcggcagcctgagctgcatcgtgtacctgtgcatcagcctgaacttcagccgcatcaagaagctgaagaagtacacctggccaggccccacccgggacagccccaatgccagcctgcagcccggccgggccaagtttgccttcagccacgccagccacacccccctgcacagccagctgggcgccctgcagacaggcaagccccaggccctgctggccagcgccaaccccctgagccgctccatgggccccccagaccaccacctgaccaccctcatcctgatcagcctggagacccccttccctggcctgctgagcagcggctgcttcccctag

SEQ ID NO: 43203 - DNA, 1008 bp, Artificial Sequence
  Description of Artificial Sequence: Synthetic coding sequence
atgcagctgctgggcctgctgggcctgctgtggatgctgaaggccagcccctgggccaccggcaccctgagcacagccaccagcatcagccaggtgcccttccccagggctgaggccgccagcgctgtgctgagcaacagcccccacagccgggacctggccggctggcccctgggcgtgccccagctggccagccctgcccctggccaccgggagaatgcccccatgaccctgaccaccagcccccatgacaccctcatcagcgagaccctgctgaacagccctgtgagcagcaacaccagcaccacccccaccagcaagtttgccttcaaggtggagaccaccccacccaccgtgctggtgtacagcgccaccacagaatgtgtgtaccccaccagcttcatcatcaccatcagccaccccaccagcatctgtgtgaccaccacccaggtggccttcaccagcagctacaccagcacccctgtgacccagaagcctgtgaccaccgtgaccagcacctacagcatgaccaccacagagaagggcaccagcgccatgaccagcagccccagcaccaccacagcccgggagacccccatcgtgacagtgacccccagctctgtgtctgccacagacaccaccttccacaccaccatcagcagcaccaccaggaccacagagaggacccccctgcccaccggcagcatccacaccaccaccagccccacccctgtgttcaccaccctgaagacagctgtgaccagcaccagccccatcaccagcagcatcaccagcaccaacacagtgacctccatgaccaccacagccagccagcccacagccaccaacaccctgagcagccccaccaggaccatcctgagcagcacccctgtgctgagcacagagaccatcaccagcggcatcaccaacaccacccccctgagcaccctggtgaccaccctgcccaccaccatcagccgcagcacccccaccagcgagaccacctag

SEQ ID NO: 43204 - DNA, 432 bp, Artificial Sequence
  Description of Artificial Sequence: Synthetic coding sequence
atgaggctgcagaagacccgctgtggcagcgctgccagcccccccaacaagcagcagacagagctgcctgccttctctgtgatgcccaggcctgctggccagcacgtgtggccctggagaggagagaggatgaggctgcctggagctgccagcagcctcttcagcaactacttcagcctgccctacgtgatctacctgagcatcagtgacctgaatgtggagtgcctgatcttctctgtgtttgacagccagcaggtgcacaccagctaccagagcaatggcctgcacagaaatggcatgtttcatgactgcctggaggtgtccaagcaccccttcctgggcctgaccctgaccctgtggctgtgtgacctgagcagcagcggcttctacatgagcggccacgagcccctgtggaacctgagccccctgtag

SEQ ID NO: 43205 - DNA, 633 bp, Artificial Sequence
  Description of Artificial Sequence: Synthetic coding sequence
atgagccgggccggcagccaccccaagccagccatccctggccggggcggggagaagctggccctgctgctggccatgctgggcggccgctgctgcccagctgggggccctgagagccacacccccaggaagccctggccacccatccggcgggagcggcccggcctgcggagccccaagccccgggaggaggccggccccagggctgacagcaaggccgccagccctgccctcttcatgggccctggcagccggggcagaagaagaccacccagctgggcccggcggcgggcccggggcggccggggcagctgcccagagccccacgtgcgggccggcccccgcttcttcatcgccctggccgccccagctgcccggggcctgcgggtgagcagccagggccctggcctgtggaggggccctgctgccaggaaggagggcgtggcccgggtgggcgtggccgccggcctgcggctgcggccccggggccggggcaggaagaccaccccagccctgagcggccacccagcccgcttccccctgcagcccggggacagccgggagaggagcaggaaccaccgggccctggagctgacctggcagcccaggggggccaaggccggcggggcctag

SEQ ID NO: 43206 - DNA, 633 bp, Artificial Sequence
  Description of Artificial Sequence: Synthetic coding sequence
atgagccgggccggcagccaccccaagccagccatccctggccggggcggggagaagctggccctgctgctggccatgctgggcggccgctgctgcccagctgggggccctgagagccacacccccaggaagccctggccacccatccggcgggagcggcccggcctgcggagccccaagccccgggaggaggccggccccagggctgacagcaaggccgccagccctgccctcttcatgggccctggcagccggggcagaagaagaccacccagctgggcccggcggcgggcccggggcggccggggcagctgcccagagccccacgtgcgggccggcccccgcttcttcatcgccctggccgcccaggccgcccggggcctgcgggtgagcagccagggccctggcctgtggaggggccctgctgccaggaaggagggcgtggcccgggtgggcgtggccgccggcctgcggctgcggccccggggccggggcaggaagaccaccccagccctgagcggccacccagcccgcttccccctgcagcccggggacagccgggagaggagcaggaaccaccgggccctggagctgacctggcagcccaggggggccaaggccggcggggcctag

SEQ ID NO: 43207 - DNA, 1881 bp, Artificial Sequence
  Description of Artificial Sequence: Synthetic coding sequence
atgaagatgcagaagggaaatgtgctgctgatgtttggcctgctgctgcacctggaggccgccaccaacagcaatgagaccagcaccagcgccaacacaggcagcagcgtcatcagcagcggggccagcacagccaccaacagcggcagctctgtgaccagcagtggagtgtccacagccaccatcagcggcagctctgtgaccagcaatggagtgtccatcgtgaccaacagcgagttccacaccaccagcagcggcatcagcacagccaccaacagcgagttcagcacagccagcagcggcatcagcatcgccaccaacagcgagagcagcaccaccagcagcggggccagcacagccaccaacagcgagagcagcacccccagcagcggggccagcacagtgaccaacagcggcagctctgtgaccagcagcggggccagcacagccaccaacagcgagagcagcacagtgagcagccgggccagcacagccaccaacagcgagagcagcaccctgagcagcggggccagcacagccaccaacagcgacagcagcaccaccagcagcggggccagcacagccaccaacagcgagagcagcaccaccagcagcggggccagcacagccaccaacagcgagagcagcacagtgagcagccgggccagcacagccaccaacagcgagagcagcaccaccagcagcggggccagcacagccaccaacagcgagagcaggaccaccagcaatggagctggaacagccaccaacagcgagagcagcaccaccagcagcggggccagcacagccaccaacagcgacagcagcacagtgagcagcggggccagcacagccaccaacagcgagagcagcaccaccagcagcggggccagcacagccaccaacagcgacagcagcaccaccagcagcggggccggcacagccaccaacagcgagagcagcaccaccagcagcggggccagcacagccaccaacagcgagagcagcaccaccagcagcggggccagcacagccaccaacagcgacagcagcaccaccagcagtggagctggaacagccaccaacagcgagagcagcacagtgagcagcggcatcagcacagtgaccaacagcgagagcagcacccccagcagcggggccaacacagccaccaacagcgagagcagcaccaccagcagcggggccaacacagccaccaacagcgagagcagcacagtgtcctctggggccagcacagccaccaacagcgagagcagcaccaccagcagcggcgtgtccacagccaccaacagcgagagcagcaccaccagcagcggggccagcacagccaccaacagcgacagcagcaccaccagcagcgaggccagcacagccaccaacagcgagagcagcacagtgagcagcggcatcagcacagtgaccaacagcgagagcagcaccaccagcagcggggccaacacagccaccaacagcggcagctctgtgaccagcgctggcagcggcacagctgccctgaccggcatgcacaccaccagccacagcgccagcacagctgtgtctgaggccaagccaggcggcagcctggtgccctgggagatcttcctgatcaccctggtgtctgtggtggccgctgtgggcctgtttgctggcctcttcttctgtgtgaggaacagcctgagcctgaggaacaccttcaacacagctgtgtaccacccccacggcctgaaccacggcctgggccctggccctgggggcaaccacggggccccccaccggccccgctggagccccaactggttctggaggaggcctgtgagcagcatcgccatggagatgagcggcaggaacagcggcccctag

SEQ ID NO: 43208 - DNA, 393 bp, Artificial Sequence
  Description of Artificial Sequence: Synthetic coding sequence
atggagggccgggaggtgtacctgtggtacagcgtggacagcagaggagacttcctggtgttcctgtgccccatcttcttctccttctccttcagcgaggtggagagcctgagcccccggctggagtgcagcggcaccatcagcgcccactgcaacctgtgcctgctgggcagcagctacagccctgccagcgccagccgggtgacaggcatcaccggcatgtgccaccacgcccagctgatctttgtgttcctggtggagatggagttccgccacgtgggccagaccagctttgagctgctggccagcagcagccccccagccagcgccagccagagcgctggcatcactggagtgagccactgtgcctggcccctggcccagtacctgtag

SEQ ID NO: 43209 - DNA, 459 bp, Artificial Sequence
  Description of Artificial Sequence: Synthetic coding sequence
atgccagacctgaagatgcaggaggtgaagaagatctgctatgagctggccctggcctacttccaccacggccaggccgagattgaggccctggccaccctgaaggtgtgggagctgtgccacacctacggcaagccagagggccccagagatgcctggagggctgtggcccgggacttctgggacacagtgggggaggaggagggcggcggggccggcagcggcggcggcagcgaggagggcacccggggcgtggaggtggaggacctgcaggcccacatctgcaagctgatgggcatcctgcagcaggtgaagctgcagaacagcagcaaggactgggagctgcaggccctgcaggacaggatggtgtgcatggagcgcatcatccccctggcccaggaccatgaagatgaaaatgaggagggcggggagttccactgggcccctcctgagggctag

SEQ ID NO: 43210 - DNA, 498 bp, Artificial Sequence
  Description of Artificial Sequence: Synthetic coding sequence
atgagccacccccaggccaccagcaacctgcagcacacagtgagcaacagcgacaacatcggcagcagcgctggccgctggacctgggtgcccctgacctggacagacaccagcaagatgtccatgaggggcctgctggacctcttctccttccacagctgcatcctgaagaatggcagcgagcctgaggagccccaggacagcgccaagacagacacccagctgagccctgccaccctggccctggagcgggaggagcacagcagcagacatgtgcccagcgtgctgagcaagaccatgagccgggccagcgctgagctgacctgcacagctggccggcagggccctggccccccaggcagccacagccaggccccccacatgctgccccagcctgagcccctgctggcctgtgccccagccatgtggtgcagaagagagccccagcccatcggcggcctgcagcccccccacctgcggctgcacctggagagctag

SEQ ID NO: 43211 - DNA, 375 bp, Artificial Sequence
  Description of Artificial Sequence: Synthetic coding sequence
atgctgcccagcaaggcctttgaatttgccaccgtgaagtccatgcacggcatcttcggctgcggcctggccctgccccctgtgtttgctgctgagctgctgtacctgacccgggcctgtgccagtgatgagcagcccttcatcacagccctgcggcccccaccccggcccccacccagcgccctgcagttcatcagccggctggtgcccatcgccacctgtggcctgggcggccccccagacatcctgagctttggcagccctgtgaccccagagctgctgcccttctggggcgcccacatctgtgacaccctggtgtgccctgtgcacttcctgcacctggagttcctgagctgcagccacatcagcatctag

SEQ ID NO: 43212 - DNA, 267 bp, Artificial Sequence
  Description of Artificial Sequence: Synthetic coding sequence
atgaggagccagggccagggcggccctggggcctggaggaggatggagagctggagcgctgagcctgctggccctggccagggccgcctgggcagcccctgtgaggccgctgagcaggccagctttgagaagacagtgattggagtgggccaggcccgggccgccctgtctgaggaggagcaccgggtgtgggaggccgccgccggcgtgggcggcctggagcagtggggctgctgggaggccggcgtgaccagcggctggggctag

SEQ ID NO: 43213 - DNA, 447 bp, Artificial Sequence
  Description of Artificial Sequence: Synthetic coding sequence
atgagcagctttgtggtggtgatgggcttcctggtggagatgaccagcaggaagaagaacaacgtgaaggaggaggagatggagtgtgctgtgacctacctgaggaagggcggcggcatctgcagcttctacttctacttctacctgttcttcatcttcatctacctgttcttcctgcgctggagcctggccctgagcccccggctggagtggagcggggccatcagcgcccactgcaacctgcggctgcccggcagctgccacagcagcgccagcgccagccgggtggccggcaccaccggggcccggcaccacgccctgctgatcttctacatcttcagcagagatggagtgagcccctggagccgcagcccccacctggtggtgtgccccccctggccacccaaggtgctgggcctgcaggccccagccaccaccccaggatag

SEQ ID NO: 43214 - DNA, 375 bp, Artificial Sequence
  Description of Artificial Sequence: Synthetic coding sequence
atgaccctgaatgagcacgccgccttcaagcacctgttcaacaaggcccacctggccccacccctcatccacctgaccctgagcggccacagcacctgcttccgggagcaccgggtgggcggcaaggtgacagaccagcaggaccccaaggccgaggagttcttcctggtgcagaacaagatgaagagcctgccctgcctgctgctgagcacccagacccggcagcccagcgacttcagcatcttcagcccccccttcccccctgtgtacagcaccaagccacccctgagctcctggcctgtgctgaatgagctgctgggcaccccaccaagaagaggaggcggccgggcagagggcctgctgaccagccagtag

SEQ ID NO: 43215 - DNA, 429 bp, Artificial Sequence
  Description of Artificial Sequence: Synthetic coding sequence
atgaggatccgcaccagcttcttcatgtctgctgccctgggcggccggcccccaccagccaggacagagtggacccccctgaccaggagcacccaccccacagcccccccagccagcctgtttggaagaagaggccccccccggcggcccctgagctgcttccctgcccgggagcccggccagaggcagctgcggctgctgcggcccagcggcctgtggaggagaagaagaagaagaagaagaagaagaagaagaagaagaagaagaggaagaagacatgctgcccgggacacccgcttcagaaatgccaatgccctgtgtgccggcacagccctgcccctgtctggaagaagatctgctggccctggcagcctggcccacccccccctgggcacagccaccccagagaccctgggccctggcatctag

SEQ ID NO: 43216 - DNA, 1977 bp, Artificial Sequence
  Description of Artificial Sequence: Synthetic coding sequence
ctgaagaccccaccagaatgtgtgctgacccccctgcccccatctgcagatgacaacctgaagaccccaccagaatgtgtgctgacccccctgccccccagcgcagatgacaacctgaagaccccacctgagtgcctgctgacccccctgcccccatctgcagatgacaacctgaagaccccaccagaatgtctgctgacccccctgccccccagcgcagatgacaacctgaagaccccacctgagtgcctgctgaccccacctcctccttctgcagatgacaacctgaagaccagggcagaatgtctgctgcaccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagccttccacccccagaggatgatcatcagccgccacctgcccagcgtgagcagcctgcccttccacccccagctgcacagccagcagatgatcatcagccgctacctgctgtctgtgtgtggcttccgcttccaccaccagcccatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggcggccgcttccacccccagaggatgatcatcagccgccacctgcccagcgtgagcagcctgcccttccacccccagctgcacccccagcagatgatcatcagccgccacctgcccagcgtgtgtggggagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccatctgagcggcagctgacccccctgcccccatctgcccctccttctgcagatgacaacatcaagaccccagctgagcggctgcggggccccctgccccccagcgcagatgacaacctgaagaccccacccctggccacccaggaggccgaggccgagaagcccaggaagcccaagaggcagagagctgctgagatggagcccccacctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcagccctgagcccaagagaagaagagtgggagatgtggagcccagcaggaagcccaagagaagaagagctgctgatgtggagcccagcctgcctgagcccaagagaagaaggctgtcctag

SEQ ID NO: 43217 - DNA, 588 bp, Artificial Sequence
  Description of Artificial Sequence: Synthetic coding sequence
atgaacagcgtcttccggcagcccggcagcaacttctccttccccatctaccagcccagcgcctctgtgacccacggcctgtccttcttctgtgaggtgagcccccagatgctgaccccccaggactaccggggcaagcagcagggccaccggggctgccccggctgcatggtggccatggacacctggccagctgtgctgcctgagctgcccggcttctggggcgagggcagcggcggccaggcctggggcgcccggggggagcccctgctgcagaaggccaactgcctgctggaggccgtgcggctcttcctgaactaccggcccctgggcgctgagggcggggagctgaccttcggcaagaggctgctggtgcccacagctgtgtcctgtgcctatgactgtgtgagcagcagcgccttcctgggcatccagctgctgggggaccccaccaggagccctggccactgctaccggcaggacttcaacggcaccctgcggctgcgggagggcaagggcctggtgcagagccacacaggcaccctgtgggccggccccctgcaggagggcacccagggccagacctag

SEQ ID NO: 43218 - DNA, 453 bp, Artificial Sequence
  Description of Artificial Sequence: Synthetic coding sequence
atggctgtgtccaggatgagcaagtggaggctgagccgggtgggcggcagccgcagcctgcctgctgagatggaggtgctgggggaggtgtggtgtgtgcgggcagaggagcagcccatgacaggcctgggcatcgtgtggcacagccccctggacaaggccctggagacctggagcctgcagcagcagcctgacttcagcctgggcctgggccacctgggcctgggcacagatgccacctggatgcagagcttccctggcagcggaggagatgcccaggccggcaccggggtgtctggccccctgcggctgtaccccaacctgctgtgtgactttggcccccggcagggccccctgtgggccctgctgctggagaagaggcagatggccggcaccggcggcagccctgccctgctggcctggaggtctgcctcctggagggccctgggctag

SEQ ID NO: 43219 - DNA, 342 bp, Artificial Sequence
  Description of Artificial Sequence: Synthetic coding sequence
atggctgtgtccaggatgagcaagtggaggctgagccgggtgggcggcagccgcagcctgcctgctgagatggaggtgctgggggaggtgtggtgtgtgcgggcagaggagcagcccatgacaggcctgggcatcgtgtggcacagccccctggacaaggccctggagacctggagcctgcagcagcagcctgacttcagcctgggcctgggccacctgggcctgggcctgtacatcctggccagctacctgctgtgcccccggcagccccccagccagccagatggcccctgtggcagccccaaccctgtgtctggggccaagaagaccaccgtggcctag

SEQ ID NO: 43220 - DNA, 228 bp, Artificial Sequence
  Description of Artificial Sequence: Synthetic coding sequence
atgcacatctacttcaccgctgagctgctgaagagaagaaatgccaagcccaccttctccatgagctccatgcaggccgcccggagcatccccaagtccatgaatgtgcacagcatgcccagcttcctgtacagcagctgcagcagcaccaacatgtggtggctgaagaactgctgcagcttcagcctggtgaagctgatgcacagctgcagccggctgctgaactag

SEQ ID NO: 43221 - DNA, 561 bp, Artificial Sequence
  Description of Artificial Sequence: Synthetic coding sequence
atgtggaaccagcagggccggcccggcatccggaaccagttcagcctcttcttcttcctgacccagagcctggccctgagcctgcggctggagtgcagcggggccatcagtgaccactgcaacctgcggctgctgggcagcagtgacagcagcgccagcgccagccgggtggccggcatcattgatgtgcgccacatgcctggccagcacggggagaccctgagcctgctgaagatccagaagctggccggctgcggcggcagccacctgtacagccagctgctgggccgcctgaagtgggaggatggcctgagcagcggcggccggggctgcagcgagctgcggggccgccactgtgcccctggctgggtgacagcccggctgtgcctgaagaagaagaagaagagaggaggcggcaagaccaagctgtacagcgtgggcctggagttcaacatctggaaggtggacatctggaatgccctggtgcccctggacctgtggttcagcctgaagggggagagcaggaccatcgtgctggagagcagcgaggtgaggacatag

SEQ ID NO: 43222 - DNA, 459 bp, Artificial Sequence
  Description of Artificial Sequence: Synthetic coding sequence
atgcccagccagccccacctgagcgcctgcagcgtggagagccctggagctgctgcccggctgacccagaggcacctgactggagtggcccggggcggcggccagacaggcaccttccacatgggcctgctgcccagccggcaggagtgtgcccctgtgtctgccctgaccctgaccaccaccatgggccgcctcttctctgtgcactggcagatctggggcccctgcagcccctgcatcgtgtaccccaagggggacagcgagcagagcgccagcaagagcaagcaggccttccccctgctgctgaggaagggcatggagtggcccctgagcgcctggctggagagcagcagccctgccccctgcatgcccctgtggaggaggaacagcttctgggagagccggcccagcccctgccgcatccggggcctgtgcagcatgaggccccacggcctgtag

SEQ ID NO: 43223 - DNA, 84 bp, Artificial Sequence
  Description of Artificial Sequence: Synthetic coding sequence
atgagccctgccctgaccttcccccggcgctggattgctgagggcctggtggagaacctgaaccccccaggagcagatgcctag

SEQ ID NO: 43224 - DNA, 159 bp, Artificial Sequence
  Description of Artificial Sequence: Synthetic coding sequence
atggccgcccggagcctggcccggcgggccctgcgggtggccggaggagatgcccggagcggcggccctgtggcccgggacacccagctgggcgcccagtggcgctggattgctgagggcctggtggagaacctgaaccccccaggagcagatgcctag

SEQ ID NO: 43225 - DNA, 381 bp, Artificial Sequence
  Description of Artificial Sequence: Synthetic coding sequence
atgcccaactttgccaagagcctcttcatccaccccatcaacttcttcctgctcttcagcacagagttctgcagcgtgtcccaggccggcgtgcagtggagggacctgggcagcctgcagcccctgcccagccgcttcaacagagtgtcctgcctgagcctgcccagctcctgggactaccgcctgatgcctgtgatcccagccctgtgggaggccaaggccggcggcagccctgaggtgcggggcagccggctggcctggagcaagtggcagaaccctgtgtccaccaagaacaccaagaagccccagaactgccccggcatggtggcccacgcctgcagccccaactacagcggcggcggcggccgccgcatcacctag

SEQ ID NO: 43226 - DNA, 501 bp, Artificial Sequence
  Description of Artificial Sequence: Synthetic coding sequence
atgacagctggcaccgtggtgatcactggaggcatcctggccaccgtcatcctgctgtgcatcatcgctgtgctgtgctactgccgcctgcagtactactgctgcaagaaggatgagagcgaggaggatgaggaggagccagactttgctgtgcacagccacctgccccccctgcacagcaacagaaacctggtgctgaccaacggccctgccctgtaccccacagccagcaccagcttcagccagaagagcccccaggcccgggccctgtgccgcagctgcagccactgtgagccccccaccttcttcctgcaggagcccccagaggaggaggaggatgtgctgaatggaggagagcgggtgctgtacaagtctgtgtcccaggaggatgtggagctgcccaggggggccttcggcggcctgcaggccctgaaccccaaccggctgagcgccatgagggaggcctttgcccggagccgcagcatcagcacagatgtgtag

SEQ ID NO: 43227 - DNA, 1164 bp, Artificial Sequence
  Description of Artificial Sequence: Synthetic coding sequence
atgtaccgctggaagctgagcagccatgagccctgcagcgccacctgcaccaccggggtgatgtctgcctatgccatgtgtgtgcgctatgatggagtggaggtggatgacagctactgtgatgccctgaccaggcctgagcctgtgcatgagttctgtgccggccgggagtgccagccccgctgggagaccagctcctggagcgaatgttccaggacctgtggggagggctaccagttccgggtggtgcgctgctggaagatgctgagccctggctttgacagctctgtgtacagcgacctgtgtgaggccgctgaggccgtgcggcctgaggagaggaagacctgcagaaatcctgcctgtggcccccagtgggagatgtctgagtggagcgagtgcacagccaagtgtggggagaggtctgtggtgacccgggacatccgctgcagtgaagatgagaagctgtgtgaccccaacaccaggcctgtgggggagaagaactgcaccggccccccctgtgaccggcagtggacagtgtctgactggggcccctgcagcggcagctgtggccagggccgcaccatcagacatgtgtactgcaagaccagtgatggccgggtggtgcctgagagccagtgccagatggagaccaagcccctggccatccacccctgtggggacaagaactgcccagcccactggctggcccaggactgggagcgctgcaacaccacctgtggccggggcgtgaagaagaggctggtgctgtgcatggagctggccaacgggaagccccagaccaggagcggcccagaatgtggcctggccaagaagcccccagaggagagcacctgctttgagcggccctgcttcaagtggtacaccagcccctggagcgagtgcaccaagacctgtggggtgggcgtgaggatgagagatgtgaagtgctaccagggcacagacatcgtgcggggctgtgaccccctggtgaagcctgtgggccggcaggcctgtgacctgcagccctgccccacagagcccccagatgacagctgccaggaccagcccggcaccaactgtgccctggccatcaaggtgaacctgtgtggccactggtactacagcaaggcctgctgccgcagctgccggcccccccacagctag

SEQ ID NO: 43228 - DNA, 672 bp, Artificial Sequence
  Description of Artificial Sequence: Synthetic coding sequence
atgtttcctgtgagcagcggctgcttccaggagcagcaggagaccaacaagagcctgcccaggtctgccagcaccccagagaccaggaccaagttcacccaggacaacctgtgccacgcccagcgggagcggctggacagcgccaacctgtgggtgctggtggactgcatcctgcgggacaccagcgaggacctgggcctgcagtgtgatgctgtgaacctggccttcggccgccgctgtgaggagctggaggatgtgcgccacaagctgcagcaccacctgcacaagatgctgcgggagatcacagaccaggagcacaacgtggtggccctgaaggaggccatcaaggacaaggaggagcccctgcacatcgcccagacccggctgtacctgctgagccaccggcccaacatgcagctgtgccgggaggccgcccagttctctgctgtgggggaggccagcagaagaggagctgtgcccctgcagccccggggccacccccatgagcccggggagggctgctacagacatgaccagcagagcctgcacaggcctcctgaggtgcacggccccagctacctgctgcacccccaccctgctgctggctggctgcctgtgagcagcggcaccgtgctgccccccaacccccccaacaagcagtgcatctcctag

SEQ ID NO: 43229 - DNA, 390 bp, Artificial Sequence
  Description of Artificial Sequence: Synthetic coding sequence
atgtttcctgtgagcagcggctgcttccaggagcagcaggagaccaacaagagcctgcccaggtctgccagcaccccagagaccaggaccaagttcacccaggacaacctgtgccacgcccagcgggagcggctggacagcgccaacctgtgggtgctggtggactgcatcctgcgggacaccagcgaggacctgggcctgcagtgtgatgctgtgaacctggccttcggccgccgctgtgaggagctggaggatgcccggcacaagctgcagcaccacctgcacaagatgctgcgggagatcacagaccaggagcacaacgtggtggccctgaaggaggccatcaaggacaaggaggagcccctgcacatcgcccagacccggctgtag

SEQ ID NO: 43230 - DNA, 528 bp, Artificial Sequence
  Description of Artificial Sequence: Synthetic coding sequence
atgaggctgcccggggccccagccctgcctgatgctgacttcctggtgcacctgcacttcctggtgcagacctcctggttcatctgcaacttcctggtgcgcatcccctgggccagcgccctgcctgatgccccagccctgctggtgatcctggagaagaccttccctgagcacgccacctgccggggctgctgggtgtctggctacctgtgctggacagcccctggcaactgcatctgcagcgccaacgtgggcttcctgaagattgagaacacctaccggcagatccaccacacccacatgcaccgccacacccacacccacacagacaagagcatcacccacacctgcacagacacccacacccagagccagaggcaccggctgaccagccgggccctgcggctcttcatcctgaatgccatcacagacaccagcaagtttggagctgctgtgttcttctacgtgtactgcctgtttgctgacagcgtgtacaagttcttccccttcctgccccccttcagatag

SEQ ID NO: 43231 - DNA, 1941 bp, Artificial Sequence
  Description of Artificial Sequence: Synthetic coding sequence
atggaggtgatcaacctgaccaccctgcccatgatccctgtggatgagcacctggccgtgtccctggtggccaggaacaccatggtgaagacagtgaggaaggagctggagaacaacccccccagctgcctgattggctccatgcaccaggtgaaccagaagattgctgacatcaacctgaggacagagcccagcgccaacagcctggccatcgagagatttgagctggagaagaaggccctgcgggagaagaccaggagcagccctgaggacaaggtgaagaggcagaggaagagccagtacagctgcaagggcagcgagctgcggcatgcccggagcagcgtcatcaagaggaagacagctgacaagaacctgctggccgagctgtaccagtacagcaacttcaacagcagcaagcccaacaagctgcccaatggagtggacttctgtgacatggtgggcaatgtggtgcgggcagagcgggactgcctgagcggcaagcacttctgcagcggccgggagctggagaagttcctgagcagcagcagcccccgggccatctggctggacagcttctggtggatcttccacgagcgctaccagcccaacaaggagctgcagaacaacctgtttgaccgcatcgcccagcactacgccctgctgctcttccgggtgcccaagagccacagcgaggaggccctgctgaagaggctgcccagcctgctgagcaaggctgtgtacaccagcttctgctgctgcttcccccagagctggtttgacacccatgagttcaagagtgacatctgcaacaccatgagcctgtggatctctgtgggcacctaccccagcccccagagctatgacagctgggactacagcgagctggaccctgagcgcttcagaagagaggagctgatgctgtacagaagaaggctgaccaagggccgggagttcagcctgtttgctgggaagagggccttcagccagaagccagcccagagcaggaagttctaccacccccagagcagcagcgccaacagccccagcgagaagaccagcagcgccaagcagaacagcgagaagagcctgaggatgcagaacacagccaaggagcaccactgccagaccctggtgctgaagaagcccacccaggaggtgaagaggatcagcgaggcccgggagtgtgagaacatgttccccaagaagagctgtgccgcctgcaagagccctgagctgaccagcaacctcttcaacatctacggcaagagccccctcatcgtgtacttcctgcagaactatgccagcctgcagcagcacggcaagaatgtgctgattgtgagaagagagaagaccaccagcaccccagactgcacccccacctacacagatgtgatcagcgagaccctgtgcagcatgaagaagaggaaggacaacctgaaccagctgtaccagcaccactggacagagtggaactactttgacaagcacctgaaggagctgcaggacaacttcagccgggagatgaagaacatcgaccccaaggctgctgacaccaagaaggccaaccacatgttcatccccccatctgctgtgaatgaggagagcccagacaagaagaccaagggcagcctgcagcgggagattgagttcaagggctgcagcaacaagaaccacggcaagggccgctctgtgaacatgaggggcaaggaggagcgggagcgggaggagaagcagaagctgaacatctccttccacagcctgcccagccctgaggagctgcacaacctggagcccggcagcgcctaccgcatccgggacatcagcgccaccaggacccccctgcggcggcccagctcctgggagcccagcctcatctaccaggagcaggtgctgctgaagacccacaccctgtccatggaggaggacaagttccgctgctag

SEQ ID NO: 43232 - DNA, 876 bp, Artificial Sequence
  Description of Artificial Sequence: Synthetic coding sequence
atggatgtggtggaggtggccggctcctggtgggcccaggagcgggaggacatcatcatgaagtatgagaagggccaccgggccggcctgcctgaggacaagggccccaagagctttggcagctacaacaacaacgtggaccacctgggcatcgtgcatgaaacagagctgccccccctgacagcccgggaggtgaagcagatcagaagagagatcagcaggaagagcaagtgggtgaagatgctgggggagtgggacacctacaagaacagcaggaagctgattgaccgggcctaccagggcatccccatgaacatccggggccccatgtggagcgtgctgctgaacatcgaggagatcaagctgaagaaccctggccgctaccagatcatgaaggagaagggcaagaggagcagcgagcacatccagcagatggacctggatgtgtctggcaccctgcggcggcacatcttcttccgggacagatatggcaccaagcagcgggagctgctgtacatcctgctggcctatgaggagtacaaccctgaggtgggctactgccgggacctgagccacatcgccgccctcttcctgctgtacctgcctgaggaggatgccttctgggccctggtgcagctgctggccagcgagcggcacagcctgcagggcttccacagccccaacggcggcaccgtgcagggcctgcaggaccagcaggagcacgtggtggccaccagcctgcccaacaccatgtggcaccagagcgccagcagaagaagacctggggtggcccggggccacgtgtttggaacaggcagcctgatgcctggccctggcatgatgaccctgtgcagcagcatcctgggccccctgtag

SEQ ID NO: 43233 - DNA, 420 bp, Artificial Sequence
  Description of Artificial Sequence: Synthetic coding sequence
atgttcctgctgaagaagagcagcgagaagggctggtaccctgtgaaggagagccgggaccggggcccccggcgctggagccagggcctgagcaggaagaagaggaccttccccaccaagtcctggaggaagaagaccccaggcctgctgctgcccctgcccagcggctggcagcacggcagcctgcgggccggccaggtgctgcacctggatggagctggaggagacagcgaggctgatgtgctgatgatgctgcggcggctcatccggggccaggtgaagggcaccctgggctggagggtgggcattgctgtgcccaccacccccaccctgggcggctgcccccggcggctggaggtgtggtggtggctgctgctgctgctgctgctgctgctgctgctgctgctgctgctgctgtag

SEQ ID NO: 43234 - DNA, 666 bp, Artificial Sequence
  Description of Artificial Sequence: Synthetic coding sequence
atgtctgccctggtgttcttcccccccagcagccccctgcccatcgccttcttcccccccagcagccccctgcccatcgccttcttcccccccagcagccccctgcccatcgtgttcttccccagcctcttcagcatcttcctgcccccaccctacccccacctgctgctggccgccgccagcagctgccgggccttcctgagcccccaccacctgctcttcctgttccccaccgtgctgagcccccggcccctgctgagcctgagcagcccccgggccttccccaccaccgtcttcagccctgtgttcttccccagccaccgcttcctgcccatgagcagccaccggctggccgccgcctctgtgtccaggaacctgctgcccaccttcttcagccccccacccatcgtgttcttcccccagcccctcatcctgcggcacctgctgcccctgcccaccttcagccagcagaggctgcctgctgccttcttcagccccaggaccctcttcagccccctgcccctgcccaccgtgtttgccccagaccggctgctggcccaccccctgctggccctgagcaactgcctgagccccaggtctgccccccgggtgcggccccctgtgtccctgcggctggtgtgcctgtgtgcccagcctgccccctag

SEQ ID NO: 43235 - DNA, 1749 bp, Artificial Sequence
  Description of Artificial Sequence: Synthetic coding sequence
tgaccaggccccaccagcagcgccaccaacgtgtccatggtggtgtctgctggccccctgagcagcgagaaggccgagatgaacatcctggagatcaatgagaagctgcacccccagctggccgagaagaagcagcagttcaggaacctgaaggagcgctgctttgtgacccagctggccggcttcctggccaaccagcagaagaagtacaagtatgaggagtgcaaggacctgatcaagtccatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggagctggccgagaaggtgcagaagagcagcgccccccgggagatgcagaaggccgaggagaaggaggtgcctgaggacagccaggaggagtgtgccatcacctacagcaacagccacggcccctatgacagcaaccagccccacaggaagaccaagatcacctttgaggaggacaaggtggacagcaccctgattggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctggaccgctgctacagcaccccatctggctgcctggagctgacagacagctgccagccctacagaagtgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcacccccagcggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagagaagaggccgccgctcctag

SEQ ID NO: 43236 - DNA, 474 bp, Artificial Sequence
  Description of Artificial Sequence: Synthetic coding sequence
accctggccgaccaccgccaccggggcacagactttggaggcagcccctggctgctgatcatcaccgtcttcctgcggagctacaagtttgccatcagcctgtgcaccagctacctgtgtgtgtccttcctgaagaccatcttccccagccagaatggacatgatggcagcacagatgtgcagcagagggcccggcgcagcaacagaagacggcaggagggcatcaagatcgtgctggaggacatcttcaccctgtggaggcaggtggagaccaaggtgcgggccaagatctgcaagatgaaggtgaccaccaaggtgaacagacatgacaagatcaatggcaagaggaagacagccaaggagcacctgaggaagctgtccatgaaggagcgggagcacggggagaaggagcggcaggtgtctgaggccgaggagaatggcaagctggacatgaaggagatccacacctactag

SEQ ID NO: 43237 - DNA, 516 bp, Artificial Sequence
  Description of Artificial Sequence: Synthetic coding sequence
atggccgagatgagggcctggaggcccctggtgcggcccagcctgcagtgtgtgaagctgggccgggccacagcccgctggtggtgggtggtgaaggtgaagccccatgacaaggatgccaagatgaagtaccaggagtgcaacaagatcgtgaagcagaaggcctttgagcgggccatcgctggagatgagcacaagaggtctgtggtggacagcctggacattgaatccatgaccatcgagggggagtacagcggccccaagctggaggatgacaaggtgaccatcaccttcatgaagggcctgatgcagtggtacaaggaccagaagaagctgcaccagaagtgtgcctaccagggcctggccctgagcccccggctgaagtgcagcggcaccatcacagcccactgcagcctgaacctgctgggcccccgggacccccccaccagcgccagccaggtggccgtgacagagggcatgcaccaccacacctggctgatcttcctgttcctgtag

SEQ ID NO: 43238 - DNA, 96 bp, Artificial Sequence
  Description of Artificial Sequence: Synthetic coding sequence
atgctggaggccatcctgggccctgtgagcaacagcctgtatgtgtctgggaagacctgccacggcagccgctctgtgttcagcagcgccaagtag

SEQ ID NO: 43239 - DNA, 225 bp, Artificial Sequence
  Description of Artificial Sequence: Synthetic coding sequence
atgagcaaggcccaccccccagagctgaagaagttcacagacaagaagttcagcctgaagctgaatggaggccgccacgtgcagggcatcctgcggggctttgaccccttcatgaacctggtgattgatgaatgtgtggagatggccaccagcggccagcagaagaacatcggcatggtggagatccggggcaacagcatcatcatgctggaggccctggagtag

SEQ ID NO: 43240 - DNA, 1893 bp, Artificial Sequence
  Description of Artificial Sequence: Synthetic coding sequence
atggaccccagctggaggaggagcagccacagctggccccagcccatgccagattctggccgggcccctgtgcggccccacctggccaagctggaggaggatgtgtggccctgcccccagttccaccagaccaaggccgccagcggccccccatttgtgaatgaggccaacagcaagtggctggatgcccactatgaccccatggccaacatccacaccttcagcgcctgcctggccctggccgacctgcatggagatggagagtacaagctggtggtgggggacctgggccctgggggccagcagccccggctgaaggtgctgaagggccccctggtgatgacagagagccccctgcctgccctgcctgctgctgctgccaccttcctgatggagcagcacgagcccaggaccccagccctggccctggccagcggcccctgtgtgtatgtgtacaagaacctgcggccctacttcaagttcagcctgccccagctgccccccaaccccctggagcaggacctgtggaaccaggccaaggaggacagaattgaccccctgaccctgaaggagatgctggagagcatccgggagacagctgaggagcccctgagcatccagagcctgcgcttcctgcagctggagctgtctgagatggaggcctttgtgaaccagcacaagagcaacagcatcaagaggcagaccgtcatcaccaccatgaccaccctgaagaagaacctggctgatgaagatgctgtgtcctgcctggtgctgggcacagagaacaaggagctgctggtgctggaccctgaggccttcaccatcctggccaagatgagcctgcccagcgtgcctgtgttcctggaggtgtctggccagtttgatgtggagttccggctggccgccgcctgcagaaatggaaacatctacatcctgcggcgggacagcaagcaccccaagtactgcatcgagctgagcgcccagcctgtgggcctcatccgggtgcacaaggtgctggtggtgggcagcacccaggacagcctgcacggcttcacccacaagggcaagaagctgtggacagtgcagatgcctgctgccatcctgaccatgaacctgctggagcagcacagccggggcctgcaggccgtgatggccggcctggccaatggagaggtgcgcatctacagagacaaggccctgctgaatgtcatccacaccccagatgctgtgaccagcctgtgcttcggccgctatggaagagaggacaacaccctcatcatgaccacccggggcggcggcctcatcatcaagatcctgaagaggacagctgtgtttgtggagggcggcagcgaggtgggccccccaccagcccaggccatgaagctgaatgtgcccaggaagacccggctgtatgtggaccagaccctgcgggagcgggaggccggcacagccatgcaccgggccttccagacagacctgtacctgctgcggctgcgggccgcccgggcctacctgcaggccctggagagcagcctgagccccctgagcaccacagcccgggagcccctgaagctgcatgctgtggtgcagggcctgggccccaccttcaagctgaccctgcacctgcagaacaccagcaccaccaggcctgtgctgggcctgctggtgtgcttcctgtacaatgaggccctgtacagcctgccccgggccttcttcaaggtgcccctgctggtgcccggcctgaactaccccctggagacctttgtggagagcctgagcaacaagggcatcagtgacatcatcaaggtgctggtgctgcgggagggccagagcgcccccctgctgagcgcccacgtgaacatgcctggcagcgagggcctggccgccgcctag

SEQ ID NO: 43241 - DNA, 474 bp, Artificial Sequence
  Description of Artificial Sequence: Synthetic coding sequence
atggtgggccgcatgaagctgctgcccaaccgcatccgcaccctggccctgacagccatcggcgtggtgctgctgggcgtggatgaccccggggcccccagcgaccaggtggaggtgcacctggagctggacctgcccacccagctgacctctgtgtggcaggtgatgagcacagtgcccctggcccccctgcccggccagctgagcctgctgggccccccaggggccctgggcttcccccagcagggcggccccacccagctgcccctgctgctgcgggaggtgggcgtggagcacaaggagcacatcggcggccgccgctgtggcggccccaggcctgccctgagcagctacccaggccacctgctgctgcagggcccccgggtgctgcagcccctgggggagaggcctggccacctgcagaaccacgccgcccagggcaagggggacctgggccagagcgacagcgagtag

SEQ ID NO: 43242 - DNA, 738 bp, Artificial Sequence
  Description of Artificial Sequence: Synthetic coding sequence
aaggagggggaggaggaccagaaccccccctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggacaggaccaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgagccgggagctgctggatgagaagggccctgaggtgctgcaggacagcctggacaggagctacagcacccccagcggctgcctggagctgacagacagctgccagccctaccgcagcgccttctacgtgctggagcagcagagggtgggcctggccgtggacatggatggagagtacctgtccatgtag

SEQ ID NO: 43243 - DNA, 258 bp, Artificial Sequence; identical to SEQ ID NO: 40267
  Description of Artificial Sequence: Synthetic coding sequence

SEQ ID NO: 43244 - DNA, 927 bp, Artificial Sequence
  Description of Artificial Sequence: Synthetic coding sequence
atgcacacccaggtgtgtgcccacacctacatccgcatgcaccgccacctgtgcacccacatgcagatccacccccagcaccccatctgtgccacccaccgccaccgctacatggagacagatgcccacacaggcctgtgcacccacatccgcatgcaccgccacctgtgcacccacatgcagatccacccccagcaccccatctgtgccacccaccgccaccgctacatgaagacagatgcccacacaggcctgtgcacccacgtgtgcatgcaccgccacctgtgcacccacatgcagatgcacccccagtaccccatctgtgccacccaccgccacacctacatggagacagatgcccacacaggcctgtgcacccacgtgcacatgcaccgccacctgtgcacccacatgcagatgcacccccagtaccccatctgtgccatccaccgccacacctacatggagacagatgcccacacaggcctgtgcacccacgtgcacatgcaccgccacctgtgcacccacatgcagatgcacccccagtaccccatctgtgccacccaccgccacacctacatggagacagatgtgcacacaggcctgtgcacccacgtgcacatgcaccgccacctgtgcacccacatgcagatgcacccccagtaccccatctgtgccacccaccgccacacctacatggagacagatgcccacacaggcctgtgcacccacgtgcacatgcaccgccacctgtgcacccacatgcagatgcacccccagtaccgcatctgtgccacccagacctacgtgcatggagaccgctgcacctaccgctccatgcacacctgcacccacgcccaggcccctggccacaccctgtacctgctgatctgcagcagccccccctgccgcctgctgggccgctag

SEQ ID NO: 43245 - DNA, 300 bp, Artificial Sequence
  Description of Artificial Sequence: Synthetic coding sequence
atgtgggagcactggctgggggacagcggcgtgggcctgctgatgaggctgcggagtgatgtgtcccaggtgtgcctgcagctgaatgcctgtgtggaggtggaggaccccctgcccggctggctgacccactgcctgcccggccgggccggctgctggtgggaggcctctgtgcccttccacggctgcttccagtacagctgtggcatccccccagagcaggtgatgaaggagaacaaggccgaggccgctgtgctcttcaccgccagcttccgcagccacgtgcccagcgacctgtag

SEQ ID NO: 43246 - DNA, 315 bp, Artificial Sequence
  Description of Artificial Sequence: Synthetic coding sequence
atggccgccctgatcccccagggcttcagctgcctgagccgggtgctgggctggtggagccggcagcctgtgctggtgacccagagcgctgccatcgtgcctgtgaggaccaagaagcgcttcaccagccccatctaccagcccaagttcaagacagagaaggagttcatgcagcacgccaggaaggccggcctggtgatccccccagagaagagtgacaggagcatccacctggcctgcacagctggcatctttgatgcctacgtgcccccagaaggagatgcccgcatcagcagcctgagcaaggagaggtag

SEQ ID NO: 43247 - DNA, 366 bp, Artificial Sequence
  Description of Artificial Sequence: Synthetic coding sequence
atgagcctgaccttccggcggcccaagaccctgcggctgcggcggcagccccgctaccccaggaagagcacccccaccaggaacaagctgggccactacgccatcatcaagttccccctggccacagagagcgctgtgaagaagattgaggagaacaacaccctggtgttcaccgtggatgtgaaggccaacaagcaccagatccggcaggccgtgaagaaggtgtatgacagtgatgtggccaaggtgaccaccctcatctgcccagacaaggagaagaaggcctacgtgcggctggccccagactatgatgcctttgatgtggtgaccaagctgggcagccccaagctgagccctgctggatag

SEQ ID NO: 43248 - DNA, 1569 bp, Artificial Sequence
  Description of Artificial Sequence: Synthetic coding sequence
atgtggccccagccccggctgcccccccacccagccatgtctgagaagacccagcagggcaagctggccgccgccaagaagaagctgaaggcctactggcagaggaagagccctggcatcccagctggggccaacaggaagaagaaggtgaatggcagcagcccagacacagccaccagcggcggctaccacagccctggggacagcgccaccggcatctacggggagggccgggccagcagcaccaccctgcaggacctggagagccagtaccaggagctggccgtggccctggacagcagcagcgccatcatcagccagctgacagagaacatcaacagcctggtgaggaccagcaaggaggagaagaagcatgagatccacctggtgcagaagctgggccgcagcctcttcaagctgaagaaccagacagctgagcccctggcccctgagcccccagctggccccagcaaggtggagcagctgcaggatgagaccaaccacctgaggaaggagctggagagcgtgggccggcagctgcaggccgaggtggagaacaaccagatgctgagcctgctgaacagacggcaggaggagcggctgcgggagcaggaggagcggctgcacgagcaggaggagcggctgcacgagcaggaggagcggctgtgtgagcaggaggagcggctgcgggagcaggaggagcggctgcgggagcaggaggagcggctgcgggagcaggaggagcggctgcacgagcaggaggagcggctgcacgagcaggaggagcggctgtgtgagcaggaggagcggctgcgggagcaggaggagcggctgtgtgagcaggaggagcggctgcgggagcaggaggagcggctgtgtgagcaggaggagcggctgcgggagcaggaggagcggctgtgtgagcaggaggagcggctgtgtgagcaggaggagcggctgtgtgagcaggagaagctgcccggccaggagcggctgctggaggaggtggagaagctgctggagcaggagcggcggcaggaggagcaggagcggctgctggagcgggagcggctgctggatgaggtggaggagctgctggagcaggagcggctgcggcagcaggatgagcggctgtggcagcaggagaccctgcgggagctggagcggctgcgggagctggagcggctgcgggagctggagaggatgctggagctgggctgggaggccctgtatgagcagagagctgagcccaggagcggctttgaggagctgaacaatgaaaacaagagcaccctgcagctggagcagcaggtgaaggagctggagaagagcggcggcgctgaggagccccggggcagcgagagcgctgctgctgcccggcctgtgcctggggcccctgtgccccagggcgcctggatgtgtggccaggccggctggaccccccaggagcaccctggcctgagcggggaggccgtgggcaccggggaggccgccggcggcgctgaggaggccgcctgccacagcttccgggcagcagaaaatcgggagctgaacatcaccatcatctag

SEQ ID NO: 43249 - DNA, 783 bp, Artificial Sequence
  Description of Artificial Sequence: Synthetic coding sequence
atgctgagaaatgagctgcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgatgaagatgaagatgaagatgtgcaggtggaggaggatgagaaggtgctggagagcagcagcccccgggagatgcagaaggccgaggagagcaaggtgcctgaggacagcctggaggagtgtgccatcacctgcagcaacagccacggcccctgtgacagcaaccagccccacaagaacatcaagatcacctttgaggaggacaaggtgaacagcagcctggtggtggaccgggagagcagccatgatgagtgccaggatgccctgaacatcctgcctgtgcccggccccaccagcagcgccaccaacgtgtccatggtggtgtctgctggccccctgagcagcgagaaggccgagatgaacatcctggagatcaatgagaagctgcggccccagctggccgagaagaagcagcagttccgcagcctgaaggagaagtgctttgtgacccaggtggcctgcttcctggccaagcagcagaacaagtactag

SEQ ID NO: 43250 - DNA, 303 bp, Artificial Sequence
  Description of Artificial Sequence: Synthetic coding sequence
atggccaagaacaagttccggggccagaagagcagaaatgtgttcagaattgccagccagaagagcttcaaggccaagaacagagtgaagcccatcacagccaacctgaagaagatccacatcatgaatgatgagaaggtgtcccgggtgaacaaggccttcggctctgtgcaggaggagctgccccacttcagcaagggcctgagcctggacctgctgcagaaggagctgatcccccagcagaggcaccagagcaagcctgtgaatgtggatgaggccaccaagctgatggcccagctgtag

SEQ ID NO: 43251 - DNA, 1659 bp, Artificial Sequence
  Description of Artificial Sequence: Synthetic coding sequence
atgctgaagagccgcatctccatgaggagccgccacccccggcgggccatcagcgagggccacaagtctgagggcaccatgccacccaacaaggaggccagcggcctgagcagcagccctgctggcctcatctgcctgccccccatcagcgaggagctgcagctggtgtggacccaggccgcccagaccagcgagctggacagcaatgagcacctgctgaagaccttctcctacttcccctaccccagcctggccgacatcgccctgctgtgcctgcgctatggcctgcagatggagaaggtgaagacctggttcatggcccagaggctgcgctgtggcatctcctggagcagcgaggagattgaggagacccgggcccgggtggtgtacagaagagaccagctgcacttcaagagcctgctgtccttcacccaccacgccggccggcccccagaggaggtgcccccacctcctgtgcctgcccctgagcaggtgggcattggaattggcccccccaccctgagcaagcccacccagaccaagggcctgaaggtggagcctgaggagcccagccagatgccacccctgccccagagccaccagaagctgaaggagagcctgatgaccccaggcagcggggccttcccctaccagagcgacttctggcagcacctgcagagcagcggcctgagcaaggagcaggccggccggggccccaaccagagccatggaattggaacagcctcctggaaccacagcaccaccgtgccccagccccaggcccgggacaagcccccacccatcgccctgattgccagcagctgcaaggaggagagcgccagctctgtgacccccagcagcagcagcaccagcagcagcttccaggtgctggccaatggagccacagctgccagcaagcccctgcagcccctgggctgtgtgccccagagcgtgagccccagcgagcaggccctgcccccccacctggagcccgcctggccccagggcctgcggcacaacagcgtgcccggccgggtgggccccacagagtacctgagcccagacatgcagaggcagaggaagaccaagaggaagaccaaggagcagctggccatcctgaagagcttcttcctgcagtgccagtgggcccggcgggaggactaccagaagctggagcagatcaccggcctgcccaggcctgagatcatccagtggtttggagacaccaggtatgccctgaagcacggccagctgaagtggttccgggacaatgctgtgcctggggcccccagcttccaggaccctgccatccccaccccaccacccagcaccaggagcctgaatgaaagagctgagaccccacccctgcccatccccccacctcctccagacatccagcccctggagcgctactgggccgcccaccagcagctgcgggagacagacatcccccagctgagccaggccagccggctgagcacccagcaggtgctggactggtttgacagccggctgccccagcctgctgaggtggtggtgtgcctggatgaggaggaggaggaggaggaggaggagctgcctgaagatgatgaggaggaggaggaggaggaggaggaggatgatgatgatgatgatgatgatgtgatcatccaggactag

SEQ ID NO: 43252 - DNA, 528 bp, Artificial Sequence
  Description of Artificial Sequence: Synthetic coding sequence
atgaaggtgaccaccaaggtgaacagacatgacaagatcaacgggaagaggaagacagccaaggagcacctgaggaagctgtccatgaaggagcgggagcacggggagaaggagcggcaggtgtctgaggccgaggagaatggcaagctggacatgaaggagatccacacctacatggagatgttccagagggcccaggccctgcggcggcgggcagaggactactaccgctgcaagatcaccccatctgccaggaagcccctgtgcaacagagtgtccctgctggtgttcctggccttcggccacagcctgcccggccaggacatggacaccttcttcagcctgcggctgtgtgcccaggccctgcagcgggagatggccgagaggaaggccgcctacaagcaccacagccccatccctgtgggcaacagagtggcccagaagcacctgcacccccaccctgtgggcccccccagcaacatcctgtctgtgcggggcagcatctttgtgattgccaacggcccctag

SEQ ID NO: 43253 - DNA, 228 bp, Artificial Sequence
  Description of Artificial Sequence: Synthetic coding sequence
atgagcaagctggtgtacctgtacatgctgcgggtgtacatcagcaacatcaacagcaacagcgtggtgtacatcttcatcagcatccctgtgacccacagcctggacaactggaccttcctggtgtcctttgagatcggcaagtatgagagcagcaactttgtgctcttccatgactacagcggctacgtgcggcccctgagcatcccctatgagctggagggctag

SEQ ID NO: 43254 - DNA, 390 bp, Artificial Sequence
  Description of Artificial Sequence: Synthetic coding sequence
atgctgtgcccctgcatccaggagagcacctttgagacctgcctcttcatggctgtgtccaggatgagcaagtggaggctgagccgggtgggcggcagccgcagcctgcctgctgagatggaggtgctgggggaggtgtggtgtgtgcgggcagaggagcagcccatgacaggcctgggcatcgtgtggcacagccccctggacaaggccctggagacctggagcctgcagcagcagcctgacttcagcctgggcctgggccacctgggcctgggcctgtacatcctggccagctacctgctgtgcccccggcagccccccagccagccagatggcccctgtggcagccccaaccctgtgtctggggccaagaagaccaccgtggcctag

SEQ ID NO: 43255 - DNA, 288 bp, Artificial Sequence
  Description of Artificial Sequence: Synthetic coding sequence
ggcaggaaggagggggaggaggaccagaaccccccctgcccccggctgaacagcgtgctgatggaggtggaggagcctgaggtgctgcaggacagcctggaccgctgctacagcacccccagcatgtactttgagctgcctgacagcttccagcactacagatctgtgttctacagctttgaggagcagcacatcagctttgccctggacatggacaaccgcttcttcaccctgactgtgaccagcctgcacctggtgttccagatgggcgtcatcttcccccagtag

SEQ ID NO: 43256 - DNA, 543 bp, Artificial Sequence
  Description of Artificial Sequence: Synthetic coding sequence
atgggcctgggcgctgtggagcaggaggccgccctggccggggaggccccagctgcccaggtgcccacagaaggagtgggcggcagcggcatggccggctgccgcagccgggccctgcccctgggcaaggccgcccgggcccctggagaaattgaaagatctgctgggggcagcgccctgctgggggaccctgtgcaccccccccagcccctggcccgggtgctgagccccagcctgcccggggccggccgggcctgccgcctgctgcgggtgcgggccgccaagctgacccccacccagaacagctcctggccagcctctgtggcctgcagccctggcagctgcagccacctgagcctgcacaccagcctgcaggccgagggcgccggcagcggcctgggcaagcccaggaagggcctgccccagtgcagcggcggcctgaagggcagcagcagcgctgccaaggtgggcgcccaggccgaggaggccccccgggccagcgagggcagcgaggactgccagcacgctgtgaccagccactag

SEQ ID NO: 43257 - DNA, 390 bp, Artificial Sequence; identical to SEQ ID NO: 43254
  Description of Artificial Sequence: Synthetic coding sequence

SEQ ID NO: 43258 - DNA, 417 bp, Artificial Sequence
  Description of Artificial Sequence: Synthetic coding sequence
atgatcttcccccagatctacctggactacttcaagatgaggcaggactactgccagagcctgaatgtgtggagctacctgccctggatcttcttctcctttggcctgggcttcatcaacaacctgaacatcatctcctaccgcatcaccaaggaggaggtgaacctgatccacctgcggctgcagcccaagatccagagcaacagcagcttcagcctgagctgcttcttcttcatgttcctgctgctgattgctgcccgcatcctgcaccgcatcagcattgagatgtatgagatcctgtggagcctgcacgtgagaattgcccagtatgtgaccatccagttccagcgggagcccacctttgtgcgcttcacagaccagggcgtggtggaggaggtggagctgcagatcagatag

SEQ ID NO: 43259 - DNA, 504 bp, Artificial Sequence
  Description of Artificial Sequence: Synthetic coding sequence
atggagcaggagcacatcccccactggatccagaccagcgccttcagcggcggcctgggccgctcctggtgcaagatccgctgcatggcccgggccggcctgcctgtgcacatggtgaatggagaccctgacaccggccggcccctgctgacagcccctggggccaagcagcccccccggggctggaggcggcaggccggcagcagctgcagccgggcccggggcgtgtggaggggggccctggccagccggcagggcgcccagaggggcagcaagggccctggggtgagccaccagagctatggagtggagggcctgggcagctctgtgtgccctgtgacctggcacctgcgggccctgccccggcagctgtgtgatgccagccaccagacagcctgcatcaagagcggcgtgtgcagcagcctgaagtggaggaggcctgaggccctggaccggcgcagccacatcctggagggctctgtgctgggccaccgctgcccctag

SEQ ID NO: 43260 - DNA, 1158 bp, Artificial Sequence
  Description of Artificial Sequence: Synthetic coding sequence
atggcctacctgggcccctaccccaccagccggcagcccccccagatgaggctgctgccccacaacagcctgcaccgccacagcagcatcgtgaccatggccagcctggaccctgccccagccagccagcccagcctgcaggccctgaacttcctgaagagcaccagccctggccctgcccacgccagcctgcagcccctgcaggcccagctgctgcacctgggcggccccagccggcccagcctgtgcctgcccagcgccagcacagtgcccaccagcgccagccagcagatcctgcacgcccagcacctgccccactgcggcccccccaagcccagcagccagcccttcagcagcttctacacccccagcagccggctgcctgtggccagcagcggcccctggggcagcttcctgaccacagccttccctggccctgtgttccccttcagaagacccctgcgggcccagaacctgctgaagagcgccagcccagaccccctggcccccagcggccgcagcctgcgggcccagctgttcttcctggtgggcagccctggccccatcccagccagccagcagcccctgtggacccagtgcctgcccatctcctggaggccctggagcgcccacagcttcctgaagcccagcagccctggccctggccaggccagccgctggcccctgcaggatgagctgctgcccagtgatggcatcagccggccccagatggtgtctggccgctgggccccaccccggcagggctgggccagcagaagaccaccccaggcccaggtggtgctgaagagcggcagccctggccctgccagccagcaggtgtccaagctgttctggctgaacagctgcccagcccccaaccggctgtgccggcccaggaccttcagcagccaggccctgcgggcccacctgctgcccccaggcggcctgtacagcagcagcacaggctggaggacagccagcgctggccccagcctggccagccagggccccctgcaggcccagctgctgcccccccggcggcccccaggggccaagagcctgcctgccagccagcagcctgcctgtggccctgccccacccagccgctggcctgtggatgcccagctgatgcccctggccccctgcccagaggcctag

SEQ ID NO: 43261 - DNA, 423 bp, Artificial Sequence
  Description of Artificial Sequence: Synthetic coding sequence
atgggcggccctgagaccaagggcctggagggggacccccacatgcaccacttcctgctcttcaccgtgtgctgggagagcagccgggccctgtgccagatgccccaggaggagaaccccccccagtgcaccgtgaaggatgacacagccctgctgcccaatgacacccggcccagctggtgcctgtacatggtggatgctggctctgtgggccccagcgtgctgggcctggtgagaagagagagcacccaggagcagagcgccagcgagaggagctctgtggcccccccagctggggccaacagagacagccaccggcccctggccgactggcccaccctgcccaccagcctgctgaccagcagcctggtgttccagaagggggagaccaccatcaaggacaagaggaagggccgctactag

SEQ ID NO: 43262 - DNA, 375 bp, Artificial Sequence
  Description of Artificial Sequence: Synthetic coding sequence
atgaccccaaatgagcacccagccttcaagcacctgttcaacaaggcccacctggccccacccctcatccacctgaccctgagcggccacagcacctgcttccgggagcaccgggtgggcggcaaggtgacagaccagcaggaccccaaggccgaggagttcttcctggtgcagaacaagatgaagagcctgccctgcctgctgctgagcacccagacccggcagcccagcgacttcagcatcttcagcccccccttcctgcccttctacagcaccaagccacccctgagctcctggcctgtgctgaatgagctgctgggcaccccaccaagaagaggaggcggccgggcagagggcctgctgaccagccagtag

SEQ ID NO: 43263 - DNA, 465 bp, Artificial Sequence
  Description of Artificial Sequence: Synthetic coding sequence
atgggcctgtggcagcagatcagcaactgcatgccagacctggccctgtgcagcgacatcaagttcttcctgcgctgcctggagcgctggctgaacagaaacagcagcgccctgcagctgcctgcccggagcacccagaaggagatcatcagcgccttccccaccaaggtgcccagcagcagccactgggactggctggacagcggctgcagcccccagaaggccagccgcagccgggtgggctgctgcctgacccgggaggcccagggcgtgcgggagctgccccccctggccaagggcagctgtgagggcctgtgccgggaggagcggggcatcccagcccagatcctgtgcttcccccacggcctgtgcaacccccagacccggcgcttcccctgggtgcctgcccctcctggcccctgggtgagcagcaagaagctgggcagccacctgggccgccactag

SEQ ID NO: 43264 - DNA, 168 bp, Artificial Sequence
  Description of Artificial Sequence: Synthetic coding sequence
atggtgcagagcgcctctgtgtccaaggccggcaagggcagcagcagcagccacggcgtggccgccgccctgaaccaggacctggaccctgaccccaagtgccacgtgttcaacgtgagcagccagcgctgccagatgggcagcgcccagccctgcctgtgctgctag

SEQ ID NO: 43265 - DNA, 621 bp, Artificial Sequence
  Description of Artificial Sequence: Synthetic coding sequence
atgcaccacaacaagcaggccacagaaaatgccaaggaggaggtgcggcgcatcctgggcctgctggatgcctacctgaagaccaggaccttcctggtgggggagcgggtgaccctggccgctgagcccaaggccaaggacccctttgcccacctgcccaagagcacctttgtgctggatgagttcaagaggaagtacagcaatgaagacaccctgtctgtggccctgccctacttctgggagcactttgacaaggatggctggagcctgtggtacagcgagtaccgcttccctgaggagctgacccagaccttcatgagctgcaacctgatcaccggcatgttccagaggctggacaagctgaggaagaatgcctttgccagcgtcatcctgtttggcaccaacaacagcagcagcatctctggagtgtgggtgttccggggccaggagctggccttccccctgagcccagactggcaggtggactatgagagctacacctggaggaagctggaccccggccgggaggagacccagaccctggtgcgggagtacttctcctgggagggcgccttccagcacgtgggcaaggccttcaaccacggcaagatcttcaagtag

SEQ ID NO: 43266 - DNA, 498 bp, Artificial Sequence
  Description of Artificial Sequence: Synthetic coding sequence
atgagctgcagccgcagccgcagcctggaggccagcagcagccggggcaccctgcctgcctcctgggtgcggggcagccgctgcctgggcagcagctttgctgatgagggccaggcccccctgcatgctgaccggccccgcttctttggaacagtgctgaccagcttccccagcgagaagctggccgccaaggccctgctgtggggcgccctgaacttcttcctgggccccaactggagcgagagcgagttcccctggcccagcttcctgcccatcctgggcgccggcggcgctgtggacttcctgccccgggacctcttcatcatcttcctgtgcagcgtgctgccccggcccagcgctgtgcctgccagcccccccagccccttcagcctgctgccccccttccccaccctgcccctgagccccttcagcctgagccgcatcctgggctgcagcaaccagagagctgtgtccctcttcttcccccactactgctag

SEQ ID NO: 43267 - DNA, 1158 bp, Artificial Sequence
  Description of Artificial Sequence: Synthetic coding sequence
atggcctacctgggcccctaccccaccagccggcagcccccccagatgaggctgctgccccacaacagcctgcaccgccacagcagcatcgtgaccatggccagcctggaccctgccccagccagccagcccagcctgcaggccctgaacttcctgaagagcaccagccctggccctgcccacgccagcctgcagcccctgcaggcccagctgctgcacctgggcggccccagccggcccagcctgtgcctgcccagcgccagcacagtgcccaccagcgccagccagcagatcctgcacgcccagcacctgccccactgcggcccccccaagcccagcagccagcccttcagcagcttctacacccccagcagccggctgcctgtggccagcagcggcccctggggcagcttcctgaccacagccttccctggccctgtgttccccttcagaagacccctgcgggcccagaacctgctgaagagcgccagcccagaccccctggcccccagcggccgcagcctgcgggcccagctgttcttcctggtgggcagccctggccccatcccagccagccagcagcccctgtggacccagtgcctgcccatctcctggaggccctggagcgcccacagcttcctgaagcccagcagccctggccctggccaggccagccgctggcccctgcaggatgagctgctgcccagtgatggcatcagccggccccagatggtgtctggccgctgggccccaccccggcagggctgggccagccggcggctgccccaggcccaggtggtgctgaagagcggcagccctggccctgccagccagcaggtgtccaagctgttctggctgaacagctgcccagcccccaaccggctgtgccggcccaggaccttcagcagccaggccctgcgggcccacctgctgcccccaggcggcctgtacagcagcagcacaggctggaggacagccagcgctggccctgccctggccagccagggccccctgcaggcccagctgctgcccccccggcggcccccaggggccaagagcctgcctgccagccagcagcctgcctgtggccctgccccacccagccgctggcctgtggatgcccagctgatgcccctggccccctgcccagaggcctag

SEQ ID NO: 43268 - DNA, 510 bp, Artificial Sequence
  Description of Artificial Sequence: Synthetic coding sequence
atggtgccccgggccccaccctgtgcctggctgcggcctggaagaagagcccaggccggggagggcccccgggaccctggaaatgctgcctggaggaccaggagaacaggcttccctgaggccaccggccctgcccggcacctgcagctgctgtatgtggactttggccgctggacccacggccggcctgtgcccctgtgcagagctggctggaggccccagtgccctggagctgctgctgccctgggcctggccggcctgggggaccacatctggcccccaggccgcacagtgccccaggaccccccagcctgggccccacccagcagcctggcccacagcctgggcgcccctgtgggcgctggggccgccggctgcccctgtggccctgccatccacaggcctgcccacgccgccagccccagcacctgcctgcccaccccaccccagccccccaccagccacctggaggagaccatgggccctgcccccccagcccctggctgctag

SEQ ID NO: 43269 - DNA, 783 bp, Artificial Sequence
  Description of Artificial Sequence: Synthetic coding sequence
atgggagacaacctgtggctgggcctgcgggcccaggacccctggagggccctgcggcctgcccagagcccccgggcctgccggccccatgctgactgtggggaccagggcttccggaggaaggcccagaccccccagctgaaccccccaacagaccacaaggtgcctgagcagagagatgagggcgctgtgcacctgctgagccggcccggccgggcccggccccagatccggcgggccccagccccccacaacagcaggaccaccacagctgggggcctgcccagcatccggcccggccggcctgagcccccaccagccctgagtgaccacctgggcgccggcctgtctgtgctgagccaggatggagctgtgcgcatccccccccagggcctgcctgacctgctggagctgcggagagatgcccccaccctggagagcaggcctgctgctgctgccctgagcctgctcttccaggccgccagcagcgctgcccggcgggccatgagccctgcccaggagacctacagcagcagcccccaccccctgcggcggctggaccgcttccggcccctggaggccacctggggcggcccccactggaagcccctgcccggcatccacagcgtgcccaaggcctacagcacagagaacagccgcagcggccgctgcaagccaggcctggtgggcgcctgccgggccagccccaccccagacaccccacctggggtgggcgctgagcagagcagcggccagcccctgaccacccgctgcaggacatag

SEQ ID NO: 43270 - DNA, 1224 bp, Artificial Sequence; identical to SEQ ID NO: 43176
  Description of Artificial Sequence: Synthetic coding sequence

SEQ ID NO: 43271 - DNA, 390 bp, Artificial Sequence
  Description of Artificial Sequence: Synthetic coding sequence
atgtgctgcaactactacggcaacagctgtggctacggcagcagctatggctgcggctacggcagcggctacggctacggctacggcagcagctatggctgcggctacggcaccggctacagctgtggctacggctgcggctacggcagcggctacggctgcggctacggcagcagctatggctgcggctacggcaccggctacagctgtggctacggcagcggctacagctgtggctacggcagcggcagcggctgcggctacggcaccggcttcggctgcggctacggctgcggctacggcaccggctacggctgcggctgcggcagcggcagcggctactgcggctaccggcccttctgcttccgccgctgctacagcagctgctag

SEQ ID NO: 43272 - DNA, 144 bp, Artificial Sequence
  Description of Artificial Sequence: Synthetic coding sequence
atggccctgccccagggcctgctgaccttcagagatgtggccatcgagttcagccaggaggagtggaagtgcctggaccctgcccagaggaccctgtacagagatgtgatgctggagaactacagaaacctggtgtccctgtag

SEQ ID NO: 43273 - DNA, 1170 bp, Artificial Sequence
  Description of Artificial Sequence: Synthetic coding sequence
atgctgctgcccccaggcagcctgagccggcccaggaccttcagcagccagcccctgcagaccaagctgatgacccacaacggcctcttccggcccatcccctacgtgacagctgccagcgcagatgaggccacagccagccagcagcccccccaggcccagctgcaccgctacaacggcctcttccggcccagcagctgcctgcctgccttcagccctggccctgagctgagccaggtggacctgacccggcccagcagctgcttctttgctgccagccctggccctgccccagcctcctggtggcccctgcaggcccagcccctgccccctgtgtccctgtacagccccaacgtgtgcctgacagctgacagcagcaggcctgccagcaccagcctgtggaccccccaggccaagctgcccaccttccagcagctgctgcacacccagctgctgcccccatctggcctcttccggcccagcagctgcttcacccgggccttccctggccccacctttgtgtcctggcagcccagcctggcccgcttcctgcctgtgtcccagcagccccggcaggcccaggtgctgccccacacaggcctgagcaccagcagcctgtgcctgactgtggccagccctggccccacccctgtgcccggccgccacctgcgggcccagaacctgctgaagctggacagcctggtgcccacagctgcctcctggtggcccatgaaggcccagaacctgctgaagctgacctgccccggccctgccccagccagctgccagaggctgcaggcccagcccctgccccacggcggcttcagccggcccaccagcagctcctggctgggcctgcaggcccagctgctgccccacaacagcctcttctggcccagcagctgcccagcccatggaggccagtgccggcccaagaccagcagcagccagaccctgcaggcccacctgctgctgcccggcggcatcaaccggcccagctttgacctgaggacagccagcgctggccctgccctggccagccagggcctcttccctggccctgccctggcctcctggcagctgccccaggccaagttcctgcctgcctgccagcagccccagcaggcccagctgctgccccacagcggccccttccggcccaacagctag

SEQ ID NO: 43274 - DNA, 780 bp, Artificial Sequence
  Description of Artificial Sequence: Synthetic coding sequence
accagcctgtggaccccccaggccaagctgcccaccttccagcagctgctgcacacccagctgctgcccccatctggcctcttccggcccagcagctgcttcacccgggccttccctggccccacctttgtgtcctggcagcccagcctggcccgcttcctgcctgtgtcccagcagccccggcaggcccaggtgctgccccacacaggcctgagcaccagcagcctgtgcctgactgtggccagccctggccccacccctgtgcccggccgccacctgcgggcccagaacctgctgaagctggacagcctggtgcccacagctgcctcctggtggcccatgaaggcccagaacctgctgaagctgacctgccccggccctgccccagccagctgccagaggctgcaggcccagcccctgccccacggcggcttcagccggcccaccagcagctcctggctgggcctgcaggcccagctgctgccccacaacagcctcttctggcccagcagctgcccagcccatggaggccagtgccggcccaagaccagcagcagccagaccctgcaggcccacctgctgctgcccggcggcatcaaccggcccagctttgacctgaggacagccagcgctggccctgccctggccagccagggcctcttccctggccctgccctggcctcctggcagctgccccaggccaagttcctgcctgcctgccagcagccccagcaggcccagctgctgccccacagcggccccttccggcccaacagctag

SEQ ID NO: 43275 - DNA, 1791 bp, Artificial Sequence
  Description of Artificial Sequence: Synthetic coding sequence
atgaagatgcagaagggaaatgtgctgctgatgtttggcctgctgctgcacctggaggccgccaccaacagcaatgagaccagcaccagcgccaacacaggcagcagcgtcatcagcagcggggccagcacagccaccaacagcggcagctctgtgaccagcagtggagtgtccacagccaccatcagcggcagctctgtgaccagcaatggagtgtccatcgtgaccaacagcgagttccacaccaccagcagcggcatcagcacagccaccaacagcgagttcagcacagccagcagcggcatcagcatcgccaccaacagcgagagcagcaccaccagcagcggggccagcacagccaccaacagcgagagcagcacccccagcagcggggccagcacagtgaccaacagcggcagctctgtgaccagcagcggggccagcacagccaccaacagcgagagcagcacagtgagcagccgggccagcacagccaccaacagcgagagcagcaccctgagcagcggggccagcacagccaccaacagcgacagcagcaccaccagcagcggggccagcacagccaccaacagcgagagcagcaccaccagcagcggggccagcacagccaccaacagcgagagcagcacagtgagcagccgggccagcacagccaccaacagcgagagcagcaccaccagcagcggggccagcacagccaccaacagcgagagcaggaccaccagcaatggagctggaacagccaccaacagcgagagcagcaccaccagcagcggggccagcacagccaccaacagcgacagcagcacagtgagcagcggggccagcacagccaccaacagcgagagcagcaccaccagcagcggggccagcacagccaccaacagcgagagcagcaccaccagcagcggggccagcacagccaccaacagcgacagcagcaccaccagcagtggagctggaacagccaccaacagcgagagcagcacagtgagcagcggcatcagcacagtgaccaacagcgagagcagcacccccagcagcggggccaacacagccaccaacagcgagagcagcaccaccagcagcggggccaacacagccaccaacagcgagagcagcacagtgtcctctggggccagcacagccaccaacagcgagagcagcaccaccagcagcggcgtgtccacagccaccaacagcgagagcagcaccaccagcagcggggccagcacagccaccaacagcgacagcagcaccaccagcagcgaggccagcacagccaccaacagcgagagcagcacagtgagcagcggcatcagcacagtgaccaacagcgagagcagcaccaccagcagcggggccaacacagccaccaacagcggcagctctgtgaccagcgctggcagcggcacagctgccctgaccggcatgcacaccaccagccacagcgccagcacagctgtgtctgaggccaagccaggcggcagcctggtgccctgggagatcttcctgatcaccctggtgtctgtggtggccgctgtgggcctgtttgctggcctcttcttctgtgtgaggaacagcctgagcctgaggaacaccttcaacacagctgtgtaccacccccacggcctgaaccacggcctgggccctggccctgggggcaaccacggggccccccaccggccccgctggagccccaactggttctggaggaggcctgtgagcagcatcgccatggagatgagcggcaggaacagcggcccctag

SEQ ID NO: 43276 - DNA, 1434 bp, Artificial Sequence
  Description of Artificial Sequence: Synthetic coding sequence
atgctgttctcctgggtgaagaggcagaggaagagccagtacagctgcaagggcagcgagctgcggcatgcccggagcagcgtcatcaagaggaagacagctgacaagaacctgctggccgagctgtaccagtacagcaacttcaacagcagcaagcccaacaagctgcccaacggggtggacttctgtgacatggtgggcaatgtggtgcgggcagagcgggactgcctgagcggcaagcacttctgcagcggccgggagctggagaagttcctgagcagcagcagcccccgggccatctggctggacagcttctggtggatcttccacgagcgctaccagcccaacaaggagctgcagaacaacctgtttgacagaattgcccagcactacgccctgctgctcttccgggtgcccaagagccacagcgaggaggccctgctgaagaggctgcccagcctgctgagcaaggctgtgtacaccagcttctgctgctgcttcccccagagctggtttgacacccatgagttcaagagtgacatctgcaacaccatgagcctgtggatcagcggcacctaccccagcccccagagctatgacagctgggactacagcgagctggaccctgagcgcttcagaagagaggagctgatgctgtacagaagaaggctgaccaagggccgggagttcagcctgtttgctgggaagagggccttcagccagaagccagcccagagcaggaagttctaccacccccagagcagcagcgccaacagccccagcgagaagaccagcagcgccaagcagaacagcgagaagagcctgaggatgcagaacacagccaaggagcaccactgccagaccctggtgctgaagaagcccacccaggaggtgaagaggatcagcgaggcccgggagtgtgagaacatgttccccaagaagagctgtgccgcctgcaagagccctgagctgaccagcaacctcttcaacatctacggcaagagccccctcatcgtgtacttcctgcagaactatgccagcctgcagcagcacggcaagaatgtgctgattgtgagaagagagaagaccaccagcgccacagactgcacccccacctacacagatgtgatcagcgagaccctgtgcagcatgaagaagaggaaggacaacctgaaccagctgtaccagcaccactggacagagtggaactactttgacaagcacctgaaggagctgcaggacaacttcagccgggagatgaagaacatcgaccccaaggctgctgacaccaagaaggccaaccacatgttcatccccccatctgctgtgaatgaggagagcccagacaagaagaccaaggagggcaagggcggggagggcaagaggcgggagacagaggtggagcacttcttccccctgaccagcaagccctag

SEQ ID NO: 43277 - DNA, 546 bp, Artificial Sequence
  Description of Artificial Sequence: Synthetic coding sequence
atgtctgagctgcccttcaccatcgccagcaagaggatcaagtacctgcgcatccagctgaccagagatgtgaaggacctcttcaagaagaactacaagcccctgctgaatgagatcaaggaggacaccaacaagtggaagaacatcccctgctcctggattggccgcatcaacatcatgaagatggccatcctgcccaaggtgatctaccgcttcaatgccatccccatcaagctgcccatgaccttcttcaccaagctggagaagaccaccctgaagttcatctggaaccagaagagggccctgattgccaagaccatcatcagcaagaagaacaaggccggcggcatcaccctgcctgacttcaagctgtgctacaaggccaccgtgaccaagacagcctgctgctggtacctgaacagagacatcgaccagtggaacagaacagaggtgtctgagatcaccatccacatctacaaccacctgatctttgacaagccagacaagaacaagcagtggggcaaggacagcctcttcaacaagtag

SEQ ID NO: 43278 - DNA, 1737 bp, Artificial Sequence
  Description of Artificial Sequence: Synthetic coding sequence
atggccgaggagacccagcacaacaagctggccgccgccaagaagaagctgaaggagtactggcagaagaacagcccccgggtgcctgctggggccaacagaaacaggaagaccaacggcagcatccctgagaaggccaccagcggcggctgccagcccccccgggacagcgccaccggcttccaccgggagggccccaccagcagcgccaccctgaaggacctggagagcccctgccaggagagagctgtggtgctggacagccgctctgtggagatcagccagctgaagaacaccatcaagagcctgaagcagcagaagaagcaggtggagcaccagctggaggaggagaagaaggccaacaacaagaagcagaaggccaagagggtgctggaggtgcagatccagaccctgaacatccagaaggaggagctgaacacagacctgtaccacatgaagaggagcctgcgctactttgaggagaagagcaaggacctggccgtgcggctgcagcacagcctgcagaggaaaggagagctggagagcgtgctgagcaatgtgatggccacccagaagaagaaggccaaccagctgaaggagagcttccagcaggtgcagctggagagagatgagtacagcgagcacctgaagggggagcgggcccgctggcagcagaggatgaggaagatgagccaggagatctgcaccctgaagaaggagaagcagcaggacatgagaagagtggagaagctggagaggagcctgagcaagctgaagaaccagatggccgagcccctgcccccagagcccccagctgtgcccagcgaggtggagctgcagcacctgaggaaggagctggagcgggtggccggggagctgcaggcccaggtgaagaagaaccagaggatcagcctgctgaaccagaggcaggaggagcgcatccaggagcaggaggagcggctgaggaagcaggaggagcgcatccaggagcagcacaagagcctgcagcagctggccaagccccagagcgtgtttgaggagcctgagcacctggaggccgccagccagcagaaccagcagctgacagcccagctgagcctgatggccctgcctggagagggccatggagagcacctggacagcgagggggaggaggccccccagcccatgcccagcgtgcctgaggacctggagagccgggaggccatgagcagcttcatggaccacctgaaggagaaggctgacctgtctgagctggtgaagaaggagctgtgcttcatccaccactggagggacagaagacaccagaagacccaccacctgctgtctgagcccggcggctgtgccaaggatgctgccctgggcggcggccaccaccaggccggggcccagggcggagatgaaggagaggccgccggggctgctgctgatggcattgctgcctacagcaactacaacaacggccacaggaagttcctggccgccgcccacaacccagcagatgagcccggccctggggccccagccccccaggagctgggcgctgctgacaagcatggagacctgcgggaggtgtccctgaccagcagcgcccagggcgaggcccgggaggaccccctgctggacaagcccacagcccagcccatcgtgcaggaccacaaggagcaccctggcctgggcagcaactgctgcgtgcccctcttctgctgggcctggctgcccaggagaagaagatag

SEQ ID NO: 43279 - DNA, 1824 bp, Artificial Sequence
  Description of Artificial Sequence: Synthetic coding sequence
atggccgaggagacccagcacaacaagctggccgccgccaagaagaagctgaaggagtactggcagaagaacagcccccgggtgcctgctggggccaacagaaacaggaagaccaacggcagcatccctgagaaggccaccagcggcggctgccagcccccccgggacagcgccaccggcttccaccgggagggccccaccagcagcgccaccctgaaggacctggagagcccctgccaggagagagctgtggtgctggacagccgctctgtggagatcagccagctgaagaacaccatcaagagcctgaagcagcagaagaagcaggtggagcaccagctggaggaggagaagaaggccaacaacaagaagcagaaggccaagagggtgctggaggtgcagatccagaccctgaacatccagaaggaggagctgaacacagacctgtaccacatgaagaggagcctgcgctactttgaggagaagagcaaggacctggccgtgcggctgcagcacagcctgcagaggaaaggagagctggagagcgtgctgagcaatgtgatggccacccagaagaagaaggccaaccagctgagcagccgcagcaaggccaggacagagtggaagctggagcagagcatgagggaggaggccctgctgaaggtgcagctgacccagctgaaggagagcttccagcaggtgcagctggagagagatgagtacagcgagcacctgaagggggagcgggcccgctggcagcagaggatgaggaagatgagccaggagatctgcaccctgaagaaggagaagcagcaggacatgagaagagtggagaagctggagaggagcctgagcaagctgaagaaccagatggccgagcccctgcccccagagcccccagctgtgcccagcgaggtggagctgcagcacctgaggaaggagctggagcgggtggccggggagctgcaggcccaggtgaagaagaaccagaggatcagcctgctgaaccagaggcaggaggagcgcatccaggagcaggaggagcggctgaggaagcaggaggagcgcatccaggagcagcacaagagcctgcagcagctggccaagccccagagcgtgtttgaggagcctgagcacctggaggccgccagccagcagaaccagcagctgacagcccagctgagcctgatggccctgcccggggagggccacggggagcacctggacagcgagggggaggaggccccccagcccatgcccagcgtgcctgaggacctggagagccgggaggccatgagcagcttcatggaccacctgaaggagaaggctgacctgtctgagctggtgaagaaggagctgtgcttcatccaccactggagggaccggcggcaccagaagacccaccacctgctgtctgagcccggcggctgtgccaaggatgctgccctgggcggcggccaccaccaggccggggcccagggcggagatgaaggagaggccgccggggctgctgctgatggcattgctgcctacagcaactacaacaacggccacaggaagttcctggccgccgcccacaacccagcagatgagcccggccctggggccccagccccccaggagctgggcgctgctgacaagcacggggacctgcgggaggtgtccctgaccagcagcgcccagggcgaggcccgggaggaccccctgctggacaagcccacagcccagcccatcgtgcaggaccacaaggagcaccctggcctgggcagcaactgctgcgtgcccctcttctgctgggcctggctgcccaggagaagaagatag

SEQ ID NO: 43280 - DNA, 258 bp, Artificial Sequence
  Description of Artificial Sequence: Synthetic coding sequence
atgatccagcaggaggagatcaggaagctggaggaggagaagaagcagctggagggggagatcatcgacttctacaagatgaaggccgccagcgaggccctgcagacccagctgagcacagacaccaagaaggacaagcacccagacccctatgagttcctgctgctgaggaagatcaagcaccctggcttcaatgaggagctgaccatcaccctgctgatcatccagaagcacgtggccggcctgagccacttctag

SEQ ID NO: 43281 - DNA, 1713 bp, Artificial Sequence
  Description of Artificial Sequence: Synthetic coding sequence
atgaaccacttcaggaagatggaggtgatcaacctgaccaccctgcccatgatccctgtggatgagcacctggccgtgtccctggtggccaggaacaccatggtgaagacagtgaggaaggagctggagaacaacccccccagctgcctgattggctccatgcaccaggtgaaccagaagattgctgacatcaacctgaggacagagcccagcgccaacagcctggccatcgagagatttgagctggagaagaaggccctgcgggagaagaccaggagcagccctgaggacaaggtgaagaggcagaggaagagccagtacagctgcaagggcagcgagctgcggcatgcccggagcagcgtcatcaagaggaagacagctgacaagaacctgctggccgagctgtaccagtacagcaacttcaacagcagcaagcccaacaagctgcccaatggagtggacttctgtgacatggtgggcaatgtggtgcgggcagagcgggactgcctgagcggcaagcacttctgcagcggccgggagctggagaagttcctgagcagcagcagcccccgggccatctggctggacagcttctggtggatcttccacgagcgctaccagcccaacaaggagctgcagaacaacctgtttgaccgcatcgcccagcactacgccctgctgctcttccgggtgcccaagagccacagcgaggaggccctgctgaagaggctgcccagcctgctgagcaaggctgtgtacaccagcttctgctgctgcttcccccagagctggtttgacacccatgagttcaagagtgacatctgcaacaccatgagcctgtggatcagcggcacctaccccagcccccagagctatgacagctgggactacagcgagctggaccctgagcgcttccggcgggaggagctgatgctgtacagaagaaggctgaccaagggccgggagttcagcctgtttgctgggaagagggccttcagccagaagccagcccagagcaggaagttctaccacccccagagcagcagcgccaacagccccagcgagaagaccagcagcgccaagcagaacagcgagaagagcctgaggatgcagaacacagccaaggagcaccactgccagaccctggtgctgaagaagcccacccaggaggtgaagaggatcagcgaggccagagaatgtgagaacatgttccccaagaagagctgtgccgcctgcaagagccctgagctgaccagcaacctcttcaacatctacggcaagagccccctgattgtgtacttcctgcagaactatgccagcctgcagcagcacggcaagaatgtgctgattgtgcggcgggagaagaccaccagcaccccagactgcacccccacctacacagatgtgatcagcgagaccctgtgcagcatgaagaagaggaaggacaacctgaaccagctgtaccagcaccactggacagagtggaactactttgacaagcacctgaaggagctgcaggacaacttcagccgggagatgaagaacatcgaccccaaggctgctgacaccaagaaggccaaccacatgttcatcccccccagcgctgtgaatgaggagagcccagacaagaagaccaaggagggcaaaggaggagagggcaagagaagagaaacagaggtggagcacttcttccccctgaccagcaagccctag

SEQ ID NO: 43282 - DNA, 366 bp, Artificial Sequence
  Description of Artificial Sequence: Synthetic coding sequence
atgactggagtgtgtgaccacgcccagctgatctttgtgttctttgtggagatggagttccgctacgtggtgcccggctggagccagaccccagagctgcggcagagcgcccacctgcggctgcagaagtgctgggactacagacctgagcccctgtgccccagcccctggctgattgacagccacctgctgcctgagagcctgcagggccacccctttgtgtgtgtgtgtgtgctgatcagcccctacaagaacacctgccacacccggctgggccccaccctgctgaccagcttctacctgaaccacctgtacaaggaccccatcagcaagtacagcaccatcctgcggagctgcaacatctag

SEQ ID NO: 43283 - DNA, 474 bp, Artificial Sequence
  Description of Artificial Sequence: Synthetic coding sequence
atggccccccaggcccagcccctgcccctgctgggcaagtgcaaggccagcaatgcccccaccccccggcccccccggcggcccacctggaagaggaagagcggcaaggtgtccaccaccgtgccccagccccagacagtgcccggctcctggccccgggagcgggagaggaagcgggagcgggaccgcatcaacagcctgctgctgcagatcatcggccacagcaagcaggccctgcccggccctggagagcccgcccagaggctgaccccagccccagctgaccccggcggccgcggggagcagggcggcgtggccgcccagggcgccggcctggccgccggccgccgctctgctgtgggccccagcaagctgtgcaacctggtgtctgccagcggggccctggccgtgttcagcatcaccggcatgtgccccggcagagatgtgtctgatggcctgaggatgggccagtag

SEQ ID NO: 43284 - DNA, 507 bp, Artificial Sequence
  Description of Artificial Sequence: Synthetic coding sequence
atgaagggcaacaccaacagcgctgtgaccccagcccccaagtgccactggctggaggacctgccccctgtgcggcggcagcaccgctgggtgctgagccccctgcggcctgctgccctgcggcggctgcagctgctgtctgctgaccggcggcccctgcggaggactggagcccccccagcccagggccctgcccagcacccctggagccggggccccccaagaagaccacccaggtctgtgaagctgtgccgggcccagcagtggccagagaccagggctgaccccctgcctgctggcacccggcagggcgagagccccctgccccggggccggcggccagacctgggccagggccggcccagcgcccggcggctgcccagcggcccctggacccacaggaccaggaccagggtgcggggcagcctgcgggccgccgcccggagccagaatgcccggcggggcagccctgcccggcaggccgccaagcccaagctggaggcctag

SEQ ID NO: 43285 - DNA, 807 bp, Artificial Sequence
  Description of Artificial Sequence: Synthetic coding sequence
atgaggcgggccccagactgggtgcagaggcaggccgcccctggcagcaaatgtcgggtgccctggcagaggcgggagttccccagcagaggaggcaggaagcagccccagcccggcagccggcagaggaagcagaaccccatcagcctgcctggagagcagaatggaaggaaggccaccccccaggccggggccctgggcgccctgggcatccggggcatccccagcctgtgccagagcgagggcacccgctggagcagaagaggccgccgctgggccgagcgctgccccccaggagtgctgggcgccggccgcagcctgcgggcccagaggagccggctgcacagccggcccccacccctgagccccctgaggaagccaggcggcagcaaccagcccaggtctgctgctgctgctggcacccatgaggcctgcctgcaggccagcggcaccacccggggctggaagtaccacgccctgcccctgcggctggaccccaggagcggccatgctggcagcgccctgaaggccggcagctgcccccggctgggcggcggcggccggggccgcggggaggccggggcccccagccgcttctggctgcccaggagcctgcagcagctgctgcccaatgagcccagaaatgctgatgtgcagaccctgcaccccacccccagccacacccggcggggccagaggacaggcaagggggcccggggcccccgcttctggaagagcaagaacagccctgccaaccggcagagcagcgccctggacttctggatcaccaccagcatctccttctag

SEQ ID NO: 43286 - DNA, 327 bp, Artificial Sequence
  Description of Artificial Sequence: Synthetic coding sequence
atgctgctgaccagccagacagtgttcttcttcttcttcttcttcctgcggcagagcctgaccctgctgagcagcctggagtgcaatggcaccatcagcgcccactgcatcctgcggctgctgggcagcagcaagagccctgccagcgccagcctggtggccggcgtgacaggcatgcaccaccacgcccggctcatctttgtgttcctggtggagatgggcttccaccacgtgggccaggccggcctggagctgctgaccagcggcaaccccccagccctggccagccagagagctgagatcaccggggccagctaccgggcctag

SEQ ID NO: 43287 - DNA, 324 bp, Artificial Sequence
  Description of Artificial Sequence: Synthetic coding sequence
atgaggcccaagaccctgagaaattctgctgcccggagcaggaaggagcccggcttcctgaaccaccacatggagggcagctgcctgcagctgggggagctgagctctgtgggctactggtggcccttcggccaccctggccctgcccagggccacctgcctgtggccgtgtgggcctcctgggtggtggccggcatcagcatcgccctgtacctgcccccccaccctgagggccgctatgagggccccttcaagaggcacaccaagaccttccgcagcgcccagtgtgccgactgcctggtgcagtgcccagccagcccctag

SEQ ID NO: 43288 - DNA, 465 bp, Artificial Sequence
  Description of Artificial Sequence: Synthetic coding sequence
atgagggacatggagagagctggggtgaccagggtgcggcagagcctgaagacctgggtggagcacggccccttcagcggggaccccggcctgcccaggtctgtgcgggtggagctgctgaccctggtggccggccctgcccggggccgcagcggccaccggcagcccccaccccagccccagagcctgcggcggcccctgtggctgagccacagcgaccccagcctgaagttccgcaccctgggcctgcgggagggcagcggggctgagtgcctgcccccaggcaccttcctgcccttctcctggagcttcagcgcccctgagctggcccacctgagcaatgcccgggccccctggatccccctgcccggggccttccagatccagcagaagcagatcttcttcttcctggagagcaggaccaagagcggcatgaggagcagaggaggcaaggacagcaagtag

SEQ ID NO: 43289 - DNA, 723 bp, Artificial Sequence
  Description of Artificial Sequence: Synthetic coding sequence
atgaacaagcagaggggcaccttcagcgaggtgtccctggcccaggaccccaagaggcagcagaggaagcccaagggcaacaagagcagcatcagcggcacagagcaggagatcttccaggtggagctgaacctgcagaaccccagcctgaaccaccagggcatcgacaagatctatgactgccagggcctgctgcccccacctgagaagctgacagctgaggtgctgggcatcatctgcatcgtgctgatggccaccgtgctgaagaccatcgtgctgatccccttcctggagcagaacaacttcagccccaacaccaggacccagaaggcccggcactgcggccactgcccagaggagtggatcacctacagcaacagctgctactacatcggcaaggagaggaggacctgggaggagagcctgcaggcctgtgccagcaagaacagcagcagcctgctgtgcatcgacaatgaggaggagatgaagttcctggccagcatcctgcccagctcctggattggagtcttcaggaacagcagccaccacccctgggtgaccatcaatggcctggccttcaagcatgagatcaaggacagcgaccatgctgagaggaactgtgccatgctgcacgtgcggggcctcatcagtgaccagtgtggcagcagccgcatcatcagaagaggcttcatcatgctgacccggctggtgctgaacagctag

SEQ ID NO: 43290 - DNA, 732 bp, Artificial Sequence
  Description of Artificial Sequence: Synthetic coding sequence
atggagcggcgctggctgagcctgcggagcagcagctgcagcgccccccggctgaacacagcctggggcatgaggagcagcccccaggccaccagcagcagcagcagaaatgctgccagcttcctgcggctcttccgggccacccggcgggcccccagcctgtgccgcctgagcctgtgccgctggccagccacctctgtgaccctggccggcaccttccctgccctgctgcggcgggacaacaccctgagctgcttcagcagccggcggctgagccgggtggccgcccgggccagctcctggggcaagagccccagccgctgcagcagcagcaagcccaggagccccaacacccagagcggcaccagccgcagcagcagccacctgacccgcatcaccttccgctggagcaggaggaagacctgcaaggagaagggcagcctggccggggagtggagcaagctgagcagctgcaagtgcaccagctgtgacagccctgggggcaaggtgatcagccagatggccagcagcctgagtgacagcaccagcctgagcagcaagacagtgtctggccggcccggctccatgcagagggccagcagcagcaggcctgctgccctgcgctgcagcttctgccgctccttcagcggcgtgcacagctggctgcggctgagctgcttccggcggctgagcctgaccagtgacaggaagacagccaagaggctggagtag

SEQ ID NO: 43291 - DNA, 4041 bp, Artificial Sequence
  Description of Artificial Sequence: Synthetic coding sequence
atggacaacaagagggacaaggccaaggccggggctgctgcccggaccccagctgcccgggcccctggcctgctgacccccaggcctcctggcagccccaggcctcctcctcctgtgaccccagctgccctgcgggtgctgggcgccgccggggctgtgggcaggaagcccctggccgagcgggccggcggcattggaggagccaccatccctgagagcgcccccagggctggccccaccaggtctgctggcaccagcagcaggaacccagccagccggcccccagccagcggccgcggggagcgggcccccccagccaagaacaccagccctggccctgtgagcagccctggccgggccagcggcaccacccggcccggccccctgggccagaagggcctgcgcatctctgctgaggagaccgtggcccggggcaaggccacagaggcccccaagaggtctgccctgtctgctggggcccggcgggacaccagcggccccaccccaggcacccccagccctgccatggcccggcgcagcagagctgctggaacagaggtgggcctgcccaggcctgcccccagcgcccggccccggcccccaacagagggccccaggaagtctgtgtcctctgccagcgagcacagcaccacagagcccagccctgctgcccggcggcggcccagcgctgggggcggcctgcagaggcctgccagccgcagcctgagcagcagcgccacccccctgagcagccctgcccggagcggccccagcgcccggggcaccccccgggccccagcccaccccagccagcccaagcccaagggcctgcaggccctgcggcccccccaggtgaccccacccaggaaggatgctgccccagccctgggccccctgagcagcagccccctggccacccccagccccagcggcaccaaggcccggcctgtgcccccaccagacaatgctgccacccccctgcctgccaccctgccccccagcccccctgtgaccccacctcctcctgctgccctgcagagccaggccccacccaccctgcctgccaccccccacagcagcagcctgacctgccagctggccacccccctgcccctggccccacccagccccagcgccccacccagcctgcagaccctgcccagccccccagccaccccacccagccaggtgccccccacccagctgatcatgtccttccctgaggccggcgtgagcagcctggccacagctgcctttgtggcctctgtgagccccagcgtgagcagccccctgcagagcatgccacccacccaggccaacccagccctgcccagcctgcccaccctgctgagccccctggccaccccacccctgagcgccatgagccccctgcagggccctgtgtccccagccaccagcctgggcaacagcgccttccccctggccgccctgccccagcccggcctgagcgccctgaccaccccaccaccccaggccagccccagccccagcccccccagcctgcaggccaccccccacaccctggccaccctgcccctgcaggacagccccctgctggccaccctgcccctgcaggccagccccagccccctgaccaccgtgtccctgcaggacccccccctggtgagccccagcctgctggccagcccccccctgcaggccccaccccacccccaggccccacccagcatgaccaccccacccatgcaggccccacccagcctgcagaccatcccccccatccaggtgccccacagcctgaccagccccagcctgcaggccccacccagccccctggccctgagcagcctgcaggccaccaccagcctgggcagccccaccctgcaggccacccacagcttcctgaccatgagcccccggcagacccaggccagcctcatcagccccagcaggcctgccagcaccccaccagacagcccccccctgcaggcccccctgagcctgcctgccagcccccccctgcagaccagcctgagccctgctgtgagccccctgagcagccccctgaccatccaccccctgcaggccctgagcagcctggccagccacagcccccaggcccccctgagcagcctcatcatgccacccctggagacccagagcagcctggccccacccagcctgcagaccccaccagccagcctgaccaccccacccctggagaacctgcccagcctggcccccccacccctgcagacagccagcgcccccctgaccaccccacccctggagaacctgcccagcctggcccccccacccctgcagacagccagcgcccccctgaccaccccccacctggagaccccaccctgcccagccccctgccccctgcaggccccacccagccccctgaccaccccacctcctgagacccccagcagcatcgccaccccaccaccccaggcccccccagccctggccagcccccccctgcagggcctgcccagcccccccctgagccccctggccaccccaccaccccaggcccccccagccctggccctgccccccctgcaggccccacccagccccccagccagcccccccctgagccccctggccacccccagcccccaggccccaaatgccctggccgtgcacctgctgcaggcccccttcagccccccacccagcccccctgtgcaggcccccttcagccccccagccagcccccctgtgagccccagcgccaccccacccagccaggccccacccagcctggccgccccacccctgcaggtgccccccagccccccagccagcccccccatgagccccagcgccaccccaccaccccaggcccccccacccctggccgccccacccctgcaggtgccccccagccccccagccagcccccccatgagccccagcgccaccccaccaccccgggtgccccccctgctggccgccccacccctgcaggtgccccccagccccccagccagcctgcccatgagccccctggccaagcccccaccccaggcccccccagccctggccaccccacccctgcaggccctgcccagccccccagccagcttccctggccaggcccccttcagccccagcgccagcctgcccatgagccccctggccaccccaccaccccaggcccctcctgtgctggccgcccccctgctgcaggtgccccccagccccccagccagccccaccctgcaggccccccggcggccccccaccccaggccctgacacctctgtgtctggcccccggctgaccctggccctggcccctggccccccacctccacccagccgcagccccagcagcaccctgagcggccctgacctggccggccacagcagcagcgccaccagcaccccagaggagctgcggggctatgacagcggccctgagggcggcgctgctgccagccccccaccagatgctgagctggccgcctgccaccctgctgcctggagccggggccctgccccacccctggccttccggggggcccctggggcccccctgccctggcccccagccaccggccctggcagcgcagatggcctgtgcaccatctatgaaacagagggccctgagagcgccaccccagcccctggggccctggaccccggccccagccctggcaccagcggcggcaaggctgctgctggggccggggccggggccagcagccgcagccccaagcaggcccggctgggggagctgcccctgggcgccctgcaggcctctgtggtgcagcacctgctgagcaggaccctgctgctggccgctgctgagggcgccgccggcggcagcggcggcggccctggaggagctgagggcggcggcgtgactggaggagcccgggccgccctgagtgatgctgagctgggccgctgggccgagctgctgagccccctggatgagagccgggccagcatcacctctgtgaccagcttctccccagatgatgtggccagcccccagggcgactggacagtggtggaggtggagaccttccactag

SEQ ID NO: 43292 - DNA, 2010 bp, Artificial Sequence
  Description of Artificial Sequence: Synthetic coding sequence
atgttcaccctgagcctgctgagccggggccacggcaagctgggccaggacaagcagaagctggaggtgtactttgagcctgaggactacctgaactggaggagcccagaagattatgtgcctgtgtccaagccccaggacaagaacaatgccagccagcacagctggagcctcttcctgcccaagaccttcagcaccaggaagggggccctgatcctgtacagcgagggctttgccatcagcgcctggacccccaaggagaggaggaagggcccctactgcccccggggcccctggaggaagctggacctggagctgcacaccctgcaggacctgaaggaggccatcctggcctacggccggcagcagggcgagcaggaccgggcctggcagccctacctgcacttccgcagccagctggagagccaggcccagaggcagatccagcccggccacagcgccaagcgctacctgcggggcctgctgcggacctggcccccagatgccatgtaccgcctgtggtgtgccggctacatcaaggacagcgtgctgctgcaggacagccagctgaatgtgcccaagaagctgcggccccagcaggacctgtctggagtgccccccaagtaccacctgctgcctgtgttccccagcttctggatccagcagggcaagagctttgagcagaggcagcagggcctggatgaaggagaggccggggctgctggccacgtggaccagggccccctggccaagaaccacggcagccagggcacccggctgccccccaggaggaagcagccctggcaggaggatgagacccaggccgaggacaccagcattgagaaccacctgtgcctgtatgccagcaaggagagctacaatgagaagacccagcagaccagcaggaaggcctttggacatggaagaattgaccacagctggctgcccagcgacaagagccacatcaccttctgtggcggggccttccccaacaggaaggctgacctgagtgacaagcagagaaatgtgaagctgcacaaggcccggagcagccacctgctgcaggtgctgcctgctgagaggagcctcttcccccctgtggccagcgccaccggcagccgcatcatcaccccaggagaggtgaagaagaagaaggcccccaaggccctgaagctgccccccatcagcgaggagcccccccgggtgctggagcccctgaagagccagttcaaggccaatgaaccacccacagagctgttcatcctgcctgtggagatccactaccacaccaagcagccccccaaggagaaggcccaccggcggggggccccccaccctgagagcgagcctgagagcagcgaggagagcacccctgtgtggaggcctcccctgaagcacgccagcctggagaccccctgggagctgactgtgcacctgcctgtggatgccagccgggacaccctgagcccccagggcagcagcagcctgcccccagccagcctgggcaacctgaccctgaagggcagcaaggcccggcacaccagggtgcacagccagggcaaaggagtgtggaagggagatgatgatgcccctcctcatgatgtggccccacccctggacctgctgccccccatcaagggcaagaagagccctgagagccagaagggcgtggacagccccaggaccagtgaccacaacagcccccccagcctgcccaacatgagggtgccccggcgggccctgcctgctgcccaggaggacagcagtgaccccaccctgggccacttcctgctgggcccagatggagagaaggtgtgcctgagcctgcccggccacacccagacagaggccctgcccagcggcaaggcctatgagagcgtgaacagcaacatcagccatgaggaggagggccccagcagccagcacttcctgaaggacatggctgctgctgccagtgaccagggcaaggatgatgacctggagaccttcagccccaagaacagcctgtag

SEQ ID NO: 43293 - DNA, 411 bp, Artificial Sequence; identical to SEQ ID NO: 43202
  Description of Artificial Sequence: Synthetic coding sequence

SEQ ID NO: 43294 - DNA, 381 bp, Artificial Sequence
  Description of Artificial Sequence: Synthetic coding sequence
atgcccacccagcccccacctggcagcggggaggtgcggcagagccccagcggaaatggagccctggtgcccaccggccagggctgccggggcaggaacctgcccatccagggctacagccctgagggccggcccacagccagcagccagcctgctggggcctggcacagcgagagcagccagaagggcacagcctgccccctggccctgggccggggcggggcccggggcggcggccagaggaagagccgcagcggggcccgggcccctggccagcctgctgaggccggcctgagcgccagccctgagaagaccaggcctgagggccgggcagagcggggccgggctgtggtgtggcagagccagcccaaccgctggtag

SEQ ID NO: 43295 - DNA, 699 bp, Artificial Sequence
  Description of Artificial Sequence: Synthetic coding sequence
atgttctgctgcctgggctatgagtggctgagcggcggctgcaagacctggcacagcgcctgggtgatcaacaccctggccgaccaccgccaccggggcacagactttggaggcagcccctggctgctgatcatcaccgtcttcctgcggagctacaagtttgccatcagcctgtgcaccagctacctgtgtgtgtccttcctgaagaccatcttccccagccagaatggacatgatggcagcacagatgtgcagcagagggcccggcgcagcaactgccggcggcaggagggcatcaagatcgtgctggaggacatcttcaccctgtggaggcaggtggagaccaaggtgcgggccaagatcaggaagatgaaggtgaccaccaaggtgaacagacatgacaagatcaatggcaagaggaagacagccaaggagcacctgaggaagctgtccatgaaggagcgggagcacggggagaaggagcggcaggtgtctgaggccgaggagaatggcaagctggacatgaaggagatccacacctacatggagatgttccagagggcccaggccctgcggaggagagctgaggactactaccgctgcaagatcacccccagcgccaggaagcccctgtgcaaccgctgcacctacaacctggtgctgcccggcagcgagaagaagtactacagccacgcctag

SEQ ID NO: 43296 - DNA, 636 bp, Artificial Sequence
  Description of Artificial Sequence: Synthetic coding sequence
atggcctacctgggcccctaccccaccagccggcagcccccccagatgaggctgctgccccacaacagcctgcaccgccacagcagcatcgtgaccatggccagcctggaccctgccccagccagccagcccagcctgcaggccctgaacttcctgaagagcaccagccctggccctgccccagcctcctggtggcccctgcaggcccagcccctgccccctgtgtccctgtacagccccaacgtgtgcctgacagctgacagcagcaggcctgccagcaccagcctgtggaccccccaggccaagctgcccaccttccagcagctgctgcacacccagctgctgccccccagcggcctcttccggcccagcagctgcttcacccgggccttccctggccccacctttgtgtcctggcagcccagcctggcccgcttcctgcctgtgtcccagcagccccggcaggcccaggtgctgccccacacaggcctgagcaccagcagcctgtgcctgactgtggccagccctggccccacccctgtgcccggccgccacctgcgggcccagaacctgctgaagagcaacagccctggccccccatctgccagccgctggcaccagcaggcccagctgtag

SEQ ID NO: 43297 - DNA, 654 bp, Artificial Sequence
  Description of Artificial Sequence: Synthetic coding sequence
atgaccctgctgccccggctggccctgcgggaggaggccgcccggcggggccccctgcgggcccctgtgcagcccggcctgggggagaggagcccccagaggcaccgggagcccaagcagggccgggtgtcccagcgctggcacccagcccgggagcccctggccgccaccggcttcctgcacggcctgggccacctgggccgggccgcccagagcccccgggccagctgctgcatcctgtggccaggcacctggggagaccccctgcggaccctgggccgcagccagcgggaggtgcagacagtgtgcaccggggtgtctggggaccaggcccagaaggagcaggacggccacctgctggcctggaggaagatcctgctgcccgggaagaagaccaccccccggggcatcggcctgggctgcaggaccctgagccaggccacagcccccttcctgctgcagaactggggcaggaagagggccttccggcccggcagcgagaaccccagcagcggcaccagccggcccagccggggccgcctggaggcccggagcagcggcctggatgaggcctgggaggcccagaggctgaccggccacggccgcttccccagccccaggaaggagaagagcctgcagaggggcctgggctag

SEQ ID NO: 43298 - DNA, 336 bp, Artificial Sequence
  Description of Artificial Sequence: Synthetic coding sequence
atggtgtccctgtgggtggaggacaccttcctgagccctggctttggatttgcccacgtggcctgcagcggcctgggcatgaagcagaagaggaaggccgccagcagcgagcccaccagcgaggtggccctgggcggcagcgctggccctgtgcgcagccacctgcaccctgagggcctgctgtggtgcagccgctgcttcttcagcctgcggcccaagggcacagagcccccaggccgctctgctggcctgcagggcgccacagagaggagcggctggacctctgtgcaggcccaggcccaggcctgtgagaacctggtgcctgctgctgtgtag

SEQ ID NO: 43299 - DNA, 5103 bp, Artificial Sequence
  Description of Artificial Sequence: Synthetic coding sequence
atgaccagcgcccagtgcccagccctggcctgtgtgatgagccccctgcgcttctggggcccctggcccctgctgatgtggcagctgctgtggctgctggtgaaggaggcccagcccctggagtgggtgaaggaccccctgcagctgaccagcaaccccctgggccccccagagccctggagcagccacagcagccacttcccccgggagagcccccacgcccccaccctgcctgctgacccctgggactttgaccacctgggccccagcgccagcagcgagatgcctgccccaccccaggagagcacagagaacctggtgcccttcctggacacctgggacagcgctggggagctgcccctggagcctgagcagttcctggccagccagcaggacctgaaggacaagctgagcccccaggagcggctgcctgtgagccccaagaagctgaagaaggaccctgcccagcgctggagcctggccgagatcatcggcatcatccggcagctgagcaccccccagagccagaagcagaccctgcagaatgagtacagcagcacagacaccccctacccaggcagcctgcccccagagctgcgggtgaagagtgatgagcccccaggccccagcgagcaggtgggccccagccagttccacctggagcctgagacccagaaccctgagaccctggaggacatccagagcagcagcctgcagcaggaggccccagcccagctgccccagctgctggaggaggagcccagctccatgcagcaggaggccccagccctgcccccagagagctccatggagagcctgaccctgcccaaccacgaggtgtctgtgcagcccccaggagaggaccaggcctactaccacctgcccaacatcaccgtgaagccagcagatgtggaggtgaccatcaccagcgagcccaccaatgaaacagagagcagccaggcccagcaggagacccccatccagtttcctgaggaggtggagcccagcgccacccagcaggaggcccccatcgagccccctgtgccccccatggagcacgagctgagcatcagcgagcagcagcagcctgtgcagcccagcgagagcccccgggaggtggagagcagccccacccagcaggagaccccaggccagcccccagagcaccacgaggtgacagtgagccccccaggccaccaccagacccaccacctggccagccccagcgtgtctgtgaagcccccagatgtgcagctgaccatcgctgctgagcccagcgctgaggtgggcaccagcctggtgcaccaggaggccaccacccggctgagcggcagcggaaatgatgtggagcccccagccatccagcacggcggcccccccctgctgcctgagagcagcgaggaggccggccccctggccgtgcagcaggagaccagcttccagagccctgagcccatcaacaatgaaaaccccagccccacccagcaggaggccgctgctgagcacccccagacagctgaggagggggagagcagcctgacccaccaggaggccccagcccagaccccagagttccccaacgtggtggtggcccagcccccagagcacagccacctgacccaggccaccgtgcagcccctggacctgggcttcaccatcaccccagagagcaagacagaggtggagctgagccccaccatgaaggagacccccacccagccccccaagaaggtggtgccccagctgcgggtgtaccagggcgtgaccaaccccaccccaggccaggaccaggcccagcaccctgtgagccccagcgtgacagtgcagctgctggacctgggcctgaccatcaccccagagcccaccacagaggtgggccacagcaccccacccaagaggaccatcgtgagccccaagcaccctgaggtgaccctgccccacccagaccaggtgcagacccagcacagccacctgacccgggccaccgtgcagcccctggacctgggcttcaccatcacccccaagtccatgacagaggtggagcccagcacagccctgatgaccacagcccctcctcctggccaccctgaggtgaccctgcccccaagtgacaagggccaggcccagcacagccacctgacccaggccaccgtgcagcccctggacctggagctgaccatcaccaccaagcccaccacagaggtgaagcccagccccaccacagaggagaccagcacccagcccccagacctgggcctggccatcatccctgagcccaccacagaaacaggccacagcacagccctggagaagaccacagcccccaggccagacagagtgcagaccctgcacaggagcctgacagaggtgactggaccacccacagagctggagcccgcccaggacagcctggtgcagagcgagagctacacccagaacaaggccctgacagcccctgaggagcacaaggccagcaccagcaccaacatctgtgagctgtgcacctgtggagatgagatgctgagctgcatcgacctgaaccctgagcagaggctgcggcaggtgcctgtgcctgagcccaacacccacaacggcaccttcaccatcctgaacttccagggcaactacatctcctacattgatggaaatgtgtggaaggcctacagctggacagagaagctgatcctgcgggagaacaacctgacagagctgcacaaggacagctttgagggcctgctgagcctgcagtacctggacctgagctgcaacaagatccagagcattgaaagacacacctttgagcccctgcccttcctgaagttcatcaacctgagctgcaacgtcatcacagagctgagctttggcaccttccaggcctggcacggcatgcagttcctgcacaagctgatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgatcctgcccagccacatggcctgctgcctgtgccagttcaagaacagcattgaagctgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgattgtggagcctgaggagcccagcgacagcagcggcatcaacctgagcggctttggaagtgagcagctggacaccaatgatgaaagtgacttcatcagcaccctgcgctacatcctgccctacttctctgctgtgaacctggatgtgaagagcctgctgctgcccctcatcaagctgcccaccactggaaacagcctggccaagatccagacagtgggccagaaccggcagagggtgaagagggtgctgatgggccccaggagcatccagaagaggcacttcaaggaggtgggccggcagagcatccggcgggagcagggcgcccaggcctctgtggagaatgctgctgaggagaagaggctgggcagccctgccccccgggaggtggagcagccccacacccagcagggccctgagaagctggccggaaatgctgtgtacaccaagcccagcttcacccaggagcacaaggctgctgtgtctgtgctgaagcccttcagcaaaggagcccccagcaccagcagccctgccaaggccctgccccaggtgcgggaccgctggaaggacctgacccacgccatcagcaccctggagagcgccaaggcccgggtgaccaacaccaagaccagcaagcccatcgtgcacgccaggaagaagtaccgcttccacaagaccaggagccacgtgacccacaggacccccaaggtgaagaagagccccaaggtgaggaagaagagctacctgagccggctgatgctggccaaccggctgcccttctctgctgccaagagcctcatcaacagccccagccagggcgccttcagcagcctgggggacctgagcccccaggagaaccccttcctggaggtgtctgcccccagcgagcacttcatcgagaagaacaacaccaagcacaccacagccagaaatgcctttgaagaaaatgacttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcctcatccccaacaacaacgtgagaagactcatcgcccacgtgatccgcaccctgaagatggactgcagcggcacccacgtgcaggtgacctgtgccaagctgatcagcaggacaggccacctgatgaagctgctgagcggccagcaggaggtgaaggccagcaagattgagtgggacacagaccagtggaagattgagaactacatcaatgaaagcacagaggcccagagcgagcagaaggagaagagcctggagctgaagaaggaggtgcccggctacggctacacagacaagctgatcctggccctgattgtgacaggcatcctgaccatcctgatcatcctcttctgcctgattgtcatctgctgccaccggcgcagcctgcaggaggatgaggagggcttcagccggggcatcttccgcttcctgccccggcggggctgcagcagccggcgggagagccaggacggcctgagcagctttggccagcccctgtggttcaaggacatgtacaagcccctgagcgccacccgcatcaacaaccacgcctggaagctgcacaagaagagcagcaatgaagacaagatcctgaacagagaccccggggacagcgaggcccccacagaggaggaggagagcgaggccctgccctag

SEQ ID NO: 43300 - DNA, 4908 bp, Artificial Sequence
  Description of Artificial Sequence: Synthetic coding sequence
atgaccagcgcccagtgcccagccctggcctgtgtgatgagccccctgcgcttctggggcccctggcccctgctgatgtggcagctgctgtggctgctggtgaaggaggcccagcccctggagtgggtgaaggaccccctgcagctgaccagcaaccccctgggccccccagagccctggagcagccacagcagccacttcccccgggagagcccccacgcccccaccctgcctgctgacccctgggactttgaccacctgggccccagcgccagcagcgagatgcctgccccaccccaggagagcacagagaacctggtgcccttcctggacacctgggacagcgctggggagctgcccctggagcctgagcagttcctggccagccagcaggacctgaaggacaagctgagcccccaggagcggctgcctgtgagccccaagaagctgaagaaggaccctgcccagcgctggagcctggccgagatcatcggcatcatccggcagctgagcaccccccagagccagaagcagaccctgcagaatgagtacagcagcacagacaccccctacccaggcagcctgcccccagagctgcgggtgaagagtgatgagcccccaggccccagcgagcaggtgggccccagccagttccacctggagcctgagacccagaaccctgagaccctggaggacatccagagcagcagcctgcagcaggaggccccagcccagctgccccagctgctggaggaggagcccagctccatgcagcaggaggccccagccctgcccccagagagctccatggagagcctgaccctgcccaaccacgaggtgtctgtgcagcccccaggagaggaccaggcctactaccacctgcccaacatcaccgtgaagccagcagatgtggaggtgaccatcaccagcgagcccaccaatgaaacagagagcagccaggcccagcaggagacccccatccagtttcctgaggaggtggagcccagcgccacccagcaggaggcccccatcgagccccctgtgccccccatggagcacgagctgagcatcagcgagcagcagcagcctgtgcagcccagcgagagcccccgggaggtggagagcagccccacccagcaggagaccccaggccagcccccagagcaccacgaggtgacagtgagccccccaggccaccaccagacccaccacctggccagccccagcgtgtctgtgaagcccccagatgtgcagctgaccatcgctgctgagcccagcgctgaggtgggcaccagcctggtgcaccaggaggccaccacccggctgagcggcagcggaaatgatgtggagcccccagccatccagcacggcggcccccccctgctgcctgagagcagcgaggaggccggccccctggccgtgcagcaggagaccagcttccagagccctgagcccatcaacaatgaaaaccccagccccacccagcaggaggccgctgctgagcacccccagacagctgaggagggggagagcagcctgacccaccaggaggccccagcccagaccccagagttccccaacgtggtggtggcccagcccccagagcacagccacctgacccaggccaccgtgcagcccctggacctgggcttcaccatcaccccagagagcaagacagaggtggagctgagccccaccatgaaggagacccccacccagccccccaagaaggtggtgccccagctgcgggtgtaccagggcgtgaccaaccccaccccaggccaggaccaggcccagcaccctgtgagccccagcgtgacagtgcagctgctggacctgggcctgaccatcaccccagagcccaccacagaggtgggccacagcaccccacccaagaggaccatcgtgagccccaagcaccctgaggtgaccctgccccacccagaccaggtgcagacccagcacagccacctgacccgggccaccgtgcagcccctggacctgggcttcaccatcacccccaagtccatgacagaggtggagcccagcacagccctgatgaccacagcccctcctcctggccaccctgaggtgaccctgcccccaagtgacaagggccaggcccagcacagccacctgacccaggccaccgtgcagcccctggacctggagctgaccatcaccaccaagcccaccacagaggtgaagcccagccccaccacagaggagaccagcacccagcccccagacctgggcctggccatcatccctgagcccaccacagaaacaggccacagcacagccctggagaagaccacagcccccaggccagacagagtgcagaccctgcacaggagcctgacagaggtgactggaccacccacagagctggagcccgcccaggacagcctggtgcagagcgagagctacacccagaacaaggccctgacagcccctgaggagcacaaggccagcaccagcaccaacatctgtgagctgtgcacctgtggagatgagatgctgagctgcatcgacctgaaccctgagcagaggctgcggcaggtgcctgtgcctgagcccaacacccacaacggcaccttcaccatcctgaacttccagggcaactacatctcctacattgatggaaatgtgtggaaggcctacagctggacagagaagctgatcctgcgggagaacaacctgacagagctgcacaaggacagctttgagggcctgctgagcctgcagtacctggacctgagctgcaacaagatccagagcattgaaagacacacctttgagcccctgcccttcctgaagttcatcaacctgagctgcaacgtcatcacagagctgagctttggcaccttccaggcctggcacggcatgcagttcctgcacaagctgatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgatcctgcccagccacatggcctgctgcctgtgccagttcaagaacagcattgaagctgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgattgtggagcctgaggagcccagcgacagcagcggcatcaacctgagcggctttggaagtgagcagctggacaccaatgatgaaagtgacttcatcagcaccctgcgctacatcctgccctacttctctgctgtgaacctggatgtgaagagcctgctgctgcccctcatcaagctgcccaccactggaaacagcctggccaagatccagacagtgggccagaaccggcagagggtgaagagggtgctgatgggccccaggagcatccagaagaggcacttcaaggaggtgggccggcagagcatccggcgggagcagggcgcccaggcctctgtggagaatgctgctgaggagaagaggctgggcagccctgccccccgggaggtggagcagccccacacccagcagggccctgagaagctggccggaaatgctgtgtacaccaagcccagcttcacccaggagcacaaggctgctgtgtctgtgctgaagcccttcagcaaaggagcccccagcaccagcagccctgccaaggccctgccccaggtgcgggaccgctggaaggacctgacccacgccatcagcaccctggagagcgccaaggcccgggtgaccaacaccaagaccagcaagcccatcgtgcacgccaggaagaagtaccgcttccacaagaccaggagccacgtgacccacaggacccccaaggtgaagaagagccccaaggtgaggaagaagagctacctgagccggctgatgctggccaaccggctgcccttctctgctgccaagagcctcatcaacagccccagccagggcgccttcagcagcctgggggacctgagcccccaggagaaccccttcctggaggtgtctgcccccagcgagcacttcatcgagaagaacaacaccaagcacaccacagccagaaatgcctttgaagaaaatgacttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcctcatccccaacaacaacgtgagaagactcatcgcccacgtgatccgcaccctgaagatggactgcagcggcacccacgtgcaggtgacctgtgccaagctgatcagcaggacaggccacctgatgaagctgctgagcggccagcaggaggtgaaggccagcaagattgagtgggacacagaccagtggaagattgagaactacatcaatgaaagcacagaggcccagagcgagcagaaggagaagagcctggagctgaagaaggaggtgcccggctacggctacacagacaagctgatcctggccctgattgtgacaggcatcctgaccatcctgatcatcctcttctgcctgattgtcatctgctgccaccggcgcagcctgcaggaggatgaggagggcttcagccgggacagcgaggcccccacagaggaggaggagagcgaggccctgccctag

SEQ ID NO: 43301 - DNA, 1701 bp, Artificial Sequence
  Description of Artificial Sequence: Synthetic coding sequence
atgaagatgcagaagggaaatgtgctgctgatgtttggcctgctgctgcacctggaggccgccaccaacagcaatgagaccagcaccagcgccaacacaggcagcagcgtcatcagcagcggggccagcacagccaccaacagcggcagctctgtgaccagcagtggagtgtccacagccaccatcagcggcagctctgtgaccagcaatggagtgtccatcgtgaccaacagcgagttccacaccaccagcagcggcatcagcacagccaccaacagcgagttcagcacagccagcagcggcatcagcatcgccaccaacagcgagagcagcaccaccagcagcggggccagcacagccaccaacagcgagagcagcacccccagcagcggggccagcacagccaccaacagcgagagcagcaccctgagcagcggggccagcacagccaccaacagcgacagcagcaccaccagcagcggggccagcacagccaccaacagcgagagcagcaccaccagcagcggggccagcacagccaccaacagcgagagcagcacagtgagcagccgggccagcacagccaccaacagcgagagcagcaccaccagcagcggggccagcacagccaccaacagcgagagcaggaccaccagcaatggagctggaacagccaccaacagcgagagcagcaccaccagcagcggggccagcacagccaccaacagcgacagcagcacagtgagcagcggggccagcacagccaccaacagcgagagcagcaccaccagcagcggggccagcacagccaccaacagcgagagcagcaccaccagcagcggggccagcacagccaccaacagcgacagcagcaccaccagcagtggagctggaacagccaccaacagcgagagcagcacagtgagcagcggcatcagcacagtgaccaacagcgagagcagcacccccagcagcggggccaacacagccaccaacagcgagagcagcaccaccagcagcggggccaacacagccaccaacagcgagagcagcacagtgtcctctggggccagcacagccaccaacagcgagagcagcaccaccagcagcggcgtgtccacagccaccaacagcgagagcagcaccaccagcagcggggccagcacagccaccaacagcgacagcagcaccaccagcagcgaggccagcacagccaccaacagcgagagcagcacagtgagcagcggcatcagcacagtgaccaacagcgagagcagcaccaccagcagcggggccaacacagccaccaacagcggcagctctgtgaccagcgctggcagcggcacagctgccctgaccggcatgcacaccaccagccacagcgccagcacagctgtgtctgaggccaagccaggcggcagcctggtgccctgggagatcttcctgatcaccctggtgtctgtggtggccgctgtgggcctgtttgctggcctcttcttctgtgtgaggaacagcctgagcctgaggaacaccttcaacacagctgtgtaccacccccacggcctgaaccacggcctgggccctggccctgggggcaaccacggggccccccaccggccccgctggagccccaactggttctggaggaggcctgtgagcagcatcgccatggagatgagcggcaggaacagcggcccctag

SEQ ID NO: 43302 - DNA, 375 bp, Artificial Sequence; identical to SEQ ID NO: 43262
  Description of Artificial Sequence: Synthetic coding sequence

SEQ ID NO: 43303 - DNA, 816 bp, Artificial Sequence
  Description of Artificial Sequence: Synthetic coding sequence
atgttcctgtctgaggagaagctgcactaccgcagcgcccggaccaaggagctggatgccctgctgggggacctgcactgtgagatccgggaccaggagaccctgctgatgtaccagctgcagtgccaggtgctggcccgggctgctgtgctgaccagggtgctggacctggccagccggctggatgtgctgctggccctggccagcgctgcccgggactatggctacagccggccccgctacagcccccaggtgctgggcgtgcgcatccagaatggccgccaccccctgatggagctgtgtgcccggacctttgtgcccaacagcacagaatgtggcggggacaagggccgggtgaaggtgatcaccggccccaacagcagcggcaagagcatctacctgaagcaggtgggcctcatcaccttcatggccctggtgggcagctttgtgcctgctgaggaggccgagattggagctgtggatgccatcttcacccgcatccacagctgtgagagcatcagcctgggcctgagcaccttcatgattgacctgaaccaggtggccaaggctgtgaacaatgccacagcccagagcctggtgctgattgatgaatttgggaagggcaccaacacagtggatggcctggccctgctggccgctgtgctgcggcactggctggcccggggccccacctgcccccacatctttgtggccaccaacttcctgagcctggtgcagctgcagctgctgccccagggccccctggtgcagtacctggactggccccgggtgtctggccaggagggcggggactag

SEQ ID NO: 43304 - DNA, 372 bp, Artificial Sequence
  Description of Artificial Sequence: Synthetic coding sequence
atgcagagcgagaagccccagggcctcttcctgcagctgaaccccaatgccagcagcacagagacccagctgctggtgcctgccctggagagccgggacaccctgccccccacccactgcttcatggccggcacagagagccccctgggcaacccctggcccctgagcctgcccccaccctgctggacaggctgtgtgctgcctgccccccggggccagaggaagccaggccccctgggcctgagcatcttcatcagcctgggcaacaagaggcacaggagcggcaaccacgtggtgcgggagagcgagcagcccctgagccagggcaacccccaccagggctggggccctgacaccaggaaaggaagatag

SEQ ID NO: 43305 - DNA, 102 bp, Artificial Sequence
  Description of Artificial Sequence: Synthetic coding sequence
atgctgaactttgacatctctgctgcccccaggaagacagccctgatgaagctggagaccatcatccacagcaagctgctgcagggccagaagaccaagtag

SEQ ID NO: 43306 - DNA, 102 bp, Artificial Sequence; identical to SEQ ID NO: 43305
  Description of Artificial Sequence: Synthetic coding sequence

SEQ ID NO: 43307 - DNA, 2025 bp, Artificial Sequence
  Description of Artificial Sequence: Synthetic coding sequence
atgcagttctacaccctgaagatcatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgatcctgcccagccacatggcctgctgcctgtgccagttcaagaacagcattgaggccgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgattgtggagcctgaggagcccagcgacagcagcggcatcaacctgagcggcttcggcagcgagcagctggacaccaatgatgaaagtgacttcatcagcaccctgcgctacatcctgccctacttctctgctgtgaacctggatgtgaagagcctgctgctgcccctcatcaagctgcccaccaccggcaacagcctggccaagatccagacagtgggccagaaccggcagagggtgaagagggtgctgatgggccccaggagcatccagaagaggcacttcaaggaggtgggccggcagagcatcagaagagagcagggcgcccaggcctctgtggagaatgctgctgaggagaagaggctgggcagccctgccccccgggaggtggagcagccccacacccagcagggccctgagaagctggccggaaatgctgtgtacaccaagcccagcttcacccaggagcacaaggctgctgtgtctgtgctgaagcccttcagcaagggggcccccagcaccagcagccctgccaaggccctgccccaggtgcgggaccgctggaaggacctgacccacgccatcagcaccctggagagcgccaaggcccgggtgaccaacaccaagaccagcaagcccatcgtgcacgccaggaagaagtaccgcttccacaagaccaggagccacgtgacccacaggacccccaaggtgaagaagagccccaaggtgaggaagaagagctacctgagccggctgatgctggccaaccggctgcccttctctgctgccaagagcctcatcaacagccccagccagggcgccttcagcagcctgggggacctgagcccccaggagaaccccttcctggaggtgtctgcccccagcgagcacttcatcgagaagaacaacaccaagcacaccacagccagaaatgcctttgaggagaatgacttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcctcatccccaacaacaacgtgcggcggctgattgcccacgtgatccgcaccctgaagatggactgcagcggggcccacgtgcaggtgacctgtgccaagctgatcagcaggacaggccacctgatgaagctgctgagcggccagcaggaggtgaaggccagcaagattgagtgggacacagaccagtggaagattgagaactacatcaatgaaagcacagaggcccagagcgagcagaaggagaagagcctggagctgaagaaggaggtgcccggctacggctacacagacaagctgatcctggccctgattgtgacaggcatcctgaccatcctgatcatcctcttctgcctgattgtcatctgctgccacagaagaagcctgcaggaggatgaggagggcttcagccgggacagcgaggcccccacagaggaggaggagagcgaggccctgccctag

SEQ ID NO: 43308 - DNA, 4908 bp, Artificial Sequence
  Description of Artificial Sequence: Synthetic coding sequence
atgaccagcgcccagtgcccagccctggcctgtgtgatgagccccctgcgcttctggggcccctggcccctgctgatgtggcagctgctgtggctgctggtgaaggaggcccagcccctggagtgggtgaaggaccccctgcagctgaccagcaaccccctgggccccccagagccctggagcagccacagcagccacttcccccgggagagcccccacgcccccaccctgcctgctgacccctgggactttgaccacctgggccccagcgccagcagcgagatgcctgccccaccccaggagagcacagagaacctggtgcccttcctggacacctgggacagcgctggggagctgcccctggagcctgagcagttcctggccagccagcaggacctgaaggacaagctgagcccccaggagcggctgcctgtgagccccaagaagctgaagaaggaccctgcccagcgctggagcctggccgagatcatcggcatcatccggcagctgagcaccccccagagccagaagcagaccctgcagaatgagtacagcagcacagacaccccctacccaggcagcctgcccccagagctgcgggtgaagagtgatgagcccccaggccccagcgagcaggtgggccccagccagttccacctggagcctgagacccagaaccctgagaccctggaggacatccagagcagcagcctgcagcaggaggccccagcccagctgccccagctgctggaggaggagcccagctccatgcagcaggaggccccagccctgcccccagagagctccatggagagcctgaccctgcccaaccacgaggtgtctgtgcagcccccaggagaggaccaggcctactaccacctgcccaacatcaccgtgaagccagcagatgtggaggtgaccatcaccagcgagcccaccaatgaaacagagagcagccaggcccagcaggagacccccatccagtttcctgaggaggtggagcccagcgccacccagcaggaggcccccatcgagccccctgtgccccccatggagcacgagctgagcatcagcgagcagcagcagcctgtgcagcccagcgagagcccccgggaggtggagagcagccccacccagcaggagaccccaggccagcccccagagcaccacgaggtgacagtgagccccccaggccaccaccagacccaccacctggccagccccagcgtgtctgtgaagcccccagatgtgcagctgaccatcgctgctgagcccagcgctgaggtgggcaccagcctggtgcaccaggaggccaccacccggctgagcggcagcggaaatgatgtggagcccccagccatccagcacggcggcccccccctgctgcctgagagcagcgaggaggccggccccctggccgtgcagcaggagaccagcttccagagccctgagcccatcaacaatgaaaaccccagccccacccagcaggaggccgctgctgagcacccccagacagctgaggagggggagagcagcctgacccaccaggaggccccagcccagaccccagagttccccaacgtggtggtggcccagcccccagagcacagccacctgacccaggccaccgtgcagcccctggacctgggcttcaccatcaccccagagagcaagacagaggtggagctgagccccaccatgaaggagacccccacccagccccccaagaaggtggtgccccagctgcgggtgtaccagggcgtgaccaaccccaccccaggccaggaccaggcccagcaccctgtgagccccagcgtgacagtgcagctgctggacctgggcctgaccatcaccccagagcccaccacagaggtgggccacagcaccccacccaagaggaccatcgtgagccccaagcaccctgaggtgaccctgccccacccagaccaggtgcagacccagcacagccacctgacccgggccaccgtgcagcccctggacctgggcttcaccatcacccccaagtccatgacagaggtggagcccagcacagccctgatgaccacagcccctcctcctggccaccctgaggtgaccctgcccccaagtgacaagggccaggcccagcacagccacctgacccaggccaccgtgcagcccctggacctggagctgaccatcaccaccaagcccaccacagaggtgaagcccagccccaccacagaggagaccagcacccagcccccagacctgggcctggccatcatccctgagcccaccacagaaacaggccacagcacagccctggagaagaccacagcccccaggccagacagagtgcagaccctgcacaggagcctgacagaggtgactggaccacccacagagctggagcccgcccaggacagcctggtgcagagcgagagctacacccagaacaaggccctgacagcccctgaggagcacaaggccagcaccagcaccaacatctgtgagctgtgcacctgtggagatgagatgctgagctgcatcgacctgaaccctgagcagaggctgcggcaggtgcctgtgcctgagcccaacacccacaacggcaccttcaccatcctgaacttccagggcaactacatctcctacattgatggaaatgtgtggaaggcctacagctggacagagaagctgatcctgcgggagaacaacctgacagagctgcacaaggacagctttgagggcctgctgagcctgcagtacctggacctgagctgcaacaagatccagagcattgaaagacacacctttgagcccctgcccttcctgaagttcatcaacctgagctgcaacgtcatcacagagctgagctttggcaccttccaggcctggcacggcatgcagttcctgcacaagctgatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgatcctgcccagccacatggcctgctgcctgtgccagttcaagaacagcattgaagctgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgattgtggagcctgaggagcccagcgacagcagcggcatcaacctgagcggctttggaagtgagcagctggacaccaatgatgaaagtgacttcatcagcaccctgcgctacatcctgccctacttctctgctgtgaacctggatgtgaagagcctgctgctgcccctcatcaagctgcccaccactggaaacagcctggccaagatccagacagtgggccagaaccggcagagggtgaagagggtgctgatgggccccaggagcatccagaagaggcacttcaaggaggtgggccggcagagcatccggcgggagcagggcgcccaggcctctgtggagaatgctgctgaggagaagaggctgggcagccctgccccccgggaggtggagcagccccacacccagcagggccctgagaagctggccggaaatgctgtgtacaccaagcccagcttcacccaggagcacaaggctgctgtgtctgtgctgaagcccttcagcaaaggagcccccagcaccagcagccctgccaaggccctgccccaggtgcgggaccgctggaaggacctgacccacgccatcagcaccctggagagcgccaaggcccgggtgaccaacaccaagaccagcaagcccatcgtgcacgccaggaagaagtaccgcttccacaagaccaggagccacgtgacccacaggacccccaaggtgaagaagagccccaaggtgaggaagaagagctacctgagccggctgatgctggccaaccggctgcccttctctgctgccaagagcctcatcaacagccccagccagggcgccttcagcagcctgggggacctgagcccccaggagaaccccttcctggaggtgtctgcccccagcgagcacttcatcgagaagaacaacaccaagcacaccacagccagaaatgcctttgaagaaaatgacttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcctcatccccaacaacaacgtgagaagactcatcgcccacgtgatccgcaccctgaagatggactgcagcggggcccacgtgcaggtgacctgtgccaagctgatcagcaggacaggccacctgatgaagctgctgagcggccagcaggaggtgaaggccagcaagattgagtgggacacagaccagtggaagattgagaactacatcaatgaaagcacagaggcccagagcgagcagaaggagaagagcctggagctgaagaaggaggtgcccggctacggctacacagacaagctgatcctggccctgattgtgacaggcatcctgaccatcctgatcatcctcttctgcctgattgtcatctgctgccaccggcgcagcctgcaggaggatgaggagggcttcagccgggacagcgaggcccccacagaggaggaggagagcgaggccctgccctag

SEQ ID NO: 43309 - DNA, 2262 bp, Artificial Sequence
  Description of Artificial Sequence: Synthetic coding sequence
atggagttccaccgggtggcccaggccggcgtggagctgctgagcagcggggaccccccagccagcgccagccagagcgtgggcatcatcggcgtgagccactgcacctggcacatcaacttccagggcaactacatctcctacattgatggaaatgtgtggaaggcctacagctggacagagaagctgatcctgcgggagaacaacctgacagagctgcacaaggacagctttgagggcctgctgagcctgcagtacctgatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgatcctgcccagccacatggcctgctgcctgtgccagttcaagaacagcattgaagctgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgattgtggagcctgaggagcccagcgacagcagcggcatcaacctgagcggctttggaagtgagcagctggacaccaatgatgaaagtgacttcatcagcaccctgcgctacatcctgccctacttctctgctgtgaacctggatgtgaagagcctgctgctgcccctcatcaagctgcccaccactggaaacagcctggccaagatccagacagtgggccagaaccggcagagggtgaagagggtgctgatgggccccaggagcatccagaagaggcacttcaaggaggtgggccggcagagcatccggcgggagcagggcgcccaggcctctgtggagaatgctgctgaggagaagaggctgggcagccctgccccccgggaggtggagcagccccacacccagcagggccctgagaagctggccggaaatgctgtgtacaccaagcccagcttcacccaggagcacaaggctgctgtgtctgtgctgaagcccttcagcaaaggagcccccagcaccagcagccctgccaaggccctgccccaggtgcgggaccgctggaaggacctgacccacgccatcagcaccctggagagcgccaaggcccgggtgaccaacaccaagaccagcaagcccatcgtgcacgccaggaagaagtaccgcttccacaagaccaggagccacgtgacccacaggacccccaaggtgaagaagagccccaaggtgaggaagaagagctacctgagccggctgatgctggccaaccggctgcccttctctgctgccaagagcctcatcaacagccccagccagggcgccttcagcagcctgggggacctgagcccccaggagaaccccttcctggaggtgtctgcccccagcgagcacttcatcgagaagaacaacaccaagcacaccacagccagaaatgcctttgaagaaaatgacttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcctcatccccaacaacaacgtgagaagactcatcgcccacgtgatccgcaccctgaagatggactgcagcggggcccacgtgcaggtgacctgtgccaagctgatcagcaggacaggccacctgatgaagctgctgagcggccagcaggaggtgaaggccagcaagattgagtgggacacagaccagtggaagattgagaactacatcaatgaaagcacagaggcccagagcgagcagaaggagaagagcctggagctgaagaaggaggtgcccggctacggctacacagacaagctgatcctggccctgattgtgacaggcatcctgaccatcctgatcatcctcttctgcctgattgtcatctgctgccaccggcgcagcctgcaggaggatgaggagggcttcagccgggacagcgaggcccccacagaggaggaggagagcgaggccctgccctag

SEQ ID NO: 43310 - DNA, 372 bp, Artificial Sequence; identical to SEQ ID NO: 43304
  Description of Artificial Sequence: Synthetic coding sequence

SEQ ID NO: 43311 - DNA, 876 bp, Artificial Sequence
  Description of Artificial Sequence: Synthetic coding sequence
tctgctgggggcggcggggccggcagccggctgcaggccgagatgctgcagatggacctgattgatgccaccggggacagcaccccagatgagccagatgtgcacttcagcaagaagttcctgaacatcttcatgagcggccgcagccgcagcagcagcgctgagagctttggcctcttcagctgcatcatcaaccgggaggagcaggagcagacccacaggaccatcttccgctttgtgcccaggcatgaagatgagcctgagctggaggtggatgaccccctgctggtggagctgcaggccgaggactactggtatgaggcctacaacatgaggactggagcccggggcttcttcaccgcctactatgccatcgaggtgaccaaggagcctgagcacatggccgccctggccaagaacagcgactgggtggaccagttccgggtgaagttcctgggctctgtgcaggtgccctaccacaagggagatgtggtgctgtctgctgccatgcagaagatcgccaccacccggcggctgactgtgcacttcaacccccccagcagctgtgtgctggagatctctgtgcggggcgtgaagattggagtgaaggcagatgacagccaggaggccaagggcaacaagtgcagccacttcttccagctgaagaacatctccttccggggctaccaccccaagaacaacaagtacttcggcttcatcaccaagcacctggccgaccacagatttgcctgccacgtgtttgtgtctgaggacagcaccaaggccctggccgagagcgtgggccgggccttccagcagttccacaagcagtttgtggagtacacctgccccacagaggacatctacctggagtag

SEQ ID NO: 43312 - DNA, 2055 bp, Artificial Sequence
  Description of Artificial Sequence: Synthetic coding sequence
atggcctgcctgggcttcctgctgcctgtgggcttcctgctgctgatcagcacagtggccggcggcaagtatggagtggcccacgtggtgtctgagaactggagcaaggactactgcatcctcttcagcagtgactacatcaccctgccccgggacctgcaccacgcccccctgctgcccctgtatgatggcaccaaggccccctggtgccctggagaggacagcccccaccaggcccagctgcggagccccagccagaggcccctgcggcagaccacagccatggtgatgaggggcaactgcagcttccacaccaagggctggctggcccagggccagggcgcccacggcctgctgattgtgtcccgggtgtctgaccagcagtgcagcgacaccaccctggccccccaggacccccggcagcccctggccgacctgaccatccctgtggccatgctgcactacgccgacatgctggacatcctgagccacaccagaggagaggccgtggtgcgggtggccatgtatgcccctcctgagcccatcatcgactacaacatgctggtgatcttcatcctggccgtgggcaccgtggccgccggcggctactgggccggcctgacagaggccaaccggctgcagaggcggcgggccaggagaggaggcggccctgggggccaccaccagctgcaggaggccgctgctgctgagggcgcccagaaggaggacaatgaagacatccctgtggacttcaccccagccatgactggagtggtggtgaccctgagctgcagcctgatgctgctgctgtacttcttctatgaccactttgtgtatgtgaccatcggcatcttcggcctgggcgccggcatcggcctgtacagctgcctgagccccctggtgtgccgcctgagcctgcggcagtaccagaggcctccccacagcctgtgggccagcctgcccctgcccctgctgctgctggccagcctgtgcaccaccgtcatcatcttctgggtggcctacagaaatgaagatcgctgggcctggctgctgcaggacaccctgggcatctcctactgcctgtttgtgctgcaccgggtgcggctgcccaccctgaagaactgcagcagcttcctgctggccctgctggcctttgatgtgttctttgtgtttgtgacccccttcttcaccaagacaggagagagcatcatggcccaggtggccctgggccctgctgagagcagcagccatgagcggctgcccatggtgctgaaggtgccccggctgcgggtgtctgccctgaccctgtgcagccagcccttcagcatcctgggctttggagacatcgtggtgcccggcttcctggtggcctactgctgcccctttgatgtgcaggtgtgcagccggcaggtgtactttgtggcctgcaccgtggcctatgctgtgggcctgctggtgaccttcatggccatggtgctgatgcagatgggccagcctgccctgctgtacctggtgagcagcaccctgctgaccagcctggccgtggccgcctgccggcaggagctgagcctcttctggacaggccagggccgggccaagatgtgtggcctgggctgtgcccccagcgctggcagccggcagaagcaggagggcgctgctgatgcccacacagccagcaccctggagcggggcaccagcagaggagctggggacctggacagcaaccctggagaggacaccacagaaattgtgaccatcagtgaaaatgaggccaccaacccagaagatagaagtgacagccctgagggctggagcgatgcccacctggaccccaatgagctgcccttcatccccccccgggccagcgaggagctgatgcccctgatgcccatggccatgctgatccccctgatgcccctgatgccccggcccagcgagctgggccacgtgcacgcccaggcccaggcccatgaaacaggcctgccctgggccggcctgcacaagaggaagggcctgaaggtgaggaagtccatgagcacccaggcccccctgtag

SEQ ID NO: 43313 - DNA, 372 bp, Artificial Sequence; identical to SEQ ID NO: 43304
  Description of Artificial Sequence: Synthetic coding sequence

SEQ ID NO: 43314 - DNA, 2025 bp, Artificial Sequence
  Description of Artificial Sequence: Synthetic coding sequence
atgcagttctacaccctgaagatcatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgatcctgcccagccacatggcctgctgcctgtgccagttcaagaacagcattgaggccgtgtgcaagacagtgaagctgcactgcaacagcgcctgcctgaccaacaccatccactgcccagaggaggcctctgtgggcaaccctgagggcgccttcatgaaggtgctgcaggccaggaagaactacaccagcacagagctgattgtggagcctgaggagcccagcgacagcagcggcatcaacctgagcggcttcggcagcgagcagctggacaccaatgatgaaagtgacttcatcagcaccctgcgctacatcctgccctacttctctgctgtgaacctggatgtgaagagcctgctgctgcccctcatcaagctgcccaccaccggcaacagcctggccaagatccagacagtgggccagaaccggcagagggtgaagagggtgctgatgggccccaggagcatccagaagaggcacttcaaggaggtgggccggcagagcatcagaagagagcagggcgcccaggcctctgtggagaatgctgctgaggagaagaggctgggcagccctgccccccgggaggtggagcagccccacacccagcagggccctgagaagctggccggaaatgctgtgtacaccaagcccagcttcacccaggagcacaaggctgctgtgtctgtgctgaagcccttcagcaagggggcccccagcaccagcagccctgccaaggccctgccccaggtgcgggaccgctggaaggacctgacccacgccatcagcatcctggagagcgccaaggcccgggtgaccaacaccaagaccagcaagcccatcgtgcacgccaggaagaagtaccgcttccacaagaccaggagccacgtgacccacaggacccccaaggtgaagaagagccccaaggtgaggaagaagagctacctgagccggctgatgctggccaaccggctgcccttctctgctgccaagagcctcatcaacagccccagccagggcgccttcagcagcctgggggacctgagcccccaggagaaccccttcctggaggtgtctgcccccagcgagcacttcatcgagaagaacaacaccaagcacaccacagccagaaatgcctttgaggagaatgacttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagaccccagccctgagcccaagagcttcaactaccccctgctgagcagccctggggaccagtttgagatccagctgacccagcagctgcagagcctcatccccaacaacaacgtgcggcggctgattgcccacgtgatccgcaccctgaagatggactgcagcggggcccacgtgcaggtgacctgtgccaagctgatcagcaggacaggccacctgatgaagctgctgagcggccagcaggaggtgaaggccagcaagattgagtgggacacagaccagtggaagattgagaactacatcaatgaaagcacagaggcccagagcgagcagaaggagaagagcctggagctgaagaaggaggtgcccggctacggctacacagacaagctgatcctggccctgattgtgacaggcatcctgaccatcctgatcatcctcttctgcctgattgtcatctgctgccacagaagaagcctgcaggaggatgaggagggcttcagccgggacagcgaggcccccacagaggaggaggagagcgaggccctgccctag

SEQ ID NO: 43315 - DNA, 393 bp, Artificial Sequence
  Description of Artificial Sequence: Synthetic coding sequence
ggggcccggagccctggcagcacccaccagggcagcctggccagcggcgtgctgcccatcaagtgcagccacgtggagtttggcatgtggaagggcggccgcagccaccccttcctgccccacagcagccgctgtgccggcagcggcggccagctggacagcatcctgccccaccagagccctgcctggggcccctggggctgcaaggacctgagcagcggcttccccagcttcctgaccagcagcatcctgtggaagtctgctgtggtgcgggagccccacatcagcccccaccaggccccaccctacaagaccagtgactgcatccgggccatctccttccctgtgtgcaccatccaccaggagatcatgaggggccactggcacaagtag

SEQ ID NO: 43316 - DNA, 876 bp, Artificial Sequence; identical to SEQ ID NO: 43311
  Description of Artificial Sequence: Synthetic coding sequence

SEQ ID NO: 43317 - DNA, 1593 bp, Artificial Sequence
  Description of Artificial Sequence: Synthetic coding sequence
atgagcctgaagtggacctctgtgttcctgctgatccagctgagctgctacttcagcagcggcagctgtgggaaggtgctggtgtggcccacagagtacagccactggatcaacatgaagaccatcctggaggagctggtgcagaggggccacgaggtgacagtgctgaccagcagcgccagcaccctggtgaatgccagcaagagcagcgccatcaagctggaggtgtaccccaccagcctgaccaagaatgacctggaggacagcctgctgaagatcctggaccgctggatctatggagtgtccaagaacaccttctggagctacttcagccagctgcaggagctgtgctgggagtactatgactacagcaacaagctgtgcaaggatgctgtgctgaacaagaagctgatgatgaagctgcaggagagcaagtttgatgtgatcctggctgatgccctgaacccctgtggggagctgctggccgagctgttcaacatccccttcctgtacagcctgcgcttctctgtgggctacacctttgagaagaatggaggcggcttcctgtttcctccttcctatgtgcctgtggtgatgtctgagctgagtgaccagatgatcttcatggagcgcatcaagaacatgatccacatgctgtactttgacttctggttccagatctatgacctgaagaagtgggaccagttctacagcgaggtgctgggccggcccaccaccctgtttgagaccatgggcaaggccgagatgtggctgatccgcacctactgggactttgagttcccccggcccttcctgcccaacgtggactttgtgggcggcctgcactgcaagccagccaagcccctgcccaaggagatggaggagtttgtgcagagcagcggggagaatggaattgtggtgttcagcctgggctccatgatcagcaacatgtctgaggagagcgccaacatgattgccagcgccctggcccagatcccccagaaggtgctgtggaggtttgatggcaagaagcccaacaccctgggcagcaacacccggctgtacaagtggctgccccagaatgacctgctgggccaccccaagaccaaggccttcatcacccatggaggcaccaacggcatctatgaggccatctaccacggcatccccatggtgggcatccccctgtttgctgaccagcacgacaacatcgcccacatgaaggccaagggggccgccctgtctgtggacatccgcaccatgagcagccgggacctgctgaatgccctgaagagcgtcatcaatgaccctgtgtacaaggaaaatgtgatgaagctgagccgcatccaccacgaccagcccatgaagcccctggacagagctgtgttctggattgaatttgtgatgaggcacaagggggccaagcacctgcgggtggccgcccacaacctgacctggatccagtaccacagcctggatgtgattgccttcctgctggcctgtgtggccaccgtcatcttcatcatcaccaagttctgcctcttctgcttcaggaagctggccaagaagggcaagaagaagaagagggactag

SEQ ID NO: 43318 - DNA, 102 bp, Artificial Sequence; identical to SEQ ID NO: 43305
  Description of Artificial Sequence: Synthetic coding sequence

SEQ ID NO: 43319 - DNA, 375 bp, Artificial Sequence
  Description of Artificial Sequence: Synthetic coding sequence
atgaccctgaatgagcacgccgccttcaagcacctgttcaacaaggcccacctggccccacccctcatccacctgaccctgagcggccacagcacctgcttccgggagcaccgggtgggcggcaaggtgacagaccagcaggaccccaaggccgaggagttcttcctggtgcagaacaagatgaagagcctgccctgcctgctgctgagcacccagacaggccagcccagcgacttcagcatcttcagcccccccttcccccccttctacagcaccaagccacccctgagctcctggcccatccccaatgagcccctgggcaccccaccaagaagaggccggggccgggcagagggcctgctgaccagccagtag

SEQ ID NO: 43320 - DNA, 474 bp, Artificial Sequence
  Description of Artificial Sequence: Synthetic coding sequence
atgcacccctggctgggcagcgccctgggcttccccaagtgccggggcatccacctgtgtgcctgtggaaatggctggaccccaggagagaccctgagccagaacaagacagagatcaccaagaacaaggtgacctgctggaggccccacggctgtgagcccaacacaggcctgggctaccagggcagccacaccagcaagtacaccctgctgccctggaacctgctgaagaccaagcccctgccccccagccacggcaaggagggcggcaaggaggccaaggtgcccagcggggacaacagcggccgcggggaggtgccccgggcccaggagggccaggccgcctgtggccgggccgccagcggggacagccaggagggcatgagaagaggctgtgaggagcgggccacagcccagaggcctgctgtgcgctctgctgagaccacagcccacggcacctggatctacccctag

SEQ ID NO: 43321 - DNA, 612 bp, Artificial Sequence
  Description of Artificial Sequence: Synthetic coding sequence
atgggcaacatctttgagaagctgttcaagagcctgctgggcaagaagaagatgaggatcctgatcctgagcctggacacagctgggaagaccaccatcctgtacaagctgaagctgggggagaccgtgcctgctgtgcccaccgtgggcttctgtgtggagaccgtggagtacaagaacaacacctttggagtgtgggatgtgggcagccacttcaagatccggcccctgtggcagcacttcttccagaacaccaagggggcccggagccctggcagcacccaccagggcagcctggccagcggcgtgctgcccatcaagtgcagccacgtggagtttggcatgtggaagggcggccgcagccaccccttcctgccccacagcagccgctgtgccggcagcggcggccagctggacagcatcctgccccaccagagccctgcctggggcccctggggctgcaaggacctgagcagcggcttccccagcttcctgaccagcagcatcctgtggaagtctgctgtgtcctaccagctgcccagcctgcacaacagcagcagaaattatgccggcagcctggcccagatgatgaggcacctgctggaggcctag

SEQ ID NO: 43322 - DNA, 1701 bp, Artificial Sequence
  Description of Artificial Sequence: Synthetic coding sequence
atgaagatgcagaagggaaatgtgctgctgatgtttggcctgctgctgcacctggaggccgccaccaacagcaatgagaccagcaccagcgccaacacaggcagcagcgtcatcagcagcggggccagcacagccaccaacagcggcagctctgtgaccagcagtggagtgtccacagccaccatcagcggcagctctgtgaccagcaatggagtgtccatcgtgaccaacagcgagttccacaccaccagcagcggcatcagcacagccaccaacagcgagttcagcacagccagcagcggcatcagcatcgccaccaacagcgagagcagcaccaccagcagcggggccagcacagccaccaacagcgagagcagcacccccagcagcggggccagcacagccaccaacagcgagagcagcaccctgagcagcggggccagcacagccaccaacagcgacagcagcaccaccagcagcggggccagcacagccaccaacagcgagagcagcaccaccagcagcggggccagcacagccaccaacagcgagagcagcacagtgagcagccgggccagcacagccaccaacagcgagagcagcaccaccagcagcggggccagcacagccaccaacagcgagagcaggaccaccagcaatggagctggaacagccaccaacagcgagagcagcaccaccagcagcggggccagcacagccaccaacagcgacagcagcaccaccagcagcggggccggcacagccaccaacagcgagagcagcaccaccagcagcggggccagcacagccaccaacagcgagagcagcaccaccagcagcggggccagcacagccaccaacagcgacagcagcaccaccagcagtggagctggaacagccaccaacagcgagagcagcacagtgagcagcggcatcagcacagtgaccaacagcgagagcagcacccccagcagcggggccaacacagccaccaacagcgagagcagcaccaccagcagcggggccaacacagccaccaacagcgagagcagcacagtgtcctctggggccagcacagccaccaacagcgagagcagcaccaccagcagcggcgtgtccacagccaccaacagcgagagcagcaccaccagcagcggggccagcacagccaccaacagcgacagcagcaccaccagcagcgaggccagcacagccaccaacagcgagagcagcacagtgagcagcggcatcagcacagtgaccaacagcgagagcagcaccaccagcagcggggccaacacagccaccaacagcggcagctctgtgaccagcgctggcagcggcacagctgccctgaccggcatgcacaccaccagccacagcgccagcacagctgtgtctgaggccaagccaggcggcagcctggtgccctgggagatcttcctgatcaccctggtgtctgtggtggccgctgtgggcctgtttgctggcctcttcttctgtgtgaggaacagcctgagcctgaggaacaccttcaacacagctgtgtaccacccccacggcctgaaccacggcctgggccctggccctgggggcaaccacggggccccccaccggccccgctggagccccaactggttctggaggaggcctgtgagcagcatcgccatggagatgagcggcaggaacagcggcccctag

SEQ ID NO: 43323 - DNA, 4908 bp, Artificial Sequence
  Description of Artificial Sequence: Synthetic coding sequence
atgaccagcgcccagtgcccagccctggcctgtgtgatgagccccctgcgcttctggggcccctggcccctgctgatgtggcagctgctgtggctgctggtgaaggaggcccagcccctggagtgggtgaaggaccccctgcagctgaccagcaaccccctgggccccccagagccctggagcagccacagcagccacttcccccgggagagcccccacgcccccaccctgcctgctgacccctgggactttgaccacctgggccccagcgccagcagcgagatgcctgccccaccccaggagagcacagagaacctggtgcccttcctggacacctgggacagcgctggggagctgcccctggagcctgagcagttcctggccagccagcaggacctgaaggacaagctgagcccccaggagcggctgcctgtgagccccaagaagctgaagaaggaccctgcccagcgctggagcctggccgagatcatcggcatcatccggcagctgagcaccccccagagccagaagcagaccctgcagaatgagtacagcagcacagacaccccctacccaggcagcctgcccccagagctgcgggtgaagagtgatgagcccccaggccccagcgagcaggtgggccccagccagttccacctggagcctgagacccagaaccctgagaccctggaggacatccagagcagcagcctgcagcaggaggccccagcccagctgccccagctgctggaggaggagcccagctccatgcagcaggaggccccagccctgcccccagagagctccatggagagcctgaccctgcccaaccacgaggtgtctgtgcagcccccaggagaggaccaggcctactaccacctgcccaacatcaccgtgaagccagcagatgtggaggtgaccatcaccagcgagcccaccaatgaaacagagagcagccaggcccagcaggagacccccatccagtttcctgaggaggtggagcccagcgccacccagcaggaggcccccatcgagccccctgtgccccccatggagcacgagctgagcatcagcgagcagcagcagcctgtgcagcccagcgagagcccccgggaggtggagagcagccccacccagcaggagaccccaggccagcccccagagcaccacgaggtgacagtgagccccccaggccaccaccagacccaccacctggccagccccagcgtgtctgtgaagcccccagatgtgcagctgaccatcgctgctgagcccagcgctgaggtgggcaccagcctggtgcaccaggaggccaccacccggctgagcggcagcggaaatgatgtggagcccccagccatccagcacggcggcccccccctgctgcctgagagcagcgaggaggccggccccctggccgtgcagcaggagaccagcttccagagccctgagcccatcaacaatgaaaaccccagccccacccagcaggaggccgctgctgagcacccccagacagctgaggagggggagagcagcctgacccaccaggaggccccagcccagaccccagagttccccaacgtggtggtggcccagcccccagagcacagccacctgacccaggccaccgtgcagcccctggacctgggcttcaccatcaccccagagagcaagacagaggtggagctgagccccaccatgaaggagacccccacccagccccccaagaaggtggtgccccagctgcgggtgtaccagggcgtgaccaaccccaccccaggccaggaccaggcccagcaccctgtgagccccagcgtgacagtgcagctgctggacctgggcctgaccatcaccccagagcccaccacagaggtgggccacagcaccccacccaagaggaccatcgtgagccccaagcaccctgaggtgaccctgccccacccagaccaggtgcagacccagcacagccacctgacccgggccaccgtgcagcccctggacctgggcttcaccatcacccccaagtccatgacagaggtggagcccagcacagccctgatgaccacagcccctcctcctggccaccctgaggtgaccctgcccccaagtgacaagggccaggcccagcacagccacctgacccaggccaccgtgcagcccctggacctggagctgaccatcaccaccaagcccaccacagaggtgaagcccagccccaccacagaggagaccagcacccagcccccagacctgggcctggccatcatccctgagcccaccacagaaacaggccacagcacagccctggagaagaccacagcccccaggccagacagagtgcagaccctgcacaggagcctgacagaggtgactggaccacccacagagctggagcccgcccaggacagcctggtgcagagcgagagctacacccagaacaaggccctgacagcccctgaggagcacaaggccagcaccagcaccaacatctgtgagctgtgcacctgtggagatgagatgctgagctgcatcgacctgaaccctgagcagaggctgcggcaggtgcctgtgcctgagcccaacacccacaacggcaccttcaccatcctgaacttccagggcaactacatctcctacattgatggaaatgtgtggaaggcctacagctggacagagaagctgatcctgcgggagaacaacctgacagagctgcacaaggacagctttgagggcctgctgagcctgcagtacctggacctgagctgcaacaagatccagagcattgaaagacacacctttgagcccctgcccttcctgaagttcatcaacctgagctgcaacgtcatcacagagctgagctttggcaccttccaggcctggcacggcatgcagttcctgcacaagctgatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgatcctgcccagccacatggcctgctgcctgtgccagttcaagaacagcattgaagctgtgtgcaagacagtgaagctgcactgcaacagcgcctgcctgaccaacaccatccactgcccagaggaggcctctgtgggcaaccctgagggcgccttcatgaaggtgctgcaggccaggaagaactacaccagcacagagctgattgtggagcctgaggagcccagcgacagcagcggcatcaacctgagcggctttggaagtgagcagctggacaccaatgatgaaagtgacttcatcagcaccctgcgctacatcctgccctacttctctgctgtgaacctggatgtgaagagcctgctgctgcccctcatcaagctgcccaccactggaaacagcctggccaagatccagacagtgggccagaaccggcagagggtgaagagggtgctgatgggccccaggagcatccagaagaggcacttcaaggaggtgggccggcagagcatccggcgggagcagggcgcccaggcctctgtggagaatgctgctgaggagaagaggctgggcagccctgccccccgggaggtggagcagccccacacccagcagggccctgagaagctggccggaaatgctgtgtacaccaagcccagcttcacccaggagcacaaggctgctgtgtctgtgctgaagcccttcagcaaaggagcccccagcaccagcagccctgccaaggccctgccccaggtgcgggaccgctggaaggacctgacccacgccatcagcatcctggagagcgccaaggcccgggtgaccaacaccaagaccagcaagcccatcgtgcacgccaggaagaagtaccgcttccacaagaccaggagccacgtgacccacaggacccccaaggtgaagaagagccccaaggtgaggaagaagagctacctgagccggctgatgctggccaaccggctgcccttctctgctgccaagagcctcatcaacagccccagccagggcgccttcagcagcctgggggacctgagcccccaggagaaccccttcctggaggtgtctgcccccagcgagcacttcatcgagaagaacaacaccaagcacaccacagccagaaatgcctttgaagaaaatgacttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagaccccagccctgagcccaagagcttcaactaccccctgctgagcagccctggggaccagtttgagatccagctgacccagcagctgcagagcctcatccccaacaacaacgtgagaagactcatcgcccacgtgatccgcaccctgaagatggactgcagcggggcccacgtgcaggtgacctgtgccaagctgatcagcaggacaggccacctgatgaagctgctgagcggccagcaggaggtgaaggccagcaagattgagtgggacacagaccagtggaagattgagaactacatcaatgaaagcacagaggcccagagcgagcagaaggagaagagcctggagctgaagaaggaggtgcccggctacggctacacagacaagctgatcctggccctgattgtgacaggcatcctgaccatcctgatcatcctcttctgcctgattgtcatctgctgccaccggcgcagcctgcaggaggatgaggagggcttcagccgggacagcgaggcccccacagaggaggaggagagcgaggccctgccctag

SEQ ID NO: 43324 - DNA, 372 bp, Artificial Sequence; identical to SEQ ID NO: 43304
  Description of Artificial Sequence: Synthetic coding sequence

SEQ ID NO: 43325 - DNA, 2262 bp, Artificial Sequence
  Description of Artificial Sequence: Synthetic coding sequence
atggagttccaccgggtggcccaggccggcgtggagctgctgagcagcggggaccccccagccagcgccagccagagcgtgggcatcatcggcgtgagccactgcacctggcacatcaacttccagggcaactacatctcctacattgatggaaatgtgtggaaggcctacagctggacagagaagctgatcctgcgggagaacaacctgacagagctgcacaaggacagctttgagggcctgctgagcctgcagtacctgatcctgaaccacaaccccctgaccaccgtggaggacccctacctgttcaagctgcctgccctgaagtacctggacatgggcaccaccctggtgcccctgaccaccctgaagaacatcctgatgatgacagtggagctggagaagctgatcctgcccagccacatggcctgctgcctgtgccagttcaagaacagcattgaagctgtgtgcaagacagtgaagctgcactgcaacagcgcctgcctgaccaacaccacccactgcccagaggaggcctctgtgggcaaccctgagggcgccttcatgaaggtgctgcaggccaggaagaactacaccagcacagagctgattgtggagcctgaggagcccagcgacagcagcggcatcaacctgagcggctttggaagtgagcagctggacaccaatgatgaaagtgacttcatcagcaccctgcgctacatcctgccctacttctctgctgtgaacctggatgtgaagagcctgctgctgcccctcatcaagctgcccaccactggaaacagcctggccaagatccagacagtgggccagaaccggcagagggtgaagagggtgctgatgggccccaggagcatccagaagaggcacttcaaggaggtgggccggcagagcatccggcgggagcagggcgcccaggcctctgtggagaatgctgctgaggagaagaggctgggcagccctgccccccgggaggtggagcagccccacacccagcagggccctgagaagctggccggaaatgctgtgtacaccaagcccagcttcacccaggagcacaaggctgctgtgtctgtgctgaagcccttcagcaaaggagcccccagcaccagcagccctgccaaggccctgccccaggtgcgggaccgctggaaggacctgacccacgccatcagcaccctggagagcgccaaggcccgggtgaccaacaccaagaccagcaagcccatcgtgcacgccaggaagaagtaccgcttccacaagaccaggagccacgtgacccacaggacccccaaggtgaagaagagccccaaggtgaggaagaagagctacctgagccggctgatgctggccaaccggctgcccttctctgctgccaagagcctcatcaacagccccagccagggcgccttcagcagcctgggggacctgagcccccaggagaaccccttcctggaggtgtctgcccccagcgagcacttcatcgagaagaacaacaccaagcacaccacagccagaaatgcctttgaagaaaatgacttcatggagaacaccaacatgcctgagggcaccatcagcgagaacaccaactacaaccaccccccagaggccgacagcgctggaacagccttcaacctgggccccaccgtgaagcagacagagaccaagtgggagtacaacaacgtgggcacagacctgagccctgagcccaagagcttcaactaccccctgctgagcagccctggggaccagtttgagatccagctgacccagcagctgcagagcctcatccccaacaacaacgtgagaagactcatcgcccacgtgatccgcaccctgaagatggactgcagcggcacccacgtgcaggtgacctgtgccaagctgatcagcaggacaggccacctgatgaagctgctgagcggccagcaggaggtgaaggccagcaagattgagtgggacacagaccagtggaagattgagaactacatcaatgaaagcacagaggcccagagcgagcagaaggagaagagcctggagctgaagaaggaggtgcccggctacggctacacagacaagctgatcctggccctgattgtgacaggcatcctgaccatcctgatcatcctcttctgcctgattgtcatctgctgccaccggcgcagcctgcaggaggatgaggagggcttcagccgggacagcgaggcccccacagaggaggaggagagcgaggccctgccctag

SEQ ID NO: 43326 - DNA, 378 bp, Artificial Sequence
  Description of Artificial Sequence: Synthetic coding sequence
atgggcaacatctttgagaagctgttcaagagcctgctgggcaagaagaagatgaggatcctgatcctgagcctggacacagctgggaagaccaccatcctgtacaagctgaagctgggggagaccgtgcctgctgtgcccaccgtgggcttctgtgtggagaccgtggagtacaagaacaacacctttggagtgtgggatgtgggcagccacttcaagatccggcccctgtggcagcacttcttccagaacaccaaggagctgagcgccagccagtttgcccagttcatcaagaagctgtgtggggtgacaggcaccaatgatgaggccagccctggcagcctgaccagctaccccagccacctgctggacagatag

SEQ ID NO: 43327 - DNA, 102 bp, Artificial Sequence; identical to SEQ ID NO: 43305
  Description of Artificial Sequence: Synthetic coding sequence

SEQ ID NO: 43328 - DNA, 522 bp, Artificial Sequence
  Description of Artificial Sequence: Synthetic coding sequence
atgcctgccatgcccagccccctgtgtgccccagcccgggtgagccccagccccctgacagctgccccacccttctgcagcctgagccccatcctgtgggtgtccctcatcctgctgctgaccagcatcagcaagtgctgtgagagcatcttcaagttcatccagaaccccttcaccagccactacttcccctgcagccaccccagccagggcaagaggcggctgcaccctggcatcctgcacagcttccccaccgtcttccccacagccagcctggtgccccacctgagcatcctcttcagcgcccagcagcctgagaggagcttccagaggatgagccccaccatgagccacttcagcaagctgagcagcccctgccacagcgagcagaggagcacccccttcccccaccccagcggcctgcctgccctggccacccccctgaccagcctgcagttcctgtgtgtgcagcccttctggctgctgccccccagcaggaacacagacaacttcctgccctag

SEQ ID NO: 43329 - DNA, 876 bp, Artificial Sequence; identical to SEQ ID NO: 43311
  Description of Artificial Sequence: Synthetic coding sequence

SEQ ID NO: 43330 - DNA, 1272 bp, Artificial Sequence
  Description of Artificial Sequence: Synthetic coding sequence
atgatgtacagaccagatgtggtgcgggccaggaagagggtgtgctgggagccctgggtgattggcctggtgatcttcatcagcctcatcgtgctggccgtgtgcatcggcctgactgtgcactacgtgcgctacaaccagaagaagacctacaactactacagcaccctgtccttcaccacagacaagctgtatgcagagtttggccgggaggccagcaacaacttcacagagatgagccagaggctggagagcatggtgaagaatgccttctacaagagccccctgcgggaggagtttgtgaagagccaggtgatcaagttcagccagcagaagcatggagtgctggcccacatgctgctgatctgccgcttccacagcacagaagatcctgagaccgtggacaagatcgtgcagctggtgctgcacgagaagctgcaggatgctgtgggcccccccaaggtggacccccagagcgtgaagatcaagaagatcaacaagacagaaacagacagctacctgaaccactgctgcggcaccaggaggagcaagaccctgggccagagcctgcgcatcgtgggcggcacagaggtggaggagggggagtggccctggcaggccagcctgcagtgggatggcagccaccgctgtggggccaccctcatcaatgccacctggctggtgtctgctgcccactgcttcaccacctacaagaacccagcccgctggacagccagctttggagtgaccatcaagcccagcaagatgaagaggggcctgcggcgcatcatcgtgcatgagaagtacaagcaccccagccatgactatgacatcagcctggccgagctgagcagccctgtgccctacaccaatgctgtgcaccgggtgtgcctgcctgatgccagctatgagttccagcctggagatgtgatgtttgtgacaggctttggagccctgaagaatgatggctacagccagaaccacctgcggcaggcccaggtgaccctgattgatgccaccacctgcaatgagccccaggcctacaatgatgccatcacccccaggatgctgtgtgccggcagcctggagggcaagacagatgcctgccagggcgacagcggcggccccctggtgtccagtgatgcccgggacatctggtacctggccggcatcgtgtcctggggagatgaatgtgccaagcccaacaagccaggagtgtacaccagggtgacagccctgcgggactggatcaccagcaagacaggcatctag

SEQ ID NO: 43331 - DNA, 375 bp, Artificial Sequence; identical to SEQ ID NO: 43262
  Description of Artificial Sequence: Synthetic coding sequence

SEQ ID NO: 43332 - DNA, 339 bp, Artificial Sequence
  Description of Artificial Sequence: Synthetic coding sequence
tgtgacatccagatgacccagagccccagcagcctgagcgcctctgtgggggacagagtgaccatcacctgccgggccagccagagcatcagcagctacctgaactggtaccagcagaagccaggcaaggcccccaagctgctgatctatgctgccagcagcctgcagagcggcgtgcccagccgcttcagcggcagcggcagcggcacagacttcaccctgaccatcagcagcctgcagcctgaggactttgccacctactactgccagcagagctacagcaccccacccaccgtgctgcagggcacccggctgaagatcagccgggtggaggcctag

SEQ ID NO: 43333 - DNA, 384 bp, Artificial Sequence
  Description of Artificial Sequence: Synthetic coding sequence
atggagtttggcctgaactgggtgttcctggtggccatcatcaagggggcccagtgtgaggtgcagctggtggagagcggcggcggcctggtgcagcccggcggcagcctgcggctgagctgcccagacagcggcttcaccttcagcaaccactacatgtcctgggtgcggcaggcccctgggaagggcctggagtggatctcctacatcagcggggacagcggctacaccaactatgctgacagcgtgaagggccgcttcaccatcagccgggacaatgccaacaacagcccctacctgcagatgaacagcctgcgggcagaggacacagctgtgtactactgtgtgaagcacacagcccggggcaacctgcagttctactag

SEQ ID NO: 43334 - DNA, 315 bp, Artificial Sequence
  Description of Artificial Sequence: Synthetic coding sequence
atgacccagagccccagcagcctgagcgcctctgtgggggacagagtgaccatcacctgccgggccagccagagcatcagcagctacctgaactggtaccagcagaagccaggcaaggcccccaagctgctgatctatgctgccagcagcctgcagagcggcgtgcccagccgcttcagcggcagcggcagcggcacagacttcaccctgaccatcagcagcctgcagcctgaggactttgccacctactactgccagcagagctacagcaccccacccaccgtgggcagcggcacctacttcaagctgaagtag

SEQ ID NO: 43335 - DNA, 348 bp, Artificial Sequence
  Description of Artificial Sequence: Synthetic coding sequence
atgctgtgggtgcccggcagcagtggagatgtggtgatgacccagagccccctgagcctgcctgtgaccctgggccagcctgccagcatcagctgccgcagcagccagagcctggtgtacagtgatggcaacacctacctgaactggttccagcagaggcctggccagagccccaggaggctcatctacaaggtgagcaactgggacagcggcgtgcctgaccgcttcagcggcagcggcagcggcacagacttcaccctgaagatcagccgggtggaggctgaagatgtgggcgtgtactactgcatgcagggcacccactggcccccaacagtggtgcagccctag

SEQ ID NO: 43336 - DNA, 348 bp, Artificial Sequence
  Description of Artificial Sequence: Synthetic coding sequence
atgagggtgcctgcccagctgctgggcctgctgctgctgtggctgcggggggcccgctgtgacatccagatgacccagagccccagcagcctgagcgcctctgtgggggacagagtgaccatcacctgccgggccagccagagcatcagcagctacctgaactggtaccagcagaagccaggcaaggcccccaagctgctgatctatgctgccagcagcctgcagagcggcgtgcccagccgcttcagcggcagcggcagcggcacagacttcaccctgaccatcagcagcctgcagccagaagattttgccacctactactgccagcagagctacagcaccccctag

SEQ ID NO: 43337 - DNA, 432 bp, Artificial Sequence
  Description of Artificial Sequence: Synthetic coding sequence
atgtgggtgcagacccaccccagcagcgccagctacaagtcctggggccctggaacagctgacacccacaccatgaggctgagcagaagacctgagaccttcctgctggcctttgtgctgctgtgcaccctgctgggcctgggctgccccctgcactgtgagatctgcacagctgctggcagccgctgccacggccagatgaagacctgcagcagtgacaaggacacctgtgtgctgctggtgggcaaggccaccagcagcaagaggatgtggccaggcacctggtggggcggcggcgtgtacctgcagggcggccgggactaccacgccgagggcggcagctcctggttcagcagaagagagcggggcaagaagtctgtggagagcaggaaggagggcaagaccatcatgcgctggagggagcagaagtag

SEQ ID NO: 43338 - DNA, 939 bp, Artificial Sequence
  Description of Artificial Sequence: Synthetic coding sequence
ctggccctgcggcccaggaggatggccagcaaccggcagaggagcctgcggggccccagccaccccagccacatggaggagcccttcctgcagatggtgcaggccagcgagagcctgccccccagccagacctgggcccagcgggagttcttcctgcccagcgagagctgggagttccctggcttcacccggcaggcctaccaccagctggccctgaagctgcccccctgcacagacatgaagagcaaggtgcggcagaggctcatccacccctggaagggcggggcccagcacacctggggcttccacacctggctggatgtgtgccgcctgcctgccaccttccccacccagcctgaccggccctatgacagcaatgtgtggcgctggctgacagacagcaatgcccaccgctgccccccaacagagcaccccatccccccacccagctggatgggccagaacagcttcctgaccttcatccactgctaccccacctttgtggacatgaagaggaagaagcaggtgatcttcagaacagtgaaggagctgaaggaggtggagaagctgaagctgcggtctgaggcccgggccccacccctggatgcccagggcaacatccagcccccagccagcttcaagaagtaccgccacatctctgctgggggccgctttgagccccagggcctgcagctgatgcccaaccccttccccaacaactttgcccgctcctggccctgccccaaccccctgccccactaccaggagaaggtgctgaagctggccctgctgcccagcgcccccctgagccaggacctgatccgggacttccagaccctcatcaaggacagaacagccctgcccctgcaccacctgagcaaggcccaggccagcaagagccctgccaggaagaggaagagaagacctggccacttctag

SEQ ID NO: 43339 - DNA, 456 bp, Artificial Sequence
  Description of Artificial Sequence: Synthetic coding sequence
atggctgtgtcccagatgagcaagtggaggctgagccgggtgggcggcagccgcagcctgcctgctgagatggaggtgctgggggaggtgtggtgtgtgcgggcagaggagcagcccatgacaggcctgggcatcgtgtggcacagccccctgctggacaaggccctggagacctggagcctgcagcagcagcctgacttcagcctgggcctgggccacctgggcctgggcacagatgccacctggatgcagagcttccctggcagcggaggagatgcccaggccggcactggagtgtctggcctgctgcggctgtaccccaacctgctgtgtgactttggcccccggcagggccccctgtgggccctgctgctggagaagaggcagatggccggcactggaggcagccctgccctgctggcctggaggtctgcctcctggagggccctgggctag

SEQ ID NO: 43340 - DNA, 345 bp, Artificial Sequence
  Description of Artificial Sequence: Synthetic coding sequence
atggctgtgtcccagatgagcaagtggaggctgagccgggtgggcggcagccgcagcctgcctgctgagatggaggtgctgggggaggtgtggtgtgtgcgggcagaggagcagcccatgacaggcctgggcatcgtgtggcacagccccctgctggacaaggccctggagacctggagcctgcagcagcagcctgacttcagcctgggcctgggccacctgggcctgggcctgtacatcctggccagctacctgctgtgcccccggcagccccccagccagccagatggcccctgtggcagccccaaccctgtgtctggggccaagaagaccaccgtggcctag

SEQ ID NO: 43341 - DNA, 504 bp, Artificial Sequence
  Description of Artificial Sequence: Synthetic coding sequence
atgctgtgcccctgcatccaggagagcacctttgagacctgcctcttcatggctgtgtcccagatgagcaagtggaggctgagccgggtgggcggcagccgcagcctgcctgctgagatggaggtgctgggggaggtgtggtgtgtgcgggcagaggagcagcccatgacaggcctgggcatcgtgtggcacagccccctgctggacaaggccctggagacctggagcctgcagcagcagcctgacttcagcctgggcctgggccacctgggcctgggcacagatgccacctggatgcagagcttccctggcagcggaggagatgcccaggccggcactggagtgtctggcctgctgcggctgtaccccaacctgctgtgtgactttggcccccggcagggccccctgtgggccctgctgctggagaagaggcagatggccggcactggaggcagccctgccctgctggcctggaggtctgcctcctggagggccctgggctag

SEQ ID NO: 43342 - DNA, 393 bp, Artificial Sequence
  Description of Artificial Sequence: Synthetic coding sequence
atgctgtgcccctgcatccaggagagcacctttgagacctgcctcttcatggctgtgtcccagatgagcaagtggaggctgagccgggtgggcggcagccgcagcctgcctgctgagatggaggtgctgggggaggtgtggtgtgtgcgggcagaggagcagcccatgacaggcctgggcatcgtgtggcacagccccctgctggacaaggccctggagacctggagcctgcagcagcagcctgacttcagcctgggcctgggccacctgggcctgggcctgtacatcctggccagctacctgctgtgcccccggcagccccccagccagccagatggcccctgtggcagccccaaccctgtgtctggggccaagaagaccaccgtggcctag

SEQ ID NO: 43343 - DNA, 2124 bp, Artificial Sequence
  Description of Artificial Sequence: Synthetic coding sequence
atggtggaccctgtgcctgaggaggagaaggccggggctgagcccggggacagcggaggagatgaagctgtggcctctgtgcccccagacagccagggcgcccaggagcctgctgccagcagcgccagcgccagcgccagcgctgctgtgcccaggaaggccgaggtgccctgtgccgctgctgagggcggcagaagagagcagagccccctgctgcacctggacctcttcaactttgactgcccagaggccgagggcagccgctacgtgctgaccagccccaggagcctggaggcctgtgcccgctgtgctgtgaagcctgtggagctgctgccccgggccctggccgacctggtgcgggaggcccctggccgctccatgagggtggccaccggcctgtatgaggcctatgaagctgagcggcgggccaagctgcagcagtgcagagctgagcgggagcgcatcatgagggaggagaagagaagactcttcacccccctgagccctgctgctgctgctgctgctgctgctgctgctgccagcgcccccagcgctggcagcagcagcagctgcagcagcgccagcctgcctgccagccctgccccccgggccgccaggaaggccagccccagccccagcagcgcccggacccagcccccacctgctggcagcaggacaggcaggaagagccacagcctggacagcctgagcagaagaagagagggcgccctgagcagcgagagcggggccagcagcagcagctacagcggggagagcctgcgggagctgcgctggccaccccgggccagcgccaggaacagctgcccagctggcagcgccagcagcaccaccaatgcccctggccggcccagcgccctgaccctggtgcccatcaccggccgctccttcagcctgggggacctgagccacagcccccagacagcccagcacgtggagagaattgtgcggcaggtgcgggcagagcggggcctgcggggcgtgcctgagcgggacaggaagattgctgccctgatgctggcccggcaccaggaggagctgctgctgctggagcagagagctgctgcccacggccagtgggagctgcagagggtgcacgccaagcagaggcgggagcgggaggagcgggagaagcagagggccctggagcagggccggcgggcctgggccgcccaggtggaggagcggcggggcagaagaggccgggaggagcgggaggccgcccggcggcggcagaggcagtatgaaagaagtgaggagcggcggcgggagctggccgagcggcagggcctgctgcggcgggagagagctgagcgggccgccagagaagatcggctgaggaagctgcagcaggagcagaacctgaagcagcgggaggagggcctgcaggagggccgggagagagctgagcagatcagaagagagcgggcccagagagctgcccgggccaagcagaggcaggagggccagctgcagcgggagaagcgggagctgagcagagctgagcgggcccggcatgaggccctgctgcagggccgcacccggcagcagaggcaggagcgggagggcctgcggagcagcctggaggccagcctgggccgggcccaggagaactatgagcacctggtggagcagaggacccgggagctgcgggagcgggcccggcgggaggagctgcagggccggcgggccaaggaggccgctgagaggaaggagcgggagcaccaggcccacctggaggccctggcccgggccggggagcggcggctgcagcacgccacccaggtggccgaggaggccgtgcagcagaaggcccggcgggtgggccagagccggctggagaaggagcgggcccagagggccaacaaggagaaggtggagagagatgaggactgcagaagaagagagctgctgcaggccatcggcaggaagctggagaggtctgagcagctgacccgggagaggagaagtgccctggagagcgcccggagcacagcccgggccagcttccacgtgcgggagaaggtgcgggaggagaccaacaccaggagctttgacaggatggtgcgggaggcccagctgcacgccagcctggacaggaagtag

SEQ ID NO: 43344 - DNA, 198 bp, Artificial Sequence
  Description of Artificial Sequence: Synthetic coding sequence
atgtctgagcagaacatctgcaaccagaaggacaagagcaccctgcccttctgccaggcccacctgtgtgaggagaccaccaaccggctgtgtgtgagcaacaaggctgtgtacagcctggagtgcaagtgggccgagagcgagaacagagtgtctgagggccgctggggccggggctgcttcatcggcgtgggctag

SEQ ID NO: 43345 - DNA, 477 bp, Artificial Sequence
  Description of Artificial Sequence: Synthetic coding sequence
atgagggccagccgcagcccccccagcccccggcgctgccaccaccaccacgaggccaccggggccgccagcggggctgctgctgggggccctggagctggctgtgtgggcctgtgccgcctggccctgacccccagcgcccaggatggaagaaacagcaccttccagacctacaagaaggaggtgtgcctgcccaggcacagcatgcaccctggcccctgggccatctgctgtgagtgccagaccaggtttggaggccgcctgcctgtgtcccgggtggaggccgccctgccctactgggtgcccctgagcctgcggcccaggaagcagcacccctgctggatgcatgctgctggcaccacagctgggggcagcgctgtgatgtctgcctgctgccccagcagcagcagcagccggccccccaccaggaccagctaccgcctgctgcagagggtgtgctgccccagcgccagctag

SEQ ID NO: 43346 - DNA, 1668 bp, Artificial Sequence
  Description of Artificial Sequence: Synthetic coding sequence
atgaggcggcccagcacagccagcctgaccaggaccccaccccgggccagccccaccaggatgcccagccgggccagcctgaagatgacccccttccgggccagcctgaccaagatggagagcacagccctgctgcggaccctgccccgggccagcctgatgaggacccccacccgggccagcctgatgaggaccccaccccgggccagccccaccaggaagccaccccgggccagccccaggacccccagccgggccagccccacccggcggctgccccgggccagccccatgggcagcccccaccgggccagccccatgaggaccccaccccgggccagccccaccggcacccccagcacagccagccccaccggcacccccagcagcgccagccccaccggcaccccaccccgggccagccccaccggcaccccaccccgggcctgggccaccaggagccccagcacagccagcctgaccaggacccccagccgggccagcctgacccgctggccaccccgggccagccccaccaggaccccaccccgggagagccccaggatgagccaccgggccagccccaccaggaccccaccccgggccagccccacccggcggcccccccgggccagccccaccaggaccccaccccgggagagcctgcggaccagccaccgggccagccccaccaggatgccaccccgggccagccccaccaggaggcctccccgggccagccccaccggcagccccccccgggccagccccatgaccccaccccgggccagccccaggaccccaccccgggccagccccaccaccacccccagccgggccagcctgaccaggacccccagctgggccagccccaccaccacccccagccgggccagcctgatgaagatggagagcacagtgtccatcaccaggaccccaccccgggccagccccaccggcacccccagccgggccagccccaccggcacccccagccgggccagcctgaccggcagccccagccgggccagcctgaccggcacccccagccgggccagcctgattggcacccccagccgggccagcctgaccggcaccccaccccgggccagcctgaccggcaccagcagcacagccagcctgaccaggacccccagccgggccagcctgaccaggacccagagcagcagcagcctgaccaggacccccagcatggccagcctgaccaggaccccaccccgggccagcctgaccaggaccccaccccgggccagcctgaccaggaccctgccccgggccagcctgaccaggaccccaccccgggccagcctgaccaggacccccagcatggtgtccctgaagaggagccccagccgggccagcctgaccaggacccccagccgggccagcctgaccatgacccccagccgggccagcctgaccaggacccccagcacagccagcctgaccggcaccccacccacagccagcctgaccaggaccccacccacagccagcctgaccaggagccccccaacagccagcctgaccaggacccccagcacagccagcctgaccaggatgcccagcacagccagcctgaccaggaagagcaatgtgaaccagcagtgcccagccagcacccccagcagcgaggtgatctcctag

SEQ ID NO: 43347 - DNA, 1719 bp, Artificial Sequence
  Description of Artificial Sequence: Synthetic coding sequence
atgcctgtgtactgcaagtaccagttccacaagacccctgtgcacaagaccaagggggagccccacggcacccacgtgtacttccaggacatcaacgtcatcttcctgggcgccctgcaccccagcgacctgcgggagtacctggagggcccccccatggtggtggaggtgcatgaccgggacaggaagtctgaggagtgcagccagaagcctgtgctgtttggagaggaccccctggacagctacctgaacttccaggccctgatcagcccccgggagacagagaacaacccctttgagagccagaacaagatgtggtacccctatggaattgcccaggtgtcctttgctgacctgctgctgggccacaagtacctgaacctggccgtgcccatccacagctgtgaggtgcagcccacccactgcggccaggacagcagaagaaggaaggtggtgggcctgggcgtgcccagagatggccaccagcacggccccatgccccggggcaactacctggaggccgacagccagctgaagctgcgggtggacattgctgtgcccctgcgggccggggcccgggctgctgaccctgacctgggcggcagccagtttggccgcatcatctttgtgtttgacttcaagaaggtgtccctgctgcacagcctgctgcaggacatcaccatgatcaatgccaaggccctgggcctggacagctaccctgtgaggaccctgcagcagatcctgagcgccttcaaggtgcgggtgcgggtgcaggagcagcagcacctggatgtgctgaccggcttccacctgctggatggcaagacccacctgttcatcctggagggcctggccgaccagggcctgcggcagctgtgggagaaccaccagagctggatccccaggtctgagcacaggaagtacaaggtgctgtacaacagccagctgctcttccgcagccggctgtatggagacctggaggccatcctgtaccacgtgcacctgttccagcccacagagctgctgctgcagcaggccgtgttcttcctgcgggacacagaaagaagaagagtcttccaggccctggcccgcatccatgacatctgctacaacagcaccaccctgtgggatgtgacagtgcgggacctgctgcccagcagcgccatgatcaaggacctgagccaggagtttggcatgcccctgagccaggaggagctgacagatgagaagctgtttgccctgcccccccagcctgcccccaacctggaggactaccacagcaggaacagcaccctgaccctggagatccacgcccaccaggagcccaggaagcgcttcacctacagccaggactacctgagcgccatggtggagcccctggacctgaaggaggaggagaagaaggcccagaagaagagccggcaggcctggctgacagcccggggcttccaggtgacaggcctgcagagcgacacagagagcagcttccaggacctgaagctgccccccatcaaggagctgaatgaggagtggaaggagaacagcctgtttgccaacgtgctggagcctgtgctggaccgggaccgctggagctgggacagacaccacgtggactttgacctgtacaagaagcccccacccttcctggagctgctgcccagccctgcccccaagcctgtgacagtgaggaagaagaagggcaacagccccatctcctag

SEQ ID NO: 43348 - DNA, 1719 bp, Artificial Sequence; identical to SEQ ID NO: 43347
  Description of Artificial Sequence: Synthetic coding sequence

SEQ ID NO: 43349 - DNA, 390 bp, Artificial Sequence
  Description of Artificial Sequence: Synthetic coding sequence
atgcctgtgtactgcaagtaccagttccacaagacccctgtgcacaagaccaagggggagccccacggcacccacgtgtacttccaggacatcaacgtcatcttcctgggcgccctgcaccccagcgacctgcgggagtacctggagggcccccccatggtggtggaggtgcatgaccgggacaggaagtctgaggagtgcagccagaagcctgtgctgtttggagaggaccccctggacagctacctgaacttccaggccctgatcagcccccgggagacagagaacaacccctttgagagccagaacaagatgtggtacccctatggaattgcccaggtgtcctttgctgacctgctgctgggccacaagtacctgaacctggcctag

SEQ ID NO: 43350 - DNA, 1068 bp, Artificial Sequence
  Description of Artificial Sequence: Synthetic coding sequence
ctgggcgtgaagggcctgcccctgtacccagaccccagccgggtgcccggcaccaagacccagaacaacctggagagtgactacctggccagagatggccccagcagcaacagcagcttccacagcagcgaggaggagggcacagacctggagggggacatgctggactgcagcggcagccggcccctgctgatggagagcgaggaggaggatgagagctgccggcccccacctgggaagctgggcggcgctgtgccctttgcccctcctgaggtgtccccagagcaggccaagacagtgcagggcggcaggaagaaccagttccaggccttcacccagcctgccacagatggcctgtctgagccagatgtgtttgccatcgcccccttccgcagcagccgggtgcccaatgatgacatggacatcttcagcaaggccccctttgtgtccaagagctccatggcccccagccagcctgaggagagtgatgtgttcctgcgggcccccttcaccaagaagaagtccatggaggagctgaccgtcatccagtgcaccagccaggagctgcctgcccagacaggcctgctgagccagacaggagatgtgcccctgcctgctggccgggagagagctgtgtacacctctgtgcaggcccagtacagcacagctggctttgtgcagcagagcaacctgctgagccacagcgtgcaggccgctgaccacctggacagcatcagcccccggggcagctgcctggagagcggcggccacagcaatgacagaaataaaggcccccagctgcagaaggaggccgtgtctggccccatggccggcaagcccttccggccccagagcctgagcaagtacagccgccactacagcccagaagatgagcccagccctgaggcccagcccatcgccgcctacaagatcgtgtcccagaccaacaagcagagcattgctggctctgtgtccatcaccagcctgagcagcaggaccacagagctgcctgctgctgacccctttgccctggcccccttccccagcaagagcggcaagaagccctag

SEQ ID NO: 43351 - DNA, 462 bp, Artificial Sequence
  Description of Artificial Sequence: Synthetic coding sequence
atgcactacgtgcacgtgcaccgggtgaccacccagcccaggaacaagccccagaccaagtgccccagcggcggccagagccagggcccccggggccagttcctggacacagtgctggccgccatgtgccccatcgccatgctgctgacagctgaccccggcatgccacccacctgcctgtggcacacccctcatgccaagcacaaggagcacctgagcatccacctgaacatggtgcccaagtgtgtgcacatgcacgtgacccacacccacaccaacagcggcagccgctacgtgggcaagtacatcctgctgatcaagtggagcctggccatgtactttgtgcagggcagcaccctgagcacagtgaccaagatgagccacggcaaggccctgcctgacagcgacacctacatccagttccccaaccagcagggcccccacacccccagcatcccctag

SEQ ID NO: 43352 - DNA, 366 bp, Artificial Sequence
  Description of Artificial Sequence: Synthetic coding sequence
atgcagaagcagctgctgcccctggccgccggccagagatgtgactacagccagcgggagagctgctgccagagcccccacagagctgagagcgctggggacaggagcacagacaatggcctgcacagaggagctgagaggagcttctgctgtgccctggaccccctgccccggcggcccccagctggccggcggggccgggacaggagcagcagcgcctgccctggggcccgggcccgggtgtggcccccaggggcctgtgccagcttccgggacagccacaagcgcttcatcatgagaagaacagccctcttccacttcacccccaccagcttccacctgcgctacaccctgaggaagctgtag

SEQ ID NO: 43353 - DNA, 384 bp, Artificial Sequence
  Description of Artificial Sequence: Synthetic coding sequence
atgctgcccagcagcaccccaggccctggccacgccacagagacctgcccagcccctcctggccctgagaggagccctgctgcccgggccccagctgctgccagcagcctgggccctgtgtccacagctggccgggccccccggggcctggacatgtctgcccaggagcccccccagggccgccgcttccccattgaagctggggacagccggggcctggccgccgcccctgagagccaggacagccctgaggccgtggccacagagcacaaccctgtgcggcccctgcggcgctgccccggctgccactgcctgaccctgctgcacgtgcccattgatgtgtacctggccatgggcggcagcccccgggcccgggccacctag

SEQ ID NO: 43354 - DNA, 408 bp, Artificial Sequence
  Description of Artificial Sequence: Synthetic coding sequence
atggtgcctgccccacccttcctgggcgtgctggagaaccctgtgccccagtgggacctgagcatcctgggcagcatccgcatccgggtgagccacacagaggtgcagggcagcggcagcagccgcagccctgaggccctgaggaaggagagcctggaggtggagtggaccctggtgctgctggccatccccccacgcatccagcccagccagcaggacggcggcccccccaagtgctgtgacctgctgcgggccgccctgctgggccgccactgccccctgtgtgtgcctgctggggaggtgttcagccagaagagggacaatgagcaggacagaagtgagttcatcggccagaccctgaagctgctggtgaagagaaatgtgtccctggagctgagctgcaggtag

SEQ ID NO: 43355 - DNA, 717 bp, Artificial Sequence
  Description of Artificial Sequence: Synthetic coding sequence
atgcctggccgcacaggcctggccggggagatgcctgtgggctggggccctggccgggccggggccagcgagcccaatgaaagcacctgtgcccctgaggccctggatggccacctgggcgtggcccggcgggagggccccatcctgggcaccctgctgggccggggcaagggccactgccaggccctgagccagctgggccactgccccagccctgcctggaacaactacagcggcatgatggacattggagtggcccccagccgggtgggccccagcggccactgcggcgtgctgcggagccacagcaggcctggagagctggccgtggtgatgaaccacaaggtgcccaggcacaggcctgtgtcctctgtgggcacagagctgctgtgggtgcgctgtgcccccaagatggtgcagctgcccatctgctgcctgctgctgaccccagcccctggcatcggcccccgggcccacggccacctgcacaccaacctggagacccggggcctgccccggggcacccgggagagccagcaggccgagggggagggggaggccatccaggagggccgcggggcctgcaagagggcccagaggaaggagggggagggcccccggggcccctgtgtggtgcgggccggcggcgtgggctggggcacccggcaggtggccggggagccccccctggtggactgcagcacagctggcacctag

SEQ ID NO: 43356 - DNA, 315 bp, Artificial Sequence
  Description of Artificial Sequence: Synthetic coding sequence
atgggcctgggggaccggcggggcagaagaagagccagcgccagcgctgccttcagaacagccagcagcagcagctgcaactgcagccgctgcagcagcgctgacaccaggagcagcaccagcatccccctggtgcctgacaagctgagcagtggaagaagaggcagcgctggctgccgggccacccaggagctgcagtgcccccggggccccagccggctgcccggcagcaagagaggagccagccacgcccccttcctgagccgctacctgggcctgggccacctggacatgagccagggccggggcctgtag

SEQ ID NO: 43357 - DNA, 198 bp, Artificial Sequence
  Description of Artificial Sequence: Synthetic coding sequence
atgcctgccaagggcaagaagggcaagggccagggcaagagccacggcaagaagcagaagaagccagaggtggacatcctgagccctgctgccatgctgaacctgtactacatcgcccacaacgtggccgactgcctgcacctgcggggcttccactggccaggggcccccaagggcaagaagggccgcagcaagtag

SEQ ID NO: 43358 - DNA, 645 bp, Artificial Sequence
  Description of Artificial Sequence: Synthetic coding sequence
gccaccatggtgtggttctgcaacagcgctgactgccagttctctgtgtttgccctgaccaccatcggctggatcctgagcagcaccagcacaggcctggtggagtggaggatctggtacatgaaggacaccagcctgtacccacctggcatcgcctgtgtgggcatcttccgggtgtgcatctacagaagaaggaccaacagcaccaccaccaagttctgctaccgctacagctaccaggacaccttcctgccctttgagatctccatggcccagcgcttcctgctgacagccagcatcttcggcttcttcggccgggccttcaacatgtttgccctgaggaacatgtccatgaggatgtttgaggaggacacctacaacagctttgtggtgtctggcatcctgaacattgctgctggggtcttcaacctgattgctgtgctgcagaactatgatgctgtgatcaacagccagggcatcaccttcctgcccagcctgcagatgcccttcaagccagatgtgcaggaggtgggcacagccatccaggtggccggcatcggcgtgctgcccatgctgctgaccggcatgttcagcctcttctacaagtgcccccccatgctgtaccagatcttccccaccacctag

SEQ ID NO: 43359 - DNA, 345 bp, Artificial Sequence
  Description of Artificial Sequence: Synthetic coding sequence
atgtacaccagcctgaagagcacctttgtggcctttgctgatggccggggcaccacagagagcatgcccagcccccccctggccaacagcaaccacgagagccctgtgaaccagctgggcaacatgcagaacatgaggctgggccccagcttcatcctgaccggcatcttcctgggcaatggccgcacagaggccagccccttcttcacagatgaatttgccctgagcaagatcttccctgagtacaagaggaacctgtttgggaagttccagaccaacatggccttcagcctggagctggacccccccagcctgctgctgtctgtggtgctcttcatgttttag

SEQ ID NO: 43360 - DNA, 1086 bp, Artificial Sequence
  Description of Artificial Sequence: Synthetic coding sequence
atggccccccagagagctggccctggcctgggcaagcccagcagcaagaagagccgggccctgcggggcggccctggggtgccccgggcccggcagaggagccccagggctgctgctgagctgaacacagaggtgcccaagcccagcgccaaggatgtggagatcctggagcaggagagcgaggtgctggagcccagcgtggagcaggatgctgagagccctggcctgagcacagctgctggctttgagagccctgagcccggcagagatgaccccggccccagcgaggcccagagagctgaggtgcagggccagcaccccccacctggccccaagaccagcagcagccgcagcggcagcgaggccccccacctgcgcttccccccctgcccagaggccccccagaggcctcctgaggagcgcttcatggagacccccatcgagcgggagatccgccgcagctgtgagcgggaggagagcctgcggcgcagccggggcctgagccctggccgggccggccgggagctggtggagctgcgggtgcggcctgtgctgaacctgcccggccctggccctgccctgccccgggccctggagcgggcccgggccggggcccagatgcagagggacatcgagcgggaggcccaccggcaggccgccctggcccggcctgctgtgcctgagccccgggcccggagccccccccagcccctgggggagctgaagcgcttctttgaagctgctgctggcagcggcagcagcgctggagctggagatggagctggcccccagaggctgcctgagcccggcggccggcccaggtctgctgtgcagggcggctgccgggtgctgggcagcgcccccccacccttcacccccagcctgctggagcaggaggtgcgggctgtgcgggagcgggagcaggagctgcagaggcagaggagatctgtgtatggaacagctgagttcaaggagcccacccccagcctgacagccagcagaggagatggcaagctggtggtgatctggccacccaggaggaaggtgtctgaaaatggcctggagcaggaggagaggaagccctag

SEQ ID NO: 43361 - DNA, 366 bp, Artificial Sequence
  Description of Artificial Sequence: Synthetic coding sequence
atgacagacaggaacagagacaagaagagcaccagccccagcaacagcgacacagagatgaagtctgagcagctgcccccctgtgtgaaccctggcaaccctgtgttcagctgcatgctggaccccaagaccctgcagacagccaccagcctgagcaagccccagatgatcatgtacaagaccaacagcagccactacggggagttcctgcccatcccccagttcttcccctgcaactacacccccaaggagcaggtgttcagcagccacatccgggccaccggcttctaccagaacaacaccctgaacacagccccagacaggaccaggaccctggacttccccaacatccagcacaccctgtag

SEQ ID NO: 43362 - DNA, 561 bp, Artificial Sequence
  Description of Artificial Sequence: Synthetic coding sequence
atggagcagcccaaggatggagctggccctgagggcaacaacctgagcctgcccagcagcggcacagagccctggcccccagcccccctgcctgcccccccacccctgctgctgaacagcacagaccccacccacctgggcctgcctgagagcgtggcctctgtgacagtgcccatccggctggacaccctgagctgcctgctgcacagcgccctgctgggcgcctacaccttccagcaggccctgcccagctgcccctgctgcagccaggccggccacagccagcccggggctgtgcggcggcccccccggggccggggcggctgggaggtgcgccacaggcctggctggggccggggcctgcacagaagaggcctgggccgggcagagcagcctgagcggggccgggccggcggccctggggccggccccaggaccccacccatgaccctgcccagcccccccaccctgcctgcccaggacggcaagaaggaggcccggggccctgagccccccctggagacccccctggccgctgaggactgggagacagagtactag

SEQ ID NO: 43363 - DNA, 357 bp, Artificial Sequence
  Description of Artificial Sequence: Synthetic coding sequence
atgcagagcctgcggcctgagcagacccggggcctgctggagcctgagaggaccaagaccctgctgccccgggagagccgggcctgggagaagccaccccacccagcctgcaccaaggactgggaggccgtggaggtgggcgccagcagccatgacagtgatgagaaggacctgagcagccaggagaccggcctgagccaggagtggagctctgtggaggaggatgatgagagcgagggcagccagggctttgtggagtggagcaaggccccccagcagaccaccatcgtgctggtggtgtgtgtgctcttcctgttcctggtgctgaccggcatgcccatgatgttccacatctag

SEQ ID NO: 43364 - DNA, 315 bp, Artificial Sequence
  Description of Artificial Sequence: Synthetic coding sequence
atgggccgcatccctgggggctgcagcagcaaggccttcatcggccgggcccagtggctgacccctgtgatcccagccctgtgggaggccaagggcctgaccctgctgagccggctggagtgcagtgatgtgatcatggaccactgcagcccccagctgaccggcctgaggatgaagggcttcctggcccagaccccacccctggagttccctgtgcaccagtaccagcccggggaccacgtgctgatcaagtcctggaagcgggagagcctgaaccagctgcggaggaccagcagcggcaccctggatgaatag

SEQ ID NO: 43365 - DNA, 381 bp, Artificial Sequence
  Description of Artificial Sequence: Synthetic coding sequence
atgaagaagtggaagagccgcctcttcccccggccccccaactggctgagcggcaagtacctgcggctgcccagcagcgccatgttcctgattgacttctgcctgtgtgtgccctggaccacccccttccagtgcaagatcctgatggtggagttcatcgtgggcttctatgacttctgcctggccctggaggtgcagtaccgcaccagcaagctgttcctgtgtggccagcccagccccaggaggagcctgggcatccagcagcaggccctgaagctggcctgcctgagccccaccctgctggagagcagcagctgtgtggaccccccaggcaacacagctggcagcaggatgcccagcagcagcaactgcatcaagtag

SEQ ID NO: 43366 - DNA, 663 bp, Artificial Sequence
  Description of Artificial Sequence: Synthetic coding sequence
gtggagggggaggcccctggcctcttcctgagcagccaggagcagagggcccgggacacagagggcccccggcagggcgacctggaggccggcctgggctggggctggcccctgcaccctggcagcaaccagggcgccccccggcagggcggcagcatcggcagcggcacccggccctgcccctgcccccccctgagccgggagggcggggccctggccagcccccgggtggccctgagccagctgcagtgtggcctgctgggcagcgctgagcagagcttcctgcagctggagcaggagaaccacagcctgaagaggcagaaccaggagctgcgggagcagctgggcgccctgctgggccctggccagcagttcctgcccctgtgcccagagcacagcagctgcacagccctggcctggcccccagaccctgctggcacccagcccctgggcaacagagcccccctgcagctgctgcggcgggagctgtgccagggccaggaggcctttgtgcagcagagccagaatgagctgcagcagatccggctgtgctttgagaggaagaagatggtgatcacagaggtgtgggacaacgtggccgagatgcacatggccctgaacaaccaggccaccggcctgctggtgggcccccaccgggcctag

SEQ ID NO: 43367 - DNA, 363 bp, Artificial Sequence
  Description of Artificial Sequence: Synthetic coding sequence
atgtacagcttccccaccaccgtggtggaggagatcctgagcctgagcctgcagctgattgccttccccaccgtgtcctgtgagatcctgctggagatcaccagccagaccaacaagaagcagacctgggagacctgctacgcccacagcgctgaggagatcggcatcatcgccggcaagaggatccacaagacccaggccgtgccctacatctgcttcctgctgcggcaccagttcatcagccagagcagccacgtgcgggtggaggccctgtacagcctgctcttcctgggcaccctgctgcaggtgggcaagggccaggaggtgctgctgaaggatgccctgcgggcccgggccccctag

SEQ ID NO: 43368 - DNA, 2568 bp, Artificial Sequence
  Description of Artificial Sequence: Synthetic coding sequence
atgtggagcacaggccctgaggccagagatggagacagctctgtgagcagcggccgcctgagctgcagcagcggcggccatgatgtgtgtgtgtcctggaaggagaggcctccccaggtgctgggcccccagcagaggcccaggaagagtgatgcccggctggagcagctgcgggacaagatccgggcccaggcctggcagcagggcagctgtgccagcctgggcaccagcgcccccagcagcgccagccggctgcacaaggccagcaccctgatgctgcggaggaagggccaggaggccaagaaccccccaccagcccctgagtgcagcggcttcagcatcctgtctgctgctgagcggcgggtggaggccaaggccagccacggccagggccgggagctgagccgggtgtcccagcaccaggtgcctgtgctgcgggagaagcccaagagggtgaagagcagcagctgcaagcgggagaagacccccaagctgcccagccccaggagagctgccaaggacaagcacaaggatgaagattctgagctggtgggcgtgtatgcctggaggaagggccaggccctggtgcgcagcctgctgggccccccacctgtgctgcggcggcaccacagcaaggaccccagccgggaccctgccctgactgtggacctgggggacagcgagaaggtgattgctgccaagtgcagccctgtgtgtgcccagctgcctgatgccaccagcgcctacagcgaccagcaggtgtctggcaacacccccagcctggccagctttgaccagcctgccaccatccagacagccatggccatcctgcaggacctgcggcagcagatccaggccggcctggagctggcccaggccaggaaaggaggccaggagctgggccccagcaagaggcggctgcaggatgtggccggccggggctgctgccgggaccccaatgcccagagcagcttcagcaagagcccctgggccatgacagagaggaagcacagcagcctggagcgggcccggtctgtgcacacctgggagccctggagcagcagcacagcccgggagagctgcccccagagggcctggggcgcccagggccaggacaggagcttccagaggcctgagagcccccatgagcggctgggccacttcagccagaggccctggagcgccctggccggccaggcctgcagcccccagagggcctggggcgcccagaggcagggccccagcagccagaggcctggcagccccccagagaagaggagccccttcccccagcagccctggagcgctgtggccacccagccctgcccccggcgggcctggacagcctgtgagacctgggaggaccccggcccccggctgaggaaccccctggagcggcccagccccccagcccagaggccctggagcagcagcggcgtgcagagagctggcccccagggcaagggccggggcatcggcagccctgtgtctgctgccaagcacgccctgccccggcccaccggcagcttcccccagaaccccctgggcaaggagaaggacaccctgcggccctgccccaggagccggggcctgctgggccccagccacagcagcgagagcctgcgggagttcatgaggcagaaggcccaggcccggcggcggcaggccctggaggagaaggccagcgccctgcggacccgggagctgcggagccggcggctgcaggaggtgtaccggcagcagcgggaggccgtgctgggccgggctgtgcctgtggtgtccaggaccaccccaggcatcgtgacctttgtgcccagcagcgcccagagcggcggcctggaggccagcggcagcctggagagccctgtgctggagtggagcaaggtgaccagcggcatggtgctgggcggccaggaggcccctggcagcttctgcctgtgcctgaacagagcctggaaccacgccgagaccctggaccccccaggcatgggcggcccccaggacggcagagatgcccctgtgctgctgagcgccagccccagcctgggcagcctggagctgcaggacctgaccacccgctacctgccccggggcatgtgcatctacctggaccccaaggaggccgagcacctgggcaccagcagcagcctgcacctgcggcacaagcaggcccagctgcaggccctggagaccacagccaaggtgctgaagcagagggtggacagcctgacagccaagctgcagggcgctgaggccctggacacagtgcgggaccctgctgtgggcctgctgcggagctgcccccacagcctgcctgctgcccccaccctggccacccccaccctggccaccccagcctgccctggggccctgggccccaactggggccgcggggcccctggagagtgggtgtccatgcagccccagcccctgctgccccccacctacttcctggatggagagaccctgtcctggggccccagctgggagcagcagcagagcgtgagcccccgggcccactgtgagagcaagccccggggcgtgtcccaggcccccctgctgctgtag

SEQ ID NO: 43369 - DNA, 2829 bp, Artificial Sequence
  Description of Artificial Sequence: Synthetic coding sequence
atggtggtgtctgctggcccctggagcagcgagaaggccgagatgaacatcctggagatcaatgagaccctgcggccccagctggccgagaagaagcagcagttcaggaacctgaaggagaagtgcttcctgacccagctggccggcttcctggccaaccagcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacagccaggagcgggagctgacccagctgcgggagaagctgcgggagggcagagatgccagccgcagcctgtatgagcacctgcaggccctgctgaccccctatgagccagacaagagccagggccaggacctgcaggagcagctggccgagggctgccgcctggcccagcacctggtgcagaagctgagcccagaaaatgatgaagatgaagatgaagatgtgcaggtggaggaggccgagaaggtgctggagagcagcgccccccgggaggtgcagaaggccgaggagagcaaggtgcctgaggacagcctggaggagtgtgccatcacctgcagcaacagccacggcccctgtgacagcaaccagccccacaagaacatcaagatcacctttgaagaagatgaggtgaacagcaccctggtggtggaccgggagagcagccatgatgagtgccaggatgccctgaacatcctgcctgtgcccggccccaccagcagcgccaccaacgtgtccatggtggtgtctgctggccccctgagcagcgagaaggccgagatgaacatcctggagatcaatgagaagctgcggccccagctggccgagaagaagcagcagttcaggaacctgaaggagaagtgcttcctgacccagctgagcggcttcctggccaaccagcagaagaagtacaagtatgaggagtgcaaggacctgatcaagttcatgctgagaaatgaaaggcagttcaaggaggagaagctggccgagcagctgaagcaggccgaggagctgcggcagtacaaggtgctggtgcacgcccaggagcgggagctgacccagctgcgggagaagctgcgggagggcagagatgccagccgcagcctgaatgagcacctgcaggccctgctgaccccagatgagccagacaagagccagggccaggacctgcaggagcagctggccgagggctgccgcctggcccagcacctggtgcagaagctgagcccagaaaatgacaatgatgatgatgaagatgtgcaggtggaggtggccgagaaggtgcagaagagcagcgccccccgggagatgcagaaggccgaggagaaggaggtgcctgaggacagcctggaggagtgtgccatcacctacagcaacagccacggcagctatgacagcaaccagccccacaggaagaccaagatcacctttgaggaggacaaggtggacagcaccctcatcggcagcagcagccacgtggagtgggaggatgctgtgcacatcatcccagaaaatgaaagtgatgatgaggaggaggaggagaagggccctgtgagccccaggaacctgcaggagagcgaggaggaggaggtgccccaggagagctgggatgagggctacagcaccctgagcatccccccagagatgctggccagctaccagagctacagcagcaccttccacagcctggaggagcagcaggtgtgcatggctgtggacatcggccgccaccgctgggaccaggtgaagaaggaggaccaggaggccaccggcccccggctgagccgggagctgctggatgagaagggccctgaggtgctgcaggacagcctggaccgctgctacagcacccccagcggctgcctggagctgacagacagctgccagccctaccgcagcgccttctacgtgctggagcagcagagggtgggcctggccgtggacatggatgaaattgagaagtaccaggaggtggaggaggaccaggaccccagctgcccccggctgagccgggagctgctggatgagaaggagcctgaggtgctgcaggacagcctggaccgctgctacagcaccccatctggctacctggagctgcctgacctgggccagccctacagcagcgctgtgtacagcctggaggagcagtacctgggcctggccctggatgtggaccgcatcaagaaggaccaggaggaggaggaggaccagggccccccctgcccccggctgagccgggagctgctggaggtggtggagcctgaggtgctgcaggacagcctggaccgctgctacagcacccccagcagctgcctggagcagcctgacagctgccagccctacggcagcagcttctacgccctggaggagaagcacgtgggcttcagcctggatgtgggggagattgagaagaagggcaagggcaagaagaggcggggcagaagaagcaagaaggagcggcggcggggcaggaaggagggggaggaggaccagaaccccccctgcccccggctgaatggagtgctgatggaggtggaggagcgggaggtgctgcaggacagcctggaccgctgctacagcacccccagcatgtactttgagctgcctgacagcttccagcactaccgcagcgtcttctacagctttgaggagcagcacatcagctttgccctgtatgtggacaaccgcttcttcaccctgactgtgaccagcctgcacctggtgttccagatgggcgtcatcttcccccagtag

SEQ ID NO: 43370 - DNA, 267 bp, Artificial Sequence
  Description of Artificial Sequence: Synthetic coding sequence
atggctgtgtccacagaggagctggaggccaccgtgcaggaggtgctgggccgcctgaagagccaccagttcttccagagcacctgggacacagtggccttcatcgtgttcctgaccttcatgggcaccgtgctgctgctgctgctgctggtggtggcccactgctgctgctgcagcagccctggcccccggcgggagagccccaggaaggtgagcccctggaaggagcggcccaagggcgtggacaacctggccctggagccctag

SEQ ID NO: 43371 - DNA, 267 bp, Artificial Sequence; identical to SEQ ID NO: 43370
  Description of Artificial Sequence: Synthetic coding sequence

SEQ ID NO: 43372 - DNA, 252 bp, Artificial Sequence
  Description of Artificial Sequence: Synthetic coding sequence
atggctgtgtccacagaggagctggaggccaccgtgcaggaggtgctgggccgcctgaagagccaccagttcttccagagcacctgggacacagtggccttcatcgtgttcctgaccttcatgggcaccgtgctgctgctgctgctgctggtggtggcccactgctgctgctgcagcagccctggcccccggcgggagagccccaggaaggagcggcccaagggcgtggacaacctggccctggagccctag

SEQ ID NO: 43373 - DNA, 615 bp, Artificial Sequence
  Description of Artificial Sequence: Synthetic coding sequence
atgcagagcgccctggtgggctcctggcacaacaacggcttctacggccactaccgcagccagttcaagtctgagagcgcccgggagtaccacctggccgccaagccccagcccccagctgtgttcctgcagcgctgccaggagcccgcccagaggcacttcttcagcaagcatgacaacagaaccagctttgacaagggcccctactgcctgctgcagggcattggaagaaggaaggacctggagcggctgtggcagaggcacaccttcctgcgctgggccccctgtgaaattgagctgcggcagcagggccccctggagagcagctaccaggccgacttccggcccggccctggcctgagcggcctgccccagcacctgatccactttgtgcaggtgcagcccagccacaccaggaccacctaccagcagaacttctgctgccccagccagggcggccactacggcagctacaaggtgggcccccaggcccctgtgacagatgtgctgcctgacctgcccggcatcccccggcccaagctgctgcagcactacctgcacgccggcgtgtctgagtgcctgaactggagccgggccctgaacaaggacagctag

SEQ ID NO: 43374 - DNA, 1140 bp, Artificial Sequence
  Description of Artificial Sequence: Synthetic coding sequence
atgcagagcttcctgaccctgctgaaggagcacgaggacacctgtgcccctcctgctgagctggtgaccctggccggccgcctgtgccgggacttccaggatgacctggcccagctgcagcccctggtgacagccatcctggacagccagctgcggctgcacctgctggacaatgctgatgtggccctggcctgtgcccgggtgctggaccagcaggagcagcagcaggccgcctgccgcctgctggagggctgccaggtgcctgggggcagccaggagctggtgcagctgtggaatgacatccactaccgcctggtgatgaggcggctgggcgtggccgccctgacccctgtgcagaagttccgctgcaggaagaggaaccccccaccacccagcctgtgcccagagggcctgaagagcaggaacttcccccgggaggtgcgggagaagctgcacaactttgctgtgggcgtgaacaccaaccccagcaaggccgagcgggagaacctggccctggagaccagcctgaccccagagcaggtgtacaactggtttgccaactacagaagacggcagagggccctgccccagcacatgaagccagcccagcaggccacagctgaggaccccggggcccgggagcggggccctgacctgctgcagcccagcggcaacccccgggtggacagcggctttgtggaccggccccagtggagcgaggagcgggaggagaagggccccccccagagcccccagaccacccagggcccctgggagcccctggccctggccccagacttcccagcagatgagaccgtgtccaagcccctggatgtgtctggccacccccagagcgtgcagctggaggagggcctgggcaccagcagcggccgcacagagctgcgggtgggcagcttcctggtgacccagccccccctgcaggcccctgagttcatcctgacccagagccccccagagctggccccagcccccagcgccttccctggccctgtgtctgccatggagctgagccaggccctgcccagcagccaggtgcagtgcagcgacagccaggccagcggagatgccttctggggcgccaggatgctgctggagttcagcggcagcagcctgggctag

SEQ ID NO: 43375 - DNA, 366 bp, Artificial Sequence
  Description of Artificial Sequence: Synthetic coding sequence
atgagcctgcacggcatcctggccagcgctggcaccatcggggctgtggccgcctggctgatgagctacaagccagccctgtttggcttcctgttcctgctgctgctgctgagcaactggctggtgaagtatgagcacaagctgaccctgcctgagccccagcaggatgagatcctgcagaggctgctcttcagcgagatgaagatgaaggtgctggagaaccagatgttcatcatctggaacaagatgaaccaccacggccgcagcagccgccacaggaacttccccatgaagaagcacaggatgagaagacatgagagcatctgccccaccctgagtgactgcaccagcagcagccccagctag

SEQ ID NO: 43376 - DNA, 756 bp, Artificial Sequence
  Description of Artificial Sequence: Synthetic coding sequence
atggacaccaccctgaggatggtgaggacagcctgccagcaccgggccccccagatcagccacaagacaggctgcagccacatctccatgcacagccctgggggcctgaccaccaccaagatggccggccccctgccccgggtgtctgacagcctcttcagcgccatggagctggccaagatgtctgacatgaccaagctgcaccaggccgtggccgccggggactacagcctggtgaagaagatcctgaagaagggcctgtgtgaccccaactacaaggatgtggactggaatgacaggacccccctgcactgggccgccatcaagggccagatggaggtgatccggctgctgattgaatatggagcccggccctgcctggtgacctctgtgggctggaccccagcccactttgctgctgaggccggccacctgaacatcctgaagaccctgcacgccctgcacgccgccattgatgccccagacttcttcggggacacccccaagagaattgcccagatctacggccagaaggcctgtgtggccttcctggagaaggccgagcctgagtgccaggaccaccgctgtgccgcccagcagaagggcctgcccctggatgaaagagatgaggactgggatgccaagaagcgggagctggagctgagcctgcccagcctgaaccagaacatgaacaagaagaacaagaagagccggggccccacccggcccagcaacaccaagggcagaagagtgtag

SEQ ID NO: 43377 - DNA, 378 bp, Artificial Sequence
  Description of Artificial Sequence: Synthetic coding sequence
atgccaccccacccagccatcttcttctactgcctgctgcggcagggcctgaccatgctgccccggctggtgctgaacttctgggcccaggccgtgcacctgcccaggcctccccgggtgctgggcctgcaggccggcggcacagcccctggccagaagaagctgttcctgaccagccacttccccccagccagccccctgcccctgtgcttcagcctgcagcagaacttcaagaagcacagccccaggagccccccaggcatcctgggcagcctgtacccaggcttctgcagccccatcgccaccagcccctttgccaagggcacccggggcctgcgggtggtgggcagcagcggccgcctgagcgccagcagctag

SEQ ID NO: 43378 - DNA, 390 bp, Artificial Sequence
  Description of Artificial Sequence: Synthetic coding sequence
atggctgctgccacctgggacaaggagagcaaatgtcggctgagccggggccactgccaccaccggcggcaccagagcctgcctgtgggcctgaccctgcgctacagcgccccagccagccaccagcccaagtgcttcaccagcaagcacggcacccggcccagccagaggaagcccagcctgcgggtgtctggccactacagcccccacagcctcttccctggccacggccggcggggggcctgtgtggcccggagcagaagatttgctggccacatgcagctgacctggaagctgaagaggaagaagccaggccgcacagccagcagcgaggagcacaagaagcagggccggggctgtgccggcagaagactcatcaagagcacctag

SEQ ID NO: 43379 - DNA, 711 bp, Artificial Sequence
  Description of Artificial Sequence: Synthetic coding sequence
atgcacacctacgtgtacagctacacccgcatctgcatccacatgtacatccacatccacgcctatgcctacatctgcatcttcatctacacccacatgcacacctacgtgtacagctacacccgcatctgcatccacatgtacatccacatccacgcctatgcctacatctacgtgtacagctacacccgcatctgcatccacatctgcatcttcatctacacccacatgcacacctacatgtacatccacatccacgcctatgcctacatctacgtgtacagctacacccgcatctgcatccacatctgtgtgttcatctgcacccacgcctacatctacgtgtacagctatgtgcagtgcatgcacatgtgcatccacatgtacacctgcatgcacatgtgcatcttcatctgcacccacgcctgcatctgtgtgttcaccagcacccacgcctgcatctgtgtgttcacctgcacccacgtgtacatctctgtgttcacctgcacccacgtgtacatctgtgtgttcatctacatctgcatccacgtgtacatccacatctacatctgcatccacatctgtgtgtacagctacatccacatgtacacctacatccacacctacacctacacctacacccagctgttcttcaaccacctgagcattgatgagcacagcctcttcctgtacctgggctactgggagtag

SEQ ID NO: 43380 - DNA, 450 bp, Artificial Sequence
  Description of Artificial Sequence: Synthetic coding sequence
atgaggctgctgcccaggaccagcatcccccggcggcagcccttcagccgctggaggaagcagaacctgaagacccctgtgtccctgaactgcagccgcagctgcaagctgctggagggccggggcatgcctgccatcttcatcatcgccctgcccccacccaacaccatcggcggccctgccctgatcatcagcctgcaggtgtacccagctgcccctgagcggcagaggcctgcccggcggggccatgatgatggcggcggctttgtgaagaccaagatgggcatctgccgggagaagaaggagaggagtgactgctactgtgtgtacatcgagcgggaggacatccgggacagcatcctgaagaagacctgcaccctgaacaactgctttgctgagatgctgctgatctgcagctttgccccagccaccctgccccagcccctgtag

SEQ ID NO: 43381 - DNA, 444 bp, Artificial Sequence
  Description of Artificial Sequence: Synthetic coding sequence
atgatctatgatggcaacaaccagctgctgaatgccagcaaggtgggggaggtgctgcggggcggcacccggcagatctactaccaggtggtgaacttcagcagcctgtggcccctgtacaagtatgctgacaagctgcacgtgatcctgctgtacaagaccctgcaccagctggtggtggagcctgtgaaggtggccgcctggtactatgagagcgcccggctgctgaacacctacggcctgctgggcatgaatgtggccggcatctcctggcacctgtacatcttccacctggtgtgcacagacacctctgtgagcagcagcgcccccctgccctgccccctgcccctcatccaccagatgctgatcatctttgtgtggaggctgctgcgggcctgcctgtactgcagcagcctggccctgatcatctggagctacagctag

SEQ ID NO: 43382 - DNA, 1242 bp, Artificial Sequence
  Description of Artificial Sequence: Synthetic coding sequence
atgagaggaggccacagccctgctgctgccccagcccacactggaggaagaagaggaggaggagccccagccccccagtgtgtgcgcagccctgctgccctgagccgccgccaccagcccggccgcctgctgctgcacgtgtgcagccctgtgccctggacaggaacagccacagagggccagagcgtgggcacctgcctgcccggccagttcacccggcccctggacagacaccgccaccggggcagcgagtgctggcacctgagcagcggctctgtgcaccccagccctggccctgccccagcccagagggtgcgggtgctggcccctgtgttccgcatctgcagccccctgcccaggactggaacagccacagagggccaggagtgctggcacctgagcagcggctctgtgcaccccagccctggccctgccccaccccagagggtgcgctctgtgggcacctgcctgcctgacctcttcacccggcccctggacagacaccgccaccggggcagcgagtgctggcacctgagcagcggctctgtgcaccccagccctggccctgccccaccccagagggtgcgggtgctggcccctgtgttccgcatctgcagccctgtgccctggacaggaacagccacagagggccagagcgtgggcacctgcctgcctgacctcttcacccggcccctggacagacaccgccaccggggcagcgagtgctggcacctgagcagcggctctgtgcaccccagccctggcagcgccccagcccagagggtgcgggtgctggcccctgtgttccgcatctgcagccctgtgccctggacaggaacagccacagagggccagagcgtgggcacctgcctgcctgacctcttcaccccccggctggacagacaccgccaccggggcagcgagtgctggcacctgagcagcggctctgtgcaccccagccctggccctgccccaccccagagggtgcgggtgctggcccctgtgttccgcatctgcagccccctgccctggattggaactggaacagagggccagagcgtgggcacctgcctgcctgacctcttcacccggcccctggacagacaccgccaccggggcagcgagtgctggcacctgagcagcggctctgtgcaccccagccctggcctggccccagcccagagggtggagtgctggcacctgagcagcggcagccccagcctgcccctgtttgtggagtag

SEQ ID NO: 43383 - DNA, 435 bp, Artificial Sequence
  Description of Artificial Sequence: Synthetic coding sequence
atgatccgggccgccctgctggagccccagccccccaagctgaagcagagcagccacctgagcccccagggcgccggcaccaccggggccggcccccacacccccctgaccttcctgtacttcttccggctggagctgctgcaggccgccctgcccccccagccccccaaggtgctggtgcggcagcccggcggcaaggacagcctggccgagagcccctttgacctgagcactggaagaaatgccccctgtggcggggccctgggcaacctgcggcacctgcagtggggcggggcctggcccctgctcttcctgggcggcacctgggacagcgtgtaccaggccggcagcaccctggccctgggccgggtgtctgtgtccctcttcttcttcctgcccaacaagttccacagccaccccagccgccacctgtag

SEQ ID NO: 43384 - DNA, 366 bp, Artificial Sequence
  Description of Artificial Sequence: Synthetic coding sequence
atgaagggctacagagacaatgctgtggagagcaccttcaccagccgcttctacggcagcgagaagtggctgcagatcacctacctgaagacccagatgcccagcggcagcgctggcaacatcgaggacctgaccagcttcttcatcttcctgcggcagagcctggccctgctgccccggctggagtgcagcggcaccatcagcgcccactgcaacctgagcctgcccggcagcagcatcagccacgccagcgccttccgggtggccggcatcaccggggtgcactgcaggacccagctgatctttgtgtacctggtggagaccggcttccaccacatgctggccaggatggtgtccatctcctag

SEQ ID NO: 43385 - DNA, 399 bp, Artificial Sequence
  Description of Artificial Sequence: Synthetic coding sequence
atgctgagccccctgtggctgcagatcagcaagaggcccaggcctgaggtgtctgtgtccaatgcctgcttcagcagcgccctgcccaccagcaaccccaccagcctgaccctgaagcaccacaacatctttgtgctgcgggtggccctggagatcatccagtacagcgtgcacggcggcaggaacaggaagcccctggaggtgaccagcctggcctacagctgcccagagaactggtggcagaagcagatcggcgtgcagcccccagatgtgcacgccagcgccctgagccccaagccctgtgtgtcctggagccggcccctgagcctgctgagcagcaccatcctcttctggaagacccatgatgaaagagctgacttcagcaagctgcacagctag

SEQ ID NO: 43386 - DNA, 465 bp, Artificial Sequence
  Description of Artificial Sequence: Synthetic coding sequence
atggagatcatgcccatgaacatcgtgtccatcatcagccccctgattgatgtgtccccaggccggcggggccgcctgaagaatgccggcggcggcatccggctggccgagcgggtgaacagaagagctgacagaaatgtgctgcggcgggagaagggcctggccctgggccgggtgaccttcccccgggccggccggggcagccgggtgtctgccccagcccggtctgagcccggccctgctgctgtgcctgggggcgtgcggcgggcagatgacaggaagttccccccaggggccagccagcctgccttccgcagccgccgcttccaggccgctgctgggggccccagctatgccaatgaccccaccagcagcgccaagcctgtgaagctgctgccccgggagagagctggcctgaaggtgaccaacttcagccagagccgggagcgggagggcagcgcctag

SEQ ID NO: 43387 - DNA, 387 bp, Artificial Sequence
  Description of Artificial Sequence: Synthetic coding sequence
atgagctgccaccagagccccctggtgtttgatgtgggccagtgccggcagcacgacctggccggccagatcctgatctaccacagcctgaccccagctggccccctgggccggcccccagatgtgccccacagcccccacctggccagccccaccggcagccggcagaggacagtgggcggcacctgtgacacagccctcttcctgtgcagctgcttcagcagcagcttcttcagcctgctggtgaccctcttcttcttcaccctgagcccccacaagaccaggaactttgtgatcctgctgatcttcctgtacagcgtgtgcctgcacacagatggctacctgcgggccagcgagctgagcctgcccccatccatcatctcctag

SEQ ID NO: 43388 - DNA, 414 bp, Artificial Sequence
  Description of Artificial Sequence: Synthetic coding sequence
atgctgggcgtggaggacctggtgggcgccggccgctggggccggggccctgagaacctgcctgattctgggggccgcctggccgagcaggccctgcagggccccagccaccccttcagctgcctgcccccacctgagcagatcctgggcgcctggagggccctgaaggaggagctgctgagccgggcccccagccagttcaccctgtgcacagaggtgctgcagagcagcaacctgagccccaccccagctgtgagcccctttgtgcagagctctgtggagatggagaagttcctggtgcccctgtccatgttcctgtctggagagaggacctggaagctgctgctgcaggtggacttcctgaaccagggcggggagtactacagaaactggaggaagagaagaagaacatag

SEQ ID NO: 43389 - DNA, 1122 bp, Artificial Sequence
  Description of Artificial Sequence: Synthetic coding sequence
atgttcctggctgatgtgcccaccagcctgcacttccagagcatgctgaagagccagtggcagaacaagccctttgacaagatcaagccacccaagaagctgagcctgaagcaccgggcccccatgcctggcagcctgcctgaccctgccaggaaggacagacacaagctggtgagcagcttcctgaccacagccatgctgaagcaccacacagacatgagcagcagcagctacctggccgccacccaccaccccccccacagccccctggtgcggcagctgagcaccagcagtgacagccctgccccagccagcagcagcagccaggtgacagccagcaccagccagcagcctgtgagaagaagaagaggagagagcagctttgacatcaacaacatcgtcatccccatgtctgtggccgccaccaccagggtggagaagctgcagtacaaggagatcctgacccccagctggagggaggtggacctgcagagcctgaagggcagcccagatgaagaaaatgaggagattgaggacctgagtgatgctgcctttgctgccctgcacgccaagtgtgaggagatggagcgggcccgctggctgtggaccacctctgtgcccccccagaggcggggcagccgcagctaccgcagcagtgatggccgcaccaccccccagctgggcagcgccaaccccagcaccccccagcctgccagcccagatgtgagcagcagccacagcctgtctgagtacagccacggccagagccccaggagccccatcagccctgagctgcacagcgcccccctgacccctgtggcccgggacacccccaggcacctggccagcgaggacacccgctgcagcaccccagagctgggcctggatgagcagagcgtgcagccctgggagaggaggaccttccccctggcccacagcccccaggctgaatgtgaggaccagctggatgcccaggagcgggccgcccgctgcaccaggaggaccagcggcagcaagacaggccgggagacagaggccgcccccaccagccccccaacagtgcccctgaagagccgccacctggtggccgccgccacagcccagaggcccacccacaggtag

SEQ ID NO: 43390 - DNA, 3318 bp, Artificial Sequence
  Description of Artificial Sequence: Synthetic coding sequence
atggccgccatggccccagccctgacagatgctgctgctgaggcccaccacatccgcttcaagctggccccacccagcagcaccctgagccctggcagcgcagaaaataatggaaatgccaacatcctgattgctgccaacggcaccaagaggaaggccatcgctgctgaggaccccagcctggacttcaggaacaaccccaccaaggaggacctgggcaagctgcagcccctggtggccagctacctgtgcagtgatgtgacctctgtgcccagcaaggagagcctgaagctgcagggcgtcttcagcaagcagacagtgctgaagagccaccccctgctgagccagagctatgagctgcgggcagagctgctgggccggcagcctgtgctggagttcagcctggagaacctgcggaccatgaacaccagcggccagacagccctgccccaggcccctgtgaatggcctggccaagaagctgaccaagagcagcacccacagcgaccatgacaacagcaccagcctgaatggaggcaagagggccctgaccagcagcgccctgcatggaggagagatgggcggcagcgagagcggggacctgaagggcggcatgaccaactgcaccctgccccacaggagcctggatgtggagcacaccaccctgtacagcaacaacagcacagccaacaagagctctgtgaacagcatggagcagcctgccctgcagggcagcagccggctgagccctggaacagacagcagcagcaacctgggcggcgtgaagctggagggcaagaagagccccctgagcagcatcctcttcagcgccctggacagcgacacccgcatcacagccctgctgcggcggcaggccgacatcgagagccgggcccggcggctgcagaagaggctgcaggtggtgcaggccaagcaggtggagcggcacatccagcaccagctgggcggcttcctggagaagaccctgagcaagctgcccaacctggagagcctgcggcccaggagccagctgatgctgaccaggaaggccgaggccgccctgaggaaggccgccagcgagaccaccaccagcgagggcctgagcaacttcctgaagagcaacagcatcagcgaggagctggagcgcttcaccgccagcggcatcgccaacctgcgctgcagcgagcaggcctttgacagtgatgtgacagacagcagcagtggaggagagagtgacatcgaggaggaggagctgaccagggctgaccctgagcagagacatgtgcccctgcggcggcgctctgagtggaagtgggccgctgacagagctgccatcgtgagccgctggaactggctgcaggcccacgtgtctgacctggagtaccgcatccggcagcagacagacatctacaagcagatccgggccaacaagggcctcatcgtgctgggggaggtgcccccacctgagcacaccacagacctcttcctgcccctgagcagcgaggtgaagacagaccacggcacagacaagctgattgagagcgtgtcccagcccctggagaaccacggggcccccatcatcggccacatcagcgagagcctgagcaccaagagctgtggggccctgcggcctgtgaatggagtcatcaacaccctgcagcctgtgctggccgaccacatccctggggacagcagtgatgctgaggagcagctgcacaagaagcagaggctgaacctggtgagcagcagcagtgatggcacctgtgtggccgcccggaccaggcctgtgctgagctgcaagaagaggcggctggtgcggcccaacagcatcgtgcccctgagcaagaaggtgcacaggaacagcaccatccggcccggctgtgatgtgaaccccagctgtgccctgtgtggcagcggcagcatcaacaccatgcctcctgagatccactatgaggcccccctgctggagcggctgagccagctggacagctgtgtgcaccctgtgctggccttcccagatgatgtgcccaccagcctgcacttccagagcatgctgaagagccagtggcagaacaagccctttgacaagatcaagccacccaagaagctgagcctgaagcaccgggcccccatgcctggcagcctgcctgaccctgccaggaaggacagacacaagctggtgtcctccttcctgaccacagccaagctgagccaccaccagaccaggccagacaggacccaccggcagcacctggatgatgtgggcgctgtgcccatggtggagcgggtgacagcccccaaggccgagcggctgctgaaccccccacctcctgtgcatgaccccaaccacagcaagatgaggctgcgggaccacagcagcgagaggtctgaggtgctgaagcaccacacagacatgagcagcagcagctacctggccgccacccaccaccccccccacagccccctggtgcggcagctgagcaccagcagtgacagccctgccccagccagcagcagcagccaggtgacagccagcaccagccagcagcctgtgagaagaagaagaggagagagcagctttgacatcaacaacatcgtcatccccatgtctgtggccgccaccaccagggtggagaagctgcagtacaaggagatcctgacccccagctggagggaggtggacctgcagagcctgaagggcagcccagatgaagaaaatgaggagattgaggacctgagtgatgctgcctttgctgccctgcacgccaagtgtgaggagatggagcgggcccgctggctgtggaccacctctgtgcccccccagaggcggggcagccgcagctaccgcagcagtgatggccgcaccaccccccagctgggcagcgccaaccccagcaccccccagcctgccagcccagatgtgagcagcagccacagcctgtctgagtacagccacggccagagccccaggagccccatcagccctgagctgcacagcgcccccctgacccctgtggcccgggacacccccaggcacctggccagcgaggacacccgctgcagcaccccagagctgggcctggatgagcagagcgtgcagccctgggagaggaggaccttccccctggcccacagcccccaggctgaatgtgaggaccagctggatgcccaggagcgggccgcccgctgcaccaggaggaccagcggcagcaagacaggccgggagacagaggccgcccccaccagccccccaacagtgcccctgaagagccgccacctggtggccgccgccacagcccagaggcccacccacaggtag

SEQ ID NO: 43391 - DNA, 486 bp, Artificial Sequence
  Description of Artificial Sequence: Synthetic coding sequence
atgggccaccggcccaacctgggccagcccccccaccccaatgctgtggccgccgccctgcacgccagcctgtgcccagccaacagaggcacctgccccctgggcaagccaggctacccaggctgcctgtggttccagcccctgctgctcttccctggctgcctgtgcagcccagatggccccttccccagggctgtgttcaccagcgctgggaagggccccctgcagacagacctgggccggggccgggtgcccccccgggaccagcagacccccaagagcggcccctgcccccgggcccctgtggccagcaaccggcagagcggcggcagcgctgtgtctgcccccctgagcggggcccggcgggcctggaagagcgcctttgctgccccacccaggagccggctgcggccccagaagggcgtgccctggacagagaagagggcccggggcggcggccgggccggcccctgcagaagaacatag

SEQ ID NO: 43392 - DNA, 372 bp, Artificial Sequence
  Description of Artificial Sequence: Synthetic coding sequence
atgaggtctgagaagagcaagggctgctggagagatggaggagatgcccaccctggagagaaggccagccagagcagcggcatcactggagtgagccacaggacccggctgacctctgtgctgctgaggaacacccagaggcggcggcacagaagaggagagcaccacgtgatggtggacacagaaattggagtgctgcagccccaggccaaggagctgctggagcccccaggagatggccgctgcaaggagctgatcttcagccagagcctgtggagagaatgtggccctggggacaccctcatcctggacttctggcccacagagccctgcacccaggaggacttcatcagccaggtgtccctgcagtag

SEQ ID NO: 43393 - DNA, 630 bp, Artificial Sequence
  Description of Artificial Sequence: Synthetic coding sequence
atgctgagcagccagctgtgctgcgtgcacagcctgcccccaacagccaacccagctgccctgtgcagcctggcccagcagatgttcaccaacatccgcagcccctgcagcggcccccagggcagccctggcctgcccaggaggacccacatccacctgtggccccacagcgcccacatgtacttcctggtgaccagcagcctgctgcccttccccctcatccagcccggctgcagcaggacccgcttcaagaccctgtgcagcctgcggcacaccagcgcccccacagaggagggccacggccctgtgcggcggccctgtggcatgcactgcctgagccacctgccccacccccggggccggccccagggccaccccacccacatgaggcctgccctgcagcaggccctgctgagccaccccagcctgctgctgccctggaggagcagcccagattctgctgtgcaggtgggccccagcatgatcctgcggcgcatccccatggccggccacctgtgcttcccccactggccccagctgctggacagccgggactgctgcacctacacctgcatcaacacccctgtgctgaacagccacatggtgcaggagggcgtgtgtggccagtag

SEQ ID NO: 43394 - DNA, 642 bp, Artificial Sequence
  Description of Artificial Sequence: Synthetic coding sequence
atgagccccaagtgtgccgagacagcccagcagctgcgctgcctgacagaaaatgtgcagaggcccctgtgccccaccatgcctgcctggggccggcccagcctgggcctgctgcgggtgtccccagcctgccagcccaagggcggccgcagctgtggctgcagccagcccctgctgaaggtgggcctgtgggtggagatgtgggccgccagcggccgccacagctacaagtgcatcccagccctgcggaccaccttcctgctgcccagccccttcctgcggacccccatgcagaagaggggccggcagctgaccaaggaccgggagggctactgctcctggcacctgatgggcagcatctgctgcatccccctgggctgctgccccggctggattggcaaggagctggccggccgcctgagctctgtgctgaccacctggctgggcggcggccgcggggcctggcaggagcagagcgctggccctggcaactggggcctggtgcacgtgtgcacccacgtgtgtgtgtgtgtgcgggcctgctgggtgggccgggaggaggccgtgaagccccaccccctgctgtctgctgctgtgctgctgtgtgtgtctgctgcccggggctgccaccacaccagctag

SEQ ID NO: 43395 - DNA, 612 bp, Artificial Sequence
  Description of Artificial Sequence: Synthetic coding sequence
atggattctgccccagctggcagcttcagcgccagcagcttctttgacctgtctgtgacagtgacccgggccaagaacagccggggccccagcagcagccccagcgagctgcagggcgcccactgcctgaccagcagcctggccgccgcctgcagcgtggcctacagcgccctgtggagcagcagccccctgcggagcccctggagcatcagcagcatcaccatgccccggctgagcagcgaggagagcagcgccagcctgctggccggggctgatggccggcccccccggctgctcttcctgcccttctgggtgaacctgctgcggctggtgctcttcctgcggccccggcggcccctgctgggcttcctggccgcccccaggtctgagcccgcctgccctgtgaccagccctgagagctgggcctgtgtgtctgaggccggcggcgtgggcgccagccctggggtgcctgccagcgctgcctgtgtgggccccagcagcagcagccggcggctcatctgcctgcggaccctggtgtcctgtgcccggagcttccacaggaccctgcagacccccagcctgcccggcatcagcctgggcatggccgcctag

SEQ ID NO: 43396 - DNA, 666 bp, Artificial Sequence
  Description of Artificial Sequence: Synthetic coding sequence
atggctgctgctggccccctgtgcacagagcgggtgtctgtgctgagccagcccaacagcggcgtggaggaccccaccccagctgggggccggggccagggcagaagaagaggccgggaggagctggagagcattggagctggccctggggcctctgtgcgcatcctgcctgccctgcggcccggcctgggcggcgtgtggggcgctggggccgccagcctggtgttccaggccggccctggcagctcctggctgggctggccagacctggacctggccctgtaccggggctgggcctgccgctctgagggcacagccaacgtggccttccctggaacagccagccctggcttcagccgggcccggcagacccgggacctgaggaagccagccctgaagacccccagccacacagccagccagctggccgctgaggccggcaaccccagcggcggctgccccagcatgcgctgccagaggagagtgggcgccctggtgcccacctggaagggcggctggagagatggctggagcggcagcggcggccgggccaaggagcgcatcctggccttctccttccctgctgggggcggcatccggggggagcgggtgcaggccgccagcaacacccgcatctgggaggagcccggcagcacccccaactag

SEQ ID NO: 43397 - DNA, 378 bp, Artificial Sequence
  Description of Artificial Sequence: Synthetic coding sequence
atgcagcctgtgatcagcgccctgaacatccagacccagacagtgcagacccacccagcccccaggaacaccagcgagcactgcaccctgcctgcctgtgatgcccaggaggagcaccgggacacagtggatggcagcatcgccaggacagagagcgccagcggggagatctggaggcagacccacatggatggagagcaccacgtgaacaccaaggccgagatctctgtgatgtctgccaaccagggcgccccccgcatcaccagcaagcccccagaggcccggcgggaggcccgggacaggagcctgcccagcgccttcagcctgcggggcctgacagacaccctcatcctgggcttctgccccccagagctgtag

SEQ ID NO: 43398 - DNA, 369 bp, Artificial Sequence
  Description of Artificial Sequence: Synthetic coding sequence
atgaaggtggccctgctgcgcttcttcagcccccccaacatgtctgtgacccacaaggaggcccacgagaggaaatgtcctgagaagccagagctgtggaaggccggcagcacagtgcccctgacagcccctgagaagacagaccccttccccctgtgcccccccctgagcctgacctgcccccagcagcagagctgcatccccagcagcagccaggatgtgctgaacagcctgtgggtgagcagccactgcctgcagctgaagatcagcaagaccaagacccactgcctgcccacccagaatgtgctgcccttcctgctgcccacccctgtgtccatcgtgtgccgcctgcccggcctggacccctag

SEQ ID NO: 43399 - DNA, 459 bp, Artificial Sequence
  Description of Artificial Sequence: Synthetic coding sequence
atggaggccgaggcctggggcagccaggcccgggccggcctgggcgctgctgagaactgcctggagggcggcaaccaggccttcctgctggagcgggtgacaggcaccaagggccggggccagggccagcccctggagcgggccggggaggagggggaggccggcggggacccccggcgggaccccggggaggtggtggccaagagccgggtgcgggcccggccccacctgagcctgtacccagccctgcccggggtggccctggccctgctgtgctgccccctgcaggaccgctgcctgcggctggtgcctgcctgccccacagctggcccccagcacccccaggtgctgccctgggccctgcagaagcagggcgtggtgcgcagcggcccctgggccacagaggagatggtgtggggcaccaggactggagtgggcggcctgacagctgtgttctag

SEQ ID NO: 43400 - DNA, 879 bp, Artificial Sequence
  Description of Artificial Sequence: Synthetic coding sequence
atgcagcccagccgggaggccctggagctgcggggcctgcccaagtctgtgtccacagtgagcagcaccaagccacccctgaccacccccagcagcaccaaccccagccggcagctggccctggaggactgtgtgcagctgcgggccgccctggacctgggctacggccctgagtgctgctgccaccacctgcctgaggtggcccacaagagcagcgccagcgctggggcccccagcgcccggctgcccctgcagccccacagcctgggcaccaggaccaagctgccccccagcctgtgcctgcccggccctggccgcacccggctgaccacagagcccttccctggggcccccttctgcagcgacagctgcagccctgccctgtgctgcgtgctgctgaccccaggccggggccggggctctgtggcccccctgggcagcagccaggacggccggggcggctgctgccccacagacacagtgcctgctgcccagggcatggatgcctcctggacagtggccccagcccaggagtggctgggccaccccctgcagagctgcccccagagcgccagccggggccacctgcccctgcccctgcccacccccaccaccccctgcatcagccagcccccaggccgccgctgccggccccactgtgggaaggagctgttccgggcccctggggccctgcacttcctgccccggcggcaccctgctgctgtgcgccaccgctggacccgggcctgcccagagggccccaggatgcacatcccccagggctggctgctgagcagccccagcctgctgacagactggttctccatggacagcttcaagccacccagcctggccagcggccagatcagcaagacctag

SEQ ID NO: 43401 - DNA, 900 bp, Artificial Sequence
  Description of Artificial Sequence: Synthetic coding sequence
atgcctgagggctctgtgtctgccatgaggaccagccccaagagctcctggccctggtgctgctcctggagctgtgcctggagcagcagcagccccccctggaggagccccccatctgccaccggcaccctgtgccgcagctgcagcctggcccccagcggggacctggaggtgctgaagagccaggagaccggctgccgggaccccctgcagctgcccggcctgctgggcccctgtgccctgagccccatggtgggcagccccagcggccgggtgaagctggtgggcagaagatctgtggtgcagtgcagccgctgctgcatcgaccccctcatcttctttgtgtttgtgttcatcctcttctgctttgtgtttgagatggagagctgcagcgtgacccaggccggcgtgcagtggtgtgatgacctgggcagcctgcagcccccacctcctggcttcagctgcctgagcctgcccggctcctgggactaccgccaccccccaccccacccagccaacttctgcatcttcagcagagatgaggtgtccacccccacccaggccggcgtgaagctgctgacagccagtgacctgcccaccctggccagccagagcgtggccatcactggagtgagccaccacgcccagcccaaccccctcatcttctgcttcagcagcagcacagtgaggaaggcctttgaccggggcccccggcgctggcagcacggcggcggcctgactgtgtgggtggtggtgaaggccctggagagccagctgcagcgggaggatgtggacctgagagatggccagtgccacctgcaccggcggctggaggccccagcctggggcaacctgctgggcaaggagggcagcaagaggggcaccatgaagcagaactag

SEQ ID NO: 43402 - DNA, 843 bp, Artificial Sequence
  Description of Artificial Sequence: Synthetic coding sequence
atgaccagcctgacccacggcatgcacctgaccagcagcaccagctgcagctgccagagcagcggcaccagcttcaccagctgcagctgccgcagcagcggcaccagcagcaccagccgctcctggtggagcagcggcaccagcagcaccagctgctcctggtggagcagcggcaccagcagcaccttctgcagctgctggagcagcggcaccagcttcaccagctgcagctgctggagcagcggcaccagcagcaccccctgcagctgccgcagcagcggcaccagcagcaccagctgcagctgctggagcagcggcaccagcagcacctcctggagctgcaagagcagcggcaccagcagcacctgctacatgtgcctgagcagcggcaccagcagcaccagctacagctcctggagcagccagaccagcagcaccagctccatgtgcctgcccagcaggaccagcagcatcttctacagctgcctgcccctgggccaccacctgcccttctgcagcgtgcggcccctgggcccccccaccaccagccccctgagcaacctgtggatcctgagccaccccttctacctgggcggcgtgtggcccctgaacaaccacctgcacatgaacctgctgggctacttcaacaacctgcacctgtggagcctgggcctgcagcccctgcccccacctggcagccccctggtgcacctgcccccaccacccctgggctggcccctgctgtctgagctgctgcaggacctgaaccagctgccctaccccctgctgcctgtgggcccccggcccaggcctcctcatgtgctgctgggcatcttcatctag

SEQ ID NO: 43403 - DNA, 477 bp, Artificial Sequence
  Description of Artificial Sequence: Synthetic coding sequence
atgctggatggcggcagaaatggccgcctgctggagctgagcagcctgctgcctgagcggggcggcggccccagcctgtgccgcagccctgccagcacagagaaggaggtgggcgcctgtggcaccctggccagcctgcggcggggcctgtggaagtgcagcctgtgccccggccctgccctgctgctgggcggcagctgctgcctgatctgcagcctgagcctgctgctgctgagcacccccaccttcttcagcaggaactttgagcccagcttcagccccagccccatcgagaagcccagcgcccccagcagcggccagagcagccagctgcagacccaggtgcagcccccagctgagagaggagctgcctccatgcctggccctgccagcctgcccctgagcacaggccccagccagcccctgcgctgcagcccccgggtgctgtgcagccgggtgctggccctgcggaggtag

SEQ ID NO: 43404 - DNA, 480 bp, Artificial Sequence
  Description of Artificial Sequence: Synthetic coding sequence
atggccaccgtggaccctgctggcctggccctgcacccagcctgcccccgggtgtggggccccagcgaccagcacaggcctccccaggagggcagccacctgcctgcccggcggcggggcctggccaggaaccagagctgccagcacccagacctgggccccccagccagcaggacagagaaggagatgtctgctgtggccgcccctggctgtgccgccctgctgcagcccccccagcagacctctgtgcagagcttcaagggcatgagcctgtctgtggaggccggcctgtgtggggagcctgctgggaagctgctgggggagggcggcggccagcgggaggccagcctggtgggcaagaagggctgggagtggaggaggcaccggggccgcaccctgtctgaggaggaccagggcgcccggcccttcagccctggcagctgtgccctgcggggggaccgggagggcggcatcggctag

SEQ ID NO: 43405 - DNA, 618 bp, Artificial Sequence
  Description of Artificial Sequence: Synthetic coding sequence
atgagggagcccctcatccccccctgcaaggccgccagcctgtctgagcaggagcaggtgagaggagaatgtggcatgatgacagcccagggcatcctgggcccccggggcaagagcaagctgcctgtgctgcctgaccccaggctcatctgccgctacatgtgcagctgccgggagatccctggggtcatcagcacccctgtgccccacagcgctggcccccaggtgacccgcttccacagccccagccccccccacatcagcgagctgagccagaccctgcacgcccccttccagggctcctggccccggccctgccacgccctgagcggcccccgggccatggtgcccaaccagctgcaccctggcaccccctgcccagcccacgtgccccacagctgcaccatgcctgctggcacctgccccctcttcaccggggccccagctgctgctgaggccggcctgaaccctggccctgccctgcgggcccccaccagctgcagcagcagcacctggcccaagcccttcatgacagtgtgcctgctgcccaccagctccatgctgaccagccctggcactggaggctgcatccgggcccgcatcctggagcccgcctag

SEQ ID NO: 43406 - DNA, 453 bp, Artificial Sequence
  Description of Artificial Sequence: Synthetic coding sequence
atggctgtgaccttccagatgctggccgtgcagcagagcaccagccacgccatccagagctggcacagcctgcggcccagctgccagaggaggccagacagcagctgcacccggctgagcggcatgaccagcgctgccaccaggaccagcgagacagccatggatgccacccggctgtggggcacccgctggaaggtgaggaccaggaggatggtggccagcaccagccgcttccaggccaacgtggccgccaccaggaagcccagcaaggccgccggctgcagcctgaacagcgtgctgggcaagcctgtgctgggggagcccgccttctgggacctgcccagcgtgcctgtggccccagccacccccagcgaggccgccgcccctgagagcgagtgctggagggcccaccgggacctgccctaccccagcggggacctggccctgcagtag

SEQ ID NO: 43407 - DNA, 528 bp, Artificial Sequence
  Description of Artificial Sequence: Synthetic coding sequence
atgacccggcccctgcctgagagcatccggctgctgcggcacacaggcctggtgccccccacccctgtgcccctgggctacccccaccagagctttgtgtcccagccccaccccttcagcaagcagcccagcccctgcccccggcagagcccccagggcgactttggctgggtgtcccctggggccagccgcagcatcaccggccccagcagccctgctgcccccagcctcatcagcctgggcagcctgggcagccacctgcagggcgcccggccccacccccggcagagcagcctgggggactttggcctggtgaccccaggcaccccctgctgccgcctgtgcccccccctgctgctgccccagggccggcccccctgggtgctgtgtgccggcgtgtccaaggagctgggccccaaccctgtgctgcccagccccatcgtggagcagaggctgggccacggggctgacatggtgcccccaccagaccaggaggagtggaatgtggtgatgagccagagcacctag

SEQ ID NO: 43408 - DNA, 528 bp, Artificial Sequence; identical to SEQ ID NO: 43407
  Description of Artificial Sequence: Synthetic coding sequence

SEQ ID NO: 43409 - DNA, 591 bp, Artificial Sequence
  Description of Artificial Sequence: Synthetic coding sequence
atggctgctgcctctgtgcccccagagagcagcatcatccacccagccagcagcgccatcaagaggacagatggcggccgcctggagctggagatccgcatcggcatctttgcccagttctggagcgcctgcctgctcttcccccgctgcagccagccccggcagcccaggtcctggggcccccgggtgaatgcctttgccctgtggccagccaccaggaggcctgcccacacaggccggcgggtgaccccagcccgggcctgcagccacaccagcggcaccggggccggcaggaagaggaaaggaggagagaccagcttccagcgggagtggagcgaaaatagaagagagaagggccagggcaagatccgcagccctgcccctgagcctgctggaggagaggccagcagcagccctgcccctgaggagcggggccccagccactgcagccaggccaacgtgtccccagccagctgcaccctgcccgggaagacccgcatccacagcctgtgccgggagggcaatgccggccgcacccccagccagccccccctgagcggctacaagacccccaacaagaggaacctgtag

SEQ ID NO: 43410 - DNA, 423 bp, Artificial Sequence
  Description of Artificial Sequence: Synthetic coding sequence
atgggcctggaggccaagaacagcccctgctgccaccagcacggggactttgtgccctaccccatcctgagcgcccgggtcttccagcctgaggtggaggaggccaccctggccgcccacgccatcagccatgactgtgtgtgcagcggcggcggcgtgctgctgccccatgactggaggaacaactacatgatcctgctgaacccccaggtgctggctgatgagcggggccaccagaggcctgtggccttcctggcctacaaggtgaatggccagtacatcatggagggctttgccagcagcttcctgttcaccatgggcggcctgggcttcatcatgctggaccagagcaatgcccccaacatccccaagctgaaccgcttcttcttcttctacagcctggacagctctgtgtcctactag

SEQ ID NO: 43411 - DNA, 462 bp, Artificial Sequence
  Description of Artificial Sequence: Synthetic coding sequence
atgcacctgaagaacccccccaaccccccccacctgccccctgtggagagcgccaggaacaagaccatcctgctgcagcagctgagcgccctgcctgacagccccctgtggggcctgggcatgaccagggtcttcctggccgacctgacagaggccagcctggccctgtgcagcctcatcagcctgaagtgcctgcccggggacagcggcaagagcggcaaggtgtccctgggcctggccggctgcagcggcatccagacctctgtggcccccagcagccagcagcagaagacagccagctgtggcactggaggccgctgctgcggcccccacccagccagccccaggaaaggagctggcagccacagcacagcccgggcctggcccagcaaaggagaggcccagctgttcagccccccagccagcgctggctgcagcggcacccagcccggggtgacctag

SEQ ID NO: 43412 - DNA, 549 bp, Artificial Sequence
  Description of Artificial Sequence: Synthetic coding sequence
atggctgtgactggagtgcagtgcagcgagcgctgcaagcagacccggcgggtggacagcagcagcggcaagtggctggccacccccctcatctgggagaagctgaactggcccagccgcagccagagccagaacctgcaccccttccgcatcctgcccaacggcctgaccctgcccggggcccaggagaggcctggctacctgctggccgccctgcccaacccctgtgccccccggccctaccaggtgcactgggtgcacgtggccgtgctgattgctgtgctgctgcagcagctgccccagagccgctgcctgcggctgcccctgcccggcggcggcggcggccagagggccctgcagggccgcctgaagacccaggccggcaagaggggcgtgaggaagaggggcggctggagggagcgggagcggcccagcgctgaccccggggagcggggcctgcgggtgggcgcccaggtgcagaacccccgggcccccaggaagatctttgccatcccagccaccagcaaggtgcagctgcggcccatgtag

SEQ ID NO: 43413 - DNA, 435 bp, Artificial Sequence
  Description of Artificial Sequence: Synthetic coding sequence
atggctgatggcggcggcggcggcagcggcggggccggccctgccagcacccgggccagccggggcctgtttgacagcttccggcgggactgcaaggcagatgtggacaccaagccagcctaccagaacctgagccagaaggctgacaactttgtgtccacccacctggacaagcaggagtggaaccccccagccaatgacaaccagctgcatgatggcctgcggcagagcgtggtgcagagcggccgctctgaggccggcgtggaccgcatcagcagccaggtggtggaccccaagctgaaccacatcttccggccccagatcgagcagatcatccacgagttcctggtggcccagaaggaggccgctgtgcctgccctgcccccagagcctgagggccaggaccccccagcccccagccaggacaccagctag

SEQ ID NO: 43414 - DNA, 861 bp, Artificial Sequence
  Description of Artificial Sequence: Synthetic coding sequence
cagcgctgctgccgctgctgctgccgctgcccctgctgcggccagggccccaggagcggctgcaagatcccagctggagatgcccgggtgagagatggagctgggggctctgtgcacctgtgtgccctgtttggcctgctgccccgggtgtggctggagcgcttctacccctgcctgtggcccctggtgcccggccggggccagtgcaggcctggggacagcgccaccaacaacagcacccagaaggtgcagaaggagacccagggccgcttccacctgctgggggaccccagcaggaacaactgcagcctgagcatcagagatgccaggagaagagacaatggcagctacttcttctgggtggcccggggccgcaccaagttctcctacaagtacagccccctgtctgtgtatgtgacagccctgacccacaggccagacatcctgatccctgagttcctgaagagcggccaccccagcaacctgacctgcagcgtgccctgggtgtgtgagcagggcaccccacccatcttctcctggatgtctgctgcccccaccagcctgggccccaggaccctgcacagctctgtgctgaccatcatcccccggccccaggaccacggcaccaacctgatctgccaggtgaccttccctggggccggcgtgaccacagagaggaccatccagctgtctgtgtcctggaagagcggcaccgtggaggaggtggtggtgctggccgtgggcgtggtggccgtgaagatcctgctgctgtgcctgtgcctgatcatcctgtccttccacaagaagaaggctgtgcgggctgtggaggtggaggagaatgtgtatgctgtgatgggctag

SEQ ID NO: 43415 - DNA, 834 bp, Artificial Sequence
  Description of Artificial Sequence: Synthetic coding sequence
atgcctgagagcgtgacagtgcaggagggcctgtgcatctttgtgcactgcagcgtcttctacctggagtatggctggaaggacagcaccccagcctacggccactggttccgggagggcgtgtctgtggaccaggagacccctgtggccaccaacaacagcacccagaaggtgcagaaggagacccagggccgcttccacctgctgggggaccccagcaggaacaactgcagcctgagcatcagagatgcccggcggcgggacaatggcagctacttcttctgggtggcccggggccgcaccaagttctcctacaagtacagccccctgtctgtgtatgtgacagccctgacccacaggccagacatcctgatccctgagttcctgaagagcggccaccccagcaacctgacctgcagcgtgccctgggtgtgtgagcagggcaccccacccatcttctcctggatgtctgctgcccccaccagcctgggccccaggaccctgcacagctctgtgctgaccatcatcccccggccccaggaccacggcaccaacctgatctgccaggtgaccttccctggagctggggtgaccacagagaggaccatccagctgtctgtgtcctaccccctgatgaaccctgtgattgaggccagcctggaggatggcaccgggaagtctggaacagtggaggaggtggtggtgctggccgtgggcgtggtggccgtgaagatcctgctgctgtgcctgtgcctgatcatcctgtccttccacaagaagaaggctgtgcgggctgtggaggtggaggagaatgtgtatgctgtgatgggctag

SEQ ID NO: 43416 - DNA, 543 bp, Artificial Sequence
  Description of Artificial Sequence: Synthetic coding sequence
atggccgagagcctgcccctggagatgctgacctacatcctgtccttcctgcccctgagtgaccagaaggaggccagcctggtgtcctgggcctggtacagagctgcccagaatgccctgcgggagagcctgggcctgcggggcatctgctgcatcagcctgaccaacctggatggcagcctggccagccaccaggtgctgcagagcgtggcctaccacctgggcccccacctgcagagcctgagcctgggcggcggcagccccacagaggccagctctgtggccctgatcctgggctgcccagccctgtgtgtgctggacctgagcggctgcaacagcctcttcaccagcggcaccctgctggcccagcctgagatggcccagagcgtgcagcaggccctgagcggcctgcgggagctgaacctggccggcctgcgggacctggccgacctgtccttcaaccagctgagcagctgtgcccccagcctggagcggctgagcctggcctactgccacctgacctttgagctgggccctgcctag

SEQ ID NO: 43417 - DNA, 702 bp, Artificial Sequence
  Description of Artificial Sequence: Synthetic coding sequence
atgaggctgctgcccctgctgaggacagtgctgtgggccgccttcctgggcagccccctgcggggcggcagcagcctgcggcacgtggtgtactggaacagcagcaaccccagcctgcggcgggagggctacacagtgcaggtgaatgtgaatgactacctggacatctactgcccccactacaacagcagcggcgtgggccctggggccggccctggccctgggggcggcgctgagcagtatgtgctgtacatggtgtccagaaatggctaccgcacctgcaatgccagccagggcttcaagcgctgggagtgcaaccggccccacgccccccacagccccatcaagttcagcgagaagttccagcgctacagcgccttcagcctgggctatgagttccacgccggccacgagtactactacatcagcacccccacccacaacctgcactggaagtgcctgaggatgaaggtgtttgtgtgctgtgccagcaccagccacagcggggagaagcctgtgcccaccctgccccagttcaccatgggccccaacgtgaagatcaacgtgctggaggactttgaaggagagaacccccaggtgcccaagctggagaagagcatcagcggcaccagccccaagcgggagcacctgcccctggccgtgggcatcgccttcttcctgatgaccttcctggccagctag

SEQ ID NO: 43418 - DNA, 495 bp, Artificial Sequence
  Description of Artificial Sequence: Synthetic coding sequence
atggaggatgagcgcatcctggacaacctgggcgctgagggccgccacggcagcgagtgggagtggaggcgctggcactttggaggctgggtggaggaggagcaccgccaccgctggccccggggcgtgtggagcacagacaagagccctgggggcgtgcagccccagtgcctgagccaggaggtgtctgccctggtgtctggcacccagagcagcctgagaaatggcctgggggacaagtggagcgcctgctgcacccgggccctgggccagatggagcagaccaagcagagcaagaggcgggccggcagagaagatcgcttctctgtggccctgggccgctgcagaggaaatgagcacaagaccctgagccacgtgcctggggccagtgatgctgcccagaagccccgggccaagccctgcagccggggcattggagcctctgtgctgctgcagaccatgcacctgtccttcatcaccctgggcttcagatag

SEQ ID NO: 43419 - DNA, 1323 bp, Artificial Sequence
  Description of Artificial Sequence: Synthetic coding sequence
atgtccatgctggccgagaggaggaggaagcagaagtgggccgtggacccccagaacacagcctggagcaatgatgacagcaagtttggccagaggatgctggagaagatgggctggagcaagggcaagggcctgggcgcccaggagcagggcgccacagaccacatcaaggtgcaggtgaagaacaaccacctgggcctgggcgccaccatcaacaatgaagacaactggatcgcccaccaggatgacttcaaccagctgctggccgagctgaacacctgccacggccaggagaccacagacagcagtgacaagaaggagaagaagagcttcagcctggaggagaagagcaagatcagcaagaacagagtgcactacatgaagttcaccaagggcaagtcctggaaggccctgaccctgagccagaagaggccctacgtggatgaggccgagcggctgcggctgcagcacatgcaggactaccccaactacaagtaccggcccaggaggaagaagcaggccaagaggctgtgcaagagggtggaccccggcttcctgctgagcagcctgagccgggaccagaatgccctgcctgagaagaggagcggcagcagaggagccctgggggagaaggaggacagaggagagtacagccctggaacagccctgcccagcctgcggggctgctaccacgagggccctgctgggggcggcggcggcggcacccccagctctgtggacacctacccctacggcctgcccaccccacctgagatgagccccctggatgtgctggagcctgagcagaccttcttcagcagcccctgccaggaggagcacggccacccccggcgcatcccccacctgcccggccacccctacagcccagaatatgcccccagccccctgcactgcagccaccccctgggcagcctggccctgggccagagccctggggtgtccatgatgagccctgtgcccggctgcccccccagccctgcctactacagccctgccacctaccaccccctgcacagcaacctgcaggcccacctgggccagctgagccccccacctgagcaccctggctttgatgccctggaccagctgagccaggtggagctgctgggggacatggacagaaatgaatttgaccagtacctgaacaccccaggccacccagacagcgccaccggggccatggccctgagcggccacgtgcctgtgtcccaggtgacccccaccggccccacagagaccagcctcatctctgtgctggctgatgccacagccacctactacaacagctacagcgtgtcctag

SEQ ID NO: 43420 - DNA, 888 bp, Artificial Sequence
  Description of Artificial Sequence: Synthetic coding sequence
atgctgcctgacttcaagctgtactacaaggccaccgtgaccaagacagcctggtaccgctaccagaacagagacatcgaccagtggaacagaacagagcccagcgagatcaccccccacatctacaactacctgatctttgacaagccagagaagaacaagcagtggggcaaggacagcctcttcaacaagtggtgctgggagaactggctggccatctgcaggaagctgaagctggaccccttcctgaccccctacaccaagatcaacagccgctggatcaagtacctgaatgtgcggcccaagaccatcaagacagtggaggagaacctgggcatcaccatccaggacatcggcatgggcaaggacttcatgagcaagacccccaaggccatggccaccaaggccaagattgacaagtgggacctgatcaagctgaagagcttctgcacagccaaggagaccaccatccgggtgaaccggcagcccaccaagtgggagaagatctttgccacctacagcagtgacaagggcctcatcagccgcatctacaatgagttcaagcagatctacaagaagaagaccaacaaccccatcaagaagtgggccaaggacatgaacagacacttcagcaaagaagacatctatgctgccaagaagcacatgaagaagtgcagccccagcctggccatccgggagatgcagatcaagaccaccatgagataccacctgacccctgtgaggatggccgtcatcaagaagagcggcaacaaccgctgctggaggggctgtggggagatcggcaccctgctgcactgctggtgggactgcaagctggtgcagcccctgtggaagtctgtgtggaggttcctgcgggacctggagtag

SEQ ID NO: 43421 - DNA, 372 bp, Artificial Sequence
  Description of Artificial Sequence: Synthetic coding sequence
atgcagagcgagaagccccagggcctcttcctgcagctgaaccccaatgccagcagcacagagacccagctgctggtgcctgccctggagagccgggacaccctgccccccacccactgcttcatggccggcacagagagccccctgggcaacccctggcccctgagcctgcccccaccctgctggacaggctgcctgctgcctgccccccggggccagaggaagccaggccccctgggcctgagcatcttcatcagcctgggcaacaagaggcacaggagcggcaaccacgtggtgcgggagagcgagcagcccctgagccagggcaacccccaccagggctggggccctgacaccaggaaaggaagatag

SEQ ID NO: 43422 - DNA, 372 bp, Artificial Sequence; identical to SEQ ID NO: 43421
  Description of Artificial Sequence: Synthetic coding sequence

SEQ ID NO: 43423 - DNA, 855 bp, Artificial Sequence
  Description of Artificial Sequence: Synthetic coding sequence
atgctgtctgtggtggagaatggcctggacccccaggccgccatccctgtgatcaagaagaagctggtgggctctgtgaaggccctgcagaagcagtatgtgtccctggacatggtggtgaccagtgaagatggagatgccaacaccatgtgcagcgccctggaggccgtgttcatccacggcctgcacaccaagcacatccgggcagaggccggcggcaagaggaagaagagcgcccaccagaagcccctgccccagcctgtgttctggcccctgctgaaggctgtgacccccaagcacatcatcagcgagctggagcacctgacctttgtgaacatggatgtgggccgctgccgggcctggctgcggctggccctgaacaacggcctgatggagtgctacctgaagctgctgctgcaggagcaggcccggctgcagctgcagaggaaggagagcctggacagcatcagccacagcagcggctctgaagatattgaggtgcaccacagcggccacaagatcagaagaaaccagaagcccacagccagcagcctgagcctggacacagccagcagcagccagctgagctgcagcctgaacagcgacagctgcctgctgcaggagaatggcagcaagagcccagaccactgtgaggagcccatgtcctatgacagcgacctgggcacagccaatgcagaagattctgaccagagcctgcaggacatcaagatcttctcctgggcccagtggctgacccctgtgatcccagccctgtgggaggccgaggccggcggcagccagagccaggagattgagaccttcctggccaacacagtgaagccccacctgtactag

SEQ ID NO: 43424 - DNA, 516 bp, Artificial Sequence
  Description of Artificial Sequence: Synthetic coding sequence
atggactggaccccccggctgcccagccgccacatcatcagcgagctggagcacctgacctttgtgaacatggatgtgggccgctgccgggcctggctgcggctggccctgaacaacggcctgatggagtgctacctgaagctgctgctgcaggagcaggcccggctgcagctgcagaggaaggagagcctggacagcatcagccacagcagcggcagcgaggacatcgaggtgcaccacagcggccacaagatcagaagaaaccagaagcccacagccagcagcctgagcctggacacagccagcagcagccagctgagctgcagcctgaacagcgacagctgcctgctgcaggagaatggcagcaagagcccagaccactgtgaggagcccatgtcctatgacagcgacctgggcacagccaatgctgaggacagcgaccagagcctgcaggagaagacccgggccggcagccagaggatgaccagcacaggcctgcccggcagcaacccctag

SEQ ID NO: 43425 - DNA, 576 bp, Artificial Sequence
  Description of Artificial Sequence: Synthetic coding sequence
atgcctgctgccatcgcccccaaggatgacctgagcatccgcttcctgaagccctggctgggggagggcatcctgctgtctggaggagacaagtggagccgccacaggaggatgctgaccccagccttccacttcaacatcctgaagccctacatcaagatcttcaacagatctgtgaacatcatgcatgacaagtggcagcacctggccagcgagggcagcagccggctggacatgtttgagcacatcagcctgatgaccctggacagcctgcagaagtgcatcttctcctttgacagccactgccaggagcggcccagcgagtacatcgccaccatcctggagctgagcgccctggtggagaagaggaaccagcacatcctgcagcacatggacttcctgtactacctgagccatgatggctggaggttcagaagagcctgccgcctggtgcatgacttcacagatgctgtgatccaggagcggcggcacaccctgcccacccagggcatcgtcatcagcagcaggaccaagcccagcccccggctgtggatcagcctgatgtgcttctgctag

SEQ ID NO: 43426 - DNA, 4098 bp, Artificial Sequence
  Description of Artificial Sequence: Synthetic coding sequence
atgagcagtggaagaagaagaggcagcgccccctggcacagcttcagccgcttctttgcccccaggagccccagccgggacaaggaggaggaggaggaggagcggcccggcaccagccccccaccagcccctggccgctctgctgcctctgtggagaatgagcccatgagcaccagccagaagaaggaaaatgtgctgagcagcgaggccgtgaagatccggcagagcgaggacaagaggaaccacgccgagaagcctgtgaccctgcctgtgcaggaggaccccaagaaggcctatgacctgagcagcagcaccagtgacaccaagatcggggagagtgaccggcagcccaaggagagcttcttccagttcctgggcaacctcttcaacatcagcggcaagagcagcctgggggaggccaagcagagcagcttcaaggatgaccaggacaagacagagaaggacctgcagaaccccagcgaccaccatgaagatggcatcaagcgggagcgggagatcttcagcggcagcctgcggacccagacccaccccacagaggagcaggacagcaacagcagcgagctgagtgatgccttcagcctggacaccacccaggacagcgaccaggagaccaccaacctgctgaagcagattgatggcaagccagagaagcccagcgtgacctacgccacctaccggggccccaggcacatcggcaagtacctgaagcagcagacaggcctggccaccgtgaacaccctggacagagaaaatgaaagcagtgacagcagcaccaacagacacattgatcctggcagcgagattgaagctggggtgctgcccctgctgctgagcgccagcacagacagctccatgaagggcaacctgctggagggccccctggaggacagcgactgcagcaagaccagcttcaacaaggagaacagcctgaccaacaaccctgagctgcagaacatcgccagcagcaacaacctgctgaacaagaatgcctggggcagcattgaaagaaacagaagcagccccagctctgtgaccaacagcagctatgatggagagagtgacagccagcaccacctgagctgtgagcctgtgtcccagaccaacagaaacctggtgtgcagcgccctgctgaccggcagcaaccacaggaaggtgccctgcagcccagacttccagagggtgaccaccacagagaacaccatcaaggagaacagcacagtgatgagcaacagaaccctggtgcagcgggaggagctggtggagccccagggccctgccatcagtgacttcagctgcagcaagagtgatggcagtgacaccacagagcaggagagcaccaacctgcccagccccaacaagagcatcagacatgagcacctgcagctgcctgagagtgaatgtagtgacaagcagaccatcgacagcagcagcaagcaggccgccacccacaccaacatcatcgccctgcagagacatgctgtgacagacacagaatttgtgaatgaaggcaagaggctgagcgcccaggacagccagaagaatgtggccgtgcgggagatccggcgggagacagaaagtgccagcgctggggagagcatcgccagcagccacgtgaaggcccctgaggacaagattgagagcctgcccaaggacacagaccagtactttgagaccaaggccaagaagctggacttccgcagccatgacaagatcccccacatccgcatgaacaagaaggacctggccagcctgaactacatcagcgagagcgctgtggtggccagcctgggcaatgaaaatgcccctgagctgaagtttgagctgaacagaagccacatcagcgagacccccctggacagcgagagcccccagcaggccgaggtgtccccagatgccaagaccagcctgagcctggactgcaagaagctgaacttcagcatcagcccccccacctttgtgtctggagtgggcatgctgagcaagctggacatcccagacctgatgaatgaaggcagccctgtgcccattgaaacaggaaatgtgaacatcgtgggcatctcctaccagcccaggaagtgcaaggaggagaatgtgaagaaccacgtggaggccgccggcaggaagagccccccacccagcttctgcctggagtacaccagcgccatctttgagttcaaggaggtgctgagcaacagcgagaagtgccaggtgctgcccggcagcgaggccagcggcccccacctgaccggcctggagctgctgagctttgattctggcaacctgagcaaggactgcagcagcatcctgagccaggaccccaacagagtggagctggtgagcagcaacaccaaggccaacatgagcatcatcgagaagagtgacagcctgagcctggaggccaagacagccaacatcgtgtccaaggccgagattgatggccagaacaacgtgctggtggagagccacagcggccggggcaagaccatcagcctgagcaaggtgtccctgagcaaggtggagcccaggaacatcagccaggacaagatgagcagcttccccctgaagatcacccacgtgcctgagaagcccatcctgtctgagctgaccttcctggaggtggagcagggcaagcgcttccagagcatcaaccacaatgagatcggggagaagtgcagtgatgctggcctgaaggagaactgccaggccgagctgagccctgctgccagcaaatatgaggacaagccagagcctgaggtggatgccctgggcagccccccagccctgctgaagagcaacatctcctggatcctgccccccatccatgatgagaagatcagccggcagatggcccagaactgtgaggcccacacctgtgtgttccaccagagcctggacatctgtggcaccaagaagatcagcggccacagcgagatggccgagctgagcctgaccaacatcagccccaagttccaggagaccggctccatgaaggtgaacagccccttcctggacagcgacagcagcctggagaagaacagcagcgccagcgaggacagcagcttcctgaaggtgcccagcgtgctgaagctggagaagaagagcagcagctacaggaagaaggagaacatccacttcctgaatggaggcattgattctgtgagcagcagcagcagctacccagaggaggtgtccatgattgtgaacagccacaagccccagaacaacctggacagcatccaggtgaccaaggacctgacccatgagggcacctctgtgaccaacctgctgtaccccaccaccagctacctggagtttgagacctctgtgtccatcggcacagaggtgacccccttccaggagcacttcggcatctacacaggcaagatcagcattgacttccccacagctgcccagtttgacaacctggtggaggccgagaccggggctgtggccggccctgctgcctctgtgaacagcagcggccagcagtgcagcgaggccagcgctgagcacatcgaggccaggagaagagcccatgaccagctgctggacctgaagagcagcctgctgaagaaggctgacaccctcatcggggagatcttcaacagcgtgcgggaggagctgaagttcaagcacacagtgtccacctgccaggagcacatcgccatcgagggcatcatgaacctgggcaccctgaaggaggacatcagcgagaagaaccccagcgaggtgaccctgacagagatccagcagacagagggcctggaggagcagggcatggagaacatgtctgaggtgaaggagaagccctgtgtgagccccaccgtgggggagaagaacctgctggtggaccccaacagcatgaatgtgtcctgcctgctggaggacaaggcccgggagctggtgaatgagatcatctacgtggcccaggagaagctgagaaatgacacctttgaggacacagaggacacctgggacagcgagctgcaggccaacaccagcaagatcctgaacagcgacagcgtgaagccccatgatgtggtgcgggagttcctggtgtctgagcagcctgtgtag

SEQ ID NO: 43427 - DNA, 372 bp, Artificial Sequence
  Description of Artificial Sequence: Synthetic coding sequence
atggccacccacaggagcaccctggccggctacagcccctgcagcagcccccagagagctgcccccaccaggaaccagaaggccgagaaggccaggaaccggcaggccagccccatccccacccggctgcccaggaaccccagcctggccagcacaggccggcagggcacccccatgagcaggaagaagcagggcagtgactgcctggtgtacccaggccaccccccaggcctgtggcctgtgatcagctgccacctgggcctgagcgccctgagcagcgagatctggaccagcaactgcctgtgcctggccgccctgccctgtgacaccggcctggagagcctgactgtggtgtgctggagcggcatctag

SEQ ID NO: 43428 - DNA, 375 bp, Artificial Sequence
  Description of Artificial Sequence: Synthetic coding sequence
atggtgcgggccacccggggctactgggaggccaagggcaagtggcagacctggctgcgcttcaggaagaagagcagcaaatgtcgggaggcccggaccttccccagcttcaagttcctgaagggcagccagagcagcttcagcagcctgctgcagatgcccctgcagagcttcaccgctgcccacacctacagaagaagaaacagccccagccagaaggatgaccgggccctgggcgctggggtgcccctggtgctggccgagagcctggatgcctgtgaggtgaagccagacctgggcaaggccgccctgtggaccctgctggccgtgccccacacccagctgggcttcctgaggaagcagcaccggctgtag

SEQ ID NO: 43429 - DNA, 402 bp, Artificial Sequence
  Description of Artificial Sequence: Synthetic coding sequence
atgggctggcccctgagcctgagccccagcggcttccgggaggtggagtggggcatcctgtttgtgtggcagtggctgctgagctcctggcacctgagccccttccctgtgcccaccagccccagcaccccctgcctgcccttcctgtgccaccccctgcctgtgctgcacggcaactgcaccggcctgtctgtgtttgcctgcatgtgtgcccctgtgtacacctgcatcgagcgctacatctgtggcggccgcggggagcggggcggcggcggcgtgaagctgcgggcctgcagccaggacacagcccactggagcctgagcagcgcccccagcgtgctggtgcggctgcgggaggagggcggccgggccctggtgaagccagactgccccagcctgtag

SEQ ID NO: 43430 - DNA, 534 bp, Artificial Sequence
  Description of Artificial Sequence: Synthetic coding sequence
atgaccaccagcatccggcagttcaccagcagcagcagcatcaagggcagcagcggcctgggcggcggcagcagcaggaccagctgccagctgagcggcggcctgggcgccggcagctgccggcccggcagcgctgggggcctgggcagcgccctgggcggcagcagctacagcagctgctacagctttggaagtggcggcggctacggcagcagcagctttgagggcgtggatggcctgctggtgggcggggagaaggccaccatgcagaacctgaatgaccggctggccagctacctggacaaggtgcgggccctggaggaggccgacacagagctggaggtgaagatccgggactggtaccagaggcaggcccctggccctgcccgggactacagccagtactaccgcatcatcgaggagctgcagaacaagccaccctggaccatgcccaccagctgctacaggatgaccatgcccatctggctgctgctgaccagcgcccccaagtcctggcagaatgaaggaagatag

SEQ ID NO: 43431 - DNA, 981 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggatag

SEQ ID NO: 43432 - DNA, 3192 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagcggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcaggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 43433 - DNA, 348 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctag

SEQ ID NO: 43434 - DNA, 2772 bp, Artificial Sequence
  Description of Artificial Sequence: Synthetic coding sequence
atgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagcggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcagctgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcgggccacctaccagctgaccaaggcccggccccgggtgctgctgcagagcagcgagcccggggaccagggcctgtttgaggccttcctggagcccctgggcaccctgggctactgtggggctgtgggcctgctgcccccaggcacagctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 43435 - DNA, 3282 bp, Artificial Sequence
  Description of Artificial Sequence: Synthetic coding sequence
atgggcggcaaggcctggccccggcgggctgtgggcacagctgggggcccctgtgccgagcagatcagcgcccccttccagaccctgctgatgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagcggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcaggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 43436 - DNA, 2772 bp, Artificial Sequence
  Description of Artificial Sequence: Synthetic coding sequence
atgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggaccgggagtgcttcaccatggatgtgggcagctctgtggccgtgacagaggcctttgtgcggctgtacaaggccggcctgctgtacagaaaccaccagctggtgaactggagctgtgccctgcggagcgccatcagtgacatcgaggtggagaaccggcccctgcccggccacacccagctgcggctgcccggctgccccacccctgtgtcctttggcctgctcttctctgtggccttccctgtggatggagagccagatgctgaggtggtggtgggcaccaccaggcctgagaccctgcctggagatgtggccgtggccgtgcacccagatgacagccgctacacccacctgcacggccggcagctgcggcaccccctgatgggccagcccctgcccctcatcacagattatgctgtgcagccccacgtgggcaccggggctgtgaaggtgaccccagcccacagccctgcagatgctgagatgggcgcccggcacggcctgagccccctgaatgtgattgctgaagatggcaccatgaccagcctgtgtggggactggctgcagggcctgcacagatttgtggcccgggagaagatcatgtctgtgctgtctgagcggggcctcttccggggcctgcagaaccaccccatggtgctgcccatctgcagccgctctggagatgtgattgagtacctgctgaagaaccagtggtttgtgcgctgccaggagatgggcgcccgggccgccaaggctgtggagagcggggccctggagctgagccccagcttccaccagaagaactggcagcactggttcagccacatcggggactggtgtgtgtcccggcagctgtggtggggccaccagatcccagcctacctggtggtggaggaccacgcccagggcgaggaggactgctgggtggtgggccgctctgaggccgaggcccgggaggtggccgctgagctgaccggccggcctggagctgagctgaccctggagcgggaccctgatgtgctggacacctggttcagcagcgccctcttccccttcagcgccctgggctggccccaggagaccccagacctggcccgcttctaccccctgagcctgctggagactggaagtgacctgctgctcttctgggtgggccgcatggtgatgctgggcacccagctgaccggccagctgcccttcagcaaggtgctgctgcaccccatggtgcgggaccggcagggcaggaagatgagcaagagcctgggcaatgtgctggacccccgggacatcatcagcggcgtggagatgcaggtgctgcaggagaagctgcggagcggcaacctggaccctgctgagctggccatcgtggccgccgcccagaagaaggacttcccccacggcatcccagaatgtggcacagatgccctgcgcttcaccctgtgcagccatggagtgcaggccggggacctgcacctgtctgtgtctgaggtgcagagctgccgccacttctgcaacaagatctggaatgccctgcgcttcatcctgaatgccctgggggagaagtttgtgccccagcctgctgaggagctgagccccagcagccccatggatgcctggatcctgagccggctggccctggccgcccaggagtgtgagcggggcttcctgacccgggagctgagcctggtgacccacgccctgcaccacttctggctgcacaacctgtgtgatgtgtacctggaggccgtgaagcctgtgctgtggcacagcccccggcccctgggccccccccaggtgctcttcagctgtgccgacctgggcctgcggctgctggcccccctgatgcccttcctggccgaggagctgtggcagaggctgcccccccggcccggctgccccccagcccccagcatctctgtggccccctaccccagcgcctgcagcctggagcactggaggcagcctgagctggagcggcgcttcagccgggtgcaggaggtggtgcaggtgctgcgggccctgcaggccacctaccagctgaccaaggcccggccccgggtgctgctgcagagcagcgagcccggggaccagggcctgtttgaggccttcctggagcccctgggcaccctgggctactgtggggctgtgggcctgctgcccccaggagctgctgcccccagcggctgggcccaggcccccctgagtgacacagcccaggtgtacatggagctgcagggcctggtggacccccagatccagctgcccctgctggccgcccggcgctacaagctgcagaagcagctggacagcctgacagcccggaccccatctgagggggaggccggcacccagaggcagcagaagctgagcagcctgcagctggagctgagcaagctggacaaggccgccagccacctgcggcagctgatggatgagcccccagcccctggcagccctgagctgtag

SEQ ID NO: 43437 - DNA, 774 bp, Artificial Sequence
  Description of Artificial Sequence: Synthetic coding sequence
atgccccacctgcccctggccagcttccggccccccttctggggcctgcggcacagccggggcctgccccgcttccacagcgtgtccacccagagcgagccccacggcagccccatcagcagaagaaaccgggaggccaagcagaagaggctgcgggagaagcaggccaccctggaggccgagattgctggggagagcaagagccctgctgagagcatcaaggcctggaggcccaaggagctggtgctgtatgagatccccaccaagccaggagagaagaaggatgtgtctggccccctgcccccagcctacagcccccgctacgtggaggccgcctggtacccctggtgggtgcgggagggcttcttcaagccagagtaccaggcccggctgccccaggccactggagagaccttctccatgtgcatccccccaccaaatgtgacaggcagcctgcacatcggccacgccctgactgtggccatccaggatgccctggtgcgctggcacaggatgagaggagaccaggtgctgtgggtgcccggcagtgaccacgccggcatcgccacccaggccgtggtggagaagcagctgtggaaggagcggggcgtgagaagacatgagctgagccgggaggccttcctgcgggaggtgtggcagtggaaggaggccaagggcggggagatctgtgagcagctgcgggccctgggcgccagcctggactgggacagagtcttctaccacggctgctggctgctgagcggctgtgactag

SEQ ID NO: 43438 - DNA, 639 bp, Artificial Sequence
  Description of Artificial Sequence: Synthetic coding sequence
atgcccaccacctgccactgtgtggccatcaccccaccagattctgggggcagccccagcagccctgctgggggcagccccagccctgccccagctgctggagctgctgagctgagccctgccacccccaccggcagcgccaaccccaccaccagcagctgtgccggcggcaccccagctgccagcctgctgcgctgggtgcgcagctgcttcctgcggctggatgacaccaccaaggacttcccccacgccctgcagtggaagggccgcagcccagaatgtacccggctgtgctttgtgcggctggcccggagcgccaaggcccggccccacagcagccagaggaagggccgctggccagaatgtaccagcgcctgccgcctgcggagccaggatgccaccaacgtgctgagccactgccgccacctgaatggccgcagccctgtgtgcacccggcgctgcatggcccggtctgctggctgcaggaagagcctgccccacttcagccagtggtacggcttcacccccagctgggcccgctggtggaggaggaagctggagggcagcgagaacatgaggccccagaggggccacaggaagggcttctccccagaatgtgtgcgctcctggctgtggtag

SEQ ID NO: 43439 - DNA, 1233 bp, Artificial Sequence
  Description of Artificial Sequence: Synthetic coding sequence
atgggcgctgtgtcctgccggcagggccagcacacccagcagggcgagcacaccagggtggccgtgccccacaagcagggcggcaacatccggggcccctgggcccggggctggaagagcctgtggacaggcctgggcaccatccgcagtgacctggaggagctgtgggagctgcggggccaccactacctgcaccaggagagcctgaagccagcccctgtgctggtggagaagcccctgcctgagtggcctgtgccccagttcatcaacctcttcctgcctgagttccccatccggcccatccggggccagcagcagctgaagatcctgggcctggtggccaagggcagctttggcaccgtgctgaaggtgctggactgcacccagaaggctgtgtttgctgtgaaggtggtgcccaaggtgaaggtgctgcagagggacacagtgcggcagtgcaaggaggaggtgtccatccagaggcagatcaaccacccctttgtgcacagcctgggggacagctggcagggcaagaggcacctgttcatcatgtgcagctactgcagcacagacctgtacagcctgtggagcgctgtgggctgcttccctgaggccagcatccggctgtttgctgctgagctggtgctggtgctgtgctacctgcatgacctgggcatcatgcacagagatgtgaagatggagaacatcctgctggatgagcggggccacctgaagctgacagactttggcctgagcagacatgtgccccagggcgcccaggcctacaccatctgtggcaccctgcagtacatggcccctgaggtgctgagcggcggcccctacaaccacgccgctgactggtggagcctgggcgtgctgctcttcagcctggccaccgggaagtttcctgtggccgctgagcgggaccacgtggccatgctggcctctgtgacccacagcgacagcgagatcccagccagcctgaaccagggcctgagcctgctgctgcacgagctgctgtgccagaaccccctgcaccggctgcgctacctgcaccacttccaggtgcaccccttcttccggggcgtggcctttgatcctgagctgctgcagaagcagcctgtgaactttgtgacagagacccaggccacccagcccagcagcgctgagaccatgccctttgatgactttgactgtgacctggagagcttcctgctgtaccccatcccagcctag

SEQ ID NO: 43440 - DNA, 447 bp, Artificial Sequence
  Description of Artificial Sequence: Synthetic coding sequence
atgggcgctgtgtcctgccggcagggccagcacacccagcagggcgagcacaccagggtggccgtgccccacaagcagggcggcaacatccggggcccctgggcccggggctggaagagcctgtggacaggcctgggcaccatccgcagtgacctggaggagctgtgggagctgcggggccaccactacctgcaccaggagagcctgaagccagcccctgtgctggtggagaagcccctgcctgagtggcctgtgccccagttcatcaacctcttcctgcctgagttccccatccggcccatccggggccagcagcagctgaagatcctgggcctggtggccaagggcagctttggcaccgtgctgaaggtgctggactgcacccagaaggctgtgtttgctgtgaaggtggtgcccaaggtgaaggtgctgcagggcatcccctag

SEQ ID NO: 43441 - DNA, 516 bp, Artificial Sequence
  Description of Artificial Sequence: Synthetic coding sequence
atgggcgctgtgtcctgccggcagggccagcacacccagcagggcgagcacaccagggtggccgtgccccacaagcagggcggcaacatccggggcccctgggcccggggctggaagagcctgtggacaggcctgggcaccatccgcagtgacctggaggagctgtgggagctgcggggccaccactacctgcaccaggagagcctgaagccagcccctgtgctggtggagaagcccctgcctgagtggcctgtgccccagttcatcaacctcttcctgcctgagttccccatccggcccatccggggccagcagcagctgaagatcctgggcctggtggccaagggcagctttggcaccgtgctgaaggtgctggactgcacccagaaggctgtgtttgctgtgaaggtggtgcccaaggtgaaggtgctgcagagggacacagtgcggcagtgcaaggaggaggtgtccatccaggtgatctccatgacctgggccagctgcatcgagatgtag

SEQ ID NO: 43442 - DNA, 516 bp, Artificial Sequence; identical to SEQ ID NO: 43441
  Description of Artificial Sequence: Synthetic coding sequence

SEQ ID NO: 43443 - DNA, 441 bp, Artificial Sequence
  Description of Artificial Sequence: Synthetic coding sequence
atggccgccagccggctggagctgaacctggtgcggctgctgagccgctgtgaggccatggctgctgagaagagggaccctgatgagtggaggctggagaagtatgtgggcgccctggaggacatgctgcaggccctgaaggtgcacgccagcaagccagccagcgaggtgatcaatgagtacagctggaaggtggacttcctgaagggcatgctgcaggccgagaagctgaccagcagcagcgagaaggccctggccaaccagttcctggcccctggccgggtgcccaccacagcccgggagcgggtgcctgccaccaagacagtgcacctgcagagccgggcccgctacaccagcgagatgaggtctgagctgctgggcacagctgaggccgagcctgagatggatgtgaggaagaggaccccctgccacacccactag

SEQ ID NO: 43444 - DNA, 780 bp, Artificial Sequence
  Description of Artificial Sequence: Synthetic coding sequence
atggccgccagccggctggagctgaacctggtgcggctgctgagccgctgtgaggccatggctgctgagaagagggaccctgatgagtggaggctggagaagtatgtgggcgccctggaggacatgctgcaggccctgaaggtgcacgccagcaagccagccagcgaggtgatcaatgagtacagctggaaggtggacttcctgaagggcatgctgcaggccgagaagctgaccagcagcagcgagaaggccctggccaaccagttcctggcccctggccgggtgcccaccacagcccgggagcgggtgcctgccaccaagacagtgcacctgcagagccgggcccgctacaccagcgagatgaggtctgagctgctgggcacagctgaggccgagcctgagatggatgtgaggaagaggactggagtggccggcagccagcctgtgtctgagaagcagctggccgctgagctggacctggtgctgcagaggcaccagaacctgcaggagaagctggccgaggagatgctgggcctggcccggagcctgaagaccaacaccctggccgcccagagcgtcatcaagaaggacaaccagaccctgagccacagcctgaagatggctgaccagaacctggagaagctgaagacagaaagtgagcggctggagcagcacacccagaagtctgtgaactggctgctgtgggccatgctgatcatcgtgtgcttcatcttcatctccatgatcctcttcatccgcatcatgcccaagctgaagtag

SEQ ID NO: 43445 - DNA, 2661 bp, Artificial Sequence
  Description of Artificial Sequence: Synthetic coding sequence
atgaggccagactgcaacagccagaagcccagccaggccctgagcatccgggacaccagcagcaaggacccctggccagacatcgagccccagctgcctgccaccccagctgctgtgtggggcgtcttcaccttctcctggaggggggccggggccctgggcccccggcggggcccccggcggctgaacaacaagagaggagctgccaagaggcaggaggacaagaccatgagcaaaggacctggccctgggggcagcgctgccagcagcgcccccccagctgccacagcccaggtgctgcaggcccagcctgagaagccccagcactacacctacctgaaggagttcagaacagagcagtgccccctgtttgtgcagcacaagtgcacccagcaccggccctacacctgcttccactggcactttgtgaaccagaggagaagaagaagcatcagaagaagagatggcaccttcaactacagcccagatgtgtactgcaccaagtatgatgaggccaccggcctgtgcccagaaggagatgaatgtcccttcctgcacaggaccactggagacacagagcggcgctaccacctgcgctactacaagacaggcatctgcatccacgagacagacagcaaaggaaactgcaccaagaatggcctgcactgtgcctttgcccacggcccccatgacctgcggagccctgtgtatgacatccgggagctgcaggccatggaggccctgcagaatggccagaccaccgtggagggcagcattgagggccagagcgctggggccgccagccacgccatgattgagaagatcctgtctgaggagccccgctggcaggagacagcctacgtgctgggcaactacaagacagagccctgcaagaagccaccccggctgtgccggcagggctacgcctgcccctactaccacaacagcaaggacagaagaagaagccccaggaagcacaagtaccgcagcagcccctgccccaacgtgaagcatggagatgagtggggagaccctggaaaatgtgaaaatggagatgcctgccagtactgccacaccaggacagagcagcagttccaccctgagatctacaagagcaccaagtgcaatgacatgcagcagagcggcagctgcccccggggccccttctgtgcctttgcccacgtggagcagccccccctgagtgatgacctgcagcccagcagcgctgtgagcagccccacccagcccggccctgtgctgtacatgcccagcgctgctggggacagcgtgcctgtgagccccagcagcccccacgccccagacctgagcgccctgctgtgcaggaacagcagcctgggcagccccagcaacctgtgtggcagccccccaggcagcatcaggaagccacccaacctggagggcatcgtgtttcctggagagagcggcctggcccctggcagctacaagaaggcccctggctttgaaagagaggaccaggtgggcgctgagtacctgaagaacttcaagtgccaggccaagctgaagccccacagcctggagcccaggagccaggagcagcccctgctgcagcccaagcaggacatgctgggcatcctgcctgctggcagccccctgaccagcagcatcagcagcagcatcaccagcagcctggccgccaccccacccagccctgtgggcaccagctctgtgcccggcatgaatgccaatgccctgcccttctaccccaccagtgacacagtggagagcgtgattgaaagtgccctggatgacctggacctgaatgaatttggagtggccgccctggagaagacctttgacaacagcacagtgccccaccctggcagcatcaccatcggcggcagcctgctgcagagcagcgcccctgtgaacatccctggcagcctgggcagcagcgccagcttccacagcgccagccccagcccccctgtgtccctgagcagccacttcctgcagcagccccagggccacctgagccagagcgagaacaccttcctgggcaccagcgccagccacggcagcctgggcctgaatggcatgaacagcagcatctgggagcactttgccagcggcagcttcagccctggcaccagccctgccttcctgagcggccctggagctgctgagctggcccggctgcggcaggagctggatgaggccaacagcaccatcaagcagtgggaggagagctggaagcaggccaagcaggcctgtgatgcctggaagaaggaggccgaggaggccggggagcgggccagcgctgctggagcagaatgtgagctggcccgggagcagagagatgccctggaggtgcaggtgaagaagctgcaggaggagctggagcggctgcacgccggccctgagccccaggccctgcctgccttcagtgacctggaggccctgagcctgagcaccctgtacagcctgcagaagcagctgcgggcccacctggagcaggtggacaaggctgtgttccacatgcagagcgtgaagtgcctgaagtgccaggagcagaagagagctgtgctgccctgccagcacgccgccctgtgtgagctgtgtgccgagggcagcgagtgccccatctgccagcccggccgggcccacaccctgcagagctag

SEQ ID NO: 43446 - DNA, 510 bp, Artificial Sequence
  Description of Artificial Sequence: Synthetic coding sequence
atggtgagcagcaagggcctgtggaaggagcggcccagcgcccacaccagcgagtgcttcagcaccacagcctgccctgtggccttcatcctgctggtgtggaacagccagaccccagctggcctgcagagcctgtgcaccggccgccaccccagcctgagcgcccgggcccagagagctggcccccgggccagccgggaggagggcaccttctggacagagcgggtgggccaggagcgctggctgatccgcagcggcagcagccagaatgaaagccaggaggaccagggcgccggcctcatcagccaggccggcctgaaggctgacaacagaagagagagcagcacctgggccaatgaggtggaggaccggcggccccagtgcaccccagccctgaacctgacccccagccacccccaccccccccacagcctgaccaccttcctgcggtctgtgattggcatccagatccccccaggcctggtggccgccggcggcaccgtggcctag

SEQ ID NO: 43447 - DNA, 510 bp, Artificial Sequence
  Description of Artificial Sequence: Synthetic coding sequence
atgggcagcagcaagggcctgtggaaggagaagcccagcgcccacaccagcgagtgcttcagcaccacagcctgccctgtggcctgcatcctgctggtgtggaacagccagaccccagctggcctgcagagcctgtgcaccggccgccaccccagcctgagcgcccgggcccagtgggccggcccccgggccagccgggaggagggcaccttctggacagagcctgtgggccaggagcggcggctcatccgcagcggcagcagccagaatgaaagccaggaggaccagggcgctgacctgatcagccatgagggcctgaaggctgacaaccagcgggagagcagcacctgggccaatgaggtggaggaccggcggccccagtgcaccagcgccctgaacctgacccccagccacctgcaccccccccaccccctgaccaccttcttcagaaatgtgattggcatcaagatccccccaggcctggtggccatgggcggcaccgtggcctag

SEQ ID NO: 43448 - DNA, 972 bp, Artificial Sequence
  Description of Artificial Sequence: Synthetic coding sequence
atgaagaatgtggacagtgatgacctggtgacaggcaccctgcccaagctgaagagcagcaaggagtggctggagcccaagcccctgtgcttcatggaggtgctggccaaggaggacacagaggccgccatccagagcatcctgtacaaggaaaattctgtcatcaaggagctggacaagtacctgcagcaccacgccttcctgaatgcccggaggaaggagatgctgtacaagcgctgggtggactgtgtggccgaccccctgcagaagaagatcatcgagaaggtgtgcagccacaagaagatcaagaagaggcggcagggcgagctggatggcttcctgaagcacgtgaacaagaagggaaatgccttcatcgagcactatgaccccaaggagtatgaccccttctacatgagcaagaaggaccccaacttcctgaaggtgaccatcccccccttccatgaccccctgaagaaggcccagtatgacaaggacaatgagaagaggaccctgctgcagtgtgagaccgggaagatctacagcatcaaggagttcaaggaggtggagaaggtgcagctgcacagccgcttcccccagatcagcaacagccgccacttcatcaccccaaatgagtggctgaagctgcccacccgctacatcgagagcgagttctgcagaagaagaaggctgaaggtgaaggtgaacttcaatgactgcagctttgacctgaagcccctggcccgggccccctacctgctggagagccaggaggaggagaagacagtcatctacaagaacaagggcagcagcttcctggagcgggagcccctgtgctaccaggagggcaacaaccccagcgccaaggaggccatcagcgagggctacttcagcagcctgagcctgcaggagcgggaggaggaccaggacggcagccccagcccccggctgggcctgctgaagctggagctgtag

SEQ ID NO: 43449 - DNA, 2592 bp, Artificial Sequence
  Description of Artificial Sequence: Synthetic coding sequence
atgctggagagctatgtgacccccatcctgatgtcctatgtgaaccgctacatcaagaacctgaagcccagcgacctgcagctgagcctgtggggcggagatgtggtgctgagcaagctggagctgaagctggatgtgctggagcaggagctgaagctgcccttcaccttcctgagcggccacatccacgagctgcgcatccacgtgccctggaccaagctgggcagcgagcctgtggtgatcaccatcaacaccatggagtgcatcctgaagctgaaggatggcatccaggatgaccacgagagctgtggcagcaacagcaccaacagaagcacagctgagagcaccaagagcagcatcaagcccaggaggatgcagcaggccgcccccacagatcctgacctgcccccaggctacgtgcagagcctcatcagaagagtggtgaacaacgtgaacatcgtcatcaacaacctgatcctgaagtatgtggaggatgacatcgtgctgtctgtgaacatcaccagcgctgagtgctacacagtgggggagctgtgggaccgggccttcatggacatcagcgccacagacctggtgctgaggaaggtgatcaacttcagtgactgcaccgtgtgcctggacaagagaaatgccagcggcaagattgagttctaccaggaccccctgctgtacaagtgcagcttccgcacccggctgcacttcacctatgagaacctgaacagcaagatgcccagcgtcatcaagatccacaccctggtggagagcctgaagctgagcatcacagaccagcagctgcccatgttcatccgcatcatgcagctgggcatcgccctgtactacggggagatcggcaacttcaaggagggggagattgaggacctgacctgccacaacaaggacatgctgggcaacatcaccggctctgaagatgagaccagaattgacatgcagtacccagcccagcacaagggccaggagctgtacagccagcaggatgaggagcagccccagggctgggtgtcctgggcctggagctttgtgcctgccatcgtgtcctatgatgatggagaggaggactttgtgggcaatgaccctgccagcaccatgcaccagcagaaggcccagaccctgaaggaccccatcgtgtccatcggcttctactgcaccaaggccaccgtgaccttcaagctgacagagatgcaggtggagagcagctactacagcccccagaaggtgaagagcaaggaggtgctgtgctgggagcaggagggcaccaccgtggaggccctgatgatgggagagcccttctttgactgccagattggatttgtgggctgccgggccatgtgcctgaagggcatcatgggcgtgaaggactttgaggagaacatgaacagaagtgaaacagaggcctgcttcttcatctgtggggacaacctgagcaccaagggcttcacctacctgaccaacagcctgtttgactaccgcagcccagaaaataatggcaccagggctgagttcatcctggacagcacccaccacaaggagacctacacagaaattgctggcatgcagagatttggagccttctacatggactacctgtacaccatggagaacaccagcggcaagggcagcaccaaccagcaggacttcagcagcggcaagtctgaggacctgggcaccgtgcaggagaagagcaccaagagcctggtgattggccccctggacttccggctggacagcagcgctgtgcaccgcatcctgaagatgattgtgtgtgccctggagcacgagtatgagccctacagccggctgaagagtgacatcaaggatgaaaatgagaccatcctgaaccctgaggaggtggccctgctggaggagtacatccccaccaggcacacctctgtgaccctgctgaagtgcacctgcaccatctccatggccgagttcaacctgctggaccacctgctgcctgtgatcatgggagagaagaacagcagcaacttcatgaacaccaccaacttccagagcctgcggcccctgcccagcatccgcatcctggtggacaagatcaacctggagcacagcgtgcccatgtatgcagagcagctggtgcacgtggtgagcagcctgacccagcccagcgacaacctgctgcactactgctacgtgcactgctacctgaagatcttcggcttccaggccggcctgaccagcctggactgcagcggcagctactgcctgcctgtgcctgtgatccccagcttcagcacagccctgtatggcaagctgctgaagctgcccacctgctggaccaagaggagccagatcgccatcacagagggcatctttgagctgcccaacctgaccatccaggccacccgggcccagaccctgctgctgcaggccatctaccagagctggagccacctgggcaatgtgagcagcagcgctgtgattgaggccctgatcaatgagatcttcctgagcattgagatcggcagctgctacgtggcccaggtggacctggagctgctggccagcaatgacccccccaccagcaccagctag

SEQ ID NO: 43450 - DNA, 11994 bp, Artificial Sequence
  Description of Artificial Sequence: Synthetic coding sequence
atgctggagagctatgtgacccccatcctgatgtcctatgtgaaccgctacatcaagaacctgaagcccagcgacctgcagctgagcctgtggggcggagatgtggtgctgagcaagctggagctgaagctggatgtgctggagcaggagctgaagctgcccttcaccttcctgagcggccacatccacgagctgcgcatccacgtgccctggaccaagctgggcagcgagcctgtggtgatcaccatcaacaccatggagtgcatcctgaagctgaaggatggcatccaggatgaccacgagagctgtggcagcaacagcaccaacagaagcacagctgagagcaccaagagcagcatcaagcccaggaggatgcagcaggccgcccccacagatcctgacctgcccccaggctacgtgcagagcctcatcagaagagtggtgaacaacgtgaacatcgtcatcaacaacctgatcctgaagtatgtggaggatgacatcgtgctgtctgtgaacatcaccagcgctgagtgctacacagtgggggagctgtgggaccgggccttcatggacatcagcgccacagacctggtgctgaggaaggtgatcaacttcagtgactgcaccgtgtgcctggacaagagaaatgccagcggcaagattgagttctaccaggaccccctgctgtacaagtgcagcttccgcacccggctgcacttcacctatgagaacctgaacagcaagatgcccagcgtcatcaagatccacaccctggtggagagcctgaagctgagcatcacagaccagcagctgcccatgttcatccgcatcatgcagctgggcatcgccctgtactacggggagatcggcaacttcaaggagggggagattgaggacctgacctgccacaacaaggacatgctgggcaacatcaccggctctgaagatgagaccagaattgacatgcagtacccagcccagcacaagggccaggagctgtacagccagcaggatgaggagcagccccagggctgggtgtcctgggcctggagctttgtgcctgccatcgtgtcctatgatgatggagaggaggactttgtgggcaatgaccctgccagcaccatgcaccagcagaaggcccagaccctgaaggaccccatcgtgtccatcggcttctactgcaccaaggccaccgtgaccttcaagctgacagagatgcaggtggagagcagctactacagcccccagaaggtgaagagcaaggaggtgctgtgctgggagcaggagggcaccaccgtggaggccctgatgatgggagagcccttctttgactgccagattggatttgtgggctgccgggccatgtgcctgaagggcatcatgggcgtgaaggactttgaggagaacatgaacagaagtgaaacagaggcctgcttcttcatctgtggggacaacctgagcaccaagggcttcacctacctgaccaacagcctgtttgactaccgcagcccagaaaataatggcaccagggctgagttcatcctggacagcacccaccacaaggagacctacacagaaattgctggcatgcagagatttggagccttctacatggactacctgtacaccatggagaacaccagcggcaagggcagcaccaaccagcaggacttcagcagcggcaagtctgaggacctgggcaccgtgcaggagaagagcaccaagagcctggtgattggccccctggacttccggctggacagcagcgctgtgcaccgcatcctgaagatgattgtgtgtgccctggagcacgagtatgagccctacagccggctgaagagtgacatcaaggatgaaaatgagaccatcctgaaccctgaggaggtggccctgctggaggagtacatccccaccaggcacacctctgtgaccctgctgaagtgcacctgcaccatctccatggccgagttcaacctgctggaccacctgctgcctgtgatcatgggagagaagaacagcagcaacttcatgaacaccaccaacttccagagcctgcggcccctgcccagcatccgcatcctggtggacaagatcaacctggagcacagcgtgcccatgtatgcagagcagctggtgcacgtggtgagcagcctgacccagcccagcgacaacctgctgcactactgctacgtgcactgctacctgaagatcttcggcttccaggccggcctgaccagcctggactgcagcggcagctactgcctgcctgtgcctgtgatccccagcttcagcacagccctgtatggcaagctgctgaagctgcccacctgctggaccaagaggagccagatcgccatcacagagggcatctttgagctgcccaacctgaccatccaggccacccgggcccagaccctgctgctgcaggccatctaccagagctggagccacctgggcaatgtgagcagcagcgctgtgattgaggccctgatcaatgagatcttcctgagcattggagtgaagagcaagaaccccctgcccaccctggagggcagcatccagaatgtggagctgaagtactgcagcaccagcctggtgaagtgtgccagcggcaccatgggcagcatcaagatctgtgccaaggcccctgtggacagcggcaaggagaagctgatccccctgctgcagggccccagcgacaccaaggacctgcacagcaccaagtggctgaatgaaagcaggaagccagagagcctgctggccccagacctgatggccttcaccatccaggtgccccagtacatcgactactgccacaacagcggggctgtgctgctgtgcagcatccagggcctggccgtgaacatcgaccccatcctgtacacctggctgatctaccagccccagaagaggaccagccgccacatgcagcagcagcctgtggtggccgtgcccctggtgatgcctgtgtgcaggaggaaagaagatgaggtgtccatcggcagcgcccccctggccaagcagcagagctaccaggcctctgaatatgccagcagccctgtgaagaccaagacagtgacagagagccggcccctgtctgtgcctgtgaaggccatgctgaacatcagcgagagctgccgcagccctgaggagaggatgaaggagttcatcggcatcgtgtggaatgctgtgaagcacctgaccctgcagctggaggtgcagagctgctgcgtgttcatccccaatgacagcctgcccagccccagcaccatcgtgtctggggacatccctggcaccgtgcgctcctggtaccacggccagacctccatgcctggcaccctggtgctgtgcctgccccagatcaagatcatctctgctggccacaagtacatggagcccctgcaggagatcccctttgtgatcccccggcccatcctggaggagggagatgccttcccctggaccatcagcctgcacaacttcagcatctacaccctgctgggcaagcaggtgaccctgtgcctggtggagcccatgggctgcaccagcaccctggccgtgaccagccagaagctgctggccactggaccagacaccaggcacagctttgtggtgtgcctgcacgtggacctggagagcctggagatcaagtgcagcaacccccaggtgcagctgttctatgagctgacagacatcatgaacaaggtgtggaacaagatccagaagaggggcaacctgaacctgagccccaccagccctgagaccatggccggccctgtgcccaccagccctgtgcgcagcagcattggaacagcccccccagacaccagcacctgcagccccagcgctgacatcggcaccaccacagaaggagacagcatccaggccggggaggagagccccttcagtgacagcgtgaccctggagcagaccaccagcaacattggaggcaccagcggccgggtgtccctgtggatgcagtgggtgctgcccaagatcaccatcaagctgtttgccccagaccctgaaaataaaggaacagaggtgtgcatggtgtctgagctggaggacctgagcgccagcattgatgtgcaggatgtgtacaccaaggtgaagtgcaagattgagagcttcaacatcgaccactaccgcagcaggcctggagagggctggcagagcggccactttgagggcgtcttcctgcagtgcaaggagaagtctgtgaccaccaccaagctgctggatggcacccaccagcagcacggcttcctgagcctgacctacaccaaggctgtgaccaagaatgtgcgccacaagctgaccagcagaaatgaaagaagaagcttccacaagctgtctgagggcctgatggatggcagcccccacttcctgcacgagatcctgctgagcgcccaggcctttgacatcgtgctgtacttccccctgctgaatgccatcgccagcatcttccaggccaagctgcccaagacccagaaggagaagaggaagagccctggccagcccatgaggacccacaccctgaccagcaggaacctgcccctcatctacgtgaacaccagcgtcatccgcatcttcatccccaagacagaggagatgcagcccaccgtggaggccaaccaggccgccaaggaggacacagtggtgctgaagattggctctgtggccatggccccccaggccgacaaccccctgggccgctctgtgctgaggaaggacatctaccagagggccctgaacctgggcatcctgcgggaccccggcagcgagattgaggaccggcagtaccagattgacctgcagagcatcaacattggaacagcccagtggcaccagctgaagccagagaaggagagcgtgtctggaggagtggtgacagaaacagagaggaacagccagaacccagccctggagtggaacatggccagcagcatccgccgccaccaggagcggcgggccatcctgacccctgtgctgacagacttctctgtgcgcatcactggagccccagctgtgatcttcaccaaggtggtgtccccagagaacctgcacacagaggagatcctggtgtgtggccacagcctggaggtgaacatcaccaccaacctggacttcttcctgtctgtggcccaggtgcagctgctgcaccagctgattgtggccaacatgacaggcctggagcccagcaacaaggctgctgagatcagcaagcaggagcagaagaaggtggacatctttgatggcggcatggccgagaccagcagccgctacagcggggcccaggacagcggcattggaagtgacagcgtgaagatccgcatcgtgcagatcgagcagcacagcggggccagccagcaccgcatcgcccggcccagccggcagagcagcatcgtgaagaacctgaacttcatcccctttgacatcttcatcacagccagccgcatcagcctgatgacctacagctgcatggccctgagcaagagcaagagccaggagcagaagaacaatgagaagacagacaagagcagcctgaacctgcctgaggtggacagtgatgtggccaagcccaaccaggcctgcatcagcacagtgacagctgaggacctgctgcggagcagcatctccttccccagcggcaagaagattggagtgctgagcctggagagcctgcacgccagcaccaggagcagcgcccggcaggccctgggcatcaccatcgtgcggcagcccggccggcggggcactggagacctgcagctggagcccttcctgtacttcatcgtgtcccagcccagcctgctgctgagctgccaccacaggaagcagagggtggaggtgtccatctttgatgctgtgctgaagggcgtggccagtgactacaagtgcattgatcctgggaagaccctgcctgaggccctggactactgcaccgtgtggctgcagacagtgcctggagaaattgacagcaagagcggcatcccccccagcttcatcaccctgcagatcaaggacttcctgaatggaccagcagatgtgaacctggacatcagcaagcccctgaaggccaacctgtccttcaccaagctggaccagatcaacctcttcctgaagaagatcaagaatgcccacagcctggcccacagcgaggagaccagcgccatgagcaacaccatggtgaacaaggatgacctgcctgtgtccaagtactaccggggcaagctgagcaagcccaagatccatggagatggagtgcagaagatcagcgcccaggagaacatgtggagggctgtgtcctgcttccagaagatctctgtgcagaccacccagatcgtcatctccatggagaccgtgccccacaccagcaagccctgcctgctggccagcctgagcaacctgaatggcagcctgtctgtgaaggccacccagaaggtgcccggcatcatcctgggcagcagcttcctgctgagcatcaatgacttcctgctgaagaccagcctgaaggagaggagccgcatcctgattggcccctgctgtgccacagccaacctggaggccaagtggtgcaagcacagcggcaaccctggccctgagcagagcatccccaagatcagcattgacctgcggggcggcctgctgcaggtgttctggggccaggagcacctgaactgcctggtgctgctgcacgagctgctgaatggctacctgaatgaggagggcaactttgaggtgcaggtgtctgagcctgtgccccagatgagcagccctgtggagaagaaccagaccttcaagtctgagcagagcagtgatgacctgaggacaggcctcttccagtatgtgcaggatgctgagagcctgaagctgcccggggtgtatgaggtgctcttctacaatgaaacagaggactgccccggcatgatgctgtggagatacccagagccccgggtgctgaccctggtgcgcatcacccctgtgcccttcaacaccacagaggaccctgacatcagcacagctgacctgggagatgtgctgcaggtgccctgcagcctggagtactgggatgagctgcagaaggtgtttgtggccttccgggagttcaacctgtctgagagcaaggtgtgtgagctgcagctgcctgacatcaacctggtgaatgaccagaagaagctggtgtccagtgacctgtggagaattgtgctgaacagcagccagaatggagcagatgaccagagcagcgccagcgagagcggcagccagagcacctgtgaccccctggtgacccccacagccctggccgcctgcaccagggtggacagctgcttcaccccctggtttgtgcccagcctgtgtgtgtccttccagtttgcccacctggagttccacctgtgccaccacctggaccagctgggcacagctgccccccagtacctgcagccctttgtgtctgacaggaacatgcccagcgagctggagtacatgattgtgtccttccgggagccccacatgtacctgcggcagtggaacaacggctctgtgtgccaggagatccagttcctggcccaggccgactgcaagctgctggagtgcagaaatgtgaccatgcagagcgtggtgaagcccttcagcatcttcggccagatggctgtgtccagtgatgtggtggagaagctgctggactgcaccgtcatcgtggacagcgtgtttgtgaacctgggccagcacgtggtgcacagcctgaacacagccatccaggcctggcagcagaacaagtgcccagaggtggaggagctggtgttcagccactttgtgatctgcaatgacacccaggagaccctgcgcttcggccaggtggacacagatgagaacatcctgctggccagcctgcacagccaccagtacagctggaggagccacaagagcccccagctgctgcacatctgcatcgagggctggggcaactggcgctggagcgagcccttctctgtggaccacgccggcaccttcatccgcaccatccagtaccggggccgcacagccagcctcatcatcaaggtgcagcagctgaatggagtgcagaagcagatcatcatctgtggccggcagatcatctgcagctacctgagccagagcattgagctgaaggtggtgcagcactacatcggccaggacggccaggccgtggtgcgggagcactttgactgcctgacagccaagcagaagctgcccagctacatcctggagaacaatgagctgacagagctgtgtgtgaaggccaagggagatgaggactggagcagagatgtgtgcctggagagcaaggcccctgagtacagcatcgtcatccaggtgcccagcagcaacagcagcatcatctacgtgtggtgcaccgtgctgaccctggagcccaacagccaggtgcagcagaggatgattgtgttcagccccctcttcatcatgaggagccacctgcctgaccccatcatcatccacctggagaagaggagcctgggcctgtctgagacccagatcatccctgggaagggccaggagaagcccctgcagaacattgaaccagacctggtgcaccacctgaccttccaggcccgggaggagtatgaccccagcgactgtgctgtgcccatcagcaccagcctcatcaagcagatcgccaccaaggtgcaccctgggggcaccgtgaaccagatcctggatgagttctacggccctgagaagagcctgcagcccatctggccctacaacaagaaggacagcgacagaaatgagcagctgagccagtgggacagccccatgagggtgaagctgagcatctggaagccctacgtgaggaccctgctgattgagctgctgccctgggccctgctgatcaatgaaagcaagtgggacctgtggctgtttgaaggagagaagatcgtgctgcaggtgcctgctgggaagatcatcatcccccccaacttccaggaggccttccagatcggcatctactgggccaacaccaacacagtgcacaagtctgtggccatcaagctggtgcacaacctgaccagccccaagtggaaggatggcggcaatggagaggtggtgaccctggatgaggaggcctttgtggacacagagatccggctgggcgccttccctggccaccagaagctgtgccagttctgcatcagctccatggtgcagcagggcatccagatcatccagatcgaggacaagaccaccatcatcaacaacaccccctaccagatcttctacaagccccagctgtctgtgtgcaacccccacagcggcaaggagtacttccgggtgcctgattctgccaccttcagcatctgccctggaggagagcagcctgccatgaagagcagcagcctgccctgctgggacctgatgccagacatcagccagagcgtgctggatgccagcctgctgcagaagcagatcatgctgggcttctccccagcccctggagctgacagcagccagtgctggagcctgcctgccatcgtgcggcctgagttcccccggcagagcgtggccgtgcccctgggcaacttcagagaaaatggcttctgcacccgggccatcgtgctgacctaccaggagcacctgggcgtgacctacctgaccctgtctgaggaccccagccccagggtcatcatccacaaccgctgccctgtgaagatgctgatcaaggagaacatcaaggacatccccaagtttgaggtgtactgcaagaagatccccagcgagtgcagcatccaccacgagctgtaccaccagatcagcagctacccagactgcaagaccaaggacctgctgcccagcctgctgctgcgggtggagcccctggatgaggtgaccacagagtggagcgatgccatcgacatcaacagccagggcacccaggtggtgttcctgactggatttggctacgtgtatgtggatgtggtgcaccagtgtggcaccgtcttcatcaccgtggcccctgagggcaaggccggccccatcctgaccaacaccaacagagcccctgagaagatcgtgaccttcaagatgttcatcacccagctgagcctggccgtgtttgatgacctgacccaccacaaggccagcgctgagctgctgcggctgaccctggacaacatcttcctgtgtgtggcccctggggccggccccctgcccggggaggagcctgtggccgccctgtttgagctgtactgtgtggagatctgctgcggggacctgcagctggacaaccagctgtacaacaagagcaacttccactttgctgtgctggtgtgccagggcgagaaggccgagcccatccagtgcagcaagatgcagagcctgctgatcagcaacaaggagctggaggagtacaaggagaagtgcttcatcaagctgtgcatcaccctgaatgaaggcaagagcatcctgtgtgacatcaatgagttctcctttgagctgaagccagcccggctgtatgtggaggacacctttgtgtactacatcaagaccctgtttgacacctacctgcccaacagccggctggccggccacagcacccacctgagcggcggcaagcaggtgctgcccatgcaggtgacccagcacgcccgggccctggtgaaccctgtgaagctgaggaagctggtgatccagcctgtgaacctgctggtgtccatccacgccagcctgaagctgtacatcgccagtgaccacacccccctgtccttctctgtgtttgagcggggccccatcttcaccacagcccggcagctggtgcacgccctggccatgcactatgctgctggggccctcttccgggccggctgggtggtgggcagcctggacatcctgggcagccctgccagcctggtgcgcagcattggaaatggagtggccgacttcttccggctgccctatgagggcctgacccggggccctggggcctttgtgtctggagtgtcccggggcaccaccagctttgtgaagcacatcagcaagggcaccctgaccagcatcaccaacctggccaccagcctggccaggaacatggaccggctgagcctggatgaggagcactacaaccggcaggaggagtggaggcggcagctgcctgagagcctgggggagggcctgcggcagggcctgagccggctgggcatcagcctgctgggcgccatcgccggcatcgtggaccagcccatgcagaacttccagaagaccagcgaggcccaggccagcgctggccacaaggccaagggcgtcatctctggagtgggcaagggcatcatgggcgtcttcaccaagcccatcggcggcgctgctgagctggtgtcccagacaggctacggcatcctgcatggagctggcctgagccagctgcccaagcagaggcaccagcccagcgacctgcacgccgaccaggcccccaacagccacgtgaagtatgtgtggaagatgctgcagagcctgggccggcctgaggtgcacatggccctggatgtggtgctggtgcggggcagcggccaggagcacgagggctgcctgctgctgaccagcgaggtgctgtttgtggtgtctgtgtctgaggacacccagcagcaggccttccctgtgacagaaattgactgtgcccaggacagcaagcagaacaacctgctgactgtgcagctgaagcagccccgggtggcctgtgatgtggaggtggatggagtgcgggagcggctgtctgagcagcagtacaaccggctggtggactacatcaccaagaccagctgccacctggcccccagctgcagctccatgcagatcccctgccctgtggtggccgctgagcccccacccagcacagtgaagacctaccactacctggtggacccccactttgcccaggtgttcctgagcaagttcaccatggtgaagaacaaggccctgaggaagggcttcccctag

SEQ ID NO: 43451 - DNA, 12069 bp, Artificial Sequence
  Description of Artificial Sequence: Synthetic coding sequence
atgctggagagctatgtgacccccatcctgatgtcctatgtgaaccgctacatcaagaacctgaagcccagcgacctgcagctgagcctgtggggcggagatgtggtgctgagcaagctggagctgaagctggatgtgctggagcaggagctgaagctgcccttcaccttcctgagcggccacatccacgagctgcgcatccacgtgccctggaccaagctgggcagcgagcctgtggtgatcaccatcaacaccatggagtgcatcctgaagctgaaggatggcatccaggatgaccacgagagctgtggcagcaacagcaccaacagaagcacagctgagagcaccaagagcagcatcaagcccaggaggatgcagcaggccgcccccacagatcctgacctgcccccaggctacgtgcagagcctcatcagaagagtggtgaacaacgtgaacatcgtcatcaacaacctgatcctgaagtatgtggaggatgacatcgtgctgtctgtgaacatcaccagcgctgagtgctacacagtgggggagctgtgggaccgggccttcatggacatcagcgccacagacctggtgctgaggaaggtgatcaacttcagtgactgcaccgtgtgcctggacaagagaaatgccagcggcaagattgagttctaccaggaccccctgctgtacaagtgcagcttccgcacccggctgcacttcacctatgagaacctgaacagcaagatgcccagcgtcatcaagatccacaccctggtggagagcctgaagctgagcatcacagaccagcagctgcccatgttcatccgcatcatgcagctgggcatcgccctgtactacggggagatcggcaacttcaaggagggggagattgaggacctgacctgccacaacaaggacatgctgggcaacatcaccggctctgaagatgagaccagaattgacatgcagtacccagcccagcacaagggccaggagctgtacagccagcaggatgaggagcagccccagggctgggtgtcctgggcctggagctttgtgcctgccatcgtgtcctatgatgatggagaggaggactttgtgggcaatgaccctgccagcaccatgcaccagcagaaggcccagaccctgaaggaccccatcgtgtccatcggcttctactgcaccaaggccaccgtgaccttcaagctgacagagatgcaggtggagagcagctactacagcccccagaaggtgaagagcaaggaggtgctgtgctgggagcaggagggcaccaccgtggaggccctgatgatgggagagcccttctttgactgccagattggatttgtgggctgccgggccatgtgcctgaagggcatcatgggcgtgaaggactttgaggagaacatgaacagaagtgaaacagaggcctgcttcttcatctgtggggacaacctgagcaccaagggcttcacctacctgaccaacagcctgtttgactaccgcagcccagaaaataatggcaccagggctgagttcatcctggacagcacccaccacaaggagacctacacagaaattgctggcatgcagagatttggagccttctacatggactacctgtacaccatggagaacaccagcggcaagggcagcaccaaccagcaggacttcagcagcggcaagtctgaggacctgggcaccgtgcaggagaagagcaccaagagcctggtgattggccccctggacttccggctggacagcagcgctgtgcaccgcatcctgaagatgattgtgtgtgccctggagcacgagtatgagccctacagccggctgaagagtgacatcaaggatgaaaatgagaccatcctgaaccctgaggaggtggccctgctggaggagtacatccccaccaggcacacctctgtgaccctgctgaagtgcacctgcaccatctccatggccgagttcaacctgctggaccacctgctgcctgtgatcatgggagagaagaacagcagcaacttcatgaacaccaccaacttccagagcctgcggcccctgcccagcatccgcatcctggtggacaagatcaacctggagcacagcgtgcccatgtatgcagagcagctggtgcacgtggtgagcagcctgacccagcccagcgacaacctgctgcactactgctacgtgcactgctacctgaagatcttcggcttccaggccggcctgaccagcctggactgcagcggcagctactgcctgcctgtgcctgtgatccccagcttcagcacagccctgtatggcaagctgctgaagctgcccacctgctggaccaagaggagccagatcgccatcacagagggcatctttgagctgcccaacctgaccatccaggccacccgggcccagaccctgctgctgcaggccatctaccagagctggagccacctgggcaatgtgagcagcagcgctgtgattgaggccctgatcaatgagatcttcctgagcattggagtgaagagcaagaaccccctgcccaccctggagggcagcatccagaatgtggagctgaagtactgcagcaccagcctggtgaagtgtgccagcggcaccatgggcagcatcaagatctgtgccaaggcccctgtggacagcggcaaggagaagctgatccccctgctgcagggccccagcgacaccaaggacctgcacagcaccaagtggctgaatgaaagcaggaagccagagagcctgctggccccagacctgatggccttcaccatccaggtgccccagtacatcgactactgccacaacagcggggctgtgctgctgtgcagcatccagggcctggccgtgaacatcgaccccatcctgtacacctggctgatctaccagccccagaagaggaccagccgccacatgcagcagcagcctgtggtggccgtgcccctggtgatgcctgtgtgcaggaggaaagaagatgaggtgtccatcggcagcgcccccctggccaagcagcagagctaccaggcctctgaatatgccagcagccctgtgaagaccaagacagtgacagagagccggcccctgtctgtgcctgtgaaggccatgctgaacatcagcgagagctgccgcagccctgaggagaggatgaaggagttcatcggcatcgtgtggaatgctgtgaagcacctgaccctgcagctggaggtgcagagctgctgcgtgttcatccccaatgacagcctgcccagccccagcaccatcgtgtctggggacatccctggcaccgtgcgctcctggtaccacggccagacctccatgcctggcaccctggtgctgtgcctgccccagatcaagatcatctctgctggccacaagtacatggagcccctgcaggagatcccctttgtgatcccccggcccatcctggaggagggagatgccttcccctggaccatcagcctgcacaacttcagcatctacaccctgctgggcaagcaggtgaccctgtgcctggtggagcccatgggctgcaccagcaccctggccgtgaccagccagaagctgctggccactggaccagacaccaggcacagctttgtggtgtgcctgcacgtggacctggagagcctggagatcaagtgcagcaacccccaggtgcagctgttctatgagctgacagacatcatgaacaaggtgtggaacaagatccagaagaggggcaacctgaacctgagccccaccagccctgagaccatggccggccctgtgcccaccagccctgtgcgcagcagcattggaacagcccccccagacaccagcacctgcagccccagcgctgacatcggcaccaccacagaaggagacagcatccaggccggggaggagagccccttcagtgacagcgtgaccctggagcagaccaccagcaacattggaggcaccagcggccgggtgtccctgtggatgcagtgggtgctgcccaagatcaccatcaagctgtttgccccagaccctgaaaataaaggaacagaggtgtgcatggtgtctgagctggaggacctgagcgccagcattgatgtgcaggatgtgtacaccaaggtgaagtgcaagattgagagcttcaacatcgaccactaccgcagcagcctgggggaggagtgctggagcctgggccagtgtggcggcgtcttcctgagctgcacagacaagctgaacagaaggaccctgctggtgcggcccatcagcaagcaggaccccttcagcaactgcagcggcttcttccccagcaccaccaccaagctgctggatggcacccaccagcagcacggcttcctgagcctgacctacaccaaggctgtgaccaagaatgtgcgccacaagctgaccagcagaaatgaaagaagaagcttccacaagctgtctgagggcctgatggatggcagcccccacttcctgcacgagatcctgctgagcgcccaggcctttgatattgtgctgtacttccccctgctgaatgccatcgccagcatcttccaggccaagctgcccaagacccagaaggagaagaggaagagccctggccagcccatgaggacccacaccctgaccagcaggaacctgcccctcatctacgtgaacaccagcgtcatccgcatcttcatccccaagacagaggagatgcagcccaccgtggaggccaaccaggccgccaaggaggacacagtggtgctgaagattggctctgtggccatggccccccaggccgacaaccccctgggccgctctgtgctgaggaaggacatctaccagagggccctgaacctgggcatcctgcgggaccccggcagcgagattgaagatcggcagtaccagattgacctgcagagcatcaacatcggcacagcccagtggcaccagctgaagccagagaaggagagcgtgtctgggggcgtggtgacagaaacagaaagaaacagccagaacccagccctggagtggaacatggccagcagcatcagaagacaccaggagcggcgggccatcctgacccctgtgctgacagacttctctgtgcgcatcaccggggccccagctgtgatcttcaccaaggtggtgtccccagagaacctgcacacagaggagatcctggtgtgtggccacagcctggaggtgaacatcaccaccaacctggacttcttcctgtctgtggcccaggtgcagctgctgcaccagctgattgtggccaacatgacaggcctggagcccagcaacaaggctgctgagatcagcaagcaggagcagaagaaggtggacatctttgatggcggcatggccgagaccagcagccgctacagcggggcccaggacagcggcatcggcagtgacagcgtgaagatcagaattgtgcagatcgagcagcacagcggggccagccagcacagaattgcccggcccagccggcagagcagcatcgtgaagaacctgaacttcatcccctttgacatcttcatcacagccagccgcatcagcctgatgacctacagctgcatggccctgagcaagagcaagagccaggagcagaagaacaatgagaagacagacaagagcagcctgaacctgcctgaggtggacagtgatgtggccaagcccaaccaggcctgcatcagcacagtgacagctgaggacctgctgcggagcagcatctccttccccagcggcaagaagattggagtgctgagcctggagagcctgcacgccagcaccaggagcagcgcccggcaggccctgggcatcaccatcgtgcggcagcctggaagaagaggcaccggggacctgcagctggagcccttcctgtacttcatcgtgtcccagcccagcctgctgctgagctgccaccacaggaagcagagggtggaggtgtccatctttgatgctgtgctgaagggcgtggccagtgactacaagtgcatcgaccccgggaagaccctgcctgaggccctggactactgcaccgtgtggctgcagacagtgcctggagaaattgacagcaagagcggcatccccccatccttcatcaccctgcagatcaaggacttcctgaatggaccagcagatgtgaacctggacatcagcaagcccctgaaggccaacctgtccttcaccaagctggaccagatcaacctcttcctgaagaagatcaagaatgcccacagcctggcccacagcgaggagaccagcgccatgagcaacaccatggtgaacaaggatgacctgcctgtgtccaagtactaccggggcaagctgagcaagcccaagatccatggagatggagtgcagaagatcagcgcccaggagaacatgtggagggctgtgtcctgcttccagaagatctctgtgcagaccacccagatcgtcatctccatggagaccgtgccccacaccagcaagccctgcctgctggccagcctgagcaacctgaatggcagcctgtctgtgaaggccacccagaaggtgcccggcatcatcctgggcagcagcttcctgctgagcatcaatgacttcctgctgaagaccagcctgaaggagaggagccgcatcctgattggcccctgctgtgccacagccaacctggaggccaagtggtgcaagcacagcggcaaccctggccctgagcagagcatccccaagatcagcattgacctgcggggcggcctgctgcaggtgttctggggccaggagcacctgaactgcctggtgctgctgcacgagctgctgaatggctacctgaatgaggagggcaactttgaggtgcaggtgtctgagcctgtgccccagatgagcagccctgtggagaagaaccagaccttcaagtctgagcagagcagtgatgacctgaggacaggcctcttccagtatgtgcaggatgctgagagcctgaagctgcccggggtgtatgaggtgctcttctacaatgaaacagaggactgccccggcatgatgctgtggagatacccagagccccgggtgctgaccctggtgcgcatcacccctgtgcccttcaacaccacagaagatcctgacatcagcacagctgacctgggagatgtgctgcaggtgccctgcagcctggagtactgggatgagctgcagaaggtgtttgtggccttccgggagttcaacctgtctgagagcaaggtgtgtgagctgcagctgcctgacatcaacctggtgaatgaccagaagaagctggtgtccagtgacctgtggagaattgtgctgaacagcagccagaatggagcagatgaccagagcagcgccagcgagagcggcagccagagcacctgtgaccccctggtgacccccacagccctggccgcctgcaccagggtggacagctgcttcaccccctggtttgtgcccagcctgtgtgtgtccttccagtttgcccacctggagttccacctgtgccaccacctggaccagctgggcacagctgccccccagtacctgcagccctttgtgtctgacaggaacatgcccagcgagctggagtacatgattgtgtccttccgggagccccacatgtacctgcggcagtggaacaatggatctgtgtgccaggagatccagttcctggcccaggccgactgcaagctgctggagtgcagaaatgtgaccatgcagagcgtggtgaagcccttcagcatcttcggccagatggctgtgtccagtgatgtggtggagaagctgctggactgcaccgtgattgtggacagcgtgtttgtgaacctgggccagcacgtggtgcacagcctgaacacagccatccaggcctggcagcagaacaagtgcccagaggtggaggagctggtgttcagccacttcgtcatctgcaatgacacccaggagaccctgcgcttcggccaggtggacacagatgagaacatcctgctggccagcctgcacagccaccagtacagctggaggagccacaagagcccccagctgctgcacatctgcatcgagggctggggcaactggcgctggagcgagcccttctctgtggaccatgctggcaccttcatccgcaccatccagtaccggggccgcacagccagcctcatcatcaaggtgcagcagctgaatggagtgcagaagcagatcatcatctgtggccggcagatcatctgcagctacctgagccagagcattgagctgaaggtggtgcagcactacatcggccaggacggccaggccgtggtgcgggagcactttgactgcctgacagccaagcagaagctgcccagctacatcctggagaacaatgagctgacagagctgtgtgtgaaggccaagggagatgaggactggagcagagatgtgtgcctggagagcaaggcccctgagtacagcatcgtcatccaggtgcccagcagcaacagcagcatcatctacgtgtggtgcaccgtgctgaccctggagcccaacagccaggtgcagcagaggatgattgtgttcagccccctcttcatcatgaggagccacctgcctgaccccatcatcatccacctggagaagaggagcctgggcctgtctgagacccagatcatccctgggaagggccaggagaagcccctgcagaacatcgagccagacctggtgcaccacctgaccttccaggcccgggaggagtatgaccccagcgactgtgctgtgcccatcagcaccagcctcatcaagcagatcgccaccaaggtgcaccctgggggcaccgtgaaccagatcctggatgagttctacggccctgagaagagcctgcagcccatctggccctacaacaagaaggacagcgacagaaatgagcagctgagccagtgggacagccccatgagggtgaagctgagcatctggaagccctacgtgaggaccctgctgattgagctgctgccctgggccctgctgatcaatgaaagcaagtgggacctgtggctgtttgaaggagagaagatcgtgctgcaggtgcctgctgggaagatcatcatcccccccaacttccaggaggccttccagatcggcatctactgggccaacaccaacacagtgcacaagtctgtggccatcaagctggtgcacaacctgaccagccccaagtggaaggatggcggcaatggagaggtggtgaccctggatgaggaggcctttgtggacacagagatccggctgggcgccttccctggccaccagaagctgtgccagttctgcatcagctccatggtgcagcagggcatccagatcatccagatcgaggacaagaccaccatcatcaacaacaccccctaccagatcttctacaagccccagctgtctgtgtgcaacccccacagcggcaaggagtacttccgggtgcctgacagcgccaccttcagcatctgccctggaggagagcagcctgccatgaagagcagcagcctgccctgctgggacctgatgccagacatcagccagagcgtgctggatgccagcctgctgcagaagcagatcatgctgggcttcagccctgcccctggagctgacagcagccagtgctggagcctgcctgccatcgtgcggcctgagttcccccggcagagcgtggccgtgcccctgggcaacttccgggagaatggcttctgcacccgggccatcgtgctgacctaccaggagcacctgggcgtgacctacctgaccctgtctgaggaccccagccccagggtcatcatccacaaccgctgccctgtgaagatgctgatcaaggagaacatcaaggacatccccaagtttgaggtgtactgcaagaagatccccagtgaatgttccatccaccacgagctgtaccaccagatcagcagctacccagactgcaagaccaaggacctgctgcccagcctgctgctgcgggtggagcccctggatgaggtgaccacagagtggagcgatgccatcgacatcaacagccagggcacccaggtggtgttcctgaccggcttcggctacgtgtatgtggatgtggtgcaccagtgtggcaccgtcttcatcaccgtggcccctgagggcaaggccggccccatcctgaccaacaccaacagagcccctgagaagatcgtgaccttcaagatgttcatcacccagctgagcctggccgtgtttgatgacctgacccaccacaaggccagcgctgagctgctgcggctgaccctggacaacatcttcctgtgtgtggcccctggagctggccccctgcctggagaggagcctgtggccgccctgtttgagctgtactgtgtggagatctgctgcggggacctgcagctggacaaccagctgtacaacaagagcaacttccactttgctgtgctggtgtgccagggcgagaaggccgagcccatccagtgcagcaagatgcagagcctgctgatcagcaacaaggagctggaggagtacaaggagaagtgcttcatcaagctgtgcatcaccctgaatgaaggcaagagcatcctgtgtgacatcaatgagttctcctttgagctgaagccagcccggctgtatgtggaggacacctttgtgtactacatcaagaccctgtttgacacctacctgcccaacagccggctggccggccacagcacccacctgagcggcggcaagcaggtgctgcccatgcaggtgacccagcacgcccgggccctggtgaaccctgtgaagctgaggaagctggtgatccagcctgtgaacctgctggtgtccatccacgccagcctgaagctgtacatcgccagtgaccacacccccctgtccttctctgtgtttgagcggggccccatcttcaccacagcccggcagctggtgcacgccctggccatgcactacgccgccggggccctcttccgggccggctgggtggtgggcagcctggacatcctgggcagccctgccagcctggtgcgcagcattggaaatggagtggccgacttcttccggctgccctatgagggcctgacccggggccctggggcctttgtgtctggagtgtcccggggcaccaccagctttgtgaagcacatcagcaagggcaccctgaccagcatcaccaacctggccaccagcctggccaggaacatggaccggctgagcctggatgaggagcactacaaccggcaggaggagtggaggcggcagctgcctgagagcctgggggagggcctgcggcagggcctgagccggctgggcatcagcctgctgggcgccatcgccggcatcgtggaccagcccatgcagaacttccagaagaccagcgaggcccaggccagcgctggccacaaggccaagggcgtcatcagcggcgtgggcaagggcatcatgggcgtcttcaccaagcccatcggcggcgctgctgagctggtgtcccagacaggctacggcatcctgcacggggccggcctgagccagctgcccaagcagaggcaccagcccagcgacctgcatgctgaccaggcccccaacagccacgtgaagtatgtgtggaagatgctgcagagcctgggccggcctgaggtgcacatggccctggatgtggtgctggtgcggggcagcggccaggagcacgagggctgcctgctgctgaccagcgaggtgctgtttgtggtgtctgtgtctgaggacacccagcagcaggccttccctgtgacagaaattgactgtgcccaggacagcaagcagaacaacctgctgactgtgcagctgaagcagccccgggtggcctgtgatgtggaggtggatggagtgcgggagcggctgtctgagcagcagtacaaccggctggtggactacatcaccaagaccagctgccacctggcccccagctgcagctccatgcagatcccctgccctgtggtggccgctgagcccccacccagcacagtgaagacctaccactacctggtggacccccactttgcccaggtgttcctgagcaagttcaccatggtgaagaacaaggccctgaggaagggcttcccctag

SEQ ID NO: 43452 - DNA, 4284 bp, Artificial Sequence
  Description of Artificial Sequence: Synthetic coding sequence
atgctggagagctatgtgacccccatcctgatgtcctatgtgaaccgctacatcaagaacctgaagcccagcgacctgcagctgagcctgtggggcggagatgtggtgctgagcaagctggagctgaagctggatgtgctggagcaggagctgaagctgcccttcaccttcctgagcggccacatccacgagctgcgcatccacgtgccctggaccaagctgggcagcgagcctgtggtgatcaccatcaacaccatggagtgcatcctgaagctgaaggatggcatccaggatgaccacgagagctgtggcagcaacagcaccaacagaagcacagctgagagcaccaagagcagcatcaagcccaggaggatgcagcaggccgcccccacagatcctgacctgcccccaggctacgtgcagagcctcatcagaagagtggtgaacaacgtgaacatcgtcatcaacaacctgatcctgaagtatgtggaggatgacatcgtgctgtctgtgaacatcaccagcgctgagtgctacacagtgggggagctgtgggaccgggccttcatggacatcagcgccacagacctggtgctgaggaaggtgatcaacttcagtgactgcaccgtgtgcctggacaagagaaatgccagcggcaagattgagttctaccaggaccccctgctgtacaagtgcagcttccgcacccggctgcacttcacctatgagaacctgaacagcaagatgcccagcgtcatcaagatccacaccctggtggagagcctgaagctgagcatcacagaccagcagctgcccatgttcatccgcatcatgcagctgggcatcgccctgtactacggggagatcggcaacttcaaggagggggagattgaggacctgacctgccacaacaaggacatgctgggcaacatcaccggctctgaagatgagaccagaattgacatgcagtacccagcccagcacaagggccaggagctgtacagccagcaggatgaggagcagccccagggctgggtgtcctgggcctggagctttgtgcctgccatcgtgtcctatgatgatggagaggaggactttgtgggcaatgaccctgccagcaccatgcaccagcagaaggcccagaccctgaaggaccccatcgtgtccatcggcttctactgcaccaaggccaccgtgaccttcaagctgacagagatgcaggtggagagcagctactacagcccccagaaggtgaagagcaaggaggtgctgtgctgggagcaggagggcaccaccgtggaggccctgatgatgggagagcccttctttgactgccagattggatttgtgggctgccgggccatgtgcctgaagggcatcatgggcgtgaaggactttgaggagaacatgaacagaagtgaaacagaggcctgcttcttcatctgtggggacaacctgagcaccaagggcttcacctacctgaccaacagcctgtttgactaccgcagcccagaaaataatggcaccagggctgagttcatcctggacagcacccaccacaaggagacctacacagaaattgctggcatgcagagatttggagccttctacatggactacctgtacaccatggagaacaccagcggcaagggcagcaccaaccagcaggacttcagcagcggcaagtctgaggacctgggcaccgtgcaggagaagagcaccaagagcctggtgattggccccctggacttccggctggacagcagcgctgtgcaccgcatcctgaagatgattgtgtgtgccctggagcacgagtatgagccctacagccggctgaagagtgacatcaaggatgaaaatgagaccatcctgaaccctgaggaggtggccctgctggaggagtacatccccaccaggcacacctctgtgaccctgctgaagtgcacctgcaccatctccatggccgagttcaacctgctggaccacctgctgcctgtgatcatgggagagaagaacagcagcaacttcatgaacaccaccaacttccagagcctgcggcccctgcccagcatccgcatcctggtggacaagatcaacctggagcacagcgtgcccatgtatgcagagcagctggtgcacgtggtgagcagcctgacccagcccagcgacaacctgctgcactactgctacgtgcactgctacctgaagatcttcggcttccaggccggcctgaccagcctggactgcagcggcagctactgcctgcctgtgcctgtgatccccagcttcagcacagccctgtatggcaagctgctgaagctgcccacctgctggaccaagaggagccagatcgccatcacagagggcatctttgagctgcccaacctgaccatccaggccacccgggcccagaccctgctgctgcaggccatctaccagagctggagccacctgggcaatgtgagcagcagcgctgtgattgaggccctgatcaatgagatcttcctgagcattggagtgaagagcaagaaccccctgcccaccctggagggcagcatccagaatgtggagctgaagtactgcagcaccagcctggtgaagtgtgccagcggcaccatgggcagcatcaagatctgtgccaaggcccctgtggacagcggcaaggagaagctgatccccctgctgcagggccccagcgacaccaaggacctgcacagcaccaagtggctgaatgaaagcaggaagccagagagcctgctggccccagacctgatggccttcaccatccaggtgccccagtacatcgactactgccacaacagcggggctgtgctgctgtgcagcatccagggcctggccgtgaacatcgaccccatcctgtacacctggctgatctaccagccccagaagaggaccagccgccacatgcagcagcagcctgtggtggccgtgcccctggtgatgcctgtgtgcaggaggaaagaagatgaggtgtccatcggcagcgcccccctggccaagcagcagagctaccaggcctctgaatatgccagcagccctgtgaagaccaagacagtgacagagagccggcccctgtctgtgcctgtgaaggccatgctgaacatcagcgagagctgccgcagccctgaggagaggatgaaggagttcatcggcatcgtgtggaatgctgtgaagcacctgaccctgcagctggaggtgcagagctgctgcgtgttcatccccaatgacagcctgcccagccccagcaccatcgtgtctggggacatccctggcaccgtgcgctcctggtaccacggccagacctccatgcctggcaccctggtgctgtgcctgccccagatcaagatcatctctgctggccacaagtacatggagcccctgcaggagatcccctttgtgatcccccggcccatcctggaggagggagatgccttcccctggaccatcagcctgcacaacttcagcatctacaccctgctgggcaagcaggtgaccctgtgcctggtggagcccatgggctgcaccagcaccctggccgtgaccagccagaagctgctggccactggaccagacaccaggcacagctttgtggtgtgcctgcacgtggacctggagagcctggagatcaagtgcagcaacccccaggtgcagctgttctatgagctgacagacatcatgaacaaggtgtggaacaagatccagaagaggggcaacctgaacctgagccccaccagccctgagaccatggccggccctgtgcccaccagccctgtgcgcagcagcattggaacagcccccccagacaccagcacctgcagccccagcgctgacatcggcaccaccacagaaggagacagcatccaggccggggaggagagccccttcagtgacagcgtgaccctggagcagaccaccagcaacattggaggcaccagcggccgggtgtccctgtggatgcagtgggtgctgcccaagatcaccatcaagctgtttgccccagaccctgaaaataaaggaacagaggtgtgcatggtgtctgagctggaggacctgagcgccagcattgatgtgcaggatgtgtacaccaaggtgaagtgcaagattgagagcttcaacatcgaccactaccgcagcaggcctggagagggctggcagagcggccactttgagggcgtcttcctgcagtgcaaggagaagtctgtgccctggggccgggtgctggtgtttggagccatgtggcgctgcctgcccttcctgtactag

SEQ ID NO: 43453 - DNA, 1248 bp, Artificial Sequence
  Description of Artificial Sequence: Synthetic coding sequence
atgctggagagctatgtgacccccatcctgatgtcctatgtgaaccgctacatcaagaacctgaagcccagcgacctgcagctgagcctgtggggcggagatgtggtgctgagcaagctggagctgaagctggatgtgctggagcaggagctgaagctgcccttcaccttcctgagcggccacatccacgagctgcgcatccacgtgccctggaccaagctgggcagcgagcctgtggtgatcaccatcaacaccatggagtgcatcctgaagctgaaggatggcatccaggatgaccacgagagctgtggcagcaacagcaccaacagaagcacagctgagagcaccaagagcagcatcaagcccaggaggatgcagcaggccgcccccacagatcctgacctgcccccaggctacgtgcagagcctcatcagaagagtggtgaacaacgtgaacatcgtcatcaacaacctgatcctgaagtatgtggaggatgacatcgtgctgtctgtgaacatcaccagcgctgagtgctacacagtgggggagctgtgggaccgggccttcatggacatcagcgccacagacctggtgctgaggaaggtgatcaacttcagtgactgcaccgtgtgcctggacaagagaaatgccagcggcaagattgagttctaccaggaccccctgctgtacaagtgcagcttccgcacccggctgcacttcacctatgagaacctgaacagcaagatgcccagcgtcatcaagatccacaccctggtggagagcctgaagctgagcatcacagaccagcagctgcccatgttcatccgcatcatgcagctgggcatcgccctgtactacggggagatcggcaacttcaaggagggggagattgaggacctgacctgccacaacaaggacatgctgggcaacatcaccggctctgaagatgagaccagaattgacatgcagtacccagcccagcacaagggccaggagctgtacagccagcaggatgaggagcagccccagggctgggtgtcctgggcctggagctttgtgcctgccatcgtgtcctatgatgatggagaggaggactttgtgggcaatgaccctgccagcaccatgcaccagcagaaggcccagaccctgaaggaccccatcgtgtccatcggcttctactgcaccaaggccaccgtgaccttcaaggtgggcctcttcagctgctgcctgtacctgtaccagctgtag

SEQ ID NO: 43454 - DNA, 11133 bp, Artificial Sequence
  Description of Artificial Sequence: Synthetic coding sequence
atggtgctggagagcgtggtggccgacctgctgaaccgcttcctgggggactatgtggagaacctgaacaagagccagctgaagctgggcatctggggcggcaatgtggccctggacaacctgcagatcaaggaaaatgccctgtctgagctggatgtgcccttcaaggtgaaggccggccagattgacaagctgaccctgaagatcccctggaagaacctgtatggagaggccgtggtggccaccctggagggcctgtacctgctggtggtgcctggggccagcatcaagtatgatgctgtgaaggaggagaagagcctgcaggatgtgaagcagaaggagctgagccgcatcgaggaggccctgcagaaggctgctgagaaggacaagcccaaggaggccaagaaggacacctttgtggagaagctggccacccaggtgatcaagaatgtgcaggtgaagatcacagacatccacatcaagtatgaagatgatgtgacagaccccaagaggcccctgagctttggagtgaccctgggggagctgagcctgctgacagccaatgagcactggaccccctgcatcctgaatgaagctgacaagatcatctacaagctgatccggctggacagcctgagcgcctactggaatgtgaactgcagcatgagctaccagaggagccgggagcagatcctggaccagctgaagaatgagatcctgaccagcggcaacatcccccccaactaccagtacatcttccagcccatcagcgccagcgccaagctgtacatgaacccctatgcagagagcgagctgaagacccccaagctggactgcaacatcgagatccagaacatcgccatcgagctgaccaagccccagtacctgtccatgattgacctgctggagagcgtggactacatggtgagaaatgccccctacaggaagtacaagccctacctgcccctgcacaccaacggccgccgctggtggaagtatgccattgattctgtgctggaggtgcacatccgccgctacacccagatgtggagctggagcaacatcaagaagcaccggcagctgctgaagagctacaagatcgcctacaagaacaagctgacccagagcaaggtgtctgaggagatccagaaggagatccaggacctggagaagaccctggatgtgttcaacatcatcctggcccggcagcaggcccaggtggaggtgatccgcagcggccagaagctgaggaagaagtctgctgacacaggagagaagaggggcggctggttcagcggcctgtggggcaagaaggagagcaagaagaaggatgaggagagcctcatccctgagaccattgatgacctgatgaccccagaggagaaggacaagctgttcaccgccatcggctacagcgagagcacccacaacctgaccctgcccaagcagtatgtggcccacatcatgaccctgaagctggtgtccacctctgtgaccatccgggagaacaagaacatccctgagatcctgaagatccagatcatcggcctgggcacccaggtgtcccagaggcctggggcccaggccctgaaggtggaggccaagctggagcactggtacatcaccggcctgcggcagcaggacatcgtgcccagcctggtggccagcattggagacaccaccagcagcctgctgaagatcaagtttgagaccaaccctgaggacagccctgctgaccagaccctgattgtgcagagccagcctgtggaggtgatctatgatgccaagacagtgaatgctgtggtggagttcttccagagcaacaagggcctggacctggagcagatcaccagcgccaccctgatgaagctggaggagatcaaggagaggacagccaccggcctgacccacatcatcgagaccaggaaggtgctggacctgcgcatcaacctgaagcccagctacctggtggtgccccagacaggcttccaccacgagaagagtgacctgctgatcctggactttggcaccttccagctgaacagcaaggaccagggcctgcagaagaccaccaacagcagcctggaggagatcatggacaaggcctatgacaagtttgatgtggagatcaagaatgtgcagctgctgtttgcccgggcagaggagacctggaagaagtgccgcttccagcaccccagcaccatgcacatcctgcagcccatggacatccacgtggagctggccaaggccatggtggagaaggacatccgcatggcccgcttcaaggtgtctgggggcctgcccctgatgcacgtgcgcatcagtgaccagaagatgaaggatgtgctgtacctgatgaacagcatccccctgccccagaagagcagcgcccagagccctgagcggcaggtgagcagcatccccatcatcagcggcggcaccaagggcctgctgggcaccagcctgctgctggacacagtggagagcgagagtgatgatgagtactttgatgctgaagatggagagccccagacctgcaagtccatgaagggcagcgagctgaagaaggctgctgaggtgcccaatgaggagctgatcaacctgctgctgaagtttgagatcaaggaggtgatcctggagttcaccaagcagcagaaggaggaggacaccatcctggtgttcaacgtgacccagctgggcacagaggccaccatgaggacctttgacctgactgtggtgtcctacctgaagaagatcagcctggactaccacgagattgagggcagcaagaggaagcccctgcacctgatcagcagcagtgacaagccaggcctggacctgctgaaggtggagtacatcaaggctgacaagaatggccccagcttccagacagccttcggcaagacagagcagacagtgaaggtggccttcagcagcctgaacctgctgctgcagacccaggccctggtggccagcatcaactacctgaccaccatcatccccagtgatgaccagagcatctctgtggccaaggaggtgcagatcagcacagagaagcagcagaagaacagcaccctgcccaaggccatcgtgagcagccgggacagcgacatcatcgacttccggctgtttgccaagctgaatgccttctgtgtgattgtgtgcaatgagaagaacaacattgctgagatcaagatccagggcctggacagcagcctgagcctgcagagcaggaagcagagcctgtttgcccggctggagaacatcatcgtgacagatgtggaccccaagacagtgcacaagaaggctgtgtccatcatgggaaatgaggtgttccgcttcaacctggacctgtacccagatgccacagaaggagacctgtacacagacatgagcaaggtggatggagtgctgagcctgaatgtgggctgcatccagatcgtgtacctgcacaagttcctgatgagcctgctgaacttcctgaacaacttccagacagccaaggagagcctgtctgctgccacagcccaggccgctgagcgggccgccacctctgtgaaggacctggcccagaggagcttccgggtgtccatcaacatcgacctgaaggcccctgtgattgtcatcccccagagcagcatcagcaccaatgctgtggtggtggacctgggcctcatccgggtgcacaaccagttcagcctggtgtctgatgaggactacctgaacccccctgtgattgacaggatggatgtgcagctgaccaagctgaccctgtacagaactgtcatccagcccggcatctaccacccagacatccagctgctgcaccccatcaacctggagttcctggtgaacagaaacctggccgcctcctggtaccacaaggtgcctgtggtggagatcaagggccacctggacagcatgaatgtgtccctgaaccaggaggacctgaacctgctcttccgcatcctgacagagaacctgtgtgagggcacagaggacctggacaaggtgaagccccgggtgcaggagactggagagatcaaggagcccctggagatcagcatcagccaggatgtgcatgacagcaagaacaccctgaccactggagtggaggagatccgctctgtggacatcatcaacatgctgctgaactttgagatcaaggaggtggtggtgaccctgatgaagaagtctgagaagaagggccggcccctgcacgagctgaatgtgctgcagctgggcatggaggccaaggtgaagacctatgacatgacagccaaggcctacctgaagaagatctccatgcagtgctttgacttcacagacagcaaaggagagcccctgcacatcatcaacagcagcaatgtgacagatgagcccctgctgaagatgctgctgaccaaggctgacagtgatggccctgagttcaagaccatccatgacagcaccaagcagaggctgaaggtgtcctttgccagcctggacctggtgctgcacctggaggccctgctgtccttcatggacttcctgagcagcgctgcccccttcagcgagcccagcagcagcgagaaggagagcgagctgaagcccctggtgggggagagccgcagcattgctgtgaaggctgtgagcagcaacatcagccagaaggatgtgtttgacctgaagatcacagctgagctgaatgccttcaacgtgtttgtgtgtgaccagaagtgcaacattgctgacatcaagatccacggcatggatgccagcatctctgtgaagcccaagcagacagatgtgtttgcccggctgaaggacatcatcgtgatgaatgtggacctgcagagcatccacaagaaggctgtgtccatcctgggagatgaggtgttccgcttccagctgaccctgtacccagatgccacagaaggagaggcctatgctgacatgagcaaggtggatggcaagctgtccttcaaggtgggctgcatccagatcgtgtatgtgcacaagttcttcatgagcctgctgaacttcctgaacaacttccagacagccaaggaggccctgagcacagccaccgtgcaggccgctgagagagctgccagctccatgaaggacctggcccagaagagcttccggctgctgatggacatcaacctgaaggcccctgtgatcatcatcccccagagctctgtgagccccaatgctgtgattgctgacctgggcctcatccgggtggagaacaagttcagcctggtgcccatggagcactacagcctgccccctgtgattgacaagatgaacatcgagctgacccagctgaagctgagcaggaccatcctgcaggccagcctgccccagaatgacatcgagatcctgaagcctgtgaacatgctgctgagcatccagaggaacctggccgccgcctggtacgtgcagatccctggcatggagatcaagggcaagctgaagcccatgcaggtggccctgtctgaagatgacctgactgtgctgatgaagatcctgctggagaacctgggggaggccagcagccagcccagccccacccagagcgtgcaggagaccgtgcgggtgaggaaggtggatgtgtcctctgtgcctgaccacctgaaggagcaggaggactggacagacagcaagctgtccatgaaccagatcgtgtccctgcagtttgacttccactttgagagcctgagcatcatcctgtacaacaatgacatcaaccaggagagcggcgtggccttccacaatgacagcttccagctgggggagctgcggctgcacctgatggccagcagcggcaagatgttcaaggatggctccatgaatgtgtctgtgaagctgaagacctgcaccctggatgacctgcgggagggcatcgagcgggccaccagcaggatgattgacaggaagaatgaccaggacaacaacagctccatgattgacatctcctacaagcaggacaagaatggcagccagattgatgctgtgctggacaagctgtatgtgtgtgcctctgtggagttcctgatgacagtggccgacttcttcatcaaggctgtgccccagagcccagaaaatgtggccaaggagacccagatcctgccccggcagacagccaccgggaaggtgaagattgagaaggatgattctgtgcggcccaacatgaccctgaaggccatgatcacagatcctgaggtggtgtttgtggccagcctgaccaaggcagatgccccagccctgacagccagcttccagtgcaacctgagcctgagcaccagcaagctggagcagatgatggaggcctctgtgcgggacctgaaggtgctggcctgccccttcctgcgggagaagaggggcaagaacatcaccaccgtgctgcagccctgcagcctcttcatggagaagtgcacctgggccagcggcaagcagaacatcaacatcatggtgaaggagttcatcatcaagatcagccccatcatcctgaacacagtgctgaccatcatggccgccctgagccccaagaccaaggaggatggcagcaaggacaccagcaaggagatggagaacctgtggggcatcaagagcatcaatgactacaacacctggttcctgggcgtggacacagccacagagatcacagagagcttcaagggcatcgagcacagcctgattgaggagaactgtggggtggtggtggagagcatccaggtgaccctggagtgtggcctgggccacaggacagtgcccctgctgctggccgagagcaagttcagcggcaacatcaagaactggaccagcctgatggctgctgtggctgatgtgaccctgcaggtgcactactacaatgagatccatgctgtgtgggagcccctgattgagcgggtggagggcaagaggcagtggaacctgcggctggatgtgaagaagaaccctgtgcaggacaagagcctgctgcctggagatgacttcatccctgagccccagatggccatccacatcagcagcggcaacaccatgaacatcaccatcagcaagagctgcctgaatgtgttcaacaacctggccaagggcttcagcgagggcacagccagcacctttgactacagcctgaaggaccgggcccccttcaccgtgaagaatgctgtgggcgtgcccatcaaggtgaagcccaactgcaacctgcgggtgatgggcttccctgagaagagtgacatctttgatgtggatgctggccagaacctggagctggagtatgcctccatggtgcccagcagccagggcaacctgagcatcctgagccggcaggagagcagcttcttcaccctgaccatcgtgccccacggctacacagaggtggccaacatccctgtggcccggcctggaagaagactctacaacgtgaggaaccccaatgccagccacagcgacagcgtgctggtgcagattgatgccacagagggcaacaaggtgatcaccctgcggagccccctgcagatcaagaaccacttcagcatcgccttcatcatctacaagtttgtgaagaatgtgaagctgctggagagaattggaattgcccggcctgaggaggagttccacgtgcccctggacagctaccgctgccagctgttcatccagcctgctggcatcctggagcaccagtacaaggagagcaccacctacatctcctggaaggaggagctgcacaggagccgggaggtgcgctgcatgctgcagtgccccagcgtggaggtgtccttcctgcccctgattgtgaacacagtggccctgcctgatgagctgagctacatctgcacccatggagaggactgggatgtggcctacatcatccacctgtaccccagcctgaccctgaggaacctgctgccctacagcctgcgctacctgctggagggcacagctgagacccatgagctggccgagggcagcacagcagatgtgctgcacagccgcatcagcggggagatcatggagctggtgctggtgaagtaccagggcaagaactggaatggccacttccgcatccgggacaccctgcctgagttcttccctgtgtgcttcagcagtgacagcacagaggtgaccaccgtggacctgtctgtgcacgtgagaagaattggcagcaggatggtgctgagcgtcttcagcccctactggctgatcaacaagaccaccagggtgctgcagtacagaagtgaggacatccacgtgaagcaccctgctgacttccgggacatcatcctcttctccttcaagaagaagaacatcttcaccaagaacaaggtgcagctgaagatcagcaccagcgcctggagcagcagcttcagcctggacacagtgggcagctatggctgtgtgaagtgcccagccaacaacatggagtacctggtgggcgtgtccatcaagatgagcagcttcaacctgagccgcatcgtgaccctgacccccttctgcaccatcgccaacaagagcagcctggagctggaggtgggggagatcgccagtgatggctccatgcccaccaacaagtggaactacatcgccagcagcgagtgcctgcccttctggccagagagcctgagcggcaagctgtgtgtgcgggtggtgggctgtgagggcagcagcaagcccttcttctacaaccggcaggacaatggcaccctgctgagcctggaggacctgaatggaggcatcctggtggatgtgaacacagctgagcacagcaccgtcatcaccttcagtgactaccacgagggcagcgccccagccctgatcatgaaccacaccccctgggacatcctgacctacaagcagagcggcagccctgaggagatggtgctgctgccccggcaggcccggctgtttgcctgggccgaccccaccggcaccaggaagctgacctggacctacgccgccaacgtgggggagcatgacctgctgaaggatggctgcggccagttcccctatgatgccaacatccagatccactgggtgtccttcctggatggccggcagagggtgctgctcttcacagatgatgtggccctggtgtccaaggccctgcaggccgaggagatggagcaggccgactatgagatcaccctgagcctgcacagcctgggcctgagcctggtgaacaatgaaagcaagcaggaggtgtcctacatcggcatcaccagcagcggcgtggtgtgggaggtgaagcccaagcagaagtggaagcccttcagccagaagcagatcatcctgctggagcagagctaccagaagcaccagatcagccgggaccacggctggatcaagctggacaacaactttgaggtgaactttgacaaggaccccatggagatgaggctgcccatccgcagccccatcaagagggacttcctgagcggcatccagatcgagttcaagcagagcagccaccagaggagcctgcgggcccggctgtactggctgcaggtggacaaccagctgcccggggccatgtttcctgtggtgttccaccctgtggccccacccaagagcatcgccctggacagcgagcccaagcccttcattgatgtgtctgtcatcacccgcttcaatgagtacagcaaggtgctgcagttcaagtacttcatggtgctgatccaggagatggccctgaagattgaccagggcttcctgggcgccatcatcgccctcttcacccccaccacagatcctgaggccgagaggaggaggaccaagctgatccagcaggacattgatgccctgaatgctgagctgatggagacctccatgacagacatgagcatcctgtccttctttgagcacttccacatcagccctgtgaagctgcacctgagcctgagcctgggcagcggcggggaggagagtgacaaggagaagcaggagatgtttgctgtgcacagcgtgaacctgctgctgaagagcattggagccaccctgacagatgtggatgacctgatcttcaagctggcctactatgagatccgctaccagttctacaagagggaccagctgatctggagcgtggtgcgccactacagcgagcagttcctgaagcagatgtatgtgctggtgctgggcctggatgtgctgggcaaccccttcggcctcatccggggcctgtctgaaggagtggaggccctcttctatgagcccttccagggcgctgtgcagggccctgaggagtttgctgagggcctggtgattggagtgcgcagcctgtttggccacacagtgggcggggccgccggcgtggtgagccgcatcactggatctgtgggcaagggcctggccgccatcaccatggacaaggagtaccagcagaagagaagagaggagctgagccggcagccccgggactttggagacagcctggcccggggcggcaagggcttcctgcggggcgtggtgggcggcgtgacaggcatcatcaccaagcctgtggagggcgccaagaaggagggcgccgccggcttcttcaagggcatcggcaagggcctggtgggcgctgtggcccggcccaccggcggcatcgtggacatggccagcagcaccttccagggcatccagagagctgctgagagcacagaggaggtgagcagcctgcggccccccaggctcatccatgaagatggcatcatccggccctatgaccggcaggagagcgagggcagtgacctgctggagaaccacatcaagaagctggagggggagacctaccgctaccactgtgccatccctggcagcaagaagaccatcctgatggtgaccaacagaagagtgctgtgcatcaaggaggtggagatcctgggcctgatgtgtgtggactggcagtgcccctttgaagattttgtgttcccccccagcgtgtctgaaaatgtgctgaagatctctgtgaaggagcagggcctcttccacaagaaggacagcgccaaccagggctgtgtgaggaaggtgtacctgaaggacacagccacagctgagcgggcctgcaatgccattgaagatgcccagagcacccggcagcagcagaagctgatgaagcagagctctgtgcggctgctgcggccccagctgcccagctag

SEQ ID NO: 43455 - DNA, 11262 bp, Artificial Sequence
  Description of Artificial Sequence: Synthetic coding sequence
atggtgctggagagcgtggtggccgacctgctgaaccgcttcctgggggactatgtggagaacctgaacaagagccagctgaagctgggcatctggggcggcaatgtggccctggacaacctgcagatcaaggaaaatgccctgtctgagctggatgtgcccttcaaggtgaaggccggccagattgacaagctgaccctgaagatcccctggaagaacctgtatggagaggccgtggtggccaccctggagggcctgtacctgctggtggtgcctggggccagcatcaagtatgatgctgtgaaggaggagaagagcctgcaggatgtgaagcagaaggagctgagccgcatcgaggaggccctgcagaaggctgctgagaagggcacccacagcggggagttcatctacggcctggagaactttgtgtacaaggacatcaagccaggcaggaagaggaagaagcacaagaagcacttcaagaagcccttcaagggcctggacaggagcaaggacaagcccaaggaggccaagaaggacacctttgtggagaagctggccacccaggtgatcaagaatgtgcaggtgaagatcacagacatccacatcaagtatgaagatgatgtgacagaccccaagaggcccctgagctttggagtgaccctgggggagctgagcctgctgacagccaatgagcactggaccccctgcatcctgaatgaggccgacaagatcatctacaagctgatccggctggacagcctgagcgcctactggaatgtgaactgcagcatgagctaccagaggagccgggagcagatcctggaccagctgaagaatgagatcctgaccagcggcaacatcccccccaactaccagtacatcttccagcccatcagcgccagcgccaagctgtacatgaacccctatgcagagagcgagctgaagacccccaagctggactgcaacatcgagatccagaacatcgccatcgagctgaccaagccccagtacctgtccatgattgacctgctggagagcgtggactacatggtgagaaatgccccctacaggaagtacaagccctacctgcccctgcacaccaatggaagacgctggtggaagtatgccatcgacagcgtgctggaggtgcacatccgccgctacacccagatgtggagctggagcaacatcaagaagcaccggcagctgctgaagagctacaagatcgcctacaagaacaagctgacccagagcaaggtgtctgaggagatccagaaggagatccaggacctggagaagaccctggatgtgttcaacatcatcctggcccggcagcaggcccaggtggaggtgatccgcagcggccagaagctgaggaagaagtctgctgacaccggggagaagagaggaggctggttcagcggcctgtggggcaagaaggagagcaagaagaaggatgaggagagcctcatccctgagaccattgatgacctgatgaccccagaggagaaggacaagctgttcaccgccatcggctacagcgagagcacccacaacctgaccctgcccaagcagtatgtggcccacatcatgaccctgaagctggtgtccacctctgtgaccatccgggagaacaagaacatccctgagatcctgaagatccagatcatcggcctgggcacccaggtgtcccagaggcctggggcccaggccctgaaggtggaggccaagctggagcactggtacatcaccggcctgcggcagcaggacatcgtgcccagcctggtggccagcatcggggacaccaccagcagcctgctgaagatcaagtttgagaccaaccctgaggacagccctgctgaccagaccctcatcgtgcagagccagcctgtggaggtgatctatgatgccaagacagtgaatgctgtggtggagttcttccagagcaacaagggcctggacctggagcagatcaccagcgccaccctgatgaagctggaggagatcaaggagaggacagccaccggcctgacccacatcatcgagaccaggaaggtgctggacctgcgcatcaacctgaagcccagctacctggtggtgccccagacaggcttccaccacgagaagagtgacctgctgatcctggactttggcaccttccagctgaacagcaaggaccagggcctgcagaagaccaccaacagcagcctggaggagatcatggacaaggcctatgacaagtttgatgtggagatcaagaatgtgcagctgctgtttgcccgggcagaggagacctggaagaagtgccgcttccagcaccccagcaccatgcacatcctgcagcccatggacatccacgtggagctggccaaggccatggtggagaaggacatccgcatggcccgcttcaaggtgtctgggggcctgcccctgatgcacgtgcgcatcagtgaccagaagatgaaggatgtgctgtacctgatgaacagcatccccctgccccagaagagcagcgcccagagccctgagcggcaggtgagcagcatccccatcatcagcggcggcaccaagggcctgctgggcaccagcctgctgctggacacagtggagagcgagagtgatgatgagtactttgatgctgaagatggagagccccagacctgcaagtccatgaagggcagcgagctgaagaaggctgctgaggtgcccaatgaggagctgatcaacctgctgctgaagtttgagatcaaggaggtgatcctggagttcaccaagcagcagaaggaggaggacaccatcctggtgttcaacgtgacccagctgggcacagaggccaccatgaggacctttgacctgactgtggtgtcctacctgaagaagatcagcctggactaccatgaaattgagggcagcaagaggaagcccctgcacctgatcagcagcagtgacaagccaggcctggacctgctgaaggtggagtacatcaaggctgacaagaatggccccagcttccagacagccttcggcaagacagagcagacagtgaaggtggccttcagcagcctgaacctgctgctgcagacccaggccctggtggccagcatcaactacctgaccaccatcatccccagtgatgaccagagcatctctgtggccaaggaggtgcagatcagcacagagaagcagcagaagaacagcaccctgcccaaggccatcgtgagcagccgggacagcgacatcatcgacttccggctgtttgccaagctgaatgccttctgtgtgattgtgtgcaatgagaagaacaacattgctgagatcaagatccagggcctggacagcagcctgagcctgcagagcaggaagcagagcctgtttgcccggctggagaacatcatcgtgacagatgtggaccccaagacagtgcacaagaaggctgtgtccatcatgggaaatgaggtgttccgcttcaacctggacctgtacccagatgccacagaaggagacctgtacacagacatgagcaaggtggatggagtgctgagcctgaatgtgggctgcatccagatcgtgtacctgcacaagttcctgatgagcctgctgaacttcctgaacaacttccagacagccaaggagagcctgtctgctgccacagcccaggccgctgagagagctgccacctctgtgaaggacctggcccagaggagcttccgggtgtccatcaacatcgacctgaaggcccctgtgattgtcatcccccagagcagcatcagcaccaatgctgtggtggtggacctgggcctcatccgggtgcacaaccagttcagcctggtgtctgatgaggactacctgaacccccctgtgattgacaggatggatgtgcagctgaccaagctgaccctgtaccgcaccgtcatccagcccggcatctaccacccagacatccagctgctgcaccccatcaacctggagttcctggtgaacagaaacctggccgcctcctggtaccacaaggtgcctgtggtggagatcaagggccacctggacagcatgaatgtgtccctgaaccaggaggacctgaacctgctcttccgcatcctgacagagaacctgtgtgagggcacagaggacctggacaaggtgaagccccgggtgcaggagaccggggagatcaaggagcccctggagatcagcatcagccaggatgtgcatgacagcaagaacaccctgaccaccggggtggaggagatccgctctgtggacatcatcaacatgctgctgaactttgagatcaaggaggtggtggtgaccctgatgaagaagtctgagaagaagggccggcccctgcacgagctgaatgtgctgcagctgggcatggaggccaaggtgaagacctatgacatgacagccaaggcctacctgaagaagatctccatgcagtgctttgacttcacagacagcaagggggagcccctgcacatcatcaacagcagcaatgtgacagatgagcccctgctgaagatgctgctgaccaaggctgacagtgatggccctgagttcaagaccatccatgacagcaccaagcagaggctgaaggtgtcctttgccagcctggacctggtgctgcacctggaggccctgctgtccttcatggacttcctgagcagcgctgcccccttcagcgagcccagcagcagcgagaaggagagcgagctgaagcccctggtgggggagagccgcagcattgctgtgaaggctgtgagcagcaacatcagccagaaggatgtgtttgacctgaagatcacagctgagctgaatgccttcaacgtgtttgtgtgtgaccagaagtgcaacattgctgacatcaagatccacggcatggatgccagcatctctgtgaagcccaagcagacagatgtgtttgcccggctgaaggacatcatcgtgatgaatgtggacctgcagagcatccacaagaaggctgtgtccatcctgggagatgaggtgttccgcttccagctgaccctgtacccagatgccacagaaggagaggcctatgctgacatgagcaaggtggatggcaagctgtccttcaaggtgggctgcatccagatcgtgtatgtgcacaagttcttcatgagcctgctgaacttcctgaacaacttccagacagccaaggaggccctgagcacagccaccgtgcaggccgctgagcgggccgccagctccatgaaggacctggcccagaagagcttccggctgctgatggacatcaacctgaaggcccctgtgatcatcatcccccagagctctgtgagccccaatgctgtgattgctgacctgggcctcatccgggtggagaacaagttcagcctggtgcccatggagcactacagcctgccccctgtgattgacaagatgaacatcgagctgacccagctgaagctgagcaggaccatcctgcaggccagcctgccccagaatgacatcgagatcctgaagcctgtgaacatgctgctgagcatccagaggaacctggccgccgcctggtacgtgcagatccctggcatggagatcaagggcaagctgaagcccatgcaggtggccctgtctgaagatgacctgactgtgctgatgaagatcctgctggagaacctgggggaggccagcagccagcccagccccacccagagcgtgcaggagaccgtgcgggtgaggaaggtggatgtgtcctctgtgcctgaccacctgaaggagcaggaggactggacagacagcaagctgtccatgaaccagatcgtgtccctgcagtttgacttccactttgagagcctgagcatcatcctgtacaacaatgacatcaaccaggagagcggcgtggccttccacaatgacagcttccagctgggggagctgcggctgcacctgatggccagcagcggcaagatgttcaaggatggctccatgaatgtgtctgtgaagctgaagacctgcaccctggatgacctgcgggagggcatcgagcgggccaccagcaggatgattgacaggaagaatgaccaggacaacaacagctccatgattgacatctcctacaagcaggacaagaatggcagccagattgatgctgtgctggacaagctgtatgtgtgtgcctctgtggagttcctgatgacagtggccgacttcttcatcaaggctgtgccccagagcccagaaaatgtggccaaggagacccagatcctgccccggcagacagccaccgggaaggtgaagattgagaaggatgacagcgtgcggcccaacatgaccctgaaggccatgatcacagatcctgaggtggtgtttgtggccagcctgaccaaggcagatgccccagccctgacagccagcttccagtgcaacctgagcctgagcaccagcaagctggagcagatgatggaggcctctgtgcgggacctgaaggtgctggcctgccccttcctgcgggagaagaggggcaagaacatcaccaccgtgctgcagccctgcagcctcttcatggagaagtgcacctgggccagcggcaagcagaacatcaacatcatggtgaaggagttcatcatcaagatcagccccatcatcctgaacacagtgctgaccatcatggccgccctgagccccaagaccaaggaggatggcagcaaggacaccagcaaggagatggagaacctgtggggcatcaagagcatcaatgactacaacacctggttcctgggcgtggacacagccacagagatcacagagagcttcaagggcatcgagcacagcctcatcgaggagaactgtggggtggtggtggagagcatccaggtgaccctggagtgtggcctgggccacaggacagtgcccctgctgctggccgagagcaagttcagcggcaacatcaagaactggaccagcctgatggctgctgtggctgatgtgaccctgcaggtgcactactacaatgagatccatgctgtgtgggagcccctcatcgagcgggtggagggcaagaggcagtggaacctgcggctggatgtgaagaagaaccctgtgcaggacaagagcctgctgcctggagatgacttcatccctgagccccagatggccatccacatcagcagcggcaacaccatgaacatcaccatcagcaagagctgcctgaatgtgttcaacaacctggccaagggcttcagcgagggcacagccagcacctttgactacagcctgaaggaccgggcccccttcaccgtgaagaatgctgtgggcgtgcccatcaaggtgaagcccaactgcaacctgcgggtgatgggcttccctgagaagagtgacatctttgatgtggatgctggccagaacctggagctggagtatgcctccatggtgcccagcagccagggcaacctgagcatcctgagccggcaggagagcagcttcttcaccctgaccatcgtgccccacggctacacagaggtggccaacatccctgtggcccggcccggccggcggctgtacaacgtgaggaaccccaatgccagccacagcgacagcgtgctggtgcagattgatgccacagagggcaacaaggtgatcaccctgcggagccccctgcagatcaagaaccacttcagcatcgccttcatcatctacaagtttgtgaagaatgtgaagctgctggagcgcatcggcatcgcccggcctgaggaggagttccacgtgcccctggacagctaccgctgccagctgttcatccagcctgctggcatcctggagcaccagtacaaggagagcaccacctacatctcctggaaggaggagctgcacaggagccgggaggtgcgctgcatgctgcagtgccccagcgtggaggtgtccttcctgcccctcatcgtgaacacagtggccctgcctgatgagctgagctacatctgcacccacggggaggactgggatgtggcctacatcatccacctgtaccccagcctgaccctgaggaacctgctgccctacagcctgcgctacctgctggagggcacagctgagacccatgagctggccgagggcagcacagcagatgtgctgcacagccgcatctctggagagatcatggagctggtgctggtgaagtaccagggcaagaactggaatggccacttccgcatccgggacaccctgcctgagttcttccctgtgtgcttcagcagtgacagcacagaggtgaccaccgtggacctgtctgtgcacgtgcggcgcatcggcagcaggatggtgctgtctgtgttcagcccctactggctgatcaacaagaccaccagggtgctgcagtacagaagtgaggacatccacgtgaagcaccctgctgacttccgggacatcatcctcttctccttcaagaagaagaacatcttcaccaagaacaaggtgcagctgaagatcagcaccagcgcctggagcagcagcttcagcctggacacagtgggcagctatggctgtgtgaagtgcccagccaacaacatggagtacctggtgggcgtgtccatcaagatgagcagcttcaacctgagcagaattgtgaccctgacccccttctgcaccatcgccaacaagagcagcctggagctggaggtgggggagatcgccagtgatggctccatgcccaccaacaagtggaactacatcgccagcagtgaatgtctgcccttctggccagagagcctgagcggcaagctgtgtgtgcgggtggtgggctgtgagggcagcagcaagcccttcttctacaaccggcaggacaatggcaccctgctgagcctggaggacctgaatggaggcatcctggtggatgtgaacacagctgagcacagcaccgtcatcaccttcagtgactaccacgagggcagcgccccagccctgatcatgaaccacaccccctgggacatcctgacctacaagcagagcggcagccctgaggagatggtgctgctgccccggcaggcccggctgtttgcctgggccgaccccaccggcaccaggaagctgacctggacctatgctgccaacgtgggggagcatgacctgctgaaggatggctgcggccagttcccctatgatgccaacatccagatccactgggtgtccttcctggatggccggcagagggtgctgctcttcacagatgatgtggccctggtgtccaaggccctgcaggccgaggagatggagcaggccgactatgagatcaccctgagcctgcacagcctgggcctgagcctggtgaacaatgaaagcaagcaggaggtgtcctacatcggcatcaccagcagtggagtggtgtgggaggtgaagcccaagcagaagtggaagcccttcagccagaagcagatcatcctgctggagcagagctaccagaagcaccagatcagccgggaccacggctggatcaagctggacaacaactttgaggtgaactttgacaaggaccccatggagatgaggctgcccatccgcagccccatcaagagggacttcctgagcggcatccagatcgagttcaagcagagcagccaccagaggagcctgcgggcccggctgtactggctgcaggtggacaaccagctgcccggggccatgtttcctgtggtgttccaccctgtggccccacccaagagcatcgccctggacagcgagcccaagcccttcattgatgtgtctgtcatcacccgcttcaatgagtacagcaaggtgctgcagttcaagtacttcatggtgctgatccaggagatggccctgaagattgaccagggcttcctgggcgccatcatcgccctcttcacccccaccacagatcctgaggccgagaggaggaggaccaagctgatccagcaggacattgatgccctgaatgctgagctgatggagacctccatgacagacatgagcatcctgtccttctttgagcacttccacatcagccctgtgaagctgcacctgagcctgagcctgggcagcggcggggaggagagtgacaaggagaagcaggagatgtttgctgtgcacagcgtgaacctgctgctgaagagcatcggggccaccctgacagatgtggatgacctgatcttcaagctggcctactatgagatccgctaccagttctacaagagggaccagctgatctggagcgtggtgcgccactacagcgagcagttcctgaagcagatgtatgtgctggtgctgggcctggatgtgctgggcaaccccttcggcctcatccggggcctgtctgagggcgtggaggccctcttctatgagcccttccagggcgctgtgcagggccctgaggagtttgctgagggcctggtgattggagtgcgcagcctgtttggccacacagtgggcggcgctgctggggtggtgagccgcatcaccggctctgtgggcaagggcctggccgccatcaccatggacaaggagtaccagcagaagaggcgggaggagctgagccggcagccccgggactttggagacagcctggcccggggcggcaagggcttcctgcggggcgtggtgggcggcgtgacaggcatcatcaccaagcctgtggagggcgccaagaaggagggcgctgctggcttcttcaagggcatcggcaagggcctggtgggcgctgtggcccggcccactggaggcatcgtggacatggccagcagcaccttccagggcatccagagagctgctgagagcacagaggaggtgagcagcctgcggccccccaggctcatccatgaagatggcatcatccggccctatgaccggcaggagagcgagggcagtgacctgctggagaaccacatcaagaagctggagggggagacctaccgctaccactgtgccatccctggcagcaagaagaccatcctgatggtgaccaacagaagagtgctgtgcatcaaggaggtggagatcctgggcctgatgtgtgtggactggcagtgcccctttgaggactttgtgtttcctccttctgtgtctgaaaatgtgctgaagatctctgtgaaggagcagggcctcttccacaagaaggacagcgccaaccagggctgtgtgaggaaggtgtacctgaaggacacagccacagctgagcgggcctgcaatgccattgaagatgcccagagcacccggcagcagcagaagctgatgaagcagagctctgtgcggctgctgcggccccagctgcccagctag

SEQ ID NO: 43456 - DNA, 10887 bp, Artificial Sequence
  Description of Artificial Sequence: Synthetic coding sequence
atggtgctggagagcgtggtggccgacctgctgaaccgcttcctgggggactatgtggagaacctgaacaagagccagctgaagctgggcatctggggcggcaatgtggccctggacaacctgcagatcaaggaaaatgccctgtctgagctggatgtgcccttcaaggtgaaggccggccagattgacaagctgaccctgaagatcccctggaagaacctgtatggagaggccgtggtggccaccctggagggcctgtacctgctggtggtgcctggggccagcatcaagtatgatgctgtgaaggaggagaagagcctgcaggatgtgaagcagaaggagctgagccgcatcgaggaggccctgcagaaggctgctgagaagggcacccacagcggggagttcatctacggcctggagaactttgtgtacaaggacatcaagccaggcaggaagaggaagaagcacaagaagcacttcaagaagcccttcaagggcctggacaggagcaaggacaagcccaaggaggccaagaaggacacctttgtggagaagctggccacccaggtgatcaagaatgtgcaggtgaagatcacagacatccacatcaagtatgaagatgatgtgacagaccccaagaggcccctgagctttggagtgaccctgggggagctgagcctgctgacagccaatgagcactggaccccctgcatcctgaatgaggccgacaagatcatctacaagctgatccggctggacagcctgagcgcctactggaatgtgaactgcagcatgagctaccagaggagccgggagcagatcctggaccagctgaagaatgagatcctgaccagcggcaacatcccccccaactaccagtacatcttccagcccatcagcgccagcgccaagctgtacatgaacccctatgcagagagcgagctgaagacccccaagctggactgcaacatcgagatccagaacatcgccatcgagctgaccaagccccagtacctgtccatgattgacctgctggagagcgtggactacatggtgagaaatgccccctacaggaagtacaagccctacctgcccctgcacaccaatggaagacgctggtggaagtatgccatcgacagcgtgctggaggtgcacatccgccgctacacccagatgtggagctggagcaacatcaagaagcaccggcagctgctgaagagctacaagatcgcctacaagaacaagctgacccagagcaaggtgtctgaggagatccagaaggagatccaggacctggagaagaccctggatgtgttcaacatcatcctggcccggcagcaggcccaggtggaggtgatccgcagcggccagaagctgaggaagaagtctgctgacaccggggagaagagaggaggctggttcagcggcctgtggggcaagaaggagagcaagaagaaggatgaggagagcctcatccctgagaccattgatgacctgatgaccccagaggagaaggacaagctgttcaccgccatcggctacagcgagagcacccacaacctgaccctgcccaagcagtatgtggcccacatcatgaccctgaagctggtgtccacctctgtgaccatccgggagaacaagaacatccctgagatcctgaagatccagatcatcggcctgggcacccaggtgtcccagaggcctggggcccaggccctgaaggtggaggccaagctggagcactggtacatcaccggcctgcggcagcaggacatcgtgcccagcctggtggccagcatcggggacaccaccagcagcctgctgaagatcaagtttgagaccaaccctgaggacagccctgctgaccagaccctcatcgtgcagagccagcctgtggaggtgatctatgatgccaagacagtgaatgctgtggtggagttcttccagagcaacaagggcctggacctggagcagatcaccagcgccaccctgatgaagctggaggagatcaaggagaggacagccaccggcctgacccacatcatcgagaccaggaaggtgctggacctgcgcatcaacctgaagcccagctacctggtggtgccccagacaggcttccaccacgagaagagtgacctgctgatcctggactttggcaccttccagctgaacagcaaggaccagggcctgcagaagaccaccaacagcagcctggaggagatcatggacaaggcctatgacaagtttgatgtggagatcaagaatgtgcagctgctgtttgcccgggcagaggagacctggaagaagtgccgcttccagcaccccagcaccatgcacatcctgcagcccatggacatccacgtggagctggccaaggccatggtggagaaggacatccgcatggcccgcttcaaggtgtctgggggcctgcccctgatgcacgtgcgcatcagtgaccagaagatgaaggatgtgctgtacctgatgaacagcatccccctgccccagaagagcagcgcccagagccctgagcggcaggtgagcagcatccccatcatcagcggcggcaccaagggcctgctgggcaccagcctgctgctggacacagtggagagcgagagtgatgatgagtactttgatgctgaagatggagagccccagacctgcaagtccatgaagggcagcgagctgaagaaggctgctgaggtgcccaatgaggagctgatcaacctgctgctgaagtttgagatcaaggaggtgatcctggagttcaccaagcagcagaaggaggaggacaccatcctggtgttcaacgtgacccagctgggcacagaggccaccatgaggacctttgacctgactgtggtgtcctacctgaagaagatcagcctggactaccatgaaattgagggcagcaagaggaagcccctgcacctgatcagcagcagtgacaagccaggcctggacctgctgaaggtggagtacatcaaggctgacaagaatggccccagcttccagacagccttcggcaagacagagcagacagtgaaggtggccttcagcagcctgaacctgctgctgcagacccaggccctggtggccagcatcaactacctgaccaccatcatccccagtgatgaccagagcatctctgtggccaaggaggtgcagatcagcacagagaagcagcagaagaacagcaccctgcccaaggccatcgtgagcagccgggacagcgacatcatcgacttccggctgtttgccaagctgaatgccttctgtgtgattgtgtgcaatgagaagaacaacattgctgagatcaagatccagggcctggacagcagcctgagcctgcagagcaggaagcagagcctgtttgcccggctggagaacatcatcgtgacagatgtggaccccaagacagtgcacaagaaggctgtgtccatcatgggaaatgaggtgttccgcttcaacctggacctgtacccagatgccacagaaggagacctgtacacagacatgagcaaggtggatggagtgctgagcctgaatgtgggctgcatccagatcgtgtacctgcacaagttcctgatgagcctgctgaacttcctgaacaacttccagacagccaaggagagcctgtctgctgccacagcccaggccgctgagagagctgccacctctgtgaaggacctggcccagaggagcttccgggtgtccatcaacatcgacctgaaggcccctgtgattgtcatcccccagagcagcatcagcaccaatgctgtggtggtggacctgggcctcatccgggtgcacaaccagttcagcctggtgtctgatgaggactacctgaacccccctgtgattgacaggatggatgtgcagctgaccaagctgaccctgtaccgcaccgtcatccagcccggcatctaccacccagacatccagctgctgcaccccatcaacctggagttcctggtgaacagaaacctggccgcctcctggtaccacaaggtgcctgtggtggagatcaagggccacctggacagcatgaatgtgtccctgaaccaggaggacctgaacctgctcttccgcatcctgacagagaacctgtgtgagggcacagaggacctggacaaggtgaagccccgggtgcaggagaccggggagatcaaggagcccctggagatcagcatcagccaggatgtgcatgacagcaagaacaccctgaccaccggggtggaggagatccgctctgtggacatcatcaacatgctgctgaactttgagatcaaggaggtggtggtgaccctgatgaagaagtctgagaagaagggccggcccctgcacgagctgaatgtgctgcagctgggcatggaggccaaggtgaagacctatgacatgacagccaaggcctacctgaagaagatctccatgcagtgctttgacttcacagacagcaagggggagcccctgcacatcatcaacagcagcaatgtgacagatgagcccctgctgaagatgctgctgaccaaggctgacagtgatggccctgagttcaagaccatccatgacagcaccaagcagaggctgaaggtgtcctttgccagcctggacctggtgctgcacctggaggccctgctgtccttcatggacttcctgagcagcgctgcccccttcagcgagcccagcagcagcgagaaggagagcgagctgaagcccctggtgggggagagccgcagcattgctgtgaaggctgtgagcagcaacatcagccagaaggatgtgtttgacctgaagatcacagctgagctgaatgccttcaacgtgtttgtgtgtgaccagaagtgcaacattgctgacatcaagatccacggcatggatgccagcatctctgtgaagcccaagcagacagatgtgtttgcccggctgaaggacatcatcgtgatgaatgtggacctgcagagcatccacaagaaggctgtgtccatcctgggagatgaggtgttccgcttccagctgaccctgtacccagatgccacagaaggagaggcctatgctgacatgagcaaggtggatggcaagctgtccttcaaggtgggctgcatccagatcgtgtatgtgcacaagttcttcatgagcctgctgaacttcctgaacaacttccagacagccaaggaggccctgagcacagccaccgtgcaggccgctgagcgggccgccagctccatgaaggacctggcccagaagagcttccggctgctgatggacatcaacctgaaggcccctgtgatcatcatcccccagagctctgtgagccccaatgctgtgattgctgacctgggcctcatccgggtggagaacaagttcagcctggtgcccatggagcactacagcctgccccctgtgattgacaagatgaacatcgagctgacccagctgaagctgagcaggaccatcctgcaggccagcctgccccagaatgacatcgagatcctgaagcctgtgaacatgctgctgagcatccagaggaacctggccgccgcctggtacgtgcagatccctggcatggagatcaagggcaagctgaagcccatgcaggtggccctgtctgaagatgacctgactgtgctgatgaagatcctgctggagaacctgggggaggccagcagccagcccagccccacccagagcgtgcaggagaccgtgcgggtgaggaaggtggatgtgtcctctgtgcctgaccacctgaaggagcaggaggactggacagacagcaagctgtccatgaaccagatcgtgtccctgcagtttgacttccactttgagagcctgagcatcatcctgtacaacaatgacatcaaccaggagagcggcgtggccttccacaatgacagcttccagctgggggagctgcggctgcacctgatggccagcagcggcaagatgttcaaggatggctccatgaatgtgtctgtgaagctgaagacctgcaccctggatgacctgcgggagggcatcgagcgggccaccagcaggatgattgacaggaagaatgaccaggacaacaacagctccatgattgacatctcctacaagcaggacaagaatggcagccagattgatgctgtgctggacaagctgtatgtgtgtgcctctgtggagttcctgatgacagtggccgacttcttcatcaaggctgtgccccagagcccagaaaatgtggccaaggagacccagatcctgccccggcagacagccaccgggaaggtgaagattgagaaggatgacagcgtgcggcccaacatgaccctgaaggccatgatcacagatcctgaggtggtgtttgtggccagcctgaccaaggcagatgccccagccctgacagccagcttccagtgcaacctgagcctgagcaccagcaagctggagcagatgatggaggcctctgtgcgggacctgaaggtgctggcctgccccttcctgcgggagaagaggggcaagaacatcaccaccgtgctgcagccctgcagcctcttcatggagaagtgcacctgggccagcggcaagcagaacatcaacatcatggtgaaggagttcatcatcaagatcagccccatcatcctgaacacagtgctgaccatcatggccgccctgagccccaagaccaaggaggatggcagcaaggacaccagcaaggagatggagaacctgtggggcatcaagagcatcaatgactacaacacctggttcctgggcgtggacacagccacagagatcacagagagcttcaagggcatcgagcacagcctcatcgaggagaactgtggggtggtggtggagagcatccaggtgaccctggagtgtggcctgggccacaggacagtgcccctgctgctggccgagagcaagttcagcggcaacatcaagaactggaccagcctgatggctgctgtggctgatgtgaccctgcaggtgcactactacaatgagatccatgctgtgtgggagcccctcatcgagcgggtggagggcaagaggcagtggaacctgcggctggatgtgaagaagaaccctgtgcaggacaagagcctgctgcctggagatgacttcatccctgagccccagatggccatccacatcagcagcggcaacaccatgaacatcaccatcagcaagagctgcctgaatgtgttcaacaacctggccaagggcttcagcgagggcacagccagcacctttgactacagcctgaaggaccgggcccccttcaccgtgaagaatgctgtgggcgtgcccatcaaggtgaagcccaactgcaacctgcgggtgatgggcttccctgagaagagtgacatctttgatgtggatgctggccagaacctggagctggagtatgcctccatggtgcccagcagccagggcaacctgagcatcctgagccggcaggagagcagcttcttcaccctgaccatcgtgccccacggctacacagaggtggccaacatccctgtggcccggcccggccggcggctgtacaacgtgaggaaccccaatgccagccacagcgacagcgtgctggtgcagattgatgccacagagggcaacaaggtgatcaccctgcggagccccctgcagatcaagaaccacttcagcatcgccttcatcatctacaagtttgtgaagaatgtgaagctgctggagcgcatcggcatcgcccggcctgaggaggagttccacgtgcccctggacagctaccgctgccagctgttcatccagcctgctggcatcctggagcaccagtacaaggagagcaccacctacatctcctggaaggaggagctgcacaggagccgggaggtgcgctgcatgctgcagtgccccagcgtggaggtgtccttcctgcccctcatcgtgaacacagtggccctgcctgatgagctgagctacatctgcacccacggggaggactgggatgtggcctacatcatccacctgtaccccagcctgaccctgaggaacctgctgccctacagcctgcgctacctgctggagggcacagctgagacccatgagctggccgagggcagcacagcagatgtgctgcacagccgcatctctggagagatcatggagctggtgctggtgaagtaccagggcaagaactggaatggccacttccgcatccgggacaccctgcctgagttcttccctgtgtgcttcagcagtgacagcacagaggtgaccaccgtggacctgtctgtgcacgtgcggcgcatcggcagcaggatggtgctgtctgtgttcagcccctactggctgatcaacaagaccaccagggtgctgcagtacagaagtgaggacatccacgtgaagcaccctgctgacttccgggacatcatcctcttctccttcaagaagaagaacatcttcaccaagaacaaggtgcagctgaagatcagcaccagcgcctggagcagcagcttcagcctggacacagtgggcagctatggctgtgtgaagtgcccagccaacaacatggagtacctggtgggcgtgtccatcaagatgagcagcttcaacctgagcagaattgtgaccctgacccccttctgcaccatcgccaacaagagcagcctggagctggaggtgggggagatcgccagtgatggctccatgcccaccaacaagtggaactacatcgccagcagtgaatgtctgcccttctggccagagagcctgagcggcaagctgtgtgtgcgggtggtgggctgtgagggcagcagcaagcccttcttctacaaccggcaggacaatggcaccctgctgagcctggaggacctgaatggaggcatcctggtggatgtgaacacagctgagcacagcaccgtcatcaccttcagtgactaccacgagggcagcgccccagccctgatcatgaaccacaccccctgggacatcctgacctacaagcagagcggcagccctgaggagatggtgctgctgccccggcaggcccggctgtttgcctgggccgaccccaccggcaccaggaagctgacctggacctatgctgccaacgtgggggagcatgacctgctgaaggatggctgcggccagttcccctatgatgccaacatccagatccactgggtgtccttcctggatggccggcagagggtgctgctcttcacagatgatgtggccctggtgtccaaggccctgcaggccgaggagatggagcaggccgactatgagatcaccctgagcctgcacagcctgggcctgagcctggtgaacaatgaaagcaagcaggaggtgtcctacatcggcatcaccagcagtggagtggtgtgggaggtgaagcccaagcagaagtggaagcccttcagccagaagcagatcatcctgctggagcagagctaccagaagcaccagatcagccgggaccacggctggatcaagctggacaacaactttgaggtgaactttgacaaggaccccatggagatgaggctgcccatccgcagccccatcaagagggacttcctgagcggcatccagatcgagttcaagcagagcagccaccagaggagcctgcgggcccggctgtactggctgcaggtggacaaccagctgcccggggccatgtttcctgtggtgttccaccctgtggccccacccaagagcatcgccctggacagcgagcccaagcccttcattgatgtgtctgtcatcacccgcttcaatgagtacagcaaggtgctgcagttcaagtacttcatggtgctgatccaggagatggccctgaagattgaccagggcttcctgggcgccatcatcgccctcttcacccccaccacagatcctgaggccgagaggaggaggaccaagctgatccagcaggacattgatgccctgaatgctgagctgatggagacctccatgacagacatgagcatcctgtccttctttgagcacttccacatcagccctgtgaagctgcacctgagcctgagcctgggcagcggcggggaggagagtgacaaggagaagcaggagatgtttgctgtgcacagcgtgaacctgctgctgaagagcatcggggccaccctgacagatgtggatgacctgatcttcaagctggcctactatgagatccgctaccagttctacaagagggaccagctgatctggagcgtggtgcgccactacagcgagcagttcctgaagcagatgtatgtgctggtgctgggcctggatgtgctgggcaaccccttcggcctcatccggggcctgtctgagggcgtggaggccctcttctatgagcccttccagggcgctgtgcagggccctgaggagtttgctgagggcctggtgattggagtgcgcagcctgtttggccacacagtgggcggcgctgctggggtggtgagccgcatcaccggctctgtgggcaagggcctggccgccatcaccatggacaaggagtaccagcagaagaggcgggaggagctgagccggcagccccgggactttggagacagcctggcccggggcggcaagggcttcctgcggggcgtggtgggcggcgtgacaggcatcatcaccaagcctgtggagggcgccaagaaggagggcgctgctggcttcttcaagggcatcggcaagggcctggtgggcgctgtggcccggcccactggaggcatcgtggacatggccagcagcaccttccagggcatccagagagctgctgagagcacagaggaggtgagcagcctgcggccccccaggctcatccatgaagatggcatcatccggccctatgaccggcaggagagcgagggcagtgacctgctggagcaggagctggagatccaggagtag

SEQ ID NO: 43457 - DNA, 10758 bp, Artificial Sequence
  Description of Artificial Sequence: Synthetic coding sequence
atggtgctggagagcgtggtggccgacctgctgaaccgcttcctgggggactatgtggagaacctgaacaagagccagctgaagctgggcatctggggcggcaatgtggccctggacaacctgcagatcaaggaaaatgccctgtctgagctggatgtgcccttcaaggtgaaggccggccagattgacaagctgaccctgaagatcccctggaagaacctgtatggagaggccgtggtggccaccctggagggcctgtacctgctggtggtgcctggggccagcatcaagtatgatgctgtgaaggaggagaagagcctgcaggatgtgaagcagaaggagctgagccgcatcgaggaggccctgcagaaggctgctgagaaggacaagcccaaggaggccaagaaggacacctttgtggagaagctggccacccaggtgatcaagaatgtgcaggtgaagatcacagacatccacatcaagtatgaagatgatgtgacagaccccaagaggcccctgagctttggagtgaccctgggggagctgagcctgctgacagccaatgagcactggaccccctgcatcctgaatgaagctgacaagatcatctacaagctgatccggctggacagcctgagcgcctactggaatgtgaactgcagcatgagctaccagaggagccgggagcagatcctggaccagctgaagaatgagatcctgaccagcggcaacatcccccccaactaccagtacatcttccagcccatcagcgccagcgccaagctgtacatgaacccctatgcagagagcgagctgaagacccccaagctggactgcaacatcgagatccagaacatcgccatcgagctgaccaagccccagtacctgtccatgattgacctgctggagagcgtggactacatggtgagaaatgccccctacaggaagtacaagccctacctgcccctgcacaccaacggccgccgctggtggaagtatgccattgattctgtgctggaggtgcacatccgccgctacacccagatgtggagctggagcaacatcaagaagcaccggcagctgctgaagagctacaagatcgcctacaagaacaagctgacccagagcaaggtgtctgaggagatccagaaggagatccaggacctggagaagaccctggatgtgttcaacatcatcctggcccggcagcaggcccaggtggaggtgatccgcagcggccagaagctgaggaagaagtctgctgacacaggagagaagaggggcggctggttcagcggcctgtggggcaagaaggagagcaagaagaaggatgaggagagcctcatccctgagaccattgatgacctgatgaccccagaggagaaggacaagctgttcaccgccatcggctacagcgagagcacccacaacctgaccctgcccaagcagtatgtggcccacatcatgaccctgaagctggtgtccacctctgtgaccatccgggagaacaagaacatccctgagatcctgaagatccagatcatcggcctgggcacccaggtgtcccagaggcctggggcccaggccctgaaggtggaggccaagctggagcactggtacatcaccggcctgcggcagcaggacatcgtgcccagcctggtggccagcattggagacaccaccagcagcctgctgaagatcaagtttgagaccaaccctgaggacagccctgctgaccagaccctgattgtgcagagccagcctgtggaggtgatctatgatgccaagacagtgaatgctgtggtggagttcttccagagcaacaagggcctggacctggagcagatcaccagcgccaccctgatgaagctggaggagatcaaggagaggacagccaccggcctgacccacatcatcgagaccaggaaggtgctggacctgcgcatcaacctgaagcccagctacctggtggtgccccagacaggcttccaccacgagaagagtgacctgctgatcctggactttggcaccttccagctgaacagcaaggaccagggcctgcagaagaccaccaacagcagcctggaggagatcatggacaaggcctatgacaagtttgatgtggagatcaagaatgtgcagctgctgtttgcccgggcagaggagacctggaagaagtgccgcttccagcaccccagcaccatgcacatcctgcagcccatggacatccacgtggagctggccaaggccatggtggagaaggacatccgcatggcccgcttcaaggtgtctgggggcctgcccctgatgcacgtgcgcatcagtgaccagaagatgaaggatgtgctgtacctgatgaacagcatccccctgccccagaagagcagcgcccagagccctgagcggcaggtgagcagcatccccatcatcagcggcggcaccaagggcctgctgggcaccagcctgctgctggacacagtggagagcgagagtgatgatgagtactttgatgctgaagatggagagccccagacctgcaagtccatgaagggcagcgagctgaagaaggctgctgaggtgcccaatgaggagctgatcaacctgctgctgaagtttgagatcaaggaggtgatcctggagttcaccaagcagcagaaggaggaggacaccatcctggtgttcaacgtgacccagctgggcacagaggccaccatgaggacctttgacctgactgtggtgtcctacctgaagaagatcagcctggactaccacgagattgagggcagcaagaggaagcccctgcacctgatcagcagcagtgacaagccaggcctggacctgctgaaggtggagtacatcaaggctgacaagaatggccccagcttccagacagccttcggcaagacagagcagacagtgaaggtggccttcagcagcctgaacctgctgctgcagacccaggccctggtggccagcatcaactacctgaccaccatcatccccagtgatgaccagagcatctctgtggccaaggaggtgcagatcagcacagagaagcagcagaagaacagcaccctgcccaaggccatcgtgagcagccgggacagcgacatcatcgacttccggctgtttgccaagctgaatgccttctgtgtgattgtgtgcaatgagaagaacaacattgctgagatcaagatccagggcctggacagcagcctgagcctgcagagcaggaagcagagcctgtttgcccggctggagaacatcatcgtgacagatgtggaccccaagacagtgcacaagaaggctgtgtccatcatgggaaatgaggtgttccgcttcaacctggacctgtacccagatgccacagaaggagacctgtacacagacatgagcaaggtggatggagtgctgagcctgaatgtgggctgcatccagatcgtgtacctgcacaagttcctgatgagcctgctgaacttcctgaacaacttccagacagccaaggagagcctgtctgctgccacagcccaggccgctgagcgggccgccacctctgtgaaggacctggcccagaggagcttccgggtgtccatcaacatcgacctgaaggcccctgtgattgtcatcccccagagcagcatcagcaccaatgctgtggtggtggacctgggcctcatccgggtgcacaaccagttcagcctggtgtctgatgaggactacctgaacccccctgtgattgacaggatggatgtgcagctgaccaagctgaccctgtacagaactgtcatccagcccggcatctaccacccagacatccagctgctgcaccccatcaacctggagttcctggtgaacagaaacctggccgcctcctggtaccacaaggtgcctgtggtggagatcaagggccacctggacagcatgaatgtgtccctgaaccaggaggacctgaacctgctcttccgcatcctgacagagaacctgtgtgagggcacagaggacctggacaaggtgaagccccgggtgcaggagactggagagatcaaggagcccctggagatcagcatcagccaggatgtgcatgacagcaagaacaccctgaccactggagtggaggagatccgctctgtggacatcatcaacatgctgctgaactttgagatcaaggaggtggtggtgaccctgatgaagaagtctgagaagaagggccggcccctgcacgagctgaatgtgctgcagctgggcatggaggccaaggtgaagacctatgacatgacagccaaggcctacctgaagaagatctccatgcagtgctttgacttcacagacagcaaaggagagcccctgcacatcatcaacagcagcaatgtgacagatgagcccctgctgaagatgctgctgaccaaggctgacagtgatggccctgagttcaagaccatccatgacagcaccaagcagaggctgaaggtgtcctttgccagcctggacctggtgctgcacctggaggccctgctgtccttcatggacttcctgagcagcgctgcccccttcagcgagcccagcagcagcgagaaggagagcgagctgaagcccctggtgggggagagccgcagcattgctgtgaaggctgtgagcagcaacatcagccagaaggatgtgtttgacctgaagatcacagctgagctgaatgccttcaacgtgtttgtgtgtgaccagaagtgcaacattgctgacatcaagatccacggcatggatgccagcatctctgtgaagcccaagcagacagatgtgtttgcccggctgaaggacatcatcgtgatgaatgtggacctgcagagcatccacaagaaggctgtgtccatcctgggagatgaggtgttccgcttccagctgaccctgtacccagatgccacagaaggagaggcctatgctgacatgagcaaggtggatggcaagctgtccttcaaggtgggctgcatccagatcgtgtatgtgcacaagttcttcatgagcctgctgaacttcctgaacaacttccagacagccaaggaggccctgagcacagccaccgtgcaggccgctgagagagctgccagctccatgaaggacctggcccagaagagcttccggctgctgatggacatcaacctgaaggcccctgtgatcatcatcccccagagctctgtgagccccaatgctgtgattgctgacctgggcctcatccgggtggagaacaagttcagcctggtgcccatggagcactacagcctgccccctgtgattgacaagatgaacatcgagctgacccagctgaagctgagcaggaccatcctgcaggccagcctgccccagaatgacatcgagatcctgaagcctgtgaacatgctgctgagcatccagaggaacctggccgccgcctggtacgtgcagatccctggcatggagatcaagggcaagctgaagcccatgcaggtggccctgtctgaagatgacctgactgtgctgatgaagatcctgctggagaacctgggggaggccagcagccagcccagccccacccagagcgtgcaggagaccgtgcgggtgaggaaggtggatgtgtcctctgtgcctgaccacctgaaggagcaggaggactggacagacagcaagctgtccatgaaccagatcgtgtccctgcagtttgacttccactttgagagcctgagcatcatcctgtacaacaatgacatcaaccaggagagcggcgtggccttccacaatgacagcttccagctgggggagctgcggctgcacctgatggccagcagcggcaagatgttcaaggatggctccatgaatgtgtctgtgaagctgaagacctgcaccctggatgacctgcgggagggcatcgagcgggccaccagcaggatgattgacaggaagaatgaccaggacaacaacagctccatgattgacatctcctacaagcaggacaagaatggcagccagattgatgctgtgctggacaagctgtatgtgtgtgcctctgtggagttcctgatgacagtggccgacttcttcatcaaggctgtgccccagagcccagaaaatgtggccaaggagacccagatcctgccccggcagacagccaccgggaaggtgaagattgagaaggatgattctgtgcggcccaacatgaccctgaaggccatgatcacagatcctgaggtggtgtttgtggccagcctgaccaaggcagatgccccagccctgacagccagcttccagtgcaacctgagcctgagcaccagcaagctggagcagatgatggaggcctctgtgcgggacctgaaggtgctggcctgccccttcctgcgggagaagaggggcaagaacatcaccaccgtgctgcagccctgcagcctcttcatggagaagtgcacctgggccagcggcaagcagaacatcaacatcatggtgaaggagttcatcatcaagatcagccccatcatcctgaacacagtgctgaccatcatggccgccctgagccccaagaccaaggaggatggcagcaaggacaccagcaaggagatggagaacctgtggggcatcaagagcatcaatgactacaacacctggttcctgggcgtggacacagccacagagatcacagagagcttcaagggcatcgagcacagcctgattgaggagaactgtggggtggtggtggagagcatccaggtgaccctggagtgtggcctgggccacaggacagtgcccctgctgctggccgagagcaagttcagcggcaacatcaagaactggaccagcctgatggctgctgtggctgatgtgaccctgcaggtgcactactacaatgagatccatgctgtgtgggagcccctgattgagcgggtggagggcaagaggcagtggaacctgcggctggatgtgaagaagaaccctgtgcaggacaagagcctgctgcctggagatgacttcatccctgagccccagatggccatccacatcagcagcggcaacaccatgaacatcaccatcagcaagagctgcctgaatgtgttcaacaacctggccaagggcttcagcgagggcacagccagcacctttgactacagcctgaaggaccgggcccccttcaccgtgaagaatgctgtgggcgtgcccatcaaggtgaagcccaactgcaacctgcgggtgatgggcttccctgagaagagtgacatctttgatgtggatgctggccagaacctggagctggagtatgcctccatggtgcccagcagccagggcaacctgagcatcctgagccggcaggagagcagcttcttcaccctgaccatcgtgccccacggctacacagaggtggccaacatccctgtggcccggcctggaagaagactctacaacgtgaggaaccccaatgccagccacagcgacagcgtgctggtgcagattgatgccacagagggcaacaaggtgatcaccctgcggagccccctgcagatcaagaaccacttcagcatcgccttcatcatctacaagtttgtgaagaatgtgaagctgctggagagaattggaattgcccggcctgaggaggagttccacgtgcccctggacagctaccgctgccagctgttcatccagcctgctggcatcctggagcaccagtacaaggagagcaccacctacatctcctggaaggaggagctgcacaggagccgggaggtgcgctgcatgctgcagtgccccagcgtggaggtgtccttcctgcccctgattgtgaacacagtggccctgcctgatgagctgagctacatctgcacccatggagaggactgggatgtggcctacatcatccacctgtaccccagcctgaccctgaggaacctgctgccctacagcctgcgctacctgctggagggcacagctgagacccatgagctggccgagggcagcacagcagatgtgctgcacagccgcatcagcggggagatcatggagctggtgctggtgaagtaccagggcaagaactggaatggccacttccgcatccgggacaccctgcctgagttcttccctgtgtgcttcagcagtgacagcacagaggtgaccaccgtggacctgtctgtgcacgtgagaagaattggcagcaggatggtgctgagcgtcttcagcccctactggctgatcaacaagaccaccagggtgctgcagtacagaagtgaggacatccacgtgaagcaccctgctgacttccgggacatcatcctcttctccttcaagaagaagaacatcttcaccaagaacaaggtgcagctgaagatcagcaccagcgcctggagcagcagcttcagcctggacacagtgggcagctatggctgtgtgaagtgcccagccaacaacatggagtacctggtgggcgtgtccatcaagatgagcagcttcaacctgagccgcatcgtgaccctgacccccttctgcaccatcgccaacaagagcagcctggagctggaggtgggggagatcgccagtgatggctccatgcccaccaacaagtggaactacatcgccagcagcgagtgcctgcccttctggccagagagcctgagcggcaagctgtgtgtgcgggtggtgggctgtgagggcagcagcaagcccttcttctacaaccggcaggacaatggcaccctgctgagcctggaggacctgaatggaggcatcctggtggatgtgaacacagctgagcacagcaccgtcatcaccttcagtgactaccacgagggcagcgccccagccctgatcatgaaccacaccccctgggacatcctgacctacaagcagagcggcagccctgaggagatggtgctgctgccccggcaggcccggctgtttgcctgggccgaccccaccggcaccaggaagctgacctggacctacgccgccaacgtgggggagcatgacctgctgaaggatggctgcggccagttcccctatgatgccaacatccagatccactgggtgtccttcctggatggccggcagagggtgctgctcttcacagatgatgtggccctggtgtccaaggccctgcaggccgaggagatggagcaggccgactatgagatcaccctgagcctgcacagcctgggcctgagcctggtgaacaatgaaagcaagcaggaggtgtcctacatcggcatcaccagcagcggcgtggtgtgggaggtgaagcccaagcagaagtggaagcccttcagccagaagcagatcatcctgctggagcagagctaccagaagcaccagatcagccgggaccacggctggatcaagctggacaacaactttgaggtgaactttgacaaggaccccatggagatgaggctgcccatccgcagccccatcaagagggacttcctgagcggcatccagatcgagttcaagcagagcagccaccagaggagcctgcgggcccggctgtactggctgcaggtggacaaccagctgcccggggccatgtttcctgtggtgttccaccctgtggccccacccaagagcatcgccctggacagcgagcccaagcccttcattgatgtgtctgtcatcacccgcttcaatgagtacagcaaggtgctgcagttcaagtacttcatggtgctgatccaggagatggccctgaagattgaccagggcttcctgggcgccatcatcgccctcttcacccccaccacagatcctgaggccgagaggaggaggaccaagctgatccagcaggacattgatgccctgaatgctgagctgatggagacctccatgacagacatgagcatcctgtccttctttgagcacttccacatcagccctgtgaagctgcacctgagcctgagcctgggcagcggcggggaggagagtgacaaggagaagcaggagatgtttgctgtgcacagcgtgaacctgctgctgaagagcattggagccaccctgacagatgtggatgacctgatcttcaagctggcctactatgagatccgctaccagttctacaagagggaccagctgatctggagcgtggtgcgccactacagcgagcagttcctgaagcagatgtatgtgctggtgctgggcctggatgtgctgggcaaccccttcggcctcatccggggcctgtctgaaggagtggaggccctcttctatgagcccttccagggcgctgtgcagggccctgaggagtttgctgagggcctggtgattggagtgcgcagcctgtttggccacacagtgggcggggccgccggcgtggtgagccgcatcactggatctgtgggcaagggcctggccgccatcaccatggacaaggagtaccagcagaagagaagagaggagctgagccggcagccccgggactttggagacagcctggcccggggcggcaagggcttcctgcggggcgtggtgggcggcgtgacaggcatcatcaccaagcctgtggagggcgccaagaaggagggcgccgccggcttcttcaagggcatcggcaagggcctggtgggcgctgtggcccggcccaccggcggcatcgtggacatggccagcagcaccttccagggcatccagagagctgctgagagcacagaggaggtgagcagcctgcggccccccaggctcatccatgaagatggcatcatccggccctatgaccggcaggagagcgagggcagtgacctgctggagcaggagctggagatccaggagtag

SEQ ID NO: 43458 - DNA, 13092 bp, Artificial Sequence
  Description of Artificial Sequence: Synthetic coding sequence
atgctggagggcctggtggcctgggtgctgaacacctacctgggcaagtatgtgaacaacctgaacacagaccagctgtctgtggccctgctgaagggagctgtggagctggagaacctgcccctgaagaaggatgccctgaaggagctggagctgccctttgaggtgaaggccggcttcatcggcaaggtgaccctgcagatccccttctaccggccccacgtggacccctgggtgatcagcatcagcagcctgcacctgattggagcccctgagaagatccaggacttcaatgatgagaaggagaagctgctggagcgggagaggaagaaggccctgctgcaggccctggaggagaagtggaagaatgaccggcagcagaagggggagagctactggtacagcgtgacagcctctgtggtgacccgcatcgtggagaacatcgagctgaagatccaggatgtgcacctgcgctttgaagatggagtgaccaaccccagccacccctttgccttcggcatctgcatcaagaatgtgtccatgcagaatgctgtgaatgaacctgtgcagaagctgatgaggaagaagcagctggatgtggccgagttcagcatctactgggatgtggactgcaccctgctgggggacctgccccagatggagctgcaggaggccatggcccgctccatggagagccgcagccaccactacgtgctggagcctgtgtttgccagcgccctgctgaagaggaactgcagcaagaagcccctgcggagccgccacagccccagaattgactgtgacatccagctggagaccatccccctgaagctgagccagctgcagtaccggcagatcatggagttcctgaaggagctggagaggaaggagcggcaggtgaagttccgccgctggaagcccaaggtggccatcagcaagaactgccgggagtggtggtactttgccctgaatgccaacctgtatgagatccgggagcagaggaagcgctgcacctgggacttcatgctgcaccgggccagagatgctgtgtcctacacagacaagtacttcaacaagctgaagggcggcctgctgagcacagatgacaaggaggagatgtgccgcatcgaggaggagcagagctttgaggagctgaagatcctgcgggagctggtgcatgaccgcttccacaagcaggaggagctggccgagagcctgcgggagccccagtttgacagccctggggcctgccctggggcccctgagcccggcggcggcagcggcatgctgcagtacctgcagagctggttccctggctggggcggctggtacggccagcagaccccagagggcaatgtggtggagggcctgtctgctgagcagcaggagcagtggatccctgaggagatcctgggcacagaggagttctttgaccccacagcagatgccagctgcatgaacacctacaccaagagggaccacgtgtttgccaagctgaacctgcagctgcagaggggcaccgtgaccctgctgcacaaggagcagggcaccccccagatgaatgaaagtgccttcatgcagctggagttcagtgatgtgaagctgctggccgagagcctgcccaggaggaacagcagcctgctgtctgtgcggctgggcggcctcttcctgcgggacctggccacagagggcaccatgttccccctgctggtgttccccaacccccagaaggaggtgggccgggtgtcccagagctttggcctgcagaccaccagcgctgacagaagtgaccactacccagctgctgaccctgatggccctgtgtttgagatgctgtatgaaagaaatcctgcccacagccactttgagcggcggctgaatgtgtccacccggcccctgaacatcatctacaacccccaggccatcaagaaggtggccgacttcttctacaagggcaaggtgcacaccagcggcttcggctaccagagcgagctggagctgcgggtggccgaggccgcccggcggcagtacaacaagctgaagatgcagaccaaggccgagatccggcagaccctggaccggctgctggtgggggacttcatcgaggagagcaagcgctggacagtgcggctggacatcagcgccccccaggtgatcttcccagatgacttcaagttcaagaaccctgtgctggtggtggtggacctgggccgcatgctgctgaccaacacccaggacaacagcaggaggaagagcagagatggcagcgccagcgaggagacccagttcagtgatgatgagtacaagacccccctggccaccccacccaacaccccacctcctgagagcagcagcagcaatggagagaagaccccacccttctctggagtggagttcagcgaggagcagctgcaggcccacctgatgagcaccaagatgtatgaaagatacagcctgtccttcatggacctgcagatcatggtgggccgggtgaaggacaactggaagcacgtgcaggacattgatgtgggccccacccacgtggtggagaagttcaacgtgcacctgcagctggagcggcggctcatctacaccagtgaccccaagtacccaggagctgtgctgagcggcaacctgcctgacctgaagatccacatcaatgaagacaagatcagcgccctgaagaactgctttgccctgctgaccaccccagagatgaagaccagtgacacccagatcaaggagaagatcttcccccaggaggagcagaggggcagcctgcaggacagcgtgatgaacctgacccagagcatcgtgctgctggagcagcacacccgggaggtgctggtggagagccagctgctgctggccgagttcaaggtgaactgcatgcagctgggcgtggagagcaatggccgctacatctctgtgctgaaggtgtttggcaccaatgcccactttgtgaagaggccctatgatgctgaggtgtccctgactgtgcacggcctgctgctggtggacaccatgcagacctacggggctgactttgacctgctgatggccagccacaagaacctgagctttgacatccccaccggcagcctgcgggacagccgggcccagagccctgtgtctggccccaacgtggcccacctgacagatggagccaccctgaatgacagaagtgccacctctgtgtccctggacaagatcctgaccaaggagcaggagagcctcatcaagctggagtaccagtttgtgtcctctgagtgccccagcatgaacctggacagcaccctgcaggtgatcagcctgcaggtgaacaacctggacatcatcctgaaccctgagaccatcgtggagctgattggcttcctgcagaagagcttccccaaggagaaggatgacctgagcccccagcccctgatgacagactttgagaggagcttccgggagcagggcacctaccagagcacctatgagcagaacacagaggtggccgtggagatccaccggctgaacctgctgctgctgaggacagtgggcatggccaaccgggagaagtatggcaggaagatcgccacagccagcatcggcggcaccaaggtgaatgtgtccatgggcagcacctttgacatgaatggcagcctgggctgcctgcagctgatggacctgacccaggacaacgtgaagaaccagtatgtggtgtccatcggcaacagcgtgggctatgagaacatcatcagtgacatcggctactttgagagcgtgtttgtgaggatggaggatgctgccctgacagaggccctgtccttcacctttgtggagaggagcaagcaggagtgcttcctgaacctgaagatggccagcctgcactacaaccacagcgccaagttcctgaaggagctgaccctgtccatggatgagctggaggagaacttccggggcatgctgaagtctgctgccaccaaggtgaccaccgtgctggccaccaagacagctgagtacagcgagatggtgtccctgtttgagacccccaggaagacccgggagcccttcatcctggaggagaatgagatctacggctttgacctggccagcagccacctggacacagtgaagctgatcctgaacatcaacatcgagagccctgtggtgtccatccccaggaagccaggcagccctgagctgctggtgggccacctgggccagatcttcatccagaactttgtggccggagatgatgagagcagaagtgaccggctgcaggtggagatcaaggacatcaagctgtacagcctgaactgcacccagctggccggccgggaggccgtgggcagcgagggcagcaggatgttctgccccccatctggcagcggcagcgccaacagccaggaggaggcccacttcaccaggcatgacttctttgagagcctgcaccggggccaggccttccacatcctgaacaacaccaccatccagttcaagctggagaagatccccatcgagcgggagagcgagctgaccttcagcctgagcccagatgacctgggcaccagcagcatcatgaagattgagggcaagtttgtgaaccctgtgcaggtggtgctggccaagcacgtgtatgagcaggtgctgcagaccctggacaacctggtgtacagcgaggacctgaacaagtacccagccagcgccaccagcagcccctgcccagacagccccctgccccccctgagcacctgtggggagagctctgtggagaggaaagaaaatggcctcttcagccacagcagcctgagcaacaccagccagaagagcctgtctgtgaaggaggtgaagagcttcacccagatccaggccaccttctgcatcagcgagctgcaggtgcagctgagcggggacctgaccctgggcgcccagggcctggtgtccctgaagttccaggactttgaggtggagttcagcaaggaccacccccagaccctgagcatccagatcgccctgcacagcctgctgatggaggacctgctggagaagaacccagacagcaagtacaagaacctgatggtgtccagaggagcccccaagcccagcagcctggcccagaaggagtacctgagccagagctgccccagcgtgtccaatgtggagtacccagacatgcccaggagcctgcccagccacatggaggaggcccccaacgtgttccagctgtaccagaggcccaccagcgccagcaggaagaagcagaaggaggtgcaggacaaggactaccccctgaccccaccacccagccccaccgtggatgagcccaagatcctggtgggcaagagcaagtttgatgacagcctggtgcacatcaacatcttcctggtggacaagaagcaccctgagttcagcagcagctacaacagagtgaacagaagcattgatgtggacttcaactgcctggatgtgctgatcaccctgcagacctgggtggtgatcctggacttctttggaattggcagcacagctgacaaccacgccatgaggctgcccccagagggcatcctgcacaacgtgaagctggagccccacgcctccatggagagcggcctgcaggaccctgtgaacaccaagctggacctgaaggtgcacagcctgagcctggtgctgaacaagaccaccagcgagctggccaaggccaacgtgtccaagctggtggcccacctggagatgattgaaggagacctggccctgcagggcagcatcggcagcctgagcctgagtgacctgacctgccacggggagttctaccgggagcgcttcaccaccagcggggaggaggccctgatcttccagaccttcaagtatggccgcccagaccccctgctgcggcgggagcatgacatccgggtgtccctgaggatggcctctgtgcagtatgtgcacacccagcgcttccaggccgaggtggtggccttcatccagcacttcacccagctgcaggatgtgctgggccggcagagagctgccatcgagggccagacagtgcgggaccaggcccagcgctgcagccgggtgctgctggacatcgaggccggggcccctgtgctgctgatccctgagagcagccgcagcaacaacctgattgtggccaacctgggcaagctgaaggtgaagaacaagttcctgtttgctggcttccctggcaccttcagcctgcaggacaaggagagcgtgcccagcgccagccccaccggcatccccaagcacagcctgaggaagaccaccagcacagaggagccccggggcacccacagccagggccagttcaccatgcccctggccggcatgagcctgggcagcctgaagtcagaatttgtgcccagcaccagcaccaagcagcagggcccccagcccaccctgtctgtgggccaggagagcagcagcccagaagatcatgtgtgcctgctggactgtgtggtggtggacctgcaggacatggacatctttgctgctgagcggcacccccgggagtacagcaaggcccctgaggacagcagcggggacctgatcttccccagctactttgtgcggcagacaggaggcagcctgctgacagagccctgccgcctgaagctgcaggtggagaggaacctggacaaggagatcagccacacagtgcctgacatcagcatccacggcaacctgagctctgtgcactgcagcctggacctgtacaagtacaagctgatccggggcctgctggagaacaacctgggggagcccatcgaggagttcatgaggccctatgacctgcaggacccccgcatccacacagtgctgagcggggaggtgtacacctgcatgtgcttcctgattgacatggtgaatgtgtccctggagctgaaggaccccaagaggaaggagggcgccggcagcctggccaggtttgacttcaagaagtgcaagctgctgtatgagagcttcagcaaccagaccaagagcatcaacctggtgagccacagcatgatggcctttgacaccaggtatgccggccagaagaccagccctggcatgaccaacgtgttcagctgcatcttccagcctgccaagaacagcagcaccacccagggcagcatccagatcgagctgcacttccgcagcaccaaggacagcagctgcttcaccgtggtgctgaacaacctgcgggtcttcctgatctttgactggctgctgctggtgcatgacttcctgcacacccccagcgacatcaagaagcagaaccacgtgacccccagccgccacaggaacagcagcagcgagagcgccatcgtgcccaagacagtgaagtctggagtggtgaccaagaggagcagcctgcctgtgtccaatgaaagacacctggaggtgaaggtgaatgtgactggaacagaatttgtggtgattgaagatgtgtcctgctttgacaccaatgccatcatcctgaagggcaccaccgtgctgacctacaagcccaggtttgtggaccggcccttcagcggcagcctgtttggaattgaggtgttcagctgccgcctgggcaatgaacatgacacagccctgagcatcgtggaccctgtgcagatccagatggagctggtgggcaacagcagctaccagaacagcagcggcctgatggatgccttcaacagcgaggacttcccccctgtgctggagatccagctgcaggccctggacatccggctgagctacaatgatgtgcagctgttcctggccatcgccaagagcatccctgagcaggccaatgctgctgtgcctgacagcgtggccctggagagtgacagcgtgggcacctacctgcccggggccagccgggtgggggaggagatccgggagggcaccaggcacaccctggaccctgtgctggagctgcagctggcccggctgcaggagctgggcttctccatggatgactgcaggaaggccctgctggcctgccagggccagctgaagaaggccgcctcctggctgttcaagaatgctgagcccctgaagagcctgagcctggccagcaccagccgggacagccctggagctgtggccgcccccctcatcagcggcgtggagatcaaggccgagagcgtgtgcatctgcttcattgatgactgcatggactgtgatgtgcccctggccgagctgaccttcagccggctgaacttcctgcagagggtgaggaccagccctgagggctacgcccacttcaccctgagcggggactactacaacagagccctgagcggctgggagcccttcatcgagccctggccctgcagcgtgtcctggcagcagcaggccgccagccggctgcaccccccccggctgaagctggaggccaaggccaagccccggctggacatcaacatcacctctgtgctgattgaccagtatgtgtccaccaaggagagctggatggctgactactgcaaggatgacaaggacatcgagagcgccaagtctgaggactggatgggcagctctgtggaccccccctgcttcggccagacagaggtgaagacccccaagaggcggcagccctttgtgccctttgccctgaggaaccacacaggctgcaccctgtggtttgccaccctgaccaccacccccaccagggctgccctgagccacagcggcagccctggggtggtgcctgagggcaatggcaccttcctggatgacacccacaacgtgtctgagtggagggaggtgctgaccggggaggagatcccctttgaatttgaggcccggggcaagctgcggcaccgccacacccatgacctgcgcatccaccagctgcaggtgcgggtgaatggctgggagcaggtgtcccctgtgtctgtggacaaggtgggcaccttcttccgctatgctgccccagacaagaacagcagcagcagcaccatcggcagccccagcagcaggaccaacatcatccacccccaggtgtacttcagcagcctgccccctgtgcgggtggtgtttgctgtgaccatggagggcagcgccaggaaggtgatcaccgtgcgcagcgccctgattgtgaggaaccggctggagacccccatggagctgcggctggacagccccagcgccccagacaagcctgtggtgctgcctgccatcatgcctggggacagctttgctgtgcccctgcacctgacctcctggaggctgcaggcccggcccaagggcctgggcgtcttcttctgcaaggcccccatccactggaccaacgtggtgaagacagctgagatcagcagcagcaagcgggagtgccacagcatggacacagagaagagccgcttcttccgcttctgtgtggccatcaagaaggagaactacccagactacatgcccagcaacatcttcagtgacagcgccaagcagatcttccggcagcccggccacaccatctacctgctgcccaccgtggtgatctgcaacctgctgccctgtgagctggacttctacgtgaagggcatgcccatcaatggcaccctgaagccaggcaaggaggccgccctgcacacagctgacaccagccagaacatcgagctgggcgtgtccctggagaacttccccctgtgcaaggagctgctgatccccccaggcacccagaactacatggtgaggatgaggctgtatgatgtgaacagacggcagctgaacctgaccatcagaattgtgtgcagagctgagggcagcctgaagatcttcatcagcgccccctactggctgatcaacaagacaggcctgcccctcatcttccggcaggacaatgccaagacagatgctgctggccagtttgaggagcacgagctggcccggagcctgagccccctgctcttctgctatgctgacaaggagcagcccaacctgtgcaccatgagaattggccggggcatccaccctgagggcatgcctggctggtgccagggcttcagcctggatggcggcagcggcgtgcgggccctgaaggtgatccagcagggcaacagacctggcctcatctacaacattggaattgatgtgaagaagggccggggccgctacatcgacacctgcatggtgatctttgccccccgctacctgctggacaacaagagcagccacaagctggcctttgcccagcgggagtttgcccggggccagggcacagccaaccctgagggctacatcagcaccctgcccggcagctctgtggtgttccactggcccagaaatgactatgaccagctgctgtgtgtgcggctgatggatgtgcccaactgcatctggagcggcggctttgaggtgaacaagaacaacagcttccacatcaacatgagggacaccctgggcaagtgcttcttcctgcgggtggagatcaccctgcggggggccacctaccgcatctccttcagtgacacagaccagctgcccccacccttcagaattgacaacttcagcaaggtgcctgtggtgttcacccagcacggcgtggccgagccccggctgaggacagaggtgaagcccatgaccagcctggactatgcctgggatgagcccaccctgccccccttcatcaccctgactgtgaagggggccggcagcagcgagatcaactgcaacatgaatgacttccaggacaaccggcagctgtactatgagaacttcatctacatcgccgccacctacaccttcagcggcctgcaggagggcaccggccggcctgtggccagcaacaaggccatcacctgtgccgagctggtgctggatgtgagccccaagacccagagggtcatcctgaagaagaaggagcccgggaagaggagccagctgtggaggatgacaggcaccggcatgctggcccacgagggcagctctgtgccccacaaccccaacaagcccagcgctgcccggagcacagagggcagcgccatcctggacattgctggcctggccgctgtgacagacaacagatatgagcccctgatgctgaggaagccagacagaagaagaagcaccacccagacctggagcttccgggagggcaagctgacctgtggcctgcacggcctggtggtgcaggccaagggcggcctgagcggcctgtttgatggagctgaggtggtgctgggccctgacacctccatggagctgctgggccctgtgcccccagagcagcagttcatcaaccagaagatgaggcctggcagcggcatgctgagcatccgggtcatcccagatggccccacccgggccctgcagatcacagacttctgccacaggaagagcagccgctcctatgaggtggatgagctgcctgtgacagagcaggagctgcagaagctgaagaacccagacacagagcaggagctggaggtgctggtgcggctggagggcggcatcggcctgagcctcatcaacaaggtgcctgaggagctggtgtttgccagcctgaccggcatcaacgtgcactacacccagctggccaccagccacatgctggagctgagcatccaggatgtgcaggtggacaaccagctgattggcaccacccagcccttcatgctgtatgtgacccccctgagcaatgaaaatgaggtgattgaaacaggccctgctgtgcaggtgaatgctgtgaagttccccagcaagagcgccctgaccaacatctacaagcacctgatgatcacagcccagcgcttcaccgtgcagatcgaggagaagctgctgctgaagctgctgtccttcttcggctatgaccaggccgagagcgaggtggagaagtatgatgagaacctgcacgagaagacagctgagcagggcggcacccccatccgctactactttgagaacctgaagatcagcatcccccagatcaagctgtctgtgttcaccagcaacaagctgcccctggacctgaaggccctgaagagcaccctgggcttccccctcatccgctttgaagatgctgtgatcaacctggaccccttcaccagggtgcacccctatgagaccaaggagttcatcatcaatgacatcctgaagcacttccaggaggagctgctgagccaggccgcccgcatcctgggctctgtggacttcctgggcaaccccatgggcctgctgaatgatgtgtctgaaggagtgacaggcctcatcaagtatggaaatgtgggcggcctcatcagaaatgtgacccacggcgtgagcaacagcgctgccaagtttgctggcaccctgagtgatggcctgggcaagaccatggacaacagacaccagagcgagcgggagtacatccgctaccacgccgccaccagcggggagcacctggtggccggcatccacggcctggcccacggcatcattggaggcctgaccagcgtcatcaccagcacagtggagggcgtgaagacagaaggaggagtgtctggcttcatcagcggcctgggcaagggcctggtgggcaccgtgaccaagcctgtggccggggccctggactttgccagcgagacagcccaggccgtgcgggacacagccaccctgagcggccccaggacccaggcccagagggtgaggaagccccgctgctgcaccggcccccagggcctgctgccccgctacagcgagagccaggccgagggccaggagcagctgttcaagctgacagacaacatccaggatgagttcttcatcgctgtggagaacatcgacagctactgtgtgctgatcagcagcaaggctgtgtacttcctgaagagcggggactatgtggaccgggaggccatcttcctggaggtgaagtatgatgacctgtaccactgcctggtgtccaaggaccacggcaaggtgtatgtgcaggtgaccaagaaggctgtgtccaccagcagtggagtgtccatccctggccccagccaccagaagcccatggtgcacgtgaagtctgaggtgctggccgtgaagctgagccaggagatcaactatgccaagagcctgtactatgagcagcagctgatgctgcggctgtctgagaaccgggagcagctggagctggacagctag

SEQ ID NO: 43459 - DNA, 13167 bp, Artificial Sequence
  Description of Artificial Sequence: Synthetic coding sequence
atgctggagggcctggtggcctgggtgctgaacacctacctgggcaagtatgtgaacaacctgaacacagaccagctgtctgtggccctgctgaagggagctgtggagctggagaacctgcccctgaagaaggatgccctgaaggagctggagctgccctttgaggtgaaggccggcttcatcggcaaggtgaccctgcagatccccttctaccggccccacgtggacccctgggtgatcagcatcagcagcctgcacctgattggagcccctgagaagatccaggacttcaatgatgagaaggagaagctgctggagcgggagaggaagaaggccctgctgcaggccctggaggagaagtggaagaatgaccggcagcagaagggggagagctactggtacagcgtgacagcctctgtggtgacccgcatcgtggagaacatcgagctgaagatccaggatgtgcacctgcgctttgaagatggagtgaccaaccccagccacccctttgccttcggcatctgcatcaagaatgtgtccatgcagaatgctgtgaatgaacctgtgcagaagctgatgaggaagaagcagctggatgtggccgagttcagcatctactgggatgtggactgcaccctgctgggggacctgccccagatggagctgcaggaggccatggcccgctccatggagagccgcagccaccactacgtgctggagcctgtgtttgccagcgccctgctgaagaggaactgcagcaagaagcccctgcggagccgccacagccccagaattgactgtgacatccagctggagaccatccccctgaagctgagccagctgcagtaccggcagatcatggagttcctgaaggagctggagaggaaggagcggcaggtgaagttccgccgctggaagcccaaggtggccatcagcaagaactgccgggagtggtggtactttgccctgaatgccaacctgtatgagatccgggagcagaggaagcgctgcacctgggacttcatgctgcaccgggccagagatgctgtgtcctacacagacaagtacttcaacaagctgaagggcggcctgctgagcacagatgacaaggaggagatgtgccgcatcgaggaggagcagagctttgaggagctgaagatcctgcgggagctggtgcatgaccgcttccacaagcaggaggagctggccgagagcctgcgggagccccagtttgacagccctggggcctgccctggggcccctgagcccggcggcggcagcggcatgctgcagtacctgcagagctggttccctggctggggcggctggtacggccagcagaccccagagggcaatgtggtggagggcctgtctgctgagcagcaggagcagtggatccctgaggagatcctgggcacagaggagttctttgaccccacagcagatgccagctgcatgaacacctacaccaagagggaccacgtgtttgccaagctgaacctgcagctgcagaggggcaccgtgaccctgctgcacaaggagcagggcaccccccagatgaatgaaagtgccttcatgcagctggagttcagtgatgtgaagctgctggccgagagcctgcccaggaggaacagcagcctgctgtctgtgcggctgggcggcctcttcctgcgggacctggccacagagggcaccatgttccccctgctggtgttccccaacccccagaaggaggtgggccgggtgtcccagagctttggcctgcagaccaccagcgctgacagaagtgaccactacccagctgctgaccctgatggccctgtgtttgagatgctgtatgaaagaaatcctgcccacagccactttgagcggcggctgaatgtgtccacccggcccctgaacatcatctacaacccccaggccatcaagaaggtggccgacttcttctacaagggcaaggtgcacaccagcggcttcggctaccagagcgagctggagctgcgggtggccgaggccgcccggcggcagtacaacaagctgaagatgcagaccaaggccgagatccggcagaccctggaccggctgctggtgggggacttcatcgaggagagcaagcgctggacagtgcggctggacatcagcgccccccaggtgatcttcccagatgacttcaagttcaagaaccctgtgctggtggtggtggacctgggccgcatgctgctgaccaacacccaggacaacagcaggaggaagagcagagatggcagcgccagcgaggagacccagttcagtgatgatgagtacaagacccccctggccaccccacccaacaccccacctcctgagagcagcagcagcaatggagagaagaccccacccttctctggagtggagttcagcgaggagcagctgcaggcccacctgatgagcaccaagatgtatgaaagatacagcctgtccttcatggacctgcagatcatggtgggccgggtgaaggacaactggaagcacgtgcaggacattgatgtgggccccacccacgtggtggagaagttcaacgtgcacctgcagctggagcggcggctcatctacaccagtgaccccaagtacccaggagctgtgctgagcggcaacctgcctgacctgaagatccacatcaatgaagacaagatcagcgccctgaagaactgctttgccctgctgaccaccccagagatgaagaccagtgacacccagatcaaggagaagatcttcccccaggaggagcagaggggcagcctgcaggacagcgtgatgaacctgacccagagcatcgtgctgctggagcagcacacccgggaggtgctggtggagagccagctgctgctggccgagttcaaggtgaactgcatgcagctgggcgtggagagcaatggccgctacatctctgtgctgaaggtgtttggcaccaatgcccactttgtgaagaggccctatgatgctgaggtgtccctgactgtgcacggcctgctgctggtggacaccatgcagacctacggggctgactttgacctgctgatggccagccacaagaacctgagctttgacatccccaccggcagcctgcgggacagccgggcccagagccctgtgtctggccccaacgtggcccacctgacagatggagccaccctgaatgacagaagtgccacctctgtgtccctggacaagatcctgaccaaggagcaggagagcctcatcaagctggagtaccagtttgtgtcctctgagtgccccagcatgaacctggacagcaccctgcaggtgatcagcctgcaggtgaacaacctggacatcatcctgaaccctgagaccatcgtggagctgattggcttcctgcagaagagcttccccaaggagaaggatgacctgagcccccagcccctgatgacagactttgagaggagcttccgggagcagggcacctaccagagcacctatgagcagaacacagaggtggccgtggagatccaccggctgaacctgctgctgctgaggacagtgggcatggccaaccgggagaagtatggcaggaagatcgccacagccagcatcggcggcaccaaggtgaatgtgtccatgggcagcacctttgacatgaatggcagcctgggctgcctgcagctgatggacctgacccaggacaacgtgaagaaccagtatgtggtgtccatcggcaacagcgtgggctatgagaacatcatcagtgacatcggctactttgagagcgtgtttgtgaggatggaggatgctgccctgacagaggccctgtccttcacctttgtggagaggagcaagcaggagtgcttcctgaacctgaagatggccagcctgcactacaaccacagcgccaagttcctgaaggagctgaccctgtccatggatgagctggaggagaacttccggggcatgctgaagtctgctgccaccaaggtgaccaccgtgctggccaccaagacagctgagtacagcgagatggtgtccctgtttgagacccccaggaagacccgggagcccttcatcctggaggagaatgagatctacggctttgacctggccagcagccacctggacacagtgaagctgatcctgaacatcaacatcgagagccctgtggtgtccatccccaggaagccaggcagccctgagctgctggtgggccacctgggccagatcttcatccagaactttgtggccggagatgatgagagcagaagtgaccggctgcaggtggagatcaaggacatcaagctgtacagcctgaactgcacccagctggccggccgggaggccgtgggcagcgagggcagcaggatgttctgccccccatctggcagcggcagcgccaacagccaggaggaggcccacttcaccaggcatgacttctttgagagcctgcaccggggccaggccttccacatcctgaacaacaccaccatccagttcaagctggagaagatccccatcgagcgggagagcgagctgaccttcagcctgagcccagatgacctgggcaccagcagcatcatgaagattgagggcaagtttgtgaaccctgtgcaggtggtgctggccaagcacgtgtatgagcaggtgctgcagaccctggacaacctggtgtacagcgaggacctgaacaagtacccagccagcgccaccagcagcccctgcccagacagccccctgccccccctgagcacctgtggggagagctctgtggagaggaaagaaaatggcctcttcagccacagcagcctgagcaacaccagccagaagagcctgtctgtgaaggaggtgaagagcttcacccagatccaggccaccttctgcatcagcgagctgcaggtgcagctgagcggggacctgaccctgggcgcccagggcctggtgtccctgaagttccaggactttgaggtggagttcagcaaggaccacccccagaccctgagcatccagatcgccctgcacagcctgctgatggaggacctgctggagaagaacccagacagcaagtacaagaacctgatggtgtccagaggagcccccaagcccagcagcctggcccagaaggagtacctgagccagagctgccccagcgtgtccaatgtggagtacccagacatgcccaggagcctgcccagccacatggaggaggcccccaacgtgttccagctgtaccagaggcccaccagcgccagcaggaagaagcagaaggaggtgcaggacaaggactaccccctgaccccaccacccagccccaccgtggatgagcccaagatcctggtgggcaagagcaagtttgatgacagcctggtgcacatcaacatcttcctggtggacaagaagcaccctgagttcagcagcagctacaacagagtgaacagaagcattgatgtggacttcaactgcctggatgtgctgatcaccctgcagacctgggtggtgatcctggacttctttggaattggcagcacagctgacaaccacgccatgaggctgcccccagagggcatcctgcacaacgtgaagctggagccccacgcctccatggagagcggcctgcaggaccctgtgaacaccaagctggacctgaaggtgcacagcctgagcctggtgctgaacaagaccaccagcgagctggccaaggccaacgtgtccaagctggtggcccacctggagatgattgaaggagacctggccctgcagggcagcatcggcagcctgagcctgagtgacctgacctgccacggggagttctaccgggagcgcttcaccaccagcggggaggaggccctgatcttccagaccttcaagtatggccgcccagaccccctgctgcggcgggagcatgacatccgggtgtccctgaggatggcctctgtgcagtatgtgcacacccagcgcttccaggccgaggtggtggccttcatccagcacttcacccagctgcaggatgtgctgggccggcagagagctgccatcgagggccagacagtgcgggaccaggcccagcgctgcagccgggtgctgctggacatcgaggccggggcccctgtgctgctgatccctgagagcagccgcagcaacaacctgattgtggccaacctgggcaagctgaaggtgaagaacaagttcctgtttgctggcttccctggcaccttcagcctgcaggacaaggagagcgtgcccagcgccagccccaccggcatccccaagcacagcctgaggaagaccaccagcacagaggagccccggggcacccacagccagggccagttcaccatgcccctggccggcatgagcctgggcagcctgaagtcagaatttgtgcccagcaccagcaccaagcagcagggcccccagcccaccctgtctgtgggccaggagagcagcagcccagaagatcatgtgtgcctgctggactgtgtggtggtggacctgcaggacatggacatctttgctgctgagcggcacccccgggagtacagcaaggcccctgaggacagcagcggggacctgatcttccccagctactttgtgcggcagacaggaggcagcctgctgacagagccctgccgcctgaagctgcaggtggagaggaacctggacaaggagatcagccacacagtgcctgacatcagcatccacggcaacctgagctctgtgcactgcagcctggacctgtacaagtacaagctgatccggggcctgctggagaacaacctgggggagcccatcgaggagttcatgaggccctatgacctgcaggacccccgcatccacacagtgctgagcggggaggtgtacacctgcatgtgcttcctgattgacatggtgaatgtgtccctggagctgaaggaccccaagaggaaggagggcgccggcagcctggccaggtttgacttcaagaagtgcaagctgctgtatgagagcttcagcaaccagaccaagagcatcaacctggtgagccacagcatgatggcctttgacaccaggtatgccggccagaagaccagccctggcatgaccaacgtgttcagctgcatcttccagcctgccaagaacagcagcaccacccagggcagcatccagatcgagctgcacttccgcagcaccaaggacagcagctgcttcaccgtggtgctgaacaacctgcgggtcttcctgatctttgactggctgctgctggtgcatgacttcctgcacacccccagcgacatcaagaagcagaaccacgtgacccccagccgccacaggaacagcagcagcgagagcgccatcgtgcccaagacagtgaagtctggagtggtgaccaagaggagcagcctgcctgtgtccaatgaaagacacctggaggtgaaggtgaatgtgactggaacagaatttgtggtgattgaagatgtgtcctgctttgacaccaatgccatcatcctgaagggcaccaccgtgctgacctacaagcccaggtttgtggaccggcccttcagcggcagcctgtttggaattgaggtgttcagctgccgcctgggcaatgaacatgacacagccctgagcatcgtggaccctgtgcagatccagatggagctggtgggcaacagcagctaccagaacagcagcggcctgatggatgccttcaacagcgaggacttcccccctgtgctggagatccagctgcaggccctggacatccggctgagctacaatgatgtgcagctgttcctggccatcgccaagagcatccctgagcaggccaatgctgctgtgcctgacagcgtggccctggagagtgacagcgtgggcacctacctgcccggggccagccgggtgggggaggagatccgggagggcaccaggcacaccctggaccctgtgctggagctgcagctggcccggctgcaggagctgggcttctccatggatgactgcaggaaggccctgctggcctgccagggccagctgaagaaggccgcctcctggctgttcaagaatgctgagcccctgaagagcctgagcctggccagcaccagccgggacagccctggagctgtggccgcccccctcatcagcggcgtggagatcaaggccgagagcgtgtgcatctgcttcattgatgactgcatggactgtgatgtgcccctggccgagctgaccttcagccggctgaacttcctgcagagggtgaggaccagccctgagggctacgcccacttcaccctgagcggggactactacaacagagccctgagcggctgggagcccttcatcgagccctggccctgcagcgtgtcctggcagcagcaggccgccagccggctgcaccccccccggctgaagctggaggccaaggccaagccccggctggacatcaacatcacctctgtgctgattgaccagtatgtgtccaccaaggagagctggatggctgactactgcaaggatgacaaggacatcgagagcgccaagtctgaggactggatgggcagctctgtggaccccccctgcttcggccagagcctgcccctggtgtacctgcggaccaggagcacagccagcctgaccaacctggagcaccagatctatgcccgggcagaggtgaagacccccaagaggcggcagccctttgtgccctttgccctgaggaaccacacaggctgcaccctgtggtttgccaccctgaccaccacccccacccgggccgccctgagccacagcggcagccctggggtggtgcctgagggcaatggcaccttcctggatgacacccacaacgtgtctgagtggagggaggtgctgactggagaggagatcccctttgaatttgaggcccggggcaagctgcggcaccgccacacccatgacctgcgcatccaccagctgcaggtgcgggtgaatggctgggagcaggtgtcccctgtgtctgtggacaaggtgggcaccttcttccgctatgctgccccagacaagaacagcagcagcagcaccatcggcagccccagcagcaggaccaacatcatccacccccaggtgtacttcagcagcctgccccctgtgcgggtggtgtttgctgtgaccatggagggcagcgccaggaaggtgatcaccgtgcgcagcgccctgattgtgaggaaccggctggagacccccatggagctgcggctggacagccccagcgccccagacaagcctgtggtgctgcctgccatcatgcctggggacagctttgctgtgcccctgcacctgacctcctggaggctgcaggcccggcccaagggcctgggcgtcttcttctgcaaggcccccatccactggaccaacgtggtgaagacagctgagatcagcagcagcaagcgggagtgccacagcatggacacagagaagagccgcttcttccgcttctgtgtggccatcaagaaggagaactacccagactacatgcccagcaacatcttcagtgacagcgccaagcagatcttccggcagcccggccacaccatctacctgctgcccaccgtggtgatctgcaacctgctgccctgtgagctggacttctacgtgaagggcatgcccatcaatggcaccctgaagccaggcaaggaggccgccctgcacacagctgacaccagccagaacatcgagctgggcgtgtccctggagaacttccccctgtgcaaggagctgctgatccccccaggcacccagaactacatggtgaggatgaggctgtatgatgtgaacagacggcagctgaacctgaccatccgcatcgtgtgcagagctgagggcagcctgaagatcttcatcagcgccccctactggctgatcaacaagacaggcctgcccctcatcttccggcaggacaatgccaagacagatgctgctggccagtttgaggagcacgagctggcccggagcctgagccccctgctcttctgctacgccgacaaggagcagcccaacctgtgcaccatgagaattggccggggcatccaccctgagggcatgcctggctggtgccagggcttcagcctggatggcggcagcggcgtgcgggccctgaaggtgatccagcagggcaaccggcccggcctcatctacaacatcggcattgatgtgaagaagggccggggccgctacatcgacacctgcatggtgatctttgccccccgctacctgctggacaacaagagcagccacaagctggcctttgcccagcgggagtttgcccggggccagggcacagccaaccctgagggctacatcagcaccctgcccggcagctctgtggtgttccactggcccagaaatgactatgaccagctgctgtgtgtgcggctgatggatgtgcccaactgcatctggagcggcggctttgaggtgaacaagaacaacagcttccacatcaacatgagggacaccctgggcaagtgcttcttcctgcgggtggagatcaccctgcggggggccacctaccgcatctccttcagtgacacagaccagctgcccccacccttcagaattgacaacttcagcaaggtgcctgtggtgttcacccagcacggcgtggccgagccccggctgaggacagaggtgaagcccatgaccagcctggactatgcctgggatgagcccaccctgccccccttcatcaccctgactgtgaagggagctggcagcagcgagatcaactgcaacatgaatgacttccaggacaaccggcagctgtactatgagaacttcatctacatcgccgccacctacaccttcagcggcctgcaggagggcaccggccggcctgtggccagcaacaaggccatcacctgtgccgagctggtgctggatgtgagccccaagacccagagggtcatcctgaagaagaaggagcccgggaagaggagccagctgtggaggatgactggaacaggcatgctggcccacgagggcagctctgtgccccacaaccccaacaagcccagcgctgcccggagcacagagggcagcgccatcctggacattgctggcctggccgctgtgacagacaacagatatgagcccctgatgctgaggaagccagacagaagaagaagcaccacccagacctggagcttccgggagggcaagctgacctgtggcctgcacggcctggtggtgcaggccaagggcggcctgagcggcctgtttgatggagctgaggtggtgctgggccctgacacctccatggagctgctgggccctgtgcccccagagcagcagttcatcaaccagaagatgaggcctggcagcggcatgctgagcatccgggtcatcccagatggccccacccgggccctgcagatcacagacttctgccacaggaagagcagccgctcctatgaggtggatgagctgcctgtgacagagcaggagctgcagaagctgaagaacccagacacagagcaggagctggaggtgctggtgcggctggagggcggcatcggcctgagcctcatcaacaaggtgcctgaggagctggtgtttgccagcctgaccggcatcaacgtgcactacacccagctggccaccagccacatgctggagctgagcatccaggatgtgcaggtggacaaccagctgattggcaccacccagcccttcatgctgtatgtgacccccctgagcaatgaaaatgaagtcatcgagaccggccctgctgtgcaggtgaatgctgtgaagttccccagcaagagcgccctgaccaacatctacaagcacctgatgatcacagcccagcgcttcaccgtgcagatcgaggagaagctgctgctgaagctgctgtccttcttcggctatgaccaggccgagagcgaggtggagaagtatgatgagaacctgcacgagaagacagctgagcagggcggcacccccatccgctactactttgagaacctgaagatcagcatcccccagatcaagctgagcgtcttcaccagcaacaagctgcccctggacctgaaggccctgaagagcaccctgggcttccccctcatccgctttgaagatgctgtgatcaacctggaccccttcaccagggtgcacccctatgagaccaaggagttcatcatcaatgacatcctgaagcacttccaggaggagctgctgagccaggccgcccgcatcctgggctctgtggacttcctgggcaaccccatgggcctgctgaatgatgtgtctgagggcgtgacaggcctcatcaagtatggaaatgtgggcggcctcatcagaaatgtgacccatggagtgagcaacagcgctgccaagtttgctggcaccctgagtgatggcctgggcaagaccatggacaacagacaccagagcgagcgggagtacatccgctaccacgccgccaccagcggggagcacctggtggccggcatccacggcctggcccacggcatcatcggcggcctgaccagcgtcatcaccagcacagtggagggcgtgaagacagagggcggcgtgtctggcttcatcagcggcctgggcaagggcctggtgggcaccgtgaccaagcctgtggccggggccctggactttgccagcgagacagcccaggccgtgcgggacacagccaccctgagcggccccaggacccaggcccagagggtgaggaagccccgctgctgcaccggcccccagggcctgctgccccgctacagcgagagccaggccgagggccaggagcagctgttcaagctgacagacaacatccaggatgagttcttcatcgctgtggagaacatcgacagctactgtgtgctgatcagcagcaaggctgtgtacttcctgaagagcggggactatgtggaccgggaggccatcttcctggaggtgaagtatgatgacctgtaccactgcctggtgtccaaggaccacggcaaggtgtatgtgcaggtgaccaagaaggctgtgtccaccagcagcggcgtgtccatccctggccccagccaccagaagcccatggtgcacgtgaagtctgaggtgctggccgtgaagctgagccaggagatcaactatgccaagagcctgtactatgagcagcagctgatgctgcggctgtctgaaaatcgggagcagctggagctggacagctag

SEQ ID NO: 43460 - DNA, 579 bp, Artificial Sequence
  Description of Artificial Sequence: Synthetic coding sequence
atgctgctggaggagaccggcctgaccccccaggagacctgcctgagcccccggcggccccaccgctggcagaggacccaggcccagagggtgaggaagccccgctgctgcaccggcccccagggcctgctgccccgctacagcgagagccaggccgagggccaggagcagctgttcaagctgacagacaacatccaggatgagttcttcatcgctgtggagaacatcgacagctactgtgtgctgatcagcagcaaggctgtgtacttcctgaagagcggggactatgtggaccgggaggccatcttcctggaggtgaagtatgatgacctgtaccactgcctggtgtccaaggaccacggcaaggtgtatgtgcaggtgaccaagaaggctgtgtccaccagcagcggcgtgtccatccctggccccagccaccagaagcccatggtgcacgtgaagtctgaggtgctggccgtgaagctgagccaggagatcaactatgccaagagcctgtactatgagcagcagctgatgctgcggctgtctgaaaatcgggagcagctggagctggacagctag

SEQ ID NO: 43461 - DNA, 1161 bp, Artificial Sequence
  Description of Artificial Sequence: Synthetic coding sequence
atgagaggagagaagctgagcaaggccctgaagagcaccctgggcttccccctcatccgctttgaagatgctgtgatcaacctggaccccttcaccagggtgcacccctatgagaccaaggagttcatcatcaatgacatcctgaagcacttccaggaggagctgctgagccaggccgcccgcatcctgggctctgtggacttcctgggcaaccccatgggcctgctgaatgatgtgtctgagggcgtgacaggcctcatcaagtatggaaatgtgggcggcctcatcagaaatgtgacccatggagtgagcaacagcgctgccaagtttgctggcaccctgagtgatggcctgggcaagaccatggacaacagacaccagagcgagcgggagtacatccgctaccacgccgccaccagcggggagcacctggtggccggcatccacggcctggcccacggcatcatcggcggcctgaccagcgtcatcaccagcacagtggagggcgtgaagacagagggcggcgtgtctggcttcatcagcggcctgggcaagggcctggtgggcaccgtgaccaagcctgtggccggggccctggactttgccagcgagacagcccaggccgtgcgggacacagccaccctgagcggccccaggacccaggcccagagggtgaggaagccccgctgctgcaccggcccccagggcctgctgccccgctacagcgagagccaggccgagggccaggagcagctgttcaagctgacagacaacatccaggatgagttcttcatcgctgtggagaacatcgacagctactgtgtgctgatcagcagcaaggctgtgtacttcctgaagagcggggactatgtggaccgggaggccatcttcctggaggtgaagtatgatgacctgtaccactgcctggtgtccaaggaccacggcaaggtgtatgtgcaggtgaccaagaaggctgtgtccaccagcagcggcgtgtccatccctggccccagccaccagaagcccatggtgcacgtgaagtctgaggtgctggccgtgaagctgagccaggagatcaactatgccaagagcctgtactatgagcagcagctgatgctgcggctgtctgaaaatcgggagcagctggagctggacagctag

SEQ ID NO: 43462 - DNA, 378 bp, Artificial Sequence
  Description of Artificial Sequence: Synthetic coding sequence
gagttcatcgaggagctgctgagccccccatttggaggcctggtggcctttgtgaaggaggccgaggccctgattgagcggggccaggccgagcggctgcggggggaggaggcccgggtgacccagctgatccggggcttcggcagctcctggaagagctctgtggagagcctgagccaggatgtgatgaggagcttcaccaacttcagaaatggcaccagcatcatccagggcgccctgacccagctgatccagctgtaccaccgcttccaccgggtgctgagccagccccagctgcgggccctgcctgcccgggcagagctgatcaacatccaccacctgatggtggagctgaagaagcacaagcccaacttctag

SEQ ID NO: 43463 - DNA, 378 bp, Artificial Sequence; identical to SEQ ID NO: 43462
  Description of Artificial Sequence: Synthetic coding sequence

SEQ ID NO: 43464 - DNA, 1797 bp, Artificial Sequence
  Description of Artificial Sequence: Synthetic coding sequence
atggagcagatgctgggcgccttccagagcgacctgagcagcatcagcagcgagatccgcaccctgcaggagcagagcggggccatgaacatccggctgaggaaccggcaggccgtgcggggcaagctgggggagctggtggatggcctggtggtgcccagcgccctggtgacagccatcctggaggcccctgtgacagagccccgcttcctggagcagctgcaggagctggatgccaaggctgctgctgtgcgggagcaggaggcccggggcacagctgcctgtgctgatgtgcggggcgtgctggaccggctgcgggtgaaggctgtgaccaagatccgggagttcatcctgcagaagatctacagcttcaggaagcccatgaccaactaccagatcccccagacagccctgctgaagtaccgcttcttctaccagttcctgctgggcaatgaaagagccacagccaaggagatcagagatgaatatgtggagaccctgagcaagatctacctgagctactaccgcagctacctgggccgcctgatgaaggtgcagtatgaggaggtggccgagaaggatgacctgatgggcgtggaggacacagccaagaagggcttcttcagcaagcccagcctgcggagcaggaacaccatcttcaccctgggcacccggggcagcgtcatcagccccacagagctggaggcccccatcctggtgccccacacagcccagagaggagagcagcgctacccctttgaggccctcttccgcagccagcactacgccctgctggacaacagctgccgggagtacctgttcatctgtgagttctttgtggtgtctggccctgctgcccatgacctcttccacgctgtgatgggccgcaccctgtccatgaccctgaagcacctggacagctacctggccgactgctatgatgccatcgctgtgttcctgtgcatccacatcgtgctgcgcttcagaaatattgctgccaagagagatgtgcctgccctggaccgctactgggagcaggtgctggccctgctgtggcccaggtttgagctgatcctggagatgaatgtgcagagcgtgcgcagcacagacccccagaggctgggcggcctggacacccggccccactacatcacccggcgctatgcagagttcagcagcgccctggtgtccatcaaccagaccatccccaatgaaagaaccatgcagctgctgggccagctgcaggtggaggtggagaactttgtgctgcgggtggccgctgagttcagcagcaggaaggagcagctggtgttcctgatcaacaactatgacatgatgctgggcgtgctgatggagagagctgctgatgacagcaaggaggtggagagcttccagcagctgctgaatgcccggacccaggagttcatcgaggagctgctgagccccccatttggaggcctggtggcctttgtgaaggaggccgaggccctgattgaaagaggccaggccgagcggctgcggggggaggaggcccgggtgacccagctgatccggggcttcggcagctcctggaagagctctgtggagagcctgagccaggatgtgatgaggagcttcaccaacttcagaaatggcaccagcatcatccagggcgccctgacccagctgatccagctgtaccaccgcttccaccgggtgctgagccagccccagctgcgggccctgcctgcccgggcagagctgatcaacatccaccacctgatggtggagctgaagaagcacaagcccaacttctag

SEQ ID NO: 43465 - DNA, 1797 bp, Artificial Sequence; identical to SEQ ID NO: 43464
  Description of Artificial Sequence: Synthetic coding sequence

SEQ ID NO: 43466 - DNA, 2106 bp, Artificial Sequence
  Description of Artificial Sequence: Synthetic coding sequence
atggaggaggaggagggccccctggccggcggccctggcctgcaggagcccctgcagctgggggagctggacatcaccagtgatgagttcatcctggatgaggtggatgtgcacatccaggccaacctggaggatgagctggtgaaggaggccctgaagacaggagtggacctgcggcactacagcaagcaggtggagctggagctgcagcagatcgagcagaagagcatccgggactacatccaggagagtgaaaatattgccagcctgcacaaccagatcacagcctgtgatgctgtgctggagaggatggagcagatgctgggcgccttccagagcgacctgagcagcatcagcagcgagatccgcaccctgcaggagcagagcggggccatgaacatccggctgaggaaccggcaggccgtgcggggcaagctgggggagctggtggatggcctggtggtgcccagcgccctggtgacagccatcctggaggcccctgtgacagagccccgcttcctggagcagctgcaggagctggatgccaaggctgctgctgtgcgggagcaggaggcccggggcacagctgcctgtgctgatgtgcggggcgtgctggaccggctgcgggtgaaggctgtgaccaagatccgggagttcatcctgcagaagatctacagcttcaggaagcccatgaccaactaccagatcccccagacagccctgctgaagtaccgcttcttctaccagttcctgctgggcaatgaaagagccacagccaaggagatcagagatgaatatgtggagaccctgagcaagatctacctgagctactaccgcagctacctgggccgcctgatgaaggtgcagtatgaggaggtggccgagaaggatgacctgatgggcgtggaggacacagccaagaagggcttcttcagcaagcccagcctgcggagcaggaacaccatcttcaccctgggcacccggggcagcgtcatcagccccacagagctggaggcccccatcctggtgccccacacagcccagagaggagagcagcgctacccctttgaggccctcttccgcagccagcactacgccctgctggacaacagctgccgggagtacctgttcatctgtgagttctttgtggtgtctggccctgctgcccatgacctcttccacgctgtgatgggccgcaccctgtccatgaccctgaagcacctggacagctacctggccgactgctatgatgccatcgctgtgttcctgtgcatccacatcgtgctgcgcttcaggaacattgctgccaagagagatgtgcctgccctggaccgctactgggagcaggtgctggccctgctgtggcccaggtttgagctgatcctggagatgaatgtgcagagcgtgcgcagcacagacccccagaggctgggcggcctggacacccggccccactacatcaccaggagatatgcagagttcagcagcgccctggtgtccatcaaccagaccatccccaatgaaagaaccatgcagctgctgggccagctgcaggtggaggtggagaactttgtgctgcgggtggccgctgagttcagcagcaggaaggagcagctggtgttcctgatcaacaactatgacatgatgctgggcgtgctgatggagagagctgctgatgacagcaaggaggtggagagcttccagcagctgctgaatgcccggacccaggagttcatcgaggagctgctgagccccccatttggaggcctggtggcctttgtgaaggaggccgaggccctgattgagcggggccaggccgagcggctgcggggggaggaggcccgggtgacccagctgatccggggcttcggcagctcctggaagagctctgtggagagcctgagccaggatgtgatgaggagcttcaccaacttcagaaatggcaccagcatcatccagggcgccctgacccagctgatccagctgtaccaccgcttccaccgggtgctgagccagccccagctgcgggccctgcctgcccgggcagagctgatcaacatccaccacctgatggtggagctgaagaagcacaagcccaacttctag

SEQ ID NO: 43467 - DNA, 2106 bp, Artificial Sequence; identical to SEQ ID NO: 43466
  Description of Artificial Sequence: Synthetic coding sequence

SEQ ID NO: 43468 - DNA, 1797 bp, Artificial Sequence; identical to SEQ ID NO: 43464
  Description of Artificial Sequence: Synthetic coding sequence

SEQ ID NO: 43469 - DNA, 2106 bp, Artificial Sequence; identical to SEQ ID NO: 43466
  Description of Artificial Sequence: Synthetic coding sequence

SEQ ID NO: 43470 - DNA, 2013 bp, Artificial Sequence
  Description of Artificial Sequence: Synthetic coding sequence
atgatggaggaggaggagctggagtttgtggaggagctggaggccgtgctgcagctgaccccagaggtgcagctggccatcgagcaggtgttccccagccaggaccccctggacagagctgacttcaatgctgtggagtacatcaacaccctcttccccacagagcagagcctggccaacattgatgaggtggtgaacaagatccggctgaagatccggcggctggatgacaacatcagaacagtggtgcggggccagaccaacgtgggccaggacggccggcaggtgaaggagatcacccgggacatcaagcagctggaccacgccaagaggcacctgaccaccagcatcaccaccctgaaccacctgcacatgctggccggcggcgtggacagcctggaggccatgacccggcggcggcagtacggggaggtggccaacctgctgcagggcgtgatgaatgtgctggagcacttccacaagtacatgggcatcccccagatccggcagctgtctgagcgggtgaaggccgcccagacagagctgggccagcagatcctggccgactttgaggaggccttccccagccagggcaccaagaggcctgggggccccagcaatgtgctgagagatgcctgcctggtggccaacatcctggacccccgcatcaagcaggagatcatcaagaagttcatcaagcagcacctgtctgagtacctggtgctcttccaggagaaccaggatgtggcctggctggacaagattgacagaagatatgcctggatcaagaggcagctggtggactatgaggagaagtatggccgcatgttcccccgggagtggtgcatggccgagagaattgctgtggagttctgccacgtgaccagggctgagctggccaagatcatgaggacccgggccaaggagattgaggtgaagctgctgctgtttgccatccagaggaccaccaactttgagggcttcctggccaagcgcttcagcggctgcaccctgacagatggcaccctgaagaagctggagagccccccacccagcaccaaccccttcctggaggatgagcccaccccagagatggaggagctggccacagagaagggggacctggaccagcccaagaagcccaaggccccagacaaccccttccatggaattgtgtccaagtgctttgagccccacctgtatgtgtacatcgagagccaggacaagaacctgggggagctgattgacagatttgtggccgacttcaaggcccagggcccccccaagcccaacacagatgaaggaggagctgtgctgcccagctgtgccgacctgtttgtgtactacaagaagtgcatggtgcagtgcagccagctgagcactggagagcccatgattgccctgaccaccatcttccagaagtacctgcgggagtatgcctggaagatcctgagcggcaacctgcccaagaccaccaccagcagcggcggcctgaccatcagcagcctgctgaaggagaaggagggcagcgaggtggccaagttcaccctggaggagctgtgcctgatctgcaacatcctgagcacagctgagtactgcctggccaccacccagcagctggaggagaagctgaaggagaaggtggatgtgtccctgattgagcgcatcaacctgactggagagatggacaccttcagcaccgtcatcagcagcagcatccagctgctggtgcaggacctggatgctgcctgtgaccctgccctgacagccatgagcaagatgcagtggcagaatgtggagcacgtgggggaccagagcccctacgtgaccagcgtcatcctgcacatcaagcagaatgtgcccatcatccgggacaacctggccagcaccaggaagtacttcacccagttctgtgtgaagtttgccaacagcttcatccccaagttcatcacccacctgttcaagtgcaagcccatctccatggtgggcgctgagcaggtgcgctggacctag

SEQ ID NO: 43471 - DNA, 1644 bp, Artificial Sequence
  Description of Artificial Sequence: Synthetic coding sequence
atgatggaggaggaggagctggagtttgtggaggagctggaggccgtgctgcagctgaccccagaggtgcagctggccatcgagcaggtgttccccagccaggaccccctggacagagctgacttcaatgctgtggagtacatcaacaccctcttccccacagagcagagcctggccaacattgatgaggtggtgaacaagatccggctgaagatccggcggctggatgacaacatcagaacagtggtgcggggccagaccaacgtgggccaggacggccggcaggccctggaggaggcccagaaggccatccagcagctgtttgggaagatcaaggacatcaaggacaaggccgagaagtctgagcagatggtgaaggagatcacccgggacatcaagcagctggaccacgccaagaggcacctgaccaccagcatcaccaccctgaaccacctgcacatgctggccggcggcgtggacagcctggaggccatgacccggcggcggcagtatggagaggtggccaacctgctgcagggcgtgatgaatgtgctggagcacttccacaagtacatgggcatcccccagatccggcagctgtctgagcgggtgaaggccgcccagacagagctgggccagcagatcctggccgactttgaggaggccttccccagccagggcaccaaggtggcctggctggacaagattgaccggcgctatgcctggatcaagaggcagctggtggactatgaggagaagtatggccgcatgttcccccgggagtggtgcatggccgagagaattgctgtggagttctgccacgtgaccagggctgagctggccaagatcatgaggacccgggccaaggagattgaggtgaagctgctgctgtttgccatccagaggaccaccaactttgagggcttcctggccaagcgcttcagcggctgcaccctgacagatggcaccctgaagaagctggagagccccccacccagcaccaaccccttcctggaggatgagcccaccccagagatggaggagctggccacagagaagggggacctggaccagcccaagaagcccaaggccccagacaaccccttccacggcatcgtgtccaaatgttttgagccccacctgtatgtgtacatcgagagccaggacaagaacctgggggagctgattgacagatttgtggccgacttcaaggcccagggcccccccaagcccaacacagatgagggcggcgctgtgctgcccagctgtgccgacctgtttgtgtactacaagaagtgcatggtgcagtgcagccagctgagcactggagagcccatgattgccctgaccaccatcttccagaagtacctgcgggagtatgcctggaagatcctgagcggcaacctgcccaagaccaccaccagcagcggcggcctgaccatcagcagcctgctgaaggagaaggagggcagcgaggtggccaagttcaccctggaggagctgtgcctgatctgcaacatcctgagcacagctgagtactgcctggccaccacccagcagctggaggagaagctgaaggagaaggtggacagacacctgcagcagtacagcgctgctggcagcggcagcggctgctgcctgtag

SEQ ID NO: 43472 - DNA, 1269 bp, Artificial Sequence
  Description of Artificial Sequence: Synthetic coding sequence
atgatggaggaggaggagctggagtttgtggaggagctggaggccgtgctgcagctgaccccagaggtgcagctggccatcgagcaggtgttccccagccaggaccccctggacagagctgacttcaatgctgtggagtacatcaacaccctcttccccacagagcagagcctggccaacattgatgaggtggtgaacaagatccggctgaagatccggcggctggatgacaacatcagaacagtggtgcggggccagaccaacgtgggccaggacggccggcagaagaagctggagagccccccacccagcaccaaccccttcctggaggatgagcccaccccagagatggaggagctggccacagagaagggggacctggaccagcccaagaagcccaaggccccagacaaccccttccatggaattgtgtccaagtgctttgagccccacctgtatgtgtacatcgagagccaggacaagaacctgggggagctgattgacagatttgtggccgacttcaaggcccagggcccccccaagcccaacacagatgaaggaggagctgtgctgcccagctgtgccgacctgtttgtgtactacaagaagtgcatggtgcagtgcagccagctgagcactggagagcccatgattgccctgaccaccatcttccagaagtacctgcgggagtatgcctggaagatcctgagcggcaacctgcccaagaccaccaccagcagcggcggcctgaccatcagcagcctgctgaaggagaaggagggcagcgaggtggccaagttcaccctggaggagctgtgcctgatctgcaacatcctgagcacagctgagtactgcctggccaccacccagcagctggaggagaagctgaaggagaaggtggatgtgtccctgattgagcgcatcaacctgactggagagatggacaccttcagcaccgtcatcagcagcagcatccagctgctggtgcaggacctggatgctgcctgtgaccctgccctgacagccatgagcaagatgcagtggcagaatgtggagcacgtgggggaccagagcccctacgtgaccagcgtcatcctgcacatcaagcagaatgtgcccatcatccgggacaacctggccagcaccaggaagtacttcacccagttctgtgtgaagtttgccaacagcttcatccccaagttcatcacccacctgttcaagtgcaagcccatctccatggtgggcgctgagcaggtgcgctggacctag

SEQ ID NO: 43473 - DNA, 2499 bp, Artificial Sequence
  Description of Artificial Sequence: Synthetic coding sequence
atgatggaggaggaggagctggagtttgtggaggagctggaggccgtgctgcagctgaccccagaggtgcagctggccatcgagcaggtgttccccagccaggaccccctggacagagctgacttcaatgctgtggagtacatcaacaccctcttccccacagagcagagcctggccaacattgatgaggtggtgaacaagatccggctgaagatccggcggctggatgacaacatcagaacagtggtgcggggccagaccaacgtgggccaggacggccggcaggccctggaggaggcccagaaggccatccagcagctgtttgggaagatcaaggacatcaaggacaaggccgagaagtctgagcagatggtgaaggagatcacccgggacatcaagcagctggaccacgccaagaggcacctgaccaccagcatcaccaccctgaaccacctgcacatgctggccggcggcgtggacagcctggaggccatgacccggcggcggcagtatggagaggtggccaacctgctgcagggcgtgatgaatgtgctggagcacttccacaagtacatgggcatcccccagatccggcagctgtctgagcgggtgaaggccgcccagacagagctgggccagcagatcctggccgactttgaggaggccttccccagccagggcaccaagaggcctgggggccccagcaatgtgctgagagatgcctgcctggtggccaacatcctggacccccgcatcaagcaggagatcatcaagaagttcatcaagcagcacctgtctgagtacctggtgctcttccaggagaaccaggatgtggcctggctggacaagattgaccggcgctatgcctggatcaagaggcagctggtggactatgaggagaagtatggccgcatgttcccccgggagtggtgcatggccgagagaattgctgtggagttctgccacgtgaccagggctgagctggccaagatcatgaggacccgggccaaggagattgaggtgaagctgctgctgtttgccatccagaggaccaccaactttgagggcttcctggccaagcgcttcagcggctgcaccctgacagatggcaccctgaagaagctggagagccccccacccagcaccaaccccttcctggaggatgagcccaccccagagatggaggagctggccacagagaagggggacctggaccagcccaagaagcccaaggccccagacaaccccttccacggcatcgtgtccaaatgttttgagccccacctgtatgtgtacatcgagagccaggacaagaacctgggggagctgattgacagatttgtggccgacttcaaggcccagggcccccccaagcccaacacagatgagggcggcgctgtgctgcccagctgtgccgacctgtttgtgtactacaagaagtgcatggtgcagtgcagccagctgagcactggagagcccatgattgccctgaccaccatcttccagaagtacctgcgggagtatgcctggaagatcctgagcggcaacctgcccaagaccaccaccagcagcggcggcctgaccatcagcagcctgctgaaggagaaggagggcagcgaggtggccaagttcaccctggaggagctgtgcctgatctgcaacatcctgagcacagctgagtactgcctggccaccacccagcagctggaggagaagctgaaggagaaggtggatgtgtccctcatcgagcgcatcaacctgaccggggagatggacaccttcagcaccgtcatcagcagcagcatccagctgctggtgcaggacctggatgctgcctgtgaccctgccctgacagccatgagcaagatgcagtggcagaatgtggagcacgtgggggaccagagcccctacgtgaccagcgtcatcctgcacatcaagcagaatgtgcccatcatccgggacaacctggccagcaccaggaagtacttcacccagttctgtgtgaagtttgccaacagcttcatccccaagttcatcacccacctgttcaagtgcaagcccatctccatggtgggcgctgagcagctgctgctggacacccacagcctgaagatggtgctgctggacctgcccagcatcagcagccaggtggtgaggaaggccccagccagctacaccaagatcgtggtgaagggcatgaccagggctgagatgatcctgaaggtggtgatggcccctcatgagcccctggtggtgtttgtggacaactacatcaagctgctgacagactgcaacacagagaccttccagaagatcctggacatgaagggcctgaagaggtctgagcagagctccatgctggagctgctgcggcagaggctgcctgcccctccttctggagctgagagcagcggcagcctgagcctgacagcccccaccccagagcaggagagcagccgcatcaggaagctggagaagctgatcaagaagaggctgtag

SEQ ID NO: 43474 - DNA, 1506 bp, Artificial Sequence
  Description of Artificial Sequence: Synthetic coding sequence
atgttcagcctgattgtgaaggccgcccagacagagctgggccagcagatcctggccgactttgaggaggccttccccagccagggcaccaagaggcctgggggccccagcaatgtgctgagagatgcctgcctggtggccaacatcctggacccccgcatcaagcaggagatcatcaagaagttcatcaagcagcacctgtctgagtacctggtgctcttccaggagaaccaggatgtggcctggctggacaagattgaccggcgctatgcctggatcaagaggcagctggtggactatgaggagaagtatggccgcatgttcccccgggagtggtgcatggccgagagaattgctgtggagttctgccacgtgaccagggctgagctggccaagatcatgaggacccgggccaaggagattgaggtgaagctgctgctgtttgccatccagaggaccaccaactttgagggcttcctggccaagcgcttcagcggctgcaccctgacagatggcaccctgaagaagctggagagccccccacccagcaccaaccccttcctggaggatgagcccaccccagagatggaggagctggccacagagaagggggacctggaccagcccaagaagcccaaggccccagacaaccccttccacggcatcgtgtccaaatgttttgagccccacctgtatgtgtacatcgagagccaggacaagaacctgggggagctgattgacagatttgtggccgacttcaaggcccagggcccccccaagcccaacacagatgagggcggcgctgtgctgcccagctgtgccgacctgtttgtgtactacaagaagtgcatggtgcagtgcagccagctgagcactggagagcccatgattgccctgaccaccatcttccagaagtacctgcgggagtatgcctggaagatcctgagcggcaacctgcccaagaccaccaccagcagcggcggcctgaccatcagcagcctgctgaaggagaaggagggcagcgaggtggccaagttcaccctggaggagctgtgcctgatctgcaacatcctgagcacagctgagtactgcctggccaccacccagcagctggaggagaagctgaaggagaaggtggatgtgtccctcatcgagcgcatcaacctgaccggggagatggacaccttcagcaccgtcatcagcagcagcatccagctgctggtgcaggacctggatgctgcctgtgaccctgccctgacagccatgagcaagatgcagtggcagaatgtggagcacgtgggggaccagagcccctacgtgaccagcgtcatcctgcacatcaagcagaatgtgcccatcatccgggacaacctggccagcaccaggaagtacttcacccagttctgtgtgaagtttgccaacagcttcatccccaagttcatcacccacctgttcaagtgcaagcccatctccatggtgggcgctgagcaggtgcgctggacctag

SEQ ID NO: 43475 - DNA, 387 bp, Artificial Sequence
  Description of Artificial Sequence: Synthetic coding sequence
atggtgctgctggacctgcccagcatcagcagccaggtggtgaggaaggccccagccagctacaccaagatcgtggtgaagggcatgaccagggctgagatgatcctgaaggtggtgatggcccctcatgagcccctggtggtgtttgtggacaactacatcaagctgctgacagactgcaacacagagaccttccagaagatcctggacatgaagggcctgaagaggtctgagcagagctccatgctggagctgctgcggcagaggctgcctgcccctccttctggagctgagagcagcggcagcctgagcctgacagcccccaccccagagcaggagagcagccgcatcaggaagctggagaagctgatcaagaagaggctgtag

SEQ ID NO: 43476 - DNA, 2934 bp, Artificial Sequence
  Description of Artificial Sequence: Synthetic coding sequence
atggccagcagccacagcagcagccctgtgccccagggcagcagcagtgatgtgttcttcaagattgaggtggaccccagcaagcacatccggcctgtgcccagcctgcctgatgtgtgccccaaggagcccactggagacagccacagcctgtatgtggcccccagcctggtgacagaccagcaccgctggacagtgtaccacagcaaggtgaacctgcctgctgccctgaatgacccccggctggccaagcgggagagtgacttcttcaccaagacctggggcctggactttgtggacacagaggtgatccccagcttctacctgccccagatcagcaaggagcacttcaccgtgtaccagcaggagatcagccagcgggagaagatccacgagcgctgcaagaacatctgcccccccaaggacacctttgagaggaccctgctgcacacccatgacaagagcaggacagacctggagcaggtgcccaagatcttcatgaagccagactttgccctggatgacagcctgaccttcaacagcgtgctgccctggagccacttcaacacagctgggggcaagggcaacagagatgctgccagcagcaagctgctgcaggagaagctgagccactacctggacatcgtggaggtgaacatcgcccaccagatcagcctgcggtctgaggccttcttccacgccatgaccagccagcacgagctgcaggactacctgaggaagaccagccaggccgtgaagatgctgcgggacaagatcgcccagattgacaaggtgatgtgtgagggcagcctgcacatcctgcggctggccctgaccaggaacaactgtgtgaaggtgtacaacaagctgaagctgatggccaccgtgcaccagacccagcccaccgtgcaggtgctgctgagcaccagcgagtttgtgggcgccctggacctgattgccaccacccaggaggtgctgcagcaggagctgcagggcatccacagcttccgccacctgggcagccagctgtgtgagctggagaagctgattgacaagatgatgattgctgagttcagcacctacagccacagcgacctgaaccggcccctggaggatgactgccaggtgctggaggaggagcggctcatcagcctggtgtttggcctgctgaagcagaggaagctgaacttcctggagatctatggagagaagatggtgatcacagccaagaacatcatcaagcagtgtgtgatcaacaaggtgtcccagacagaggagattgacacagatgtggtggtgaagctggccgaccagatgaggatgctgaacttcccccagtggtttgacctgctgaaggacatcttcagcaagttcaccatcttcctgcagagggtgaaggccaccctgaacatcatccacagcgtggtgctgtctgtgctggacaagaaccagaggacccgggagctggaggagatcagccagcagaagaatgctgccaaggacaacagcctggacacagaggtggcctacctgattcatgagggcatgttcatcagtgatgccttcggggagggggagctgacccccatcgctgtggacaccaccagccagagaaatgccagccccaacagcgagccctgcagcagtgacagcgtgtctgagcctgagtgcaccacagacagcagcagcagcaaggagcacaccagcagcagcgccatccctgggggcgtggacatcatggtgtctgaggacatgaagctgacagacagcgagctgggcaagctggccaacaacatccaggagctgctgtacagcgccagtgacatctgccacgacagagctgtgaagttcctgatgagccgggccaaggatggcttcctggagaagctgaacagcatggagttcatcaccctgagccggctgatggagaccttcatcctggacacagagcagatctgtggcaggaagagcaccagcctgctgggcgccctgcagagccaggccatcaagtttgtgaaccgcttccacgaggagaggaagaccaagctgagcctgctgctggacaatgaacgctggaagcaggctgatgtgcctgctgagttccaggacctggtggacagcctgagtgatggcaagatcgccctgcctgagaagaagagcggggccacagaggagaggaagccagctgaggtgctgattgtggagggccagcagtatgctgtggtgggcaccgtgctgctgctgatccgcatcatcctggagtactgccagtgtgtggacaacatccccagcgtgaccacagacatgctgacccggctgagtgacctgctgaagtacttcaacagccgcagctgccagctggtgctgggcgctggggccctgcaggtggtgggcctgaagaccatcaccaccaagaacctggccctgagcagccgctgcctgcagctgattgtgcactacatccctgtgatccgggcccactttgaggcccggctgccccccaagcagtacagcatgctgcggcactttgaccacatcaccaaggactaccatgaccacatcgccgagatcagcgccaagctggtggccatcatggacagcctgtttgacaagctgctgagcaaatatgaggtgaaggcccctgtgcccagcgcctgcttcaggaacatctgcaagcagatgaccaagatgcatgaggccatctttgacctgctgcctgaggagcagacccagatgctgttcctgcgcatcaatgccagctacaagctgcacctgaagaagcagctgagccacctgaatgtcatcaatgatggcggcccccagaatggcctggtgacagcagatgtggccttctacacaggcaacctgcaggccctgaagggcctgaaggacctggacctgaacatggccgagatctgggagcagaagaggtag

SEQ ID NO: 43477 - DNA, 2901 bp, Artificial Sequence
  Description of Artificial Sequence: Synthetic coding sequence
atggccagcagccacagcagcagccctgtgccccagggcagcagcagtgatgtgttcttcaagattgaggtggaccccagcaagcacatccggcctgtgcccagcctgcctgatgtgtgccccaaggagcccactggagacagccacagcctgtatgtggcccccagcctggtgacagaccagcaccgctggacagtgtaccacagcaaggtgaacctgcctgctgccctgaatgacccccggctggccaagcgggagagtgacttcttcaccaagacctggggcctggactttgtggacacagaggtgatccccagcttctacctgccccagatcagcaaggagcacttcaccgtgtaccagcaggagatcagccagcgggagaagatccacgagcgctgcaagaacatctgcccccccaaggacacctttgagaggaccctgctgcacacccatgacaagagcaggacagacctggagcaggtgcccaagatcttcatgaagccagactttgccctggatgacagcctgaccttcaacagcgtgctgccctggagccacttcaacacagctgggggcaagggcaacagagatgctgccagcagcaagctgctgcaggagaagctgagccactacctggacatcgtggaggtgaacatcgcccaccagatcagcctgcggtctgaggccttcttccacgccatgaccagccagcacgagctgcaggactacctgaggaagaccagccaggccgtgaagatgctgcgggacaagatcgcccagattgacaaggtgatgtgtgagggcagcctgcacatcctgcggctggccctgaccaggaacaactgtgtgaaggtgtacaacaagctgaagctgatggccaccgtgcaccagacccagcccaccgtgcaggtgctgctgagcaccagcgagtttgtgggcgccctggacctgattgccaccacccaggaggtgctgcagcaggagctgcagggcatccacagcttccgccacctgggcagccagctgtgtgagctggagaagctgattgacaagatgatgattgctgagttcagcacctacagccacagcgacctgaaccggcccctggaggatgactgccaggtgctggaggaggagcggctcatcagcctggtgtttggcctgctgaagcagaggaagctgaacttcctggagatctatggagagaagatggtgatcacagccaagaacatcatcaagcagtgtgtgatcaacaaggtgtcccagacagaggagattgacacagatgtggtggtgaagctggccgaccagatgaggatgctgaacttcccccagtggtttgacctgctgaaggacatcttcagcaagttcaccatcttcctgcagagggtgaaggccaccctgaacatcatccacagcgtggtgctgtctgtgctggacaagaaccagaggacccgggagctggaggagatcagccagcagaagaatgctgccaaggacaacagcctggacacagaggtggcctacctgattcatgagggcatgttcatcagtgatgccttcggggagggggagctgacccccatcgctgtggacaccaccagccagagaaatgccagccccaacagcgagccctgcagcagtgacagcgtgtctgagcctgagtgcaccacagacagcagcagcagcaaggagcacaccagcagcagcgccatccctgggggcgtggacatcatggtgtctgaggacatgaagctgacagacagcgagctgggcaagctggccaacaacatccaggagctgctgtacagcgccagtgacatctgccacgacagagctgtgaagttcctgatgagccgggccaaggatggcttcctggagaagctgaacagcatggagttcatcaccctgagccggctgatggagaccttcatcctggacacagagcagatctgtggcaggaagagcaccagcctgctgggcgccctgcagagccaggccatcaagtttgtgaaccgcttccacgaggagaggaagaccaagctgagcctgctgctggacaatgaacgctggaagcaggctgatgtgcctgctgagttccaggacctggtggacagcctgagtgatggcaagatcgccctgcctgagaagaagagcggggccacagaggagaggaagccagctgaggtgctgattgtggagggccagcagtatgctgtggtgggcaccgtgctgctgctgatccgcatcatcctggagtactgccagtgtgtggacaacatccccagcgtgaccacagacatgctgacccggctgagtgacctgctgaagtacttcaacagccgcagctgccagctggtgctgggcgctggggccctgcaggtggtgggcctgaagaccatcaccaccaagaacctggccctgagcagccgctgcctgcagctgattgtgcactacatccctgtgatccgggcccactttgaggcccggctgccccccaagcagtacagcatgctgcggcactttgaccacatcaccaaggactaccatgaccacatcgccgagatcagcgccaagctggtggccatcatggacagcctgtttgacaagctgctgagcaaatatgaggtgaaggcccctgtgcccagcgcctgcttcaggaacatctgcaagcagatgaccaagatgcatgaggccatctttgacctgctgcctgaggagcagacccagatgctgttcctgcgcatcaatgccagctacaagctgcacctgaagaagcagctgagccacctgaatgtcatcaatgatggcggcccccagaatggcctggtgacagcagatgtggccttctacacaggcaacctgcaggccctgaagggcctgaagatctggatgtag

SEQ ID NO: 43478 - DNA, 2898 bp, Artificial Sequence
  Description of Artificial Sequence: Synthetic coding sequence
atggccagcagccacagcagcagccctgtgccccagggcagcagcagtgatgtgttcttcaagattgaggtggaccccagcaagcacatccggcctgtgcccagcctgcctgatgtgtgccccaaggagcccaccgtgacagaccagcaccgctggacagtgtaccacagcaaggtgaacctgcctgctgccctgaatgacccccggctggccaagcgggagagtgacttcttcaccaagacctggggcctggactttgtggacacagaggtgatccccagcttctacctgccccagatcagcaaggagcacttcaccgtgtaccagcaggagatcagccagcgggagaagatccacgagcgctgcaagaacatctgcccccccaaggacacctttgagaggaccctgctgcacacccatgacaagagcaggacagacctggagcaggtgcccaagatcttcatgaagccagactttgccctggatgacagcctgaccttcaacagcgtgctgccctggagccacttcaacacagctgggggcaagggcaacagagatgctgccagcagcaagctgctgcaggagaagctgagccactacctggacatcgtggaggtgaacatcgcccaccagatcagcctgcggtctgaggccttcttccacgccatgaccagccagcacgagctgcaggactacctgaggaagaccagccaggccgtgaagatgctgcgggacaagatcgcccagattgacaaggtgatgtgtgagggcagcctgcacatcctgcggctggccctgaccaggaacaactgtgtgaaggtgtacaacaagctgaagctgatggccaccgtgcaccagacccagcccaccgtgcaggtgctgctgagcaccagcgagtttgtgggcgccctggacctgattgccaccacccaggaggtgctgcagcaggagctgcagggcatccacagcttccgccacctgggcagccagctgtgtgagctggagaagctgattgacaagatgatgattgctgagttcagcacctacagccacagcgacctgaaccggcccctggaggatgactgccaggtgctggaggaggagcggctcatcagcctggtgtttggcctgctgaagcagaggaagctgaacttcctggagatctatggagagaagatggtgatcacagccaagaacatcatcaagcagtgtgtgatcaacaaggtgtcccagacagaggagattgacacagatgtggtggtgaagctggccgaccagatgaggatgctgaacttcccccagtggtttgacctgctgaaggacatcttcagcaagttcaccatcttcctgcagagggtgaaggccaccctgaacatcatccacagcgtggtgctgtctgtgctggacaagaaccagaggacccgggagctggaggagatcagccagcagaagaatgctgccaaggacaacagcctggacacagaggtggcctacctgattcatgagggcatgttcatcagtgatgccttcggggagggggagctgacccccatcgctgtggacaccaccagccagagaaatgccagccccaacagcgagccctgcagcagtgacagcgtgtctgagcctgagtgcaccacagacagcagcagcagcaaggagcacaccagcagcagcgccatccctgggggcgtggacatcatggtgtctgaggacatgaagctgacagacagcgagctgggcaagctggccaacaacatccaggagctgctgtacagcgccagtgacatctgccacgacagagctgtgaagttcctgatgagccgggccaaggatggcttcctggagaagctgaacagcatggagttcatcaccctgagccggctgatggagaccttcatcctggacacagagcagatctgtggcaggaagagcaccagcctgctgggcgccctgcagagccaggccatcaagtttgtgaaccgcttccacgaggagaggaagaccaagctgagcctgctgctggacaatgaacgctggaagcaggctgatgtgcctgctgagttccaggacctggtggacagcctgagtgatggcaagatcgccctgcctgagaagaagagcggggccacagaggagaggaagccagctgaggtgctgattgtggagggccagcagtatgctgtggtgggcaccgtgctgctgctgatccgcatcatcctggagtactgccagtgtgtggacaacatccccagcgtgaccacagacatgctgacccggctgagtgacctgctgaagtacttcaacagccgcagctgccagctggtgctgggcgctggggccctgcaggtggtgggcctgaagaccatcaccaccaagaacctggccctgagcagccgctgcctgcagctgattgtgcactacatccctgtgatccgggcccactttgaggcccggctgccccccaagcagtacagcatgctgcggcactttgaccacatcaccaaggactaccatgaccacatcgccgagatcagcgccaagctggtggccatcatggacagcctgtttgacaagctgctgagcaaatatgaggtgaaggcccctgtgcccagcgcctgcttcaggaacatctgcaagcagatgaccaagatgcatgaggccatctttgacctgctgcctgaggagcagacccagatgctgttcctgcgcatcaatgccagctacaagctgcacctgaagaagcagctgagccacctgaatgtcatcaatgatggcggcccccagaatggcctggtgacagcagatgtggccttctacacaggcaacctgcaggccctgaagggcctgaaggacctggacctgaacatggccgagatctgggagcagaagaggtag

SEQ ID NO: 43479 - DNA, 2898 bp, Artificial Sequence; identical to SEQ ID NO: 43478
  Description of Artificial Sequence: Synthetic coding sequence

SEQ ID NO: 43480 - DNA, 4287 bp, Artificial Sequence
  Description of Artificial Sequence: Synthetic coding sequence
atggagaatgaaccagaccatgaaaatgtggagcagagcctgtgtgccaagaccagcgaggaggagctgaacaagagcttcaacctggaggccagcctgagcaagttctcctacatcgacatggacaaggagctggagttcaagaatgacctgattgatgacaaggagtttgacatcccccaggtggacaccccacccaccctggagagcatcctgaatgaaacagatgatgaagatgagagcttcatcctggaggaccccaccctgctgaacatcgacaccatcgacagccacagctatgacaccagctctgtggccagcagtgacagcggggacaggaccaacctgaagaggaagaagaagctgcctgacagcttcagcctgcacggctctgtgatgaggcacagcctgctgaagggcatcagcgcccagatcgtgtctgctgctgacaaggtggatgctggcctgcccacagccatcgctgtgagcagcctgattgctgtgggcaccagccacggcctggccctgatctttgggaagtaccagaaccaggccctgcggctgtgcctgggcagcacctctgtgggcggccagtatggagccatcagcgccctgagcatcaacaatgactgcagccggctgctgtgtggctttgccaagggccagatcaccatgtgggacctggccagcggcaagctgctgcggagcatcacagatgcccaccccccaggcacagccatcctgcacatcaagttcacagatgaccccaccctggccatctgcaatgacagcggcggctctgtgtttgagctgaccttcaagagggtgatgggcgtgaggacctgtgagagccgctgcctcttcagcggcagcaagggggaggtgtgctgcatcgagcccctgcacagcaagccagagctgaaggaccaccccatcacccagttcagcctgctggccatggccagcctgaccaagatcctggtgattggcctgaagcccagcctgaaggtgtggatgaccttcccctacggccgcatggaccccagctctgtgcccctgctggcctggcactttgtggccgtgcagaactacgtgaaccccatgctggccttctgcagaggagatgtggtgcacttcctgctggtgaagagagatgaaagtggggccatccacgtgaccaagcagaagcacctgcacctgtactatgacctgatcaacttcacctggatcaacagcaggacagtggtgctgctggacagcgtggagaagctgcacgtgattgaccggcagacccaggaggagctggagaccgtggagatcagcgaggtgcagctggtgtacaacagcagccacttcaagagcctggccactggaggaaatgtgtcccaggccctggccctggtgggggagaaggcctgctaccagagcatcagcagctatggaggccagatcttctacctgggcaccaagtctgtgtatgtgatgatgctgcgctcctggagggagcgggtggaccacctgctgaagcaggactgcctgacagaggccctggccctggcctggagcttccacgagggcaaggccaaggctgtggtgggcctgtctggagatgccagcaagaggaaggccatcgtggccgacaggatggtggagatcctcttccactatgctgaccgggccctgaagaagtgcccagaccagggcaagatccaggtgatggagcagcacttccaggacatggtgcctgtgattgtggactactgcctgctgctgcagaggaaggacctgctcttcagccagatgtatgacaagctgtctgaaaattctgtggccaagggcgtcttcctggagtgcctggagccctacatcctgagtgacaagctggtgggcatcaccccccaggtgatgaaggacctgattgtgcacttccaggacaagaagctgatggagaatgtggaggccctgattgtgcacatggacatcaccagcctggacatccagcaggtggtgctgatgtgctgggagaaccggctgtatgatgccatgatctacgtgtacaacagaggcatgaatgagttcatcagccccatggagaagctgttccgggtcatcgccccacccctgaatgctgggaagaccctgacagatgagcaggtggtgatgggcaacaagctgctggtgtacatcagctgctgcctggccggccgggcctaccccctgggggacatccctgaggacctggtgcccctggtgaagaaccaggtgtttgagttcctgatccggctgcacagcgctgaggccagccctgaggaggagatctacccctacatccgcaccctgctgcactttgacacccgggagttcctgaatgtgctggccctgacctttgaggacttcaagaatgacaagcaggccgtggagtaccagcagagaattgtggacatcctgctgaaggtgatggtggagaacagcgacttcacccccagccaggtgggctgcctcttcaccttcctggcccggcagctggccaagccagacaacaccctgtttgtgaacagaaccctgtttgaccaggtgctggagttcctgtgcagcccagatgatgacagccgccacagcgagcggcagcaggtgctgctggagctgctgcaggccggcggcatcgtgcagtttgaggagagccgcctcatccgcatggccgagaaggccgagttctaccagatctgtgagttcatgtatgagcgggagcaccagtatgacaagatcatcgactgctacctgcgggaccccctgcgggaggaggaggtgttcaactacatccacaacatcctgagcatccctggccacagcgctgaggagaagcagagcgtgtggcagaaggccatggaccacatcgaggagctggtgtccctgaagccctgcaaggctgctgagctggtggccacccacttcagcggccacatcgagaccgtcatcaagaagctgcagaaccaggtgctgctcttcaagttcctgcggagcctgctggacccccgggagggcatccacgtgaaccaggagctgctgcagatcagcccctgcatcacagagcagttcatcgagctgctgtgccagttcaaccccacccaggtgattgagaccctgcaggtgctggagtgctaccgcctggaggagaccatccagatcacccagaagtaccagctgcacgaggtgacagcctacctgctggagaagaagggggacatccatggagccttcctgatcatgctggagcggctgcagagcaagctgcaggaggtgacccaccagggcgagaacaccaaggaggaccccagcctgaaggatgtggaggacaccatggtggagaccatcgccctgtgccagaggaacagccacaacctgaaccagcagcagcgggaggccctgtggttccccctgctggaggccatgatggccccccagaagctgagcagcagcgccatcccccacctgcacagcgaggccctgaagagcctgaccatgcaggtgctgaacagcatggccgccttcatcgccctgcccagcatcctgcagaggatcctgcaggaccctgtgtatggcaagggcaagctgggggagatccagggcctcatcctgggcatgctggacaccttcaactatgagcagaccctgctggagaccaccaccagcctgctgaaccaggacctgcactggagcctgtgcaacctgcgggcctctgtgacccggggcctgaaccccaagcaggactactgcagcatctgcctgcagcagtacaagaggcggcaggagatggctgatgagatcatcgtgttcagctgtggccacctgtaccacagcttctgcctgcagaacaaggaatgtactgtggagtttgagggccagacccgctggacctgctacaagtgcagcagcagcaacaaggtgggcaagctgtctgagaacagcagcgagatcaagaagggccgcatcacccccagccaggtgaagatgagccccagctaccaccagagcaaaggagaccccacagccaagaagggcaccagcgagcctgtgctggacccccagcagatccaggcctttgaccagctgtgccgcctgtaccggggcagcagccggctggccctgctgacagagctgagccagaacagaagcagcgagagctaccggcccttcagcggcagccagagcgccccagccttcaacagcatcttccagaatgaaaacttccagctgcagctgatccccccacctgtgacagaagattag

SEQ ID NO: 43481 - DNA, 609 bp, Artificial Sequence
  Description of Artificial Sequence: Synthetic coding sequence
atggagaatgaaccagaccatgaaaatgtggagcagagcctgtgtgccaagaccagcgaggaggagctgaacaagagcttcaacctggaggccagcctgagcaagttctcctacatcgacatggacaaggagctggagttcaagaatgacctgattgatgacaaggagtttgacatcccccaggtggacaccccacccaccctggagagcatcctgaatgaaacagatgatgaagatgagagcttcatcctggaggaccccaccctgctgaacatcgacaccatcgacagccacagctatgacaccagctctgtggccagcagtgacagcggggacaggaccaacctgaagaggaagaagaagctgcctgacagcttcagcctgcacggctctgtgatgaggcacagcctgctgaagggcatcagcgcccagatcgtgtctgctgctgacaaggtggatgctggcctgcccacagccatcgctgtgagcagcctgattgctgtgggcaccagccacggcctggccctgatctttgaccagaaccaggccctgcggctgtgcctgggcagcacctctgtgggcggccagtatggagccatcagcgcctag

SEQ ID NO: 43482 - DNA, 4281 bp, Artificial Sequence
  Description of Artificial Sequence: Synthetic coding sequence
atggagaatgaaccagaccatgaaaatgtggagcagagcctgtgtgccaagaccagcgaggaggagctgaacaagagcttcaacctggaggccagcctgagcaagttctcctacatcgacatggacaaggagctggagttcaagaatgacctgattgatgacaaggagtttgacatcccccaggtggacaccccacccaccctggagagcatcctgaatgaaacagatgatgaagatgagagcttcatcctggaggaccccaccctgctgaacatcgacaccatcgacagccacagctatgacaccagctctgtggccagcagtgacagcggggacaggaccaacctgaagaggaagaagaagctgcctgacagcttcagcctgcacggctctgtgatgaggcacagcctgctgaagggcatcagcgcccagatcgtgtctgctgctgacaaggtggatgctggcctgcccacagccatcgctgtgagcagcctgattgctgtgggcaccagccacggcctggccctgatctttgaccagaaccaggccctgcggctgtgcctgggcagcacctctgtgggcggccagtatggagccatcagcgccctgagcatcaacaatgactgcagccggctgctgtgtggctttgccaagggccagatcaccatgtgggacctggccagcggcaagctgctgcggagcatcacagatgcccaccccccaggcacagccatcctgcacatcaagttcacagatgaccccaccctggccatctgcaatgacagcggcggctctgtgtttgagctgaccttcaagagggtgatgggcgtgaggacctgtgagagccgctgcctcttcagcggcagcaagggggaggtgtgctgcatcgagcccctgcacagcaagccagagctgaaggaccaccccatcacccagttcagcctgctggccatggccagcctgaccaagatcctggtgattggcctgaagcccagcctgaaggtgtggatgaccttcccctacggccgcatggaccccagctctgtgcccctgctggcctggcactttgtggccgtgcagaactacgtgaaccccatgctggccttctgcagaggagatgtggtgcacttcctgctggtgaagagagatgaaagtggggccatccacgtgaccaagcagaagcacctgcacctgtactatgacctgatcaacttcacctggatcaacagcaggacagtggtgctgctggacagcgtggagaagctgcacgtgattgaccggcagacccaggaggagctggagaccgtggagatcagcgaggtgcagctggtgtacaacagcagccacttcaagagcctggccactggaggaaatgtgtcccaggccctggccctggtgggggagaaggcctgctaccagagcatcagcagctatggaggccagatcttctacctgggcaccaagtctgtgtatgtgatgatgctgcgctcctggagggagcgggtggaccacctgctgaagcaggactgcctgacagaggccctggccctggcctggagcttccacgagggcaaggccaaggctgtggtgggcctgtctggagatgccagcaagaggaaggccatcgtggccgacaggatggtggagatcctcttccactatgctgaccgggccctgaagaagtgcccagaccagggcaagatccaggtgatggagcagcacttccaggacatggtgcctgtgattgtggactactgcctgctgctgcagaggaaggacctgctcttcagccagatgtatgacaagctgtctgaaaattctgtggccaagggcgtcttcctggagtgcctggagccctacatcctgagtgacaagctggtgggcatcaccccccaggtgatgaaggacctgattgtgcacttccaggacaagaagctgatggagaatgtggaggccctgattgtgcacatggacatcaccagcctggacatccagcaggtggtgctgatgtgctgggagaaccggctgtatgatgccatgatctacgtgtacaacagaggcatgaatgagttcatcagccccatggagaagctgttccgggtcatcgccccacccctgaatgctgggaagaccctgacagatgagcaggtggtgatgggcaacaagctgctggtgtacatcagctgctgcctggccggccgggcctaccccctgggggacatccctgaggacctggtgcccctggtgaagaaccaggtgtttgagttcctgatccggctgcacagcgctgaggccagccctgaggaggagatctacccctacatccgcaccctgctgcactttgacacccgggagttcctgaatgtgctggccctgacctttgaggacttcaagaatgacaagcaggccgtggagtaccagcagagaattgtggacatcctgctgaaggtgatggtggagaacagcgacttcacccccagccaggtgggctgcctcttcaccttcctggcccggcagctggccaagccagacaacaccctgtttgtgaacagaaccctgtttgaccaggtgctggagttcctgtgcagcccagatgatgacagccgccacagcgagcggcagcaggtgctgctggagctgctgcaggccggcggcatcgtgcagtttgaggagagccgcctcatccgcatggccgagaaggccgagttctaccagatctgtgagttcatgtatgagcgggagcaccagtatgacaagatcatcgactgctacctgcgggaccccctgcgggaggaggaggtgttcaactacatccacaacatcctgagcatccctggccacagcgctgaggagaagcagagcgtgtggcagaaggccatggaccacatcgaggagctggtgtccctgaagccctgcaaggctgctgagctggtggccacccacttcagcggccacatcgagaccgtcatcaagaagctgcagaaccaggtgctgctcttcaagttcctgcggagcctgctggacccccgggagggcatccacgtgaaccaggagctgctgcagatcagcccctgcatcacagagcagttcatcgagctgctgtgccagttcaaccccacccaggtgattgagaccctgcaggtgctggagtgctaccgcctggaggagaccatccagatcacccagaagtaccagctgcacgaggtgacagcctacctgctggagaagaagggggacatccatggagccttcctgatcatgctggagcggctgcagagcaagctgcaggaggtgacccaccagggcgagaacaccaaggaggaccccagcctgaaggatgtggaggacaccatggtggagaccatcgccctgtgccagaggaacagccacaacctgaaccagcagcagcgggaggccctgtggttccccctgctggaggccatgatggccccccagaagctgagcagcagcgccatcccccacctgcacagcgaggccctgaagagcctgaccatgcaggtgctgaacagcatggccgccttcatcgccctgcccagcatcctgcagaggatcctgcaggaccctgtgtatggcaagggcaagctgggggagatccagggcctcatcctgggcatgctggacaccttcaactatgagcagaccctgctggagaccaccaccagcctgctgaaccaggacctgcactggagcctgtgcaacctgcgggcctctgtgacccggggcctgaaccccaagcaggactactgcagcatctgcctgcagcagtacaagaggcggcaggagatggctgatgagatcatcgtgttcagctgtggccacctgtaccacagcttctgcctgcagaacaaggaatgtactgtggagtttgagggccagacccgctggacctgctacaagtgcagcagcagcaacaaggtgggcaagctgtctgagaacagcagcgagatcaagaagggccgcatcacccccagccaggtgaagatgagccccagctaccaccagagcaaaggagaccccacagccaagaagggcaccagcgagcctgtgctggacccccagcagatccaggcctttgaccagctgtgccgcctgtaccggggcagcagccggctggccctgctgacagagctgagccagaacagaagcagcgagagctaccggcccttcagcggcagccagagcgccccagccttcaacagcatcttccagaatgaaaacttccagctgcagctgatccccccacctgtgacagaagattag

SEQ ID NO: 43483 - DNA, 4287 bp, Artificial Sequence
  Description of Artificial Sequence: Synthetic coding sequence
atggagaatgaaccagaccatgaaaatgtggagcagagcctgtgtgccaagaccagcgaggaggagctgaacaagagcttcaacctggaggccagcctgagcaagttctcctacatcgacatggacaaggagctggagttcaagaatgacctgattgatgacaaggagtttgacatcccccaggtggacaccccacccaccctggagagcatcctgaatgaaacagatgatgaagatgagagcttcatcctggaggaccccaccctgctgaacatcgacaccatcgacagccacagctatgacaccagctctgtggccagcagtgacagcggggacaggaccaacctgaagaggaagaagaagctgcctgacagcttcagcctgcacggctctgtgatgaggcacagcctgctgaagggcatcagcgcccagatcgtgtctgctgctgacaaggtggatgctggcctgcccacagccatcgctgtgagcagcctgattgctgtgggcaccagccacggcctggccctgatctttgggaaggaccagaaccaggccctgcggctgtgcctgggcagcacctctgtgggcggccagtatggagccatcagcgccctgagcatcaacaatgactgcagccggctgctgtgtggctttgccaagggccagatcaccatgtgggacctggccagcggcaagctgctgcggagcatcacagatgcccaccccccaggcacagccatcctgcacatcaagttcacagatgaccccaccctggccatctgcaatgacagcggcggctctgtgtttgagctgaccttcaagagggtgatgggcgtgaggacctgtgagagccgctgcctcttcagcggcagcaagggggaggtgtgctgcatcgagcccctgcacagcaagccagagctgaaggaccaccccatcacccagttcagcctgctggccatggccagcctgaccaagatcctggtgattggcctgaagcccagcctgaaggtgtggatgaccttcccctacggccgcatggaccccagctctgtgcccctgctggcctggcactttgtggccgtgcagaactacgtgaaccccatgctggccttctgcagaggagatgtggtgcacttcctgctggtgaagagagatgaaagtggggccatccacgtgaccaagcagaagcacctgcacctgtactatgacctgatcaacttcacctggatcaacagcaggacagtggtgctgctggacagcgtggagaagctgcacgtgattgaccggcagacccaggaggagctggagaccgtggagatcagcgaggtgcagctggtgtacaacagcagccacttcaagagcctggccactggaggaaatgtgtcccaggccctggccctggtgggggagaaggcctgctaccagagcatcagcagctatggaggccagatcttctacctgggcaccaagtctgtgtatgtgatgatgctgcgctcctggagggagcgggtggaccacctgctgaagcaggactgcctgacagaggccctggccctggcctggagcttccacgagggcaaggccaaggctgtggtgggcctgtctggagatgccagcaagaggaaggccatcgtggccgacaggatggtggagatcctcttccactatgctgaccgggccctgaagaagtgcccagaccagggcaagatccaggtgatggagcagcacttccaggacatggtgcctgtgattgtggactactgcctgctgctgcagaggaaggacctgctcttcagccagatgtatgacaagctgtctgaaaattctgtggccaagggcgtcttcctggagtgcctggagccctacatcctgagtgacaagctggtgggcatcaccccccaggtgatgaaggacctgattgtgcacttccaggacaagaagctgatggagaatgtggaggccctgattgtgcacatggacatcaccagcctggacatccagcaggtggtgctgatgtgctgggagaaccggctgtatgatgccatgatctacgtgtacaacagaggcatgaatgagttcatcagccccatggagaagctgttccgggtcatcgccccacccctgaatgctgggaagaccctgacagatgagcaggtggtgatgggcaacaagctgctggtgtacatcagctgctgcctggccggccgggcctaccccctgggggacatccctgaggacctggtgcccctggtgaagaaccaggtgtttgagttcctgatccggctgcacagcgctgaggccagccctgaggaggagatctacccctacatccgcaccctgctgcactttgacacccgggagttcctgaatgtgctggccctgacctttgaggacttcaagaatgacaagcaggccgtggagtaccagcagagaattgtggacatcctgctgaaggtgatggtggagaacagcgacttcacccccagccaggtgggctgcctcttcaccttcctggcccggcagctggccaagccagacaacaccctgtttgtgaacagaaccctgtttgaccaggtgctggagttcctgtgcagcccagatgatgacagccgccacagcgagcggcagcaggtgctgctggagctgctgcaggccggcggcatcgtgcagtttgaggagagccgcctcatccgcatggccgagaaggccgagttctaccagatctgtgagttcatgtatgagcgggagcaccagtatgacaagatcatcgactgctacctgcgggaccccctgcgggaggaggaggtgttcaactacatccacaacatcctgagcatccctggccacagcgctgaggagaagcagagcgtgtggcagaaggccatggaccacatcgaggagctggtgtccctgaagccctgcaaggctgctgagctggtggccacccacttcagcggccacatcgagaccgtcatcaagaagctgcagaaccaggtgctgctcttcaagttcctgcggagcctgctggacccccgggagggcatccacgtgaaccaggagctgctgcagatcagcccctgcatcacagagcagttcatcgagctgctgtgccagttcaaccccacccaggtgattgagaccctgcaggtgctggagtgctaccgcctggaggagaccatccagatcacccagaagtaccagctgcacgaggtgacagcctacctgctggagaagaagggggacatccatggagccttcctgatcatgctggagcggctgcagagcaagctgcaggaggtgacccaccagggcgagaacaccaaggaggaccccagcctgaaggatgtggaggacaccatggtggagaccatcgccctgtgccagaggaacagccacaacctgaaccagcagcagcgggaggccctgtggttccccctgctggaggccatgatggccccccagaagctgagcagcagcgccatcccccacctgcacagcgaggccctgaagagcctgaccatgcaggtgctgaacagcatggccgccttcatcgccctgcccagcatcctgcagaggatcctgcaggaccctgtgtatggcaagggcaagctgggggagatccagggcctcatcctgggcatgctggacaccttcaactatgagcagaccctgctggagaccaccaccagcctgctgaaccaggacctgcactggagcctgtgcaacctgcgggcctctgtgacccggggcctgaaccccaagcaggactactgcagcatctgcctgcagcagtacaagaggcggcaggagatggctgatgagatcatcgtgttcagctgtggccacctgtaccacagcttctgcctgcagaacaaggaatgtactgtggagtttgagggccagacccgctggacctgctacaagtgcagcagcagcaacaaggtgggcaagctgtctgagaacagcagcgagatcaagaagggccgcatcacccccagccaggtgaagatgagccccagctaccaccagagcaaaggagaccccacagccaagaagggcaccagcgagcctgtgctggacccccagcagatccaggcctttgaccagctgtgccgcctgtaccggggcagcagccggctggccctgctgacagagctgagccagaacagaagcagcgagagctaccggcccttcagcggcagccagagcgccccagccttcaacagcatcttccagaatgaaaacttccagctgcagctgatccccccacctgtgacagaagattag

SEQ ID NO: 43484 - DNA, 423 bp, Artificial Sequence
  Description of Artificial Sequence: Synthetic coding sequence
atggagaatgaaccagaccatgaaaatgtggagcagagcctgtgtgccaagaccagcgaggaggagctgaacaagagcttcaacctggaggccagcctgagcaagttctcctacatcgacatggacaaggagctggagttcaagaatgacctgattgatgacaaggagtttgacatcccccaggtggacaccccacccaccctggagagcatcctgaatgaaacagatgatgaagatgagagcttcatcctggaggaccccaccctgctgaacatcgacaccatcgacagccacagctatgacaccagctctgtggccagcagtgacagcggggacaggaccaacctgaagaggaagaagaagctgcctgacagcttcagcctgcacggctctgtgatgaggcacagcctgctgaagggctag

SEQ ID NO: 43485 - DNA, 366 bp, Artificial Sequence
  Description of Artificial Sequence: Synthetic coding sequence
atggagaatgaaccagaccatgaaaatgtggagcagagcctgtgtgccaagaccagcgaggaggagctgaacaagagcttcaacctggaggccagcctgagcaagttctcctacatcgacatggacaaggagctggagttcaagaatgacctgattgatgacaaggagtttgacatcccccaggtggacaccccacccaccctggagagcatcctgaatgaaacagatgatgaagatgagagcttcatcctggaggaccccaccctgctgaacatcgacaccatcgacagccacagctatgacaccagctctgtggccagcagtgacagcggggacaggaccaacctgaagaggaagaagaagtag

SEQ ID NO: 43486 - DNA, 4011 bp, Artificial Sequence
  Description of Artificial Sequence: Synthetic coding sequence
atggagaatgaaccagaccatgaaaatgtggagcagagcctgtgtgccaagaccagcgaggaggagctgaacaagagcttcaacctggaggccagcctgagcaagttctcctacatcgacatggacaaggagctggagttcaagaatgacctgattgatgacaaggagtttgacatcccccaggtggacaccccacccaccctggagagcatcctgaatgaaacagatgatgaagatgagagcttcatcctggaggaccccaccctgctgaacatcgacaccatcgacagccacagctatgacaccagctctgtggccagcagtgacagcggggacaggaccaacctgaagaggaagaagaagctgcctgacagcttcagcctgcacggctctgtgatgaggcacagcctgctgaagggcatcagcgcccagatcgtgtctgctgctgacaaggtggatgctggcctgcccacagccatcgctgtgagcagcctgattgctgtgggcaccagccacggcctggccctgatctttgaccagaaccaggccctgcggctgtgcctgggcagcacctctgtgggcggccagtatggagccatcagcgccctgagcatcaacaatgactgcagccggctgctgtgtggctttgccaagggccagatcaccatgtgggacctggccagcggcaagctgctgcggagcatcacagatgcccaccccccaggcacagccatcctgcacatcaagttcacagatgaccccaccctggccatctgcaatgacagcggcggctctgtgtttgagctgaccttcaagagggtgatgggcgtgaggacctgtgagagccgctgcctcttcagcggcagcaagggggaggtgtgctgcatcgagcccctgcacagcaagccagagctgaaggaccaccccatcacccagttcagcctgctggccatggccagcctgaccaagatcctggtgattggcctgaagcccagcctgaaggtgtggatgaccttcccctacggccgcatggaccccagctctgtgcccctgctggcctggcactttgtggccgtgcagaactacgtgaaccccatgctggccttctgcagaggagatgtggtgcacttcctgctggtgaagagagatgaaagtggggccatccacgtgaccaagcagaagcacctgcacctgtactatgacctgatcaacttcacctggatcaacagcaggacagtggtgctgctggacagcgtggagaagctgcacgtgattgaccggcagacccaggaggagctggagaccgtggagatcagcgaggtgcagctggtgtacaacagcagccacttcaagagcctggccactggaggaaatgtgtcccaggccctggccctggtgggggagaaggcctgctaccagagcatcagcagctatggaggccagatcttctacctgggcaccaagtctgtgtatgtgatgatgctgcgctcctggagggagcgggtggaccacctgctgaagcaggactgcctgacagaggccctggccctggcctggagcttccacgagggcaaggccaaggctgtggtgggcctgtctggagatgccagcaagaggaaggccatcgtggccgacaggatggtggagatcctcttccactatgctgaccgggccctgaagaagtgcccagaccagggcaagatccaggtgatggagcagcacttccaggtggtgctgatgtgctgggagaaccggctgtatgatgccatgatctacgtgtacaacagaggcatgaatgagttcatcagccccatggagaagctgttccgggtcatcgccccacccctgaatgctgggaagaccctgacagatgagcaggtggtgatgggcaacaagctgctggtgtacatcagctgctgcctggccggccgggcctaccccctgggggacatccctgaggacctggtgcccctggtgaagaaccaggtgtttgagttcctgatccggctgcacagcgctgaggccagccctgaggaggagatctacccctacatccgcaccctgctgcactttgacacccgggagttcctgaatgtgctggccctgacctttgaggacttcaagaatgacaagcaggccgtggagtaccagcagagaattgtggacatcctgctgaaggtgatggtggagaacagcgacttcacccccagccaggtgggctgcctcttcaccttcctggcccggcagctggccaagccagacaacaccctgtttgtgaacagaaccctgtttgaccaggtgctggagttcctgtgcagcccagatgatgacagccgccacagcgagcggcagcaggtgctgctggagctgctgcaggccggcggcatcgtgcagtttgaggagagccgcctcatccgcatggccgagaaggccgagttctaccagatctgtgagttcatgtatgagcgggagcaccagtatgacaagatcatcgactgctacctgcgggaccccctgcgggaggaggaggtgttcaactacatccacaacatcctgagcatccctggccacagcgctgaggagaagcagagcgtgtggcagaaggccatggaccacatcgaggagctggtgtccctgaagccctgcaaggctgctgagctggtggccacccacttcagcggccacatcgagaccgtcatcaagaagctgcagaaccaggtgctgctcttcaagttcctgcggagcctgctggacccccgggagggcatccacgtgaaccaggagctgctgcagatcagcccctgcatcacagagcagttcatcgagctgctgtgccagttcaaccccacccaggtgattgagaccctgcaggtgctggagtgctaccgcctggaggagaccatccagatcacccagaagtaccagctgcacgaggtgacagcctacctgctggagaagaagggggacatccatggagccttcctgatcatgctggagcggctgcagagcaagctgcaggaggtgacccaccagggcgagaacaccaaggaggaccccagcctgaaggatgtggaggacaccatggtggagaccatcgccctgtgccagaggaacagccacaacctgaaccagcagcagcgggaggccctgtggttccccctgctggaggccatgatggccccccagaagctgagcagcagcgccatcccccacctgcacagcgaggccctgaagagcctgaccatgcaggtgctgaacagcatggccgccttcatcgccctgcccagcatcctgcagaggatcctgcaggaccctgtgtatggcaagggcaagctgggggagatccagggcctcatcctgggcatgctggacaccttcaactatgagcagaccctgctggagaccaccaccagcctgctgaaccaggacctgcactggagcctgtgcaacctgcgggcctctgtgacccggggcctgaaccccaagcaggactactgcagcatctgcctgcagcagtacaagaggcggcaggagatggctgatgagatcatcgtgttcagctgtggccacctgtaccacagcttctgcctgcagaacaaggaatgtactgtggagtttgagggccagacccgctggacctgctacaagtgcagcagcagcaacaaggtgggcaagctgtctgagaacagcagcgagatcaagaagggccgcatcacccccagccaggtgaagatgagccccagctaccaccagagcaaaggagaccccacagccaagaagggcaccagcgagcctgtgctggacccccagcagatccaggcctttgaccagctgtgccgcctgtaccggggcagcagccggctggccctgctgacagagctgagccagaacagaagcagcgagagctaccggcccttcagcggcagccagagcgccccagccttcaacagcatcttccagaatgaaaacttccagctgcagctgatccccccacctgtgacagaagattag

SEQ ID NO: 43487 - DNA, 225 bp, Artificial Sequence
  Description of Artificial Sequence: Synthetic coding sequence
atggagaatgaaccagaccatgaaaatgtggagcagagcctgtgtgccaagaccagcgaggaggagctgaacaagagcttcaacctggaggccagcctgagcaagttctcctacatcgacatggacaaggagctggagttcaagaatgacctgattgatgacaaggagtttgacatcccccaggtggacaccccacccaccctggagagcatcctgaatgaatag

SEQ ID NO: 43488 - DNA, 741 bp, Artificial Sequence
  Description of Artificial Sequence: Synthetic coding sequence
atgagccccaagccccgggccagcggccccccagccaaggccaaggaggccggcaagaggaagagcagcagccagcccagccccagcgaccccaagaagaagaccaccaaggtggccaagaagggcaaggctgtgcggcggggcagaagaggcaagaagggagctgccaccaagatggctgctgtgacagcccctgaggccgagagcggccctgctgcccctggccccagcgaccagcccagccaggagctgccccagcacgagctgcccccagaggagcctgtgtctgagggcacccagcacgaccccctgagccaggagagcgagctggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgaggtggaggagcccctgagccaggagagcgaggtggaggagcccctgagccaggagagccaggtggaggagcccctgagccaggagagcgaggtggaggagcccctgagccaggagagccaggtggaggagcccctgagccaggagagcgagatggaggagcccctgagccaggagagccaggtggaggagcccctgagccaggagagcgagatggaggagcccctgagccaggagagcgagatggaggagctgcccagcgtgtag

SEQ ID NO: 43489 - DNA, 378 bp, Artificial Sequence
  Description of Artificial Sequence: Synthetic coding sequence
atgagccccaagccccgggccagcggccccccagccaaggccaaggagaccgggaagaggaagagcagcagccagcccagccccagcggccccaagaagaagaccaccaaggtggccgagaagggggaggccgtgcggggcggcagaagaggcaagaagggagctgccaccaagatggctgctgtgacagcccctgaggccgagagcggccctgctgcccctggccccagcgaccagcccagccaggagctgccccagcacgagctgcccccagaggagcctgtgtctgagggcacccagcacgaccccctgagccaggagagcgagctggaggagcccctgagcaagggccggcccagcacccccctgagcccctag

SEQ ID NO: 43490 - DNA, 2109 bp, Artificial Sequence
  Description of Artificial Sequence: Synthetic coding sequence
atgaccagcaggaaccagctggtgcagaaggtgctgcaggagctgcaggaggccgtggagtgtgagggcctggagggcctcatcggggccagcctggaggccaagcaggtgctgagcagcttcaccctgcccacctgccgggagggcggccctggcctgcaggtgctggaggtggacagcgtggccctgagcctgtacccagaagatgcccccaggaacatgctgcccctggtgtgcaagggggagggcagcctgctgtttgaagctgcctccatgctgctgtggggagatgctggcctgagcctggagctgcgggccaggacagtggtggagatgctgctgcaccgccactactacctgcagggcatgattgacagcaaggtgatgctgcaggccgtgcgctacagcctgtgcagcgaggagagccctgagatgaccagcctgcccccagccaccctggaggccatctttgatgctgatgtgaaggccagctgcttccccagcagcttcagcaatgtgtggcacctgtatgccctggcctctgtgctgcagaggaacatctacagcatctaccccatgaggaacctgaagatccggccctacttcaacagagtcatccggccccggcgctgtgaccacgtgcccagcaccctgcacatcatgtgggccggccagcccctgaccagccacttcttccgccaccagtactttgcccctgtggtgggcctggaggaggtggaggccgagggcgcccctggggtggccccagccctgcctgccctggcccccctgagcagccctgccaagaccctggagctgctgaaccgggagcccggcctgagctacagccacctgtgtgagcgctacagcgtgaccaagagcaccttctaccgctggaggcggcagagccaggagcaccggcagaaggtggccgcccgcttcagcgccaagcacttcctgcaggacagcttccacagaggaggagtggtgcccctgcagcagttcctgcagcgcttccctgagatcagccgcagcacctactatgcctggaagcatgagctgctgggcagcggcacctgcccagccctgcccccccgggaggtgctgggcatggaggagctggagaagctgcctgaggagcaggtggccgaggaggagctggagtgcagcgccctggccgtgagcagccctggcatggtgctgatgcagagggccaagctgtacctggagcactgcatcagcctgaacaccctggtgccctaccgctgcttcaagaggcgcttccctggcatcagccgcagcacctactacaactggaggaggaaggccctgcggaggaaccccagcttcaagccagccccagccctgtctgctgctggcaccccccagctggcctctgtgggggagggcgctgtgatcccctggaagtctgaggccgaggagggcgctggaaatgccactggagaagatcctccagcccctggagagctgctgcccctgaggatgcccctgagccgctggcagaggcggctgcggcgggccgcccggcggcaggtgctgagcggccacctgcccttctgccgcttccggctgcgctaccccagcctgagccccagcgccttctgggtgtggaagagcctggcccggggctggccccggggcctgagcaagctgcaggtgcctgtgcccaccctgggcaaaggaggccaggaggccgaggagaagcaggagaaggaggccggcagagatgtgacagctgtgatggcccctcctgtgggcgccagcagtgaagatgtggagggcggccccagccgggagggcgccctgcaggagggcgccacagcccagggccagccccacagcggccccctgctgagccagcctgtggtggccgctgctgggggcagagatggccgcatgctggtgatggacatgattgccaccaccaagttcaaggcccaggccaagctgttcctgcagaagcgcttccagagcaagagcttccccagctacaaggagttcagcgccctcttccccctgacagcccggagcacctactacatgtggaagagggccctgtatgatggcctgaccctggtggatggatag

SEQ ID NO: 43491 - DNA, 252 bp, Artificial Sequence
  Description of Artificial Sequence: Synthetic coding sequence
atgaccagcaggaaccagctggtgcagaaggtgctgcaggagctgcaggaggccgtggagtgtgagggcctggagggcctcatcggggccagcctggaggccaagcaggtgctgagcagcttcaccctgcccacctgccgggagggcggccctggcctgcaggtgctggaggtggacagcgtggccctgagcctgtacccagaagatgcccccaggaacatgctgcccctggtgtgcaagggggagggctag

SEQ ID NO: 43492 - DNA, 1260 bp, Artificial Sequence
  Description of Artificial Sequence: Synthetic coding sequence
atggccaaggagggcgtggagaaggccgaggagacagagcagatgattgagaaggaggccggcaaggagcctgctgagggcggcggcggagatggcagccaccggctgggagatgcccaggagatgagagctgtggtgctggccggctttggaggcctgaacaagctgcggctcttcaggaaggccatgcctgagccccaggatggagagctgaagatccgggtgaaggcctgtggcctgaacttcatcgacctgatggtgcggcagggcaacatcgacaacccccccaagacccccctggtgcccggctttgaatgttctggaattgtggaggccctgggggacagcgtgaagggctatgagatcggggacagagtgatggcctttgtgaactacaatgcctgggccgaggtggtgtgcacccctgtggagtttgtgtacaagatcccagatgacatgtccttcagcgaggccgccgccttccccatgaactttgtgacagcctacgtgatgctgtttgaggtggccaacctgcgggagggcatgtctgtgctggtgcacagcgctgggggcggcgtgggccaggccgtggcccagctgtgcagcacagtgcccaacgtgacagtgtttggaacagccagcaccttcaagcatgaggccatcaaggacagcgtgacccacctgtttgacagaaatgctgactatgtgcaggaggtgaagaggatctctgctgagggcgtggacatcgtgctggactgcctgtgtggggacaacacaggcaagggcctgagcctgctgaagcccctgggcacctacatcctgtatggcagcagcaacatggtgactggagagaccaagagcttcttctcctttgccaagtcctggtggcaggtggagaaggtgaaccccatcaagctgtatgaggagaacaaggtgattgctggcttcagcctgctgaacctgctcttcaagcagggccgggccggcctcatccggggcgtggtggagaagctgattggcctgtacaaccagaagaagatcaagcctgtggtggacagcctgtgggccctggaggaggtgaaggaggccatgcagagaattcatgaccggggcaacatcggcaagctgatcctggatgtggagaagacccccacccccctgatggccaatgacagcacagagaccagcgaggccggggaggaggaggaggaccatgaaggagacagcgagaacaaggagaggatgcccttcatccagtag

SEQ ID NO: 43493 - DNA, 648 bp, Artificial Sequence
  Description of Artificial Sequence: Synthetic coding sequence
atggtgctgctgaccatgattgcccgggtggctgatggcctgcccctggccgcctccatgcaggaggatgagcagagcggccgggacctgcagcagtaccagagccaggccaagcagctgttcaggaagctgaatgagcagagccccacccgctgcaccctggaggccggggccatgaccttccactacatcatcgagcagggcgtgtgctacctggtgctgtgtgaggccgccttccccaagaagctggcctttgcctacctggaggacctgcacagcgagtttgatgagcagcacggcaagaaggtgcccaccgtgtcccggccctacagcttcattgaatttgacaccttcatccagaagaccaagaagctgtacatcgacagccgggcccggaggaacctgggcagcatcaacacagagctgcaggatgtgcagaggatcatggtggccaacatcgaggaggtgctgcagagaggagaggccctgagcgccctggacagcaaggccaacaacctgagcagcctgagcaagaagtaccggcaggatgccaagtacctgaacatgaggagcacctacgccaagctggccgctgtggccgtgttcttcatcatgctgattgtgtatgtgcgcttctggtggctgtag

SEQ ID NO: 43494 - DNA, 873 bp, Artificial Sequence
  Description of Artificial Sequence: Synthetic coding sequence
atggagacccccctggatgtgctgagcagagctgccagcctggtgcatgctgatgatgagaagcgggaggccgccctgcggggggagccccgcatccagaccctgcctgtggccagcgccctgagcagccacaggacaggccccccacccatcagccccagcaagaggaagttctccatggagcctggagatgaggacctggactgtgacaatgaccacgtgtccaagatgagccgcatcttcaacccccacctgaacaagacagccaacggggactgccggcgggacccccgggagaggagccgcagccccatcgagagagctgtggcccccaccatgagcctgcacggcagccacctgtacaccagcctgcccagcctgggcctggagcagcccctggccctgaccaagaacagcctggatgccagcaggcctgctggcctgagccccaccctgaccccaggagagcggcagcagaaccggcccagcgtcatcacctgtgccagcgctggggccaggaactgcaacctgagccactgccccatcgcccacagcggctgtgccgcccctggccctgccagctaccgccggccccccagcgctgccaccacctgtgaccctgtggtggaggagcacttccgccgcagcctgggcaagaactacaaggagcctgagcccgcccccaacagcgtgtccatcaccggctctgtggatgaccactttgccaaggccctgggggacacctggctgcagatcaaggccgccaaggatggagccagcagcagccctgagagcgccagccggcggggccagcctgccagccccagcgcccacatggtgagccacagccacagccccagcgtggtgtcctag

SEQ ID NO: 43495 - DNA, 888 bp, Artificial Sequence
  Description of Artificial Sequence: Synthetic coding sequence
atgacagagaacacccactttgacaagatccctgagagctgtgccctgaagtcctggaggcaccctggcctgcaccacggggaggccgccctgcggggggagccccgcatccagaccctgcctgtggccagcgccctgagcagccacaggactggacctccacccatcagccccagcaagaggaagttctccatggagcctggagatgaggacctggactgtgacaatgaccacgtgtccaagatgagccgcatcttcaacccccacctgaacaagacagccaatggagactgcagaagagacccccgggagaggagccgcagccccatcgagagagctgtggcccccaccatgagcctgcacggcagccacctgtacaccagcctgcccagcctgggcctggagcagcccctggccctgaccaagaacagcctggatgccagcaggcctgctggcctgagccccaccctgaccccaggagagcggcagcagaaccggcccagcgtcatcacctgtgccagcgctggggccaggaactgcaacctgagccactgccccatcgcccacagcggctgtgccgcccctggccctgccagctacagaagacctccttctgctgccaccacctgtgaccctgtggtggaggagcacttcagaagaagcctgggcaagaactacaaggagcctgagcccgcccccaacagcgtgtccatcactggatctgtggatgaccactttgccaaggccctgggggacacctggctgcagatcaaggccgccaaggatggagccagcagcagccctgagagcgccagcagaagaggccagcctgccagccccagcgcccacatggtgagccacagccacagccccagcgtggtgtcctag

SEQ ID NO: 43496 - DNA, 510 bp, Artificial Sequence
  Description of Artificial Sequence: Synthetic coding sequence
atggagacccccctggatgtgctgagcagagctgccagcctggtgcatgctgatgatgagaagcgggaggccgccctgcggggggagccccgcatccagaccctgcctgtggccagcgccctgagcagccacaggacaggccccccacccatcagccccagcaagaggaagttctccatggagcctggagatgaggacctggactgtgacaatgaccacgtgtccaagatgagccgcatcttcaacccccacctgaacaagacagccaacggggactgccggcgggacccccgggagaggagccgcagccccatcgagagagctgtggcccccaccatgagcctgcacggcagccacctgtacaccagcctgcccagcctgggcctggagcagcccctggccctgaccaagaacagcctggatgccagcaggcctgctggcctgagccccaccctgaccccaggagagcggcagcaggtgggcctgtgcctgggcggctggaggggctag

SEQ ID NO: 43497 - DNA, 603 bp, Artificial Sequence
  Description of Artificial Sequence: Synthetic coding sequence
atggagacccccctggatgtgctgagcagagctgccagcctggtgcatgctgatgatgagaagcgggaggccgccctgcggggggagccccgcatccagaccctgcctgtggccagcgccctgagcagccacaggacaggccccccacccatcagccccagcaagaggaagttctccatggagcctggagatgaggacctggactgtgacaatgaccacgtgtccaagatgagccgcatcttcaacccccacctgaacaagacagccaacggggactgccggcgggacccccgggagaggagccgcagccccatcgagagagctgtggcccccaccatgagcctgcacggcagccacctgtacaccagcctgcccagcctgggcctggagcagcccctggccctgaccaagaacagcctggatgccagcaggcctgctggcctgagccccaccctgaccccaggagagcggcagcagaaccggcccagcgtcatcacctgtgccagcgctggggccaggaactgcaacctgagccactgccccatcgcccacagcggctgtgccgcccctggccctgccagctaccgccggccccccagctag

SEQ ID NO: 43498 - DNA, 384 bp, Artificial Sequence
  Description of Artificial Sequence: Synthetic coding sequence
atggagacccccctggatgtgctgagcagagctgccagcctggtgcatgctgatgatgagaagcgggaggccgccctgcggggggagccccgcatccagaccctgcctgtggccagcgccctgagcagccacaggacaggccccccacccatcagccccagcaagaggaagttctccatggagcctggagatgaggacctggactgtgacaatgaccacgtgtccaagatgagccgcatcttcaacccccacctgaacaagacagccaacggggactgccggcgggacccccgggagaggagccgcagccccatcgagagagctgtggcccccaccatgagcctgcacggcagccacctgtacaccagcctgcccagcctgtag

SEQ ID NO: 43499 - DNA, 891 bp, Artificial Sequence
  Description of Artificial Sequence: Synthetic coding sequence
atgctgttcatgaagatggacctgctgaactaccagtacctggacaagatgaacaacaacatcggcatcctgtgctatgaaggagaggccgccctgcggggggagccccgcatccagaccctgcctgtggccagcgccctgagcagccacaggacaggccccccacccatcagccccagcaagaggaagttctccatggagcctggagatgaggacctggactgtgacaatgaccacgtgtccaagatgagccgcatcttcaacccccacctgaacaagacagccaacggggactgccggcgggacccccgggagaggagccgcagccccatcgagagagctgtggcccccaccatgagcctgcacggcagccacctgtacaccagcctgcccagcctgggcctggagcagcccctggccctgaccaagaacagcctggatgccagcaggcctgctggcctgagccccaccctgaccccaggagagcggcagcagaaccggcccagcgtcatcacctgtgccagcgctggggccaggaactgcaacctgagccactgccccatcgcccacagcggctgtgccgcccctggccctgccagctaccgccggccccccagcgctgccaccacctgtgaccctgtggtggaggagcacttccgccgcagcctgggcaagaactacaaggagcctgagcccgcccccaacagcgtgtccatcaccggctctgtggatgaccactttgccaaggccctgggggacacctggctgcagatcaaggccgccaaggatggagccagcagcagccctgagagcgccagccggcggggccagcctgccagccccagcgcccacatggtgagccacagccacagccccagcgtggtgtcctag

SEQ ID NO: 43500 - DNA, 675 bp, Artificial Sequence
  Description of Artificial Sequence: Synthetic coding sequence
atggagacccccctggatgtgctgagcagagctgccagcctggtgcatgctgatgatgagaagcgggaggccgccctgcggggggagccccgcatccagaccctgcctgtggccagcgccctgagcagccacaggacaggccccccacccatcagccccagcaagaggaagttctccatggagcctggagatgaggacctggactgtgacaatgaccacgtgtccaagatgagccgcatcttcaacccccacctgaacaagacagccaacggggactgccggcgggacccccgggagaggagccgcagccccatcgagagagctgtggcccccaccatgagcctgcacggcagccacctgtacaccagcctgcccagcctgggcctggagcagcccctggccctgaccaagaacagcctggatgccagcaggcctgctggcctgagccccaccctgaccccaggagagcggcagcagaaccggcccagcgtcatcacctgtgccagcgctggggccaggaactgcaacctgagccactgccccatcgcccacagcggctgtgccgcccctggccctgccagctaccgccggccccccagcgctgccaccacctgtgaccctgtggtggaggagcacttccgccgcagcctgggcaagaactacaaggagccctag

SEQ ID NO: 43501 - DNA, 621 bp, Artificial Sequence
  Description of Artificial Sequence: Synthetic coding sequence
atgaacaagacagccaacggggactgccggcgggacccccgggagaggagccgcagccccatcgagagagctgtggcccccaccatgagcctgcacggcagccacctgtacaccagcctgcccagcctgggcctggagcagcccctggccctgaccaagaacagcctggatgccagcaggcctgctggcctgagccccaccctgaccccaggagagcggcagcagaaccggcccagcgtcatcacctgtgccagcgctggggccaggaactgcaacctgagccactgccccatcgcccacagcggctgtgccgcccctggccctgccagctaccgccggccccccagcgctgccaccacctgtgaccctgtggtggaggagcacttccgccgcagcctgggcaagaactacaaggagcctgagcccgcccccaacagcgtgtccatcaccggctctgtggatgaccactttgccaaggccctgggggacacctggctgcagatcaaggccgccaaggatggagccagcagcagccctgagagcgccagccggcggggccagcctgccagccccagcgcccacatggtgagccacagccacagccccagcgtggtgtcctag

SEQ ID NO: 43502 - DNA, 633 bp, Artificial Sequence
  Description of Artificial Sequence: Synthetic coding sequence
atgatcaaggtgaggaacaagacagccaacggggactgccggcgggacccccgggagaggagccgcagccccatcgagagagctgtggcccccaccatgagcctgcacggcagccacctgtacaccagcctgcccagcctgggcctggagcagcccctggccctgaccaagaacagcctggatgccagcaggcctgctggcctgagccccaccctgaccccaggagagcggcagcagaaccggcccagcgtcatcacctgtgccagcgctggggccaggaactgcaacctgagccactgccccatcgcccacagcggctgtgccgcccctggccctgccagctaccgccggccccccagcgctgccaccacctgtgaccctgtggtggaggagcacttccgccgcagcctgggcaagaactacaaggagcctgagcccgcccccaacagcgtgtccatcaccggctctgtggatgaccactttgccaaggccctgggggacacctggctgcagatcaaggccgccaaggatggagccagcagcagccctgagagcgccagccggcggggccagcctgccagccccagcgcccacatggtgagccacagccacagccccagcgtggtgtcctag

SEQ ID NO: 43503 - DNA, 906 bp, Artificial Sequence
  Description of Artificial Sequence: Synthetic coding sequence
atggccagccgctacgtggccgtgggcatgatcctgagccagacagtggtgggcgtgctgggcagcttctctgtgctgctgcactacctgtccttctactgcaccggctgccgcctgcggagcacagacctgattgtgaagcacctgattgtggccaacttcctggccctgcgctgcaagggcgtgccccagaccatggccgcctttggagtgcgctacttcctgaatgccctgggctgcaagctggtgttctacctgcaccgggtgggccggggcgtgtccatcggcaccacctgcctgctgagcgtcttccaggtgatcaccgtgagcagcaggaagagccgctgggccaagctgaaggagaaggcccccaagcacgtgggcttctctgtgctgctgtgctggatcgtgtgcatgctggtgaacatcatcttccccatgtatgtgacaggcaagtggaactacaccaacatcaccgtgaatgaagacctgggctactgcagcggcggcggcaacaacaagatcgcccagaccctgcgggccatgctgctgtccttcccagatgtgctgtgcctgggcctgatgctgtgggtgagcagctccatggtgtgcatcctgcaccgccacaagcagagggtgcagcacatcgacaggagcaacctgagcccccgggccagccctgagaacagagccacccagagcatcctgatcctggtgtccacctttgtgtcctcctacaccctgagctgcctcttccaggtgtgcatggccctgctggacaaccccaacagcctgctggtgaacaccagcgccctgatgtctgtgtgcttccccaccctgagcccctttgtgctgatgagctgtgaccccagcgtgtaccgcttctgctttgcctggaagaggtag

SEQ ID NO: 43504 - DNA, 2178 bp, Artificial Sequence
  Description of Artificial Sequence: Synthetic coding sequence
atgccacccttcctgctgctggaggccgtgtgtgtgttcctgttcagccgggtgccccccagcctgcccctgcaggaggtgcacgtgtccaaggagaccatcggcaagatctctgctgccagcaagatgatgtggtgcagcgctgctgtggacatcatgttcctgctggatggcagcaacagcgtgggcaagggcagctttgagaggagcaagcactttgccatcaccgtgtgtgatggcctggacatcagccctgagcgggtgcgggtgggcgccttccagttcagcagcaccccccacctggagttccccctggacagcttcagcacccagcaggaggtgaaggcccgcatcaagaggatggtgttcaagggcggccgcacagaaacagagctggccctgaagtacctgctgcaccggggcctgcccggcggcagaaatgcctctgtgccccagatcctgatcatcgtgacagatggcaagagccagggagatgtggccctgcccagcaagcagctgaaggagcggggcgtgacagtgtttgctgtgggcgtgcgcttcccccgctgggaggagctgcacgccctggccagcgagccccggggccagcacgtgctgctggccgagcaggtggaggatgccaccaacggcctcttcagcaccctgagcagcagcgccatctgcagcagcgccaccccagactgccgggtggaggcccacccctgtgagcacaggaccctggagatggtgcgggagtttgctggaaatgccccctgctggaggggcagcaggaggaccctggccgtgctggccgcccactgccccttctacagctggaagagggtcttcctgacccacccagccacctgctaccgcaccacctgccccggcccctgtgacagccagccctgccagaatggaggcacctgtgtgcctgagggcctggatggctaccagtgcctgtgccccctggccttcggcggggaggccaactgtgccctgaagctgagcctggagtgccgggtggacctgctcttcctgctggacagcagcgctggcaccaccctggatggcttcctgcgggccaaggtgtttgtgaagagatttgtgcgggctgtgctgtctgaggacagccgggcccgggtgggcgtggccacctacagccgggagctgctggtggccgtgcctgtgggggagtaccaggatgtgcctgacctggtgtggagcctggatggcatccccttccggggcggccccaccctgaccggcagcgccctgcggcaggccgctgagcggggcttcggcagcgccaccaggacaggccaggaccggccccggcgggtggtggtgctgctgacagagagccacagtgaagatgaggtggccggccctgcccggcatgcccgggcccgggagctgctgctgctgggcgtgggcagcgaggccgtgcgggcagagctggaggagatcaccggcagccccaagcacgtgatggtgtacagcgacccccaggacctcttcaaccagatccctgagctgcagggcaagctgtgcagccggcagaggcctggctgcaggacccaggccctggacctggtgttcatgctggacaccagcgcctctgtgggcccagaaaattttgcccagatgcagagctttgtgcgcagctgtgccctgcagtttgaggtgaacccagatgtgacccaggtgggcctggtggtgtatggcagccaggtgcagacagccttcggcctggacaccaagcccacccgggccgccatgctgcgggccatcagccaggccccctacctgggcggcgtgggcagcgctggaacagccctgctgcacatctatgacaaggtgatgacagtgcagagaggagcccggcctggggtgcccaaggctgtggtggtgctgaccggcggcagaggagcagaagatgctgctgtgcctgcccagaagctgaggaacaacggcatctctgtgctggtggtgggcgtgggccctgtgctgtctgagggcctgcggcggctggccggcccccgggacagcctcatccacgtggccgcctatgctgacctgcgctaccaccaggatgtgctgattgagtggctgtgtggcggggagtggggcaacccccacccccagggctgcccccacggccggcccagcgcctag

SEQ ID NO: 43505 - DNA, 1251 bp, Artificial Sequence
  Description of Artificial Sequence: Synthetic coding sequence
atggccaccaagggcatgaggctgaagagcaccaaggaggtgttccccctggcccacgtgtgcaatgacaccaacaagatgaccctcatcaacccccagggcgccaagctgaacatctacaagaggaaggtggagcaggccatccagagctatgagaagaggctgaacaagatcgtgtggagggccctgagccaggaggagaaggagaagctggatgccaacaagcccatccagtacctggagaacaagacagtgctgaaccaggccctggagcggctgaactggcccatcagcctgaaggagctgtccatgctggagagcgagatcctggccggcaagatgtacatccagcaggccatggagctgcaggaggccgccaagaagaactatgccaacaaggcccctggagagcagcagaagctgcagggcaaccccaccaagaagaccaagagcaagaggccagaccccctgaagggccagaaggtgattgcccgctgtgatgaaaatggcttctacttccctggggtggtgaagaagtgtgtgtccaggacccaggccctggtgggcttctcctatggagacaccaaggtggtgtccaccagcttcatcacccctgtgggcggggccatgccctgccccctgctgcaggtgggggactatgtgtttgccaagatcgtcatccccaagggctttgacttctacgtgcctgccatcgtcatcgccctgcccaacaagcacgtggccacagagaagttctacacagtgctgaagtgcaacaacagaagagagttctgccccaggtctgccctgatcaagatcagccagaacaagtatgccctgagctgcagccacatcaagagcccccccatccctgaggaccctgaggtggaggatgtggaggccaggaacagcgccttcctgttctggcccctgaaggaggccgacacccaggacagccgggagccccggcgggagaagcccaggaggaagaagaggcctgccaagcagcccctgcagcaggccgcccccagcgacagtgatggcagcagccacggcatcagcagccacggcagctgccagggcacccaccctgagcccaggacagcccacctgcacttccctgctgctggccgcctgggcctgagcagccacgccatcatcgccaccccaccaccccgggccgccctgccctgcaccctgcaggccacccacagcagcaagggcctgcggtctgtgcctgagaccctgtag

SEQ ID NO: 43506 - DNA, 1875 bp, Artificial Sequence
  Description of Artificial Sequence: Synthetic coding sequence
atggagaagagcggccccagcagcaccatcagcgagcagcagctgcagaggcaggagggctggatcaacaccaagacagacctggccgagcagagcctcatcagcagcgagaagtggctgcagctgcacggcctgaagagcaacaagctgaccctgaagcagatcctgagccagatcggcttcccccactgtgaagattatgtggccagcctgggccggcctgtggccagccgctatgcagatggcctcttcccccagctgtacagagcagaagatggccgggtgtacaacctgacagccaagtctgagctgatctaccagtttgtggagcacctgacccaggccgtggagagctacaagcagaggatggactggctgaccagcaagagccggcagatctttggagtcatcctggagcagtgtgtgaccatcgtgctggactttggaggcatcctggagggggagctggacctgtgccgggaggccctgaccatggtgctgcaggagcaggtggcccacatcacagagttcaacatcatccgggtgtcccaggagcctgtgaagtggcaggagaatgccacccctgtgacagagcagagcatcgccacagccatctcctgggtggagaagctgactgtggagctgactgtgtctgaggccggccgcctggatgccctgctggaggccggccgggacaagaccatcgagagcatctactactttgtggtgggagatgtgcctgaggagagcaaggagctgctgctgcagagggccctggagatcccctgccctgtgtacacagtgtccttcaatgcccggggggagggcaccatcgccttcctgaaggacctgagcgccaagacccacagccgcttccacgcctttgctgagaggacagaatgtgtggagttccctgccttcagcaccaaggatggagacaacgtgatgacctggaacagcaggaagctgaagggcaagctgcccccaggagctggggtgagagaagatgtgttcctggtgtggcaggagatggaggaggcctgcagcaccctggcccagatccagaggctggtggccgagccccccaagccagatgtggccaccgtggactgtgagagcgagaccacctctgtggagatcgccagcaaccctgaggacacctgggacagcaagacctggctgcagaagtatggcctgaaggcccagaagctgagcctgtatgatgtgctggccgactgcagcttcagacatgctgatggagtggtggacatcaaggccaagccagaaaatgaatctgtgcagaccagcgctgagaccaacaagaagacagtgcacgccaagtactgcagcagatttgtgcacgccccctggaaggatggcagcctggtgcacgtgaacatcaccaaggagaagtgcaagtggtacagcgagcgcatccacacagccctggcccgcatcagaagacgcatcaagtggctgcaggacggcagccagagcctgtttggccgcctgcacaatgactgcatctacatcctgattgacaccagccacagcatgaagagcaagctggacctggtgaaggacaagatcatccagttcatccaggagcagctgaagtacaagagcaagttcaactttgtgaagtttgatggccaggccgtggcctggagggagcagctggccgaggtgaatgaagacaacctggagcaggcccagagctggatccgggacatcaagattggcagcagcaccaacaccctgagcgccctgaagacagcctttgctgacaaggagacccaggccatctacctgctgacagatggccgcccagaccagggcaccagcagccacctgctgctgacagctgctgtgtag

SEQ ID NO: 43507 - DNA, 1428 bp, Artificial Sequence
  Description of Artificial Sequence: Synthetic coding sequence
atgtggaggctgtggggagacctgtggctgctgggcatgctgatggtgtgcttccacagcagcacagagcagaagatggccgagtacaccatggtgtcccaggagcctgtgaagtggcaggagaatgccacccctgtgacagagcagagcatcgccacagccatctcctgggtggagaagctgactgtggagctgactgtgtctgaggccggccgcctggatgccctgctggaggccggccgggacaagaccatcgagagcatctactactttgtggtgggagatgtgcctgaggagagcaaggagctgctgctgcagagggccctggagatcccctgccctgtgtacacagtgtccttcaatgcccggggggagggcaccatcgccttcctgaaggacctgagcgccaagacccacagccgcttccacgcctttgctgagaggacagaatgtgtggagttccctgccttcagcaccaaggatggagacaacgtgatgacctggaacagcaggaagctgaagggcaagctgcccccaggagctggggtgagagaagatgtgttcctggtgtggcaggagatggaggaggcctgcagcaccctggcccagatccagaggctggtggccgagccccccaagccagatgtggccaccgtggactgtgagagcgagaccacctctgtggagatcgccagcaaccctgaggacacctgggacagcaagacctggctgcagaagtatggcctgaaggcccagaagctgagcctgtatgatgtgctggccgactgcagcttcagacatgctgatggagtggtggacatcaaggccaagccagaaaatgaatctgtgcagaccagcgctgagaccaacaagaagacagtgcacgccaagtactgcagcagatttgtgcacgccccctggaaggatggcagcctggtgcacgtgaacatcaccaaggagaagtgcaagtggtacagcgagcgcatccacacagccctggcccgcatcagaagacgcatcaagtggctgcaggacggcagccagagcctgtttggccgcctgcacaatgactgcatctacatcctgattgacaccagccacagcatgaagagcaagctggacctggtgaaggacaagatcatccagttcatccaggagcagctgaagtacaagagcaagttcaactttgtgaagtttgatggccaggccgtggcctggagggagcagctggccgaggtgaatgaagacaacctggagcaggcccagagctggatccgggacatcaagattggcagcagcaccaacaccctgagcgccctgaagacagcctttgctgacaaggagacccaggccatctacctgctgacagatggccgcccagaccagcagcccttcaaggagggcgtgtctgtgctgagccacaggtag

SEQ ID NO: 43508 - DNA, 3885 bp, Artificial Sequence
  Description of Artificial Sequence: Synthetic coding sequence
atggagaagagcggccccagcagcaccatcagcgagcagcagctgcagaggcaggagggctggatcaacaccaagacagacctggccgagcagagcctcatcagcagcgagaagtggctgcagctgcacggcctgaagagcaacaagctgaccctgaagcagatcctgagccagatcggcttcccccactgtgaagattatgtggccagcctgggccggcctgtggccagccgctatgcagatggcctcttcccccagctgtacagagcagaagatggccgggtgtacaacctgacagccaagtctgagctgatctaccagtttgtggagcacctgacccaggccgtggagagctacaagcagaggatggactggctgaccagcaagagccggcagatctttggagtcatcctggagcagtgtgtgaccatcgtgctggactttggaggcatcctggagggggagctggacctgtgccgggaggccctgaccatggtgctgcaggagcaggtggcccacatcacagagttcaacatcatccgggtgtcccaggagcctgtgaagtggcaggagaatgccacccctgtgacagagcagagcatcgccacagccatctcctgggtggagaagctgactgtggagctgactgtgtctgaggccggccgcctggatgccctgctggaggccggccgggacaagaccatcgagagcatctactactttgtggtgggagatgtgcctgaggagagcaaggagctgctgctgcagagggccctggagatcccctgccctgtgtacacagtgtccttcaatgcccggggggagggcaccatcgccttcctgaaggacctgagcgccaagacccacagccgcttccacgcctttgctgagaggacagaatgtgtggagttccctgccttcagcaccaaggatggagacaacgtgatgacctggaacagcaggaagctgaagggcaagctgcccccaggagctggggtgagagaagatgtgttcctggtgtggcaggagatggaggaggcctgcagcaccctggcccagatccagaggctggtggccgagccccccaagccagatgtggccaccgtggactgtgagagcgagaccacctctgtggagatcgccagcaaccctgaggacacctgggacagcaagacctggctgcagaagtatggcctgaaggcccagaagctgagcctgtatgatgtgctggccgactgcagcttcagacatgctgatggagtggtggacatcaaggccaagccagaaaatgaatctgtgcagaccagcgctgagaccaacaagaagacagtgcacgccaagtactgcagcagatttgtgcacgccccctggaaggatggcagcctggtgcacgtgaacatcaccaaggagaagtgcaagtggtacagcgagcgcatccacacagccctggcccgcatcagaagacgcatcaagtggctgcaggacggcagccagagcctgtttggccgcctgcacaatgactgcatctacatcctgattgacaccagccacagcatgaagagcaagctggacctggtgaaggacaagatcatccagttcatccaggagcagctgaagtacaagagcaagttcaactttgtgaagtttgatggccaggccgtggcctggagggagcagctggccgaggtgaatgaagacaacctggagcaggcccagagctggatccgggacatcaagattggcagcagcaccaacaccctgagcgccctgaagacagcctttgctgacaaggagacccaggccatctacctgctgacagatggccgcccagaccagcccccagagaccgtcatcgaccaggtgaagcgcttccaggagatccccatctacaccatctccttcaactacaatgatgagatcgccaaccgcttcctgaaggaggtggccgccctgaccggcggggagttccacttctacaactttggctgcaaggaccccaccccacctgaggccgtgcagaatgaagacctgaccctgctggtgaaggagatggagcagggccacagcgacctggagaagatgcaggacctgtacagcgagagcctcatcatggactggtggtacaatgctgagaaggatggagacagcaagcaccagaaggagatctgcagcatgatcagcaccccagagaagtgtgccaagccccagagtgatgtggacagcacccagaccagcagcctgaacatgctgaagggcccctggggcctgagtgaccagaaggtgcagaagaagaaggtgctgcatgctgagagcaccaagaccagcctgctgcggagccagatgagcagcctgcggagcagcgcctgcagcgagaggaaggatggcctgagcaatgccagcagcagaagaacagccctgagtgacaaggagatgagcatcctgctggccgaggagtggctggatgacaagagcagcgagaaggtgacccgggagggcagccaggtgtatgaccatgacagcagtgatgtgtcctctgagaactggctgaagacctacggcctggtggccaagaagctgaccctgatggatgccctgtctgtggccgctgtgccccacagcagcacctacgtgcctgtgctggacaagcacgtggtgtccaaggtgtttgatgaggtgttccccctggcccacgtgtgcaatgacaccaacaagatgaccctcatcaacccccagggcgccaagctgaacatctacaagaggaaggtggagcaggccatccagagctatgagaagaggctgaacaagatcgtgtggagggccctgagccaggaggagaaggagaagctggatgccaacaagcccatccagtacctggagaacaagacagtgctgaaccaggccctggagcggctgaactggcccatcagcctgaaggagctgtccatgctggagagcgagatcctggccggcaagatgtacatccagcaggccatggagctgcaggaggccgccaagaagaactatgccaacaaggcccctggagagcagcagaagctgcagggcaaccccaccaagaagaccaagagcaagaggccagaccccctgaagggccagaaggtgattgcccgctgtgatgaaaatggcttctacttccctggggtggtgaagaagtgtgtgtccaggacccaggccctggtgggcttctcctatggagacaccaaggtggtgtccaccagcttcatcacccctgtgggcggggccatgccctgccccctgctgcaggtgggggactatgtgtttgccaagatcgtcatccccaagggctttgacttctacgtgcctgccatcgtcatcgccctgcccaacaagcacgtggccacagagaagttctacacagtgctgaagtgcaacaacagaagagagttctgccccaggtctgccctgatcaagatcagccagaacaagtatgccctgagctgcagccacatcaagagcccccccatccctgaggaccctgaggtggaggatgtggaggccaggaacagcgccttcctgttctggcccctgaaggaggccgacacccaggacagccgggagccccggcgggagaagcccaggaggaagaagaggcctgccaagcagcccctgcagcaggccgcccccagcgacagtgatggcagcagccacggcatcagcagccacggcagctgccagggcacccaccctgagcccaggacagcccacctgcacttccctgctgctggccgcctgggcctgagcagccacgccatcatcgccaccccaccaccccgggccgccctgccctgcaccctgcaggccacccacagcagcaagggcctgcggtctgtgcctgagaccctgtag

SEQ ID NO: 43509 - DNA, 3729 bp, Artificial Sequence
  Description of Artificial Sequence: Synthetic coding sequence
atgcctggcctgtactgccccagctcctggacccccctgcccctgacagacagctgggtgcgggcctgtgccaacggcccctgcctgtctgtgcgggcccggctgacctacagaaacccccagccccagcctgtggatggagtgtttgtgtaccccctggccgaggccgaggtggtgtctggctttgaggccgaggccgccggcagaagagtgtccttccagctgcagagcagaagaagaagccaggccgcctgctgccgggccctgggccctggcctgggcacccccaccccaagaagatgtgcccagggccacctggtgctggacctggcccaggcccggagcaccctggtgctgcccaccggcatcatcgctgctgctggcaccatgacagtgaccctgcacagcagccgggagctgcccagcaggccagatggagtgctgcacgtggccctgcccaccgtgctgacccccctggcccctcctggccccccaggccccccccggcccccaggcctgtgtgatgacagccccaccagctgcttcggcgtgggcagcctgcaggaggagggcctggcctgggaggagctggccgcccccagagatgtgttttctggccctgcccgctgcccagccccctacaccttctcctttgagatgctggtgacaggcccctgcctgctggccggcctggagagccccagccacgccctgcgggcagatgcccctcctcatgccagcagcgctgccaccatctgtgtgaccctggccgagggccaccactgtgaccgggccctggagatcctgctgcaccccagcgagccccaccagccccacctgatgctggagggcggcagcctgagcagcgcagaatatgaggcccgggtgcgggcccggcgggacttccagaggctgcagaggcgggacagtgatggagaccggcaggtgtggttcctgcagaggcgcttccacaaggacatcctgctgaaccctgtgctggccctgtccttctgcccagacctgagcagcaagccaggccacctgggcacagccacccgggagctgctcttcctgctggacagcagctctgtggcccacaaggatgccatcgtgctggccgtgaagagcctgcccccccagaccctcatcaacctggccgtgtttggcaccctggtgcagcccctcttccctgagagccggccctgcagtgatgatgctgtgcagctgatctgtgagagcattgagaccctgcaggtgcccagcggccccccagatgtgctggccgccctggactgggccgtgggccagccccagcaccgggcctacccccggcagctgttcctgctgacagctgccagccccatggccgccaccacccacaggaccctggagctgatgcgctggcaccggggcacagcccgctgcttctcctttggcctgggccccacctgccaccagctgctgcagggcctgagcgccctgagccggggccaggcctacttcctgcggcccggccagaggctgcagcccatgctggtgcaggccctgaggaaggccctggagcccgccctgagtgacatctctgtggactggtttgtgcctgacacagtggaggccctgctgaccccccgggagatcccagccctgtacccaggggaccagctgctgggctactgcagcctcttccgggtggatggcttccgcagcaggcctcctgggggccaggagcccggctggcagagcagcggcggctctgtgttccccagccctgaggaggcccccagcgctgccagccctggaacagagcccaccggcaccagcgagcccctgggcaccggcaccgtgtctgctgagctgagcagcccctgggccgcccgggacagcgagcagagcacagatgccctgacagatcctgtgacagaccccggccccaaccccagcgacacagccatctggaggcgcatcttccagagcagctacatccgggagcagtatgtgctgacccactgcagcgccagccctgagcccggccctggcagcacaggcagcagcgagagccctggcagccagggccctggcagccctgagggcagcgcccccctggagccccccagccagcagggctgccgcagcctggcctggggcgagcccgccggcagccgcagctgccccctgcctgcccccaccccagcccccttcaaggtgggcgccctgagcacagaggtgctgggccggcagcacagagctgccctggccggccgcagcctgagcagccccccaggccgggccaaccaggtgcccggccggcccaggaagcccagcctgggcgccatcctggatggccccagccctgagcccggccagcagctgggccagggcctggatgattctggcaacctgctgagccctgcccccatggactgggacatgctgatggagccccccttcctgttcaccgctgtgccccccagcggggagctggcccctcctgctgtgcccccccaggccccccgctgccacgtggtgatccggggcctgtgtggggagcagcccatgtgctgggaggtgggcgtgggcctggagaccctgtggggccctggagatggcagccagccccccagcccccctgtgcgggaggccgcctgggaccaggccctgcaccggctgacagctgcctctgtggtgcgggacaatgagcagctggccctgcggggcggcgctgagaccacagctgaccggggccacgcccggcgctgctggctgcgggccctgcagaccagcaaggtgtcctctgcccccagctgcttcacctgccctgtggccgtggatgccaccacccgggaggtgctgcccggggccctgcaggtgtgcagcagcgagcctgctgagcccccaggcaccccaccagccagccacagccacctggatgctgcccccctgcccaccgtggtgtacagcaagggcctgcagaggggcagccctgctggggcctgggacagcgaccagaatggaaacagcaagagggccctgggggaccctgccacccccacagagggcccccggcggcccccacccaggcctccctgccgcctgtccatgggcagaagacacaagctgtgcagcccagaccccggccaggccaacaacagcgagggcagtgaccatgactacctgcccctggtgcggctgcaggaggcccctggcagcttccggctggatgcccccttctgtgccgctgtgcgcatcagccaggagcggctgtgccgggccagcccctttgctgtgcaccgggccagcctgagccccaccagcgccagcctgccctgggccctgctgggccctggggtgggccagggcgacagcgccacagccagctgcagccccagccccagcagcggcagcgagggccctggccaggtggacagcggccggggcagtgacacagaggccagcgagggcgctgagggcctgggcggcacagacctgcggggccgcacctgggccacagctgtggccctggcctggctggagcaccgctgtgccgccgcctttgatgagtgggagctgacagctgccaaggctgactgctggctgcgggcccagcacctgcctgatggcctggacctggccgccctgaaggctgctgcccggggcctcttcctgctgctgcggcactgggaccagaacctgcagctgcacctgctgtgctacagccctgccaacgtgtag

SEQ ID NO: 43510 - DNA, 2676 bp, Artificial Sequence
  Description of Artificial Sequence: Synthetic coding sequence
atgctgcccacagaggtgccccagagccaccctggccccagcgccctgctgctgctgcagctgctgctgccccccaccagcgccttcttccccaacatctggagcctgctggccgcccctggcagcatcacccaccaggacctgacagaggaggccgccctgaatgtgaccctgcagctgttcctggagcagcccccacctggccggccccccctgcggctggaggacttcctgggccgcaccctgctggctgatgacctgtttgctgcctacttcggccctggcagcagccgccgcttccgggccgccctgggggaggtgtcccgggccaatgctgcccaggacttcctgcccaccagcagaaatgaccctgacctgcactttgatgctgagcggctgggccagggccgggcccggctggtgggcgccctgcgggagaccgtggtggccgcccgggccctggaccacaccctggcccggcagaggctgggcgccgccctgcacgccctgcaggacttctacagccacagcaactgggtggagctgggggagcagcagccccacccccacctgctgtggccccggcaggagctgcagaacctggcccaggtggccgaccccacctgcagcgactgtgaggagctgagctgccccaggaactggctgggcttcaccctgctgaccagcggctacttcggcacccacccccccaagcccccaggcaagtgcagccatggaggccactttgacaggagcagcagccagcccccccggggcggcatcaacaaggacagcaccagccctggcttcagcccccaccacatgctgcacctgcaggccgccaagctggccctgctggccagcatccaggccttcagcctgctgcggagccggctgggggaccgggacttcagccggctgctggacatcaccccagccagcagcctgagctttgtgctggacaccaccggctccatgggagaggagatcaatgctgccaagatccaggcccggcacctggtggagcagaggcggggcagccccatggagcctgtgcactacgtgctggtgcccttccatgaccccggcttcggccctgtgttcaccaccagtgaccctgacagcttctggcagcagctgaatgagatccacgccctgggcggcggagatgagcctgagatgtgcctgagcgccctgcagctggccctgctgcacaccccacccctgagtgacatctttgtgttcacagatgccagccccaaggatgccttcctgaccaaccaggtggagagcctgacccaggagcggcgctgccgggtgaccttcctggtgacagaggacaccagccgggtgcagggccgggcccggcgggagatcctgagccccctgcgctttgagccctacaaggctgtggccctggccagcggcggggaggtgatcttcaccaaggaccagcacatcagagatgtggccgccatcgtgggggagagcatggccgccctggtgaccctgcccctggacccccctgtggtggtgcccggccagcccctggtgttttctgtggatggcctgctgcagaagatcaccgtgcgcatccatggagacatcagcagcttctggatcaagaacccagctggggtgtcccagggccaggaggagggcggcggccccctgggccacacccggcgcttcggccagttctggatggtgaccatggatgatcctccccagacaggcacctgggagatccaggtgacagctgaggacaccccaggagtgcgggtgcaggcccagaccagcctggacttcctgttccacttcggcatccccatggaggatggcccccaccctggcctgtaccccctgacccagcctgtggccggcctgcagacccagctgctggtggaggtgacaggcctgggcagccgggccaaccctggggacccccagccccacttcagccacgtgatcctgcggggcgtgcctgagggcgctgagctgggccaggtgcccctggagcctgtgggccccccagagcggggcctgctggccgccagcctgagccccaccctgctgagcaccccccggcccttcagcctggagctgattggccaggatgctgctggccggcggctgcacagagctgccccccagcccagcacagtggtgcctgtgctgctggagctgagcggccccagcggcttcctggcccctggcagcaaggtgcccctgagcctgcgcatcgccagcttcagcggcccccaggacctggacctgcggacctttgtgaaccccagcttcagcctgaccagcaacctgagccgggcccacctggagctgaatgaaagtgcctggggccgcctgtggctggaggtgcctgattctgctgccccagacagcgtggtgatggtgacagtgacagctgggggccgggaggccaaccctgtgccccccacccacgccttcctgcggctgctggtgtctgccccagccccccaggacagacacaccacccccaccggcagcagtgaccccatcctgaccacagccaccccagccttcagccccttcaccctggtggcccagggccgggccggggccggcctggccgccggcagcccctggtggggcaccgtgggcggcgtgctgctgctgctgggcctggcctcctggtag

SEQ ID NO: 43511 - DNA, 2067 bp, Artificial Sequence
  Description of Artificial Sequence: Synthetic coding sequence
atgctgcccacagaggtgccccagagccaccctggccccagcgccctgctgctgctgcagctgctgctgccccccaccagcgccttcttccccaacatctggagcctgctggccgcccctggcagcatcacccaccaggacctgacagaggaggccgccctgaatgtgaccctgcagctgttcctggagcagcccccacctggccggccccccctgcggctggaggacttcctgggccgcaccctgctggctgatgacctgtttgctgcctacttcggccctggcagcagccgccgcttccgggccgccctgggggaggtgtcccgggccaatgctgcccaggacttcctgcccaccagcagaaatgaccctgacctgcactttgatgctgagcggctgggccagggccgggcccggctggtgggcgccctgcgggagaccgtggtggccgcccgggccctggaccacaccctggcccggcagaggctgggcgccgccctgcacgccctgcaggacttctacagccacagcaactgggtggagctgggggagcagcagccccacccccacctgctgtggccccggcaggagctgcagaacctggcccaggtggccgaccccacctgcagcgactgtgaggagctgagctgccccaggaactggctgggcttcaccctgctgaccagcggctacttcggcacccacccccccaagcccccaggcaagtgcagccatggaggccactttgacaggagcagcagccagcccccccggggcggcatcaacaaggacagcaccagccctggcttcagcccccaccacatgctgcacctgcaggccgccaagctggccctgctggccagcatccaggccttcagcctgctgcggagccggctgggggaccgggacttcagccggctgctggacatcaccccagccagcagcctgagctttgtgctggacaccaccggctccatgggagaggagatcaatgctgccaagatccaggcccggcacctggtggagcagaggcggggcagccccatggagcctgtgcactacgtgctggtgcccttccatgaccccggcttcggccctgtgttcaccaccagtgaccctgacagcttctggcagcagctgaatgagatccacgccctgggcggcggagatgagcctgagatgtgcctgagcgccctgcagctggccctgctgcacaccccacccctgagtgacatctttgtgttcacagatgccagccccaaggatgccttcctgaccaaccaggtggagagcctgacccaggagcggcgctgccgggtgaccttcctggtgacagaggacaccagccgggtgcagggccgggcccggcgggagatcctgagccccctgcgctttgagccctacaaggctgtggccctggccagcggcggggaggtgatcttcaccaaggaccagcacatcagagatgtggccgccatcgtgggggagagcatggccgccctggtgaccctgcccctggacccccctgtggtggtgcccggccagcccctggtgttttctgtggatggcctgctgcagaagatcaccgtgcgcatccatggagacatcagcagcttctggatcaagaacccagctggggtgtcccagggccaggaggagggcggcggccccctgggccacacccggcgcttcggccagttctggatggtgaccatggatgatcctccccagacaggcacctgggagatccaggtgacagctgaggacaccccaggagtgcgggtgcaggcccagaccagcctggacttcctgttccacttcggcatccccatggaggatggcccccaccctggcctgtaccccctgacccagcctgtggccggcctgcagacccagctgctggtggagagccagagctggggcagcagcgctgccttcctgcccaggcaccccagccggggcccccggggctgcaggaccaggcctggggccctgggcgcccggggcaccagcggggcccggagccccaggagcctggccgtggcccacgccgctgtgaacccctag

SEQ ID NO: 43512 - DNA, 2559 bp, Artificial Sequence
  Description of Artificial Sequence: Synthetic coding sequence
atgctgcccacagaggtgccccagagccaccctggccccagcgccctgctgctgctgcagctgctgctgccccccaccagcgccttcttccccaacatctggagcctgctggccgcccctggcagcatcacccaccaggacctgacagaggaggccgccctgaatgtgaccctgcagctgttcctggagcagcccccacctggccggccccccctgcggctggaggacttcctgggccgcaccctgctggctgatgacctgtttgctgcctacttcggccctggcagcagccgccgcttccgggccgccctgggggaggtgtcccgggccaatgctgcccaggacttcctgcccaccagcagaaatgaccctgacctgcactttgatgctgagcggctgggccagggccgggcccggctggtgggcgccctgcgggagaccgtggtggccgcccgggccctggaccacaccctggcccggcagaggctgggcgccgccctgcacgccctgcaggacttctacagccacagcaactgggtggagctgggggagcagcagccccacccccacctgctgtggccccggcaggagctgcagaacctggcccaggtggccgaccccacctgcagcgactgtgaggagctgagctgccccaggaactggctgggcttcaccctgctgaccagcggctacttcggcacccacccccccaagcccccaggcaagtgcagccatggaggccactttgacaggagcagcagccagcccccccggggcggcatcaacaaggacagcaccagccctggcttcagcccccaccacatgctgcacctgcaggccgccaagctggccctgctggccagcatccaggccttcagcctgctgcggagccggctgggggaccgggacttcagccggctgctggacatcaccccagccagcagcctgagctttgtgctggacaccaccggctccatgggagaggagatcaatgctgccaagatccaggcccggcacctggtggagcagaggcggggcagccccatggagcctgtgcactacgtgctggtgcccttccatgaccccggcttcggccctgtgttcaccaccagtgaccctgacagcttctggcagcagctgaatgagatccacgccctgggcggcggagatgagcctgagatgtgcctgagcgccctgcagctggccctgctgcacaccccacccctgagtgacatctttgtgttcacagatgccagccccaaggatgccttcctgaccaaccaggtggagagcctgacccaggagcggcgctgccgggtgaccttcctggtgacagaggacaccagccgggtgcagggccgggcccggcgggagatcctgagccccctgcgctttgagccctacaaggctgtggccctggccagcggcggggaggtgatcttcaccaaggaccagcacatcagagatgtggccgccatcgtgggggagagcatggccgccctggtgaccctgcccctggacccccctgtggtggtgcccggccagcccctggtgttttctgtggatggcctgctgcagaagatcaccgtgcgcatccatggagacatcagcagcttctggatcaagaacccagctggggtgtcccagggccaggaggagggcggcggccccctgggccacacccggcgcttcggccagttctggatggtgaccatggatgatcctccccagacaggcacctgggagatccaggtgacagctgaggacaccccaggagtgcgggtgcaggcccagaccagcctggacttcctgttccacttcggcatccccatggaggatggcccccaccctggcctgtaccccctgacccagcctgtggccggcctgcagacccagctgctggtggaggtgacaggcctgggcagccgggccaaccctggggacccccagccccacttcagccacgtgatcctgcggggcgtgcctgagggcgctgagctgggccaggtgcccctggagcctgtgggccccccagagcggggcctgctggccgccagcctgagccccaccctgctgagcaccccccggcccttcagcctggagctgattggccaggatgctgctggccggcggctgcacagagctgccccccagcccagcacagtggtgcctgtgctgctggagctgagcggccccagcggcttcctggcccctggcagcaaggtgcccctgagcctgcgcatcgccagcttcagcggcccccaggacctggacctgcggacctttgtgaaccccagcttcagcctgaccagcaacctgagccgggcccacctggagctgaatgaaagtgcctggggccgcctgtggctggaggtgcctgattctgctgccccagacagcgtggtgatggtgacagtgacagctgggggccgggaggccaaccctgtgccccccacccacgccttcctgcggctgctggtgtctgccccagccccccaggtgaggaaccactacttccccagccagggccctgcccaccacccctaccgcctcatctag

SEQ ID NO: 43513 - DNA, 2835 bp, Artificial Sequence
  Description of Artificial Sequence: Synthetic coding sequence
atgagcctgaccatccgggcccccagcgtggactacagaaacaccctgggcctgtgtggcacctttgatgagaacccagaaaatgacttccatgacaagaatggcatgcagattgaccagaacttcaacaactacgtggccttcatcaatgagtggaggatcctgcccgggaagtccatgtctgacaccctgcctgtgtccatgaccagccctgggaagcccagctactgcagctgcagcctggacacagctgcctaccccagcagcgaggacctggacagcgtgagccgctctgagatcgccctgggctgcaaggacctgaaccacgtgtccctgagcagcctcatccctgagctggatgtgaccagcgagtacatcaacagcgacaccctggtgcgggagatcaacaagcacaccagccctgaggagtacaacctgaacctcttcctgcaggagaagaagcacatcaacctgaccaagctgggcctgaatgtgcagaagcaccctggaaatgagaaggaggacagcctgcagtacctggccaacaagaagtacacccagggccggggcagccacagccaggagatgagatacaaccggcagaaccgctggaagaggcagaacttccacgagttcccccccctgtttgccttccccagcctgagccagacagacctggaggagctgacctacttcttcccagaagatcatgctgaagatgtgcagcaggagttcttccccagctggcccaccccatctggcctgacagagtacagcaccctgaccctgtgccaggagaccctggccaacagcagcatcggccgcctgtgcctggccttcctgggcaagaggctggacagcgtgattgagatgtgtgtgaaggatgtgctgctgaaggatgacctgtcctgggccgaggccggcgtggccctgctggagaatgaatgtgagaagagaattgtggaggagggcaagtacaacacagaggagtatggcaccagcattgaggacatcctgtctgtgctgaagtgccccaacctgtgcagcggaaatggccagtgcatggagtggggctgtgcctgcagccccagcttcagcagctatgactgcagcgacagctatgacaaggcccctgagatcacagagctgggcaatgccggcttctgtgatgtgcagaagtacaactgcatgatggtgcgggtgtttgggaagggcttcaaggagctgcccagcatcaagtgtgaggtgaccaagctgcagtacaacagcagcgagtggatgcctggagagcccatctacacccagaccgtcttccacaacagcagagctgtggactgccagctgcccacagatgtgcagcagtttgacaccatggacctggtgggcggcaagcccaccgggaagtggcagctgaaggtgtccaatgatggctacaagttcagcaaccccaagatcaccgtcatctatgatggagcctgccaggtgtgtggcctgtacaagaatgacagctgcaccatcaaggaaaatgtgtgcatcattgatggcctgtgctacgtggagggggacaagaaccccaccagcccctgcctgatctgccggcccaagatcagccgcttcacctggagcttcctggagaacaaccagccccctgtgatccaggccctgcaggacaagctgcagaccttctatggagaaaattttgagtaccagtttgtggcctttgatcctgagggcagtgacatccacttcaccctggacagcggccctgagggcgcctctgtgagcagcgctggcctcttcatgtggaagacagacctgctgaccacccagcagatcaccgtgcggctgaatgatgactgtgatgctgagaccagggtgaccatcgaggtgacagtgaagagctgtgactgcctgaatggaggcagctgtgtgtctgacaggaacttcagccctggcagcggcgtgtacctgtgtgtgtgcctgcccggcttccacggcagcctgtgtgaggtggacatcagcggctgccagagcaacccctgtggcctgggcagctacatcagcggcttccacagctacagctgtgactgccccccagagctgaaggtggagacccagtttgtgaaccagttcaccacccagacagtggtgctgaccaggagtgacaagtctgtgaacaaggaggaggatgacaagaatgcccagggcaggaagagacatgtgaagcccaccagcggaaatgccttcaccatctgcaagtacccctgtgggaagagcagagaatgtgtggcccccaacatctgcaagtgcaagccaggctacatcggcagcaactgccagacagccctgtgtgaccctgactgcaagaaccacggcaagtgcatcaagcccaacatctgccagtgcctgcccggccacggcggggccacctgtgatgaggagcactgcaaccccccctgccagcacggcggcacctgcctggccggcaacctgtgcacctgcccctacggctttgtgggcccccgctgtgagaccatggtgtgcaacagacactgtgaaaatggaggccagtgcctgaccccagacatctgccagtgcaagccaggctggtacggccccacctgcagcacagccctgtgtgaccctgtgtgcctgaatggaggcagctgcaacaagcccaacacctgcctgtgccccaacggcttctttggagagcactgccagaatgccttctgccaccccccctgcaagaatggaggccactgcatgaggaacaacgtgtgtgtgtgccgggagggctacacaggaagacgcttccagaagaggcacctgtag

SEQ ID NO: 43514 - DNA, 513 bp, Artificial Sequence
  Description of Artificial Sequence: Synthetic coding sequence
atgcctgggggcgcctgtgtgctggtgattgccctgatgttcctggcctggggcgaggcccaggagtgcagccctgggggccaccagttcctgcggagcccctacagatctgtgcgctttgacagctggcacctgcagcagagcgctgtgcaggacctgatctgtgaccacagcctgagccctggctggtaccgcttcctgatcctggacaggcctgctgagatgcccaccaagtgtgtggagatgaaccactgcggcacccaggcccccatctggctgagcctgcgggacagcgagaccctgcccagccctggagagatcaagcagctgacagcctgtgccacctggcagttcctgttcagcaccaccaaggactgctgcctcttccagatccctgtgtctgtgaggaactgtggcaacttctctgtgtacctgctgcagcccacccagggctgcatgggctactgtgccgagggcttctttgccaagatcgtgaagagcccccacacctag

SEQ ID NO: 43515 - DNA, 4524 bp, Artificial Sequence
  Description of Artificial Sequence: Synthetic coding sequence
atgaccaccgtggtggtgcacgtggacagcaaggccgagctgaccaccctgctggagcagtgggagaaggagcacggcagcggccaggacatggtgcccatcctgaccaggatgagccagctgattgagaaggagacagaggagtacagaaaaggagaccctgacccctttgatgacagacaccctggccgggctgaccctgagtgcatgctgggccacctgctgcgcatcctcttcaagaatgatgacttcatgaatgccctggtgaatgcctacgtgatgaccagccgggagccccccctgaacacagctgcctgccgcctgctgctggacatcatgcctggcctggagacagctgtggtgttccaggagaaggagggcatcgtggagaacctcttcaagtgggcccgggaggccgaccagcccctgcggacctacagcacaggcctgctgggcggggccatggagaaccaggacattgctgccaactacagagatgagaacagccagctggtggccatcgtgctgcggcggctgcgggagctgcagctgcaggaggtggccctgcggcaggagaacaagaggcccagccccaggaagctgagcagcgagcccctgctgcccctggatgaggaggccgtggacatggactatggagacatggctgtggatgtggtggatggagaccaggaggaggccagcggggacatggagatctccttccacctggacagcggccacaagaccagcagccgggtgaacagcaccaccaagccagaagatggcggcctgaagaagaacaagagcgccaagcagggcgaccgggagaacttcaggaaggccaagcagaagctgggcttcagcagcagtgaccctgacaggatgtttgtggagctgagcaacagctcctggagcgagatgagcccctgggtgattggcaccaactacaccctgtaccccatgaccccagccatcgagcagaggctcatcctgcagtacctgacccccctgggggagtaccaggagctgctgcccatcttcatgcagctgggcagccgggagctgatgatgttctacatcgacctgaagcagaccaatgatgtgctgctgacctttgaggccctgaagcacctggccagcctgctgctgcacaacaagtttgccacagaatttgtggcccacggcggcgtgcagaagctgctggagatcccccggcccagcatggccgccactggagtgtccatgtgcctgtactacctgagctacaaccaggatgccatggagcgggtgtgcatgcacccccacaacgtgctgagtgatgtggtgaactacaccctgtggctgatggagtgcagccacgccagcggctgctgccacgccaccatgttcttcagcatctgcttctccttccgggctgtgctggagctgtttgacagatatgatggcctgcggcggctggtgaacctgatcagcaccctggagatcctgaacctggaggaccagggcgccctgctgagtgatgatgagatctttgccagccggcagacaggcaagcacacctgcatggccctgaggaagtactttgaggcccacctggccatcaagctggagcaggtgaagcagagcctgcagaggacagagggcggcatcctggtgcacccccagcccccctacaaggcctgcagctacacccatgagcagatcgtggagatgatggagttcctgattgaatatggccctgcccagctgtactgggagcctgctgaggtgttcctgaagctgagctgtgtgcagctgctgctgcagctgatcagcatcgcctgcaactggaagacctactatgccagaaatgacacagtgcgctttgccctggatgtgctggccatcctgactgtggtgcccaagatccagctgcagctggccgagagcgtggatgtgctggatgaggccggcagcacagtgtccacagtgggcatcagcatcatcctgggcgtggccgagggggagttcttcatccatgatgctgagatccagaagagcgccctgcagatcatcatcaactgtgtgtgtggccctgacaaccgcatcagcagcatcggcaagttcatcagcggcacccccaggaggaagctgccccagaaccccaagagcagcgagcacaccctggccaagatgtggaatgtggtgcagagcaacaacggcatcaaggtgctgctgagcctgctgagcatcaagatgcccatcacagatgctgaccagatccgggccctggcctgcaaggccctggtgggcctgagccgcagcagcacagtgcggcagatcatcagcaagctgcccctcttcagcagctgccagatccagcagctgatgaaggagcctgtgctgcaggacaagagaagtgaccacgtgaagttctgcaagtatgctgctgagctgattgagcgggtgtctgggaagcccctgctgattggaacagatgtgtccctggcccggctgcagaaggcagatgtggtggcccagagccgcatctccttccctgagaaggagctgctgctgctgatccggaaccacctgatcagcaagggcctgggggagacagccaccgtgctgaccaaggaggccgacctgcccatgacagctgccagccacagcagcgccttcacccctgtgacagctgctgccagccctgtgtccctgcccaggaccccaagaattgccaatggaattgccacccggctgggcagccatgctgctgtgggcgccagcgcccccagcgcccccacagcccacccccagcccaggcctccccagggccccctggccctgcccggccccagctatgccggcaacagccccctcatcggccgcatctccttcatccgggagcggcccagcccctgcaatggaaggaagatccgggtgctgcggcagaagagtgaccatggagcctacagccagagccctgccatcaagaagcagctggacagacacctgcccagcccccccaccctggacagcatcatcacagagtacctgcgggagcagcacgcccgctgcaagaaccctgtggccacctgcccccccttcagcctcttcaccccccaccagtgcccagagcccaagcagaggcggcaggcccccatcaacttcaccagccggctgaacagaagagccagcttccccaagtatggaggagtggatggcggctgctttgacagacacctgatcttcagccgcttccggcccatcagcgtcttccgggaggccaatgaagatgagagcggcttcacctgctgtgccttcagcgcccgggagcgcttcctgatgctgggcacctgcaccggccagctgaagctgtacaacgtgttcagcggccaggaggaggccagctacaactgccacaacagcgccatcacccacctggagcccagcagagatggcagcctgctgctgaccagcgccacctggagccagcccctgagcgccctgtggggcatgaagtctgtgtttgacatgaagcacagcttcacagaggaccactacgtggagttcagcaagcacagccaggacagagtgattggcaccaagggggacatcgcccacatctatgacatccagacaggcaacaagctgctgaccctcttcaacccagacctggccaacaactacaagaggaactgtgccaccttcaaccccacagatgacctggtgctgaatgatggagtgctgtgggatgtgcgcagcgcccaggccatccacaagtttgacaagttcaacatgaacatctctggagtcttccaccccaacggcctggaggtgatcatcaacacagagatctgggacctgcggaccttccacctgctgcacacagtgcctgccctggaccagtgccgggtggtgttcaaccacacaggcaccgtgatgtatggagccatgctgcaggctgatgatgaagatgacctgatggaggagaggatgaagagccccttcggcagcagcttccgcaccttcaatgccacagactacaagcccatcgccaccattgatgtgaagaggaacatctttgacctgtgcacagacaccaaggactgctacctggccgtgattgagaaccagggctccatggatgccctgaacatggacacagtgtgccgcctgtatgaggtgggccggcagaggctggccgaggatgaagatgaggaggaggaccaggaggaggaggagcaggaggaggaggatgatgatgaagatgatgatgacacagatgacctggatgagctggacacagaccagctgctggaggccgagctggaggaggatgacaacaatgaaaatgctggggaggatggagacaatgacttcagccccagtgatgaggagctggccaacctgctggaggagggagaagatggagaagatgaggacagtgatgctgatgaggaggtggagctgatcctgggggacacagacagcagtgacaacagcgacctggaggatgacatcatcctgagcctgaatgaatag

SEQ ID NO: 43516 - DNA, 4524 bp, Artificial Sequence; identical to SEQ ID NO: 43515
  Description of Artificial Sequence: Synthetic coding sequence

SEQ ID NO: 43517 - DNA, 984 bp, Artificial Sequence
  Description of Artificial Sequence: Synthetic coding sequence
atggccgagctgcccggccccttcctgtgtggggccctgctgggcttcctgtgcctgagcggcctggccgtggaggtgaaggtgcccacagagcccctgagcacccccctgggcaagacagctgagctgacctgcacctacagcacctctgtgggggacagctttgccctggagtggagctttgtgcagcccgggaagcccatcagcgagagccaccccatcctgtacttcaccaacggccacctgtaccccaccggcagcaagagcaagagggtgtccctgctgcagaacccccccaccgtgggcgtggccaccctgaagctgacagatgtgcaccccagcgacaccggcacctacctgtgccaggtgaacaaccccccagacttctacaccaacggcctgggcctcatcaacctgactgtgctggtgccccccagcaaccccctgtgcagccagagcggccagacctctgtgggcggcagcacagccctgcgctgcagcagcagcgagggcgcccccaagcctgtgtacaactgggtgcggctgggcaccttccccacccccagccctggctccatggtgcaggatgaggtgtctggccagctgatcctgaccaacctgagcctgaccagcagcggcacctaccgctgtgtggccaccaaccagatgggcagcgccagctgtgagctgaccctgtctgtgacagagcccagccagggccgggtggccggggccctgattggagtgctgctgggcgtgctgctgctgtctgtggccgccttctgcctggtgcgcttccagaaggagcggggcaagaagcccaaggagacctacggcggcagtgacctgagagaagatgccatcgcccctggcatcagcgagcacacctgcatgagagctgacagcagcaagggcttcctggagcggcccagcagcgccagcacagtgaccaccaccaagagcaagctgcccatggtggtgtag

SEQ ID NO: 43518 - DNA, 855 bp, Artificial Sequence
  Description of Artificial Sequence: Synthetic coding sequence
atggccgagctgcccggccccttcctgtgtggggccctgctgggcttcctgtgcctgagcggcctggccgtggaggtgaaggtgcccacagagcccctgagcacccccctgggcaagacagctgagctgacctgcacctacagcacctctgtgggggacagctttgccctggagtggagctttgtgcagcccgggaagcccatcagcgagagccaccccatcctgtacttcaccaacggccacctgtaccccaccggcagcaagagcaagagggtgtccctgctgcagaacccccccaccgtgggcgtggccaccctgaagctgacagatgtgcaccccagcgacaccggcacctacctgtgccaggtgaacaaccccccagacttctacaccaacggcctgggcctcatcaacctgactgtgctggtgccccccagcaaccccctgtgcagccagagcggccagacctctgtgggcggcagcacagccctgcgctgcagcagcagcgagggcgcccccaagcctgtgtacaactgggtgcggctgggcaccttccccacccccagccctggctccatggtgcaggatgaggtgtctggccagctgatcctgaccaacctgagcctgaccagcagcggcacctaccgctgtgtggccaccaaccagatgggcagcgccagctgtgagctgaccctgtctgtgacagagcccagccagggccgggtggccggggccctgattggagtgctgctgggcgtgctgctgctgtctgtggccgccttctgcctggtgcgcttccagaaggagcggggcaagaagcccaaggagacctacggcggcagtgacctgaggtag

SEQ ID NO: 43519 - DNA, 363 bp, Artificial Sequence
  Description of Artificial Sequence: Synthetic coding sequence
atggactggaactggaggatcctcttcctggtggtgattgctgctggggcccagagccaggtgcagctggtgcagagcggggctgaggtgaagaagccaggggcctctgtgaaggtgtcctgcaaggccagcggctacaccatcaccagctactgcatgcactgggtgcaccaggtgcacgcccagggcctggagtggatgggcctggtgtgccccagtgatggcagcaccagctatgcccagaagttccaggcccgggtgaccatcacccgggacacctccatgagcacagcctacatggagctgagcagcctgcggtctgaggacacagccatgtactactgtgtgcgggacaccatgtag

SEQ ID NO: 43520 - DNA, 564 bp, Artificial Sequence
  Description of Artificial Sequence: Synthetic coding sequence
atgggcgcccccctggccgtggccctgggcgccctgcactacctggccctcttcctgcagctgggcggggccaccaggcctgctggccacgccccctgggacaaccacgtgtctggccacgccctcttcacagagacccctcatgacatgacagccaggactggagaagatgtggagatggcctgcagcttccggggcagcggcagccccagctacagcctggagatccagtggtggtacgtgcgcagccaccgggactggacagacaagcaggcctgggccagcaaccaggtggtgaaggtggtgggcagcaacatcagccacaagctgcggctgagccgggtgaagcccacagatgagggcacctatgagtgcagggtcatcgacttcagtgatggcaaggcccggcaccacaaggtgaaggcctacctgcgggtgcagcccggggagaacagcgtgctgcacctgcctgaggcccccccagctgccccagcccctcctccacccaagccaggcaaggagctgaggaagaggtctgtggaccaggaggcctgcagcctgtag

SEQ ID NO: 43521 - DNA, 615 bp, Artificial Sequence
  Description of Artificial Sequence: Synthetic coding sequence
atgggcgcccccctggccgtggccctgggcgccctgcactacctggccctcttcctgcagctgggcggggccaccaggcctgctggccacgccccctgggacaaccacgtgtctggccacgccctcttcacagagacccctcatgacatgacagccaggactggagaagatgtggagatggcctgcagcttccggggcagcggcagccccagctacagcctggagatccagtggtggtacgtgcgcagccaccgggactggacagacaagcaggcctgggccagcaaccagctgaaggccagccagcaggaggatgctgggaaggaggccaccaagatctctgtggtgaaggtggtgggcagcaacatcagccacaagctgcggctgagccgggtgaagcccacagatgagggcacctatgaatgtcgggtgattgacttcagtgatggcaaggcccggcaccacaaggtgaaggcctacctgcgggtgcagcctggagaaaattctgtgctgcacctgcctgaggcccctcctgctgccccagcccctcctccacccaagccaggcaaggagctgaggaagaggtctgtggaccaggaggcctgcagcctgtag

SEQ ID NO: 43522 - DNA, 450 bp, Artificial Sequence
  Description of Artificial Sequence: Synthetic coding sequence
atgggcgcccccctggccgtggccctgggcgccctgcactacctggccctcttcctgcagctgggcggggccaccaggcctgctggccacgccccctgggacaaccacgtgtctggccacgccctcttcacagagacccctcatgacatgacagccaggactggagaagatgtggagatggcctgcagcttccggggcagcggcagccccagctacagcctggagatccagtggtggtacgtgcgcagccaccgggactggacagacaagcaggcctgggccagcaaccaggtggtgaaggtggtgggcagcaacatcagccacaagctgcggctgagccgggtgaagcccacagatgagggcacctatgagtgcagggtcatcgacttcagtgatggcaaggcccggcaccacaaggtgaaggcctacctgcgggtgcagcccggctag

SEQ ID NO: 43523 - DNA, 858 bp, Artificial Sequence
  Description of Artificial Sequence: Synthetic coding sequence
atggagcagaggaaccggctgggcgccctgggctacctgccccccctgctgctgcacgccctgctgctgtttgtggctgatgctgccttcacagaggtgcccaaggatgtgacagtgcgggagggagatgacatcgagatgccctgtgccttccgggccagcggggccaccagctacagcctggagatccagtggtggtacctgaaggagcccccccgggagctgctgcacgagctggccctgtctgtgcctggggcccggagcaaggtgaccaacaaggatgccaccaagatcagcacagtgcgggtgcagggcaatgacatcagccaccggctgcggctgtctgctgtgcggctgcaggatgaaggagtgtatgagtgccgggtgtctgactacagtgatgatgacacccaggagcacaaggcccaggccatgctgcgggtgctgagcagatttgccccacccaacatgcaggccgctgaggccgtgagccacatccagagcagcggcccccggcggcacggccctgccagcgctgccaatgccaacaatgctggggccgccagcaggaccaccagcgagcccggccgcggggacaagagccccccacctggcagccccccagctgccattgatcctgctgtgcctgaggccgccgccgccagcgctgcccacacccccaccaccaccgtggccgctgctgctgctgccagcagcgccagcccccccagcggccaggccgtgctgctgcggcagagacatggcagcggcaccggccgcagctacaccacagaccccctgctgagcctgctgctgctggccctgcacaagttcctgcggctgctgctgggccactag

SEQ ID NO: 43524 - DNA, 2034 bp, Artificial Sequence
  Description of Artificial Sequence: Synthetic coding sequence
atggccaaggtgaacatcacccgggacctgatccggcggcagatcaaggagcggggggccctgagctttgaaagacgctaccacgtgacagaccccttcatccggcggctgggcctggaggccgagctgcagggccacagcggctgtgtgaactgcctggagtggaatgagaagggggacctgctggccagcggcagtgatgaccagcacaccatcgtgtgggaccccctgcaccacaagaagctgctgtccatgcacacaggccacacagccaacatcttctctgtgaagttcctgccccacgccggggaccgcatcctgatcactggagctgctgacagcaaggtgcacgtgcatgacctgactgtgaaggagaccatccacatgtttggagaccacaccaacagagtgaagagaattgccacagcccccatgtggcccaacaccttctggagcgctgctgaagatggcctcatccggcagtatgacctgcgggagaacagcaagcacagcgaggtgctgattgacctgacagagtactgcggccagctggtggaggccaagtgcctgactgtgaacccccaggacaacaactgcctggccgtgggcgccagcggcccctttgtgcggctgtatgacatccgcatgatccacaaccacaggaagtccatgaagcagagccccagcgctggggtgcacaccttctgtgaccggcagaagcccctgcctgatggagctgcccagtactacgtggccggccacctgcctgtgaagctgcctgactacaacaaccggctgcgggtgctggtggccacctacgtgaccttcagccccaatggaacagagctgctggtgaacatgggcggggagcaggtgtacctgtttgacctgacctacaagcagaggccctacaccttcctgctgcccaggaagtgccacagcagtggagaggtgcagaatggcaagatgagcaccaacggggtgtccaatggagtgtccaatggcctgcacctgcacagcaatggcttccggctgcctgagagccggggccacgtgagcccccaggtggagctgcccccctacctggagcgggtgaagcagcaggccaatgaggcctttgcctgccagcagtggacccaggccatccagctgtacagcaaggctgtgcagagggccccccacaatgccatgctgtatggcaacagagctgctgcctacatgaagaggaagtgggatggagaccactatgatgccctgcgggactgcctgaaggccatcagcctgaacccctgccacctgaaggcccacttccggctggcccgctgcctgtttgagctgaagtatgtggccgaggccctggagtgcctggatgacttcaagggcaagtttcctgagcaggcccacagcagcgcctgtgatgccctgggccgggacatcacagctgccctcttcagcaagaatgatggagaggagaagaagggccctgggggcggggcccctgtgcggctgcggagcaccagcaggaaggacagcatcagtgaagatgagatggtgctgcgggagaggagctatgactaccagttccgctactgcggccactgcaacaccaccacagacatcaaggaggccaacttcttcggcagcaatgcccagtacatcgtgtctggcagtgatgatggcagcttcttcatctgggagaaggagaccaccaacctggtgcgggtgctgcagggagatgagagcatcgtgaactgcctgcagccccaccccagctactgcttcctggccaccagcggcatcgaccctgtggtgcggctgtggaaccccaggcctgagagcgaggacctgaccggccgggtggtggaggacatggagggcgccagccaggccaaccagaggaggatgaatgctgaccccctggaggtgatgctgctgaacatgggctaccgcatcaccggcctgagcagcggcggggccggggccagtgatgatgaggacagcagcgagggccaggtgcagtgccggcccagctag

SEQ ID NO: 43525 - DNA, 2031 bp, Artificial Sequence
  Description of Artificial Sequence: Synthetic coding sequence
atggccaaggtgaacatcacccgggacctgatccggcggcagatcaaggagcggggggccctgagctttgaaagacgctaccacgtgacagaccccttcatccggcggctgggcctggaggccgagctgcagggccacagcggctgtgtgaactgcctggagtggaatgagaagggggacctgctggccagcggcagtgatgaccagcacaccatcgtgtgggaccccctgcaccacaagaagctgctgtccatgcacacaggccacacagccaacatcttctctgtgaagttcctgccccacgccggggaccgcatcctgatcactggagctgctgacagcaaggtgcacgtgcatgacctgactgtgaaggagaccatccacatgtttggagaccacaccaacagagtgaagagaattgccacagcccccatgtggcccaacaccttctggagcgctgctgaagatggcctcatccggcagtatgacctgcgggagaacagcaagcacagcgaggtgctgattgacctgacagagtactgcggccagctggtggaggccaagtgcctgactgtgaacccccaggacaacaactgcctggccgtgggcgccagcggcccctttgtgcggctgtatgacatccgcatgatccacaaccacaggaagtccatgaagcagagccccagcgctggggtgcacaccttctgtgaccggcagaagcccctgcctgatggagctgcccagtactacgtggccggccacctgcctgtgaagctgcctgactacaacaaccggctgcgggtgctggtggccacctacgtgaccttcagccccaatggaacagagctgctggtgaacatgggcggggagcaggtgtacctgtttgacctgacctacaagcagaggccctacaccttcctgctgcccaggaagtgccacagcagtggagtgcagaatggcaagatgagcaccaatggagtgtccaatggagtgtccaatggcctgcacctgcacagcaatggcttccggctgcctgagagccggggccacgtgagcccccaggtggagctgcccccctacctggagcgggtgaagcagcaggccaatgaggcctttgcctgccagcagtggacccaggccatccagctgtacagcaaggctgtgcagagggccccccacaatgccatgctgtatggcaacagagctgctgcctacatgaagaggaagtgggatggagaccactatgatgccctgcgggactgcctgaaggccatcagcctgaacccctgccacctgaaggcccacttccggctggcccgctgcctgtttgagctgaagtatgtggccgaggccctggagtgcctggatgacttcaagggcaagtttcctgagcaggcccacagcagcgcctgtgatgccctgggccgggacatcacagctgccctcttcagcaagaatgatggagaggagaagaagggccctgggggcggggcccctgtgcggctgcggagcaccagcaggaaggacagcatcagtgaagatgagatggtgctgcgggagaggagctatgactaccagttccgctactgcggccactgcaacaccaccacagacatcaaggaggccaacttcttcggcagcaatgcccagtacatcgtgtctggcagtgatgatggcagcttcttcatctgggagaaggagaccaccaacctggtgcgggtgctgcagggagatgagagcatcgtgaactgcctgcagccccaccccagctactgcttcctggccaccagcggcattgatcctgtggtgcggctgtggaaccccaggcctgagagcgaggacctgaccggccgggtggtggaggacatggagggcgccagccaggccaaccagaggaggatgaatgctgaccccctggaggtgatgctgctgaacatgggctaccgcatcaccggcctgagcagtggaggagctggggccagtgatgatgaggacagcagcgagggccaggtgcagtgccggcccagctag

SEQ ID NO: 43526 - DNA, 1203 bp, Artificial Sequence
  Description of Artificial Sequence: Synthetic coding sequence
atggctgctgagatccagcccaagcccctgaccaggaagcccatcctgctgcagaggatggagggcagccaggaggtggtgaacatggccgtcatcgtgcccaaggaggagggcgtcatctctgtgtctgaggacagaacagtgcgggtgtggctgaagagggacagcggccagtactggcccagcgtgtaccacgccatgcccagcccctgcagctgcatgtccttcaaccctgagacccggcggctgagcatcggcctggacaatggcaccatcagcgagttcatcctgtctgaggactacaacaagatgacccctgtgaagaactaccaggcccaccagagccgggtgaccatgatcctgtttgtgctggagctggagtgggtgctgagcacaggccaggacaagcagtttgcctggcactgcagcgagagcggccagaggctgggcggctaccgcaccagcgctgtggccagcggcctgcagtttgatgtggagaccaggcatgtgttcatcggggaccacagcggccaggtgaccatcctgaagctggagcaggagaactgcaccctggtgaccaccttccggggccacactggaggagtgacagccctgtgctgggaccctgtgcagagggtgctcttcagcggcagcagtgaccacagcgtcatcatgtgggacatcggcggcaggaagggcacagccatcgagctgcagggccacaatgacagagtgcaggccctgtcctatgcccagcacacccggcagctgatcagctgtggaggagatggcggcatcgtggtgtggaacatggatgtggagcggcaggagaccccagagtggctggacagcgacagctgccagaagtgtgaccagcccttcttctggaacttcaagcagatgtgggacagcaagaagattggcctgcggcagcaccactgcaggaaatgtgggaaggctgtgtgtgggaagtgcagcagcaagaggagcagcatccccctgatgggctttgaatttgaggtgcgggtgtgtgacagctgccacgaggccatcacagatgaggagcgggcccccacagccaccttccatgacagcaagcacaacatcgtgcacgtgcactttgatgccacccggggctggctgctgaccagcggcacagacaaggtgatcaagctgtgggacatgacccctgtggtgtcctag

SEQ ID NO: 43527 - DNA, 1266 bp, Artificial Sequence
  Description of Artificial Sequence: Synthetic coding sequence
atggccagcttccccccccgggtgaatgagaaggagatcgtgcggctgcggaccatcggggagctgctggccccagctgccccctttgacaagaagtgtggccgggagaactggacagtggcctttgccccagatggcagctactttgcctggagccagggccacaggacagtgaagctggtgccctggagccagtgcctgcagaacttcctgctgcacggcaccaagaatgtgaccaacagcagcagcctgcggctgccccggcagaacagtgatggcggccagaagaacaagccccgggagcacatcatcgactgtggggacatcgtgtggagcctggccttcggcagctctgtgcctgagaagcagagccgctgtgtgaacatcgagtggcaccgcttccgcttcggccaggaccagctgctgctggccaccggcctgaacaacggccgcatcaagatctgggatgtgtacacaggcaagctgctgctgaacctggtggaccacacagaggtggtgcgggacctgacctttgccccagatggcagcctcatcctggtgtctgccagccgggacaagaccctgcgggtgtgggacctgaaggatgatggcaacatgatgaaggtgctgcggggccaccagaactgggtgtacagctgtgccttctccccagacagctccatgctgtgcagcgtgggcgccagcaaggctgtgttcctgtggaacatggacaagtacaccatgatcaggaagctggagggccaccaccatgatgtggtggcctgtgacttctccccagatggagccctgctggccacagccagctatgacaccagggtgtacatctgggacccccacaatggagacatcctgatggagtttggccacctgtttcctccacccacccccatctttgctgggggcgccaatgaccgctgggtgcgctctgtgtccttcagccatgatggcctgcacgtggccagcctggctgatgacaagatggtgcgcttctggagaattgatgaggactaccctgtgcaggtggcccccctgagcaatggcctgtgctgtgccttcagcacagatggctctgtgctggccgccggcacccatgatggctctgtgtacttctgggccaccccccggcaggtgcccagcctgcagcacctgtgcaggatgagcatccggcgggtgatgcccacccaggaggtgcaggagctgcccatccccagcaagctgctggagttcctgagctaccgcatctag

SEQ ID NO: 43528 - DNA, 828 bp, Artificial Sequence
  Description of Artificial Sequence: Synthetic coding sequence
atggccagcttccccccccgggtgaatgagaaggagatcggcaagctgctgctgaacctggtggaccacacagaggtggtgcgggacctgacctttgccccagatggcagcctcatcctggtgtctgccagccgggacaagaccctgcgggtgtgggacctgaaggatgatggcaacatgatgaaggtgctgcggggccaccagaactgggtgtacagctgtgccttctccccagacagctccatgctgtgcagcgtgggcgccagcaaggctgtgttcctgtggaacatggacaagtacaccatgatcaggaagctggagggccaccaccatgatgtggtggcctgtgacttctccccagatggagccctgctggccacagccagctatgacaccagggtgtacatctgggacccccacaatggagacatcctgatggagtttggccacctgtttcctccacccacccccatctttgctgggggcgccaatgaccgctgggtgcgctctgtgtccttcagccatgatggcctgcacgtggccagcctggctgatgacaagatggtgcgcttctggagaattgatgaggactaccctgtgcaggtggcccccctgagcaatggcctgtgctgtgccttcagcacagatggctctgtgctggccgccggcacccatgatggctctgtgtacttctgggccaccccccggcaggtgcccagcctgcagcacctgtgcaggatgagcatccggcgggtgatgcccacccaggaggtgcaggagctgcccatccccagcaagctgctggagttcctgagctaccgcatctag

SEQ ID NO: 43529 - DNA, 642 bp, Artificial Sequence
  Description of Artificial Sequence: Synthetic coding sequence
atggccagcttccccccccgggtgaatgagaaggagattgatggcagctactttgcctggagccagggccacaggacagtgaagctggtgccctggagccagtgcctgcagaacttcctgctgcacggcaccaagaatgtgaccaacagcagcagcctgcggctgccccggcagaacagtgatggcggccagaagaacaagccccgggagcacatcatcgactgtggggacatcgtgtggagcctggccttcggcagctctgtgcctgagaagcagagccgctgtgtgaacatcgagtggcaccgcttccgcttcggccaggaccagctgctgctggccaccggcctgaacaacggccgcatcaagatctgggatgtgtacaccgggaagctgctgctgaacctggtggaccacacagaggtggtgcgggacctgacctttgccccagatggcagcctcatcctggtgtctgccagccgggacaagaccctgcgggtgtgggacctgaaggatgatggcaacatgatgaaggtgctgcggggccaccagaactgggtgtacagctgtgccttctccccagacagctccatgctgtgcagcgtgggcgccagcaaggctgtggtggccgccatcctggtgtag

SEQ ID NO: 43530 - DNA, 1215 bp, Artificial Sequence
  Description of Artificial Sequence: Synthetic coding sequence
atggaggccggggaggagcccctgctgctggccgagctgaagccaggccggccccaccagtttgactggaagagcagctgtgagacctggagcgtggccttctccccagatggctcctggtttgcctggagccagggccactgcatcgtgaagctgatcccctggcccctggaggagcagttcatccccaagggctttgaggccaagagccgcagcagcaagaatgagaccaagggccggggcagccccaaggagaagaccctggactgtggccagatcgtgtggggcctggccttcagcccctggcccagcccccccagcaggaagctgtgggcccggcaccacccccaggtgcctgatgtgtcctgcctggtgctggccaccggcctgaatgatggccagatcaagatctgggaggtgcagacaggcctgctgctgctgaacctgagcggccaccaggatgtggtgcgggacctgtccttcacccccagcggcagcctcatcctggtgtctgccagccgggacaagaccctgcgcatctgggacctgaacaagcacggcaagcagatccaggtgctgagcggccacctgcagtgggtgtactgctgcagcatcagcccagactgcagcatgctgtgcagcgctgctggggagaagagcgtcttcctgtggagcatgaggagctacaccctcatcaggaagctggagggccaccagagctctgtggtgtcctgtgacttctccccagattctgccctgctggtgacagccagctatgacaccaacgtcatcatgtgggacccctacaccggggagcggctgcggagcctgcaccacacccaggtggaccctgccatggatgacagtgatgtgcacatcagcagcctgcggtctgtgtgcttcagccctgagggcctgtacctggccaccgtggctgatgaccggctgctgcgcatctgggccctggagctgaagacccccatcgcctttgcccccatgaccaacggcctgtgctgcaccttcttcccccacggcggcgtcatcgccaccggcaccagagatggccacgtgcagttctggacagccccccgggtgctgagcagcctgaagcacctgtgcaggaaggccctgcgctccttcctgaccacctaccaggtgctggccctgcccatccccaagaagatgaaggagttcctgacctaccgcaccttctag

SEQ ID NO: 43531 - DNA, 540 bp, Artificial Sequence
  Description of Artificial Sequence: Synthetic coding sequence
atgaggagctacaccctcatcaggaagctggagggccaccagagctctgtggtgtcctgtgacttctccccagacagcgccctgctggtgacagccagctatgacaccaacgtcatcatgtgggacccctacacaggagagcggctgcggagcctgcaccacacccaggtggaccctgccatggatgacagtgatgtgcacatcagcagcctgcggtctgtgtgcttcagccctgagggcctgtacctggccaccgtggctgatgaccggctgctgcgcatctgggccctggagctgaagacccccatcgcctttgcccccatgaccaacggcctgtgctgcaccttcttcccccatggaggagtgattgccaccggcaccagagatggccacgtgcagttctggacagccccccgggtgctgagcagcctgaagcacctgtgcaggaaggccctgcggagcttcctgaccacctaccaggtgctggccctgcccatccccaagaagatgaaggagttcctgacctaccgcaccttctag

SEQ ID NO: 43532 - DNA, 585 bp, Artificial Sequence
  Description of Artificial Sequence: Synthetic coding sequence
atgctgtgcagcgctgctggggagaagagcgtcttcctgtggagcatgaggagctacaccctcatcaggaagctggagggccaccagagctctgtggtgtcctgtgacttctccccagattctgccctgctggtgacagccagctatgacaccaacgtcatcatgtgggacccctacaccggggagcggctgcggagcctgcaccacacccaggtggaccctgccatggatgacagtgatgtgcacatcagcagcctgcggtctgtgtgcttcagccctgagggcctgtacctggccaccgtggctgatgaccggctgctgcgcatctgggccctggagctgaagacccccatcgcctttgcccccatgaccaacggcctgtgctgcaccttcttcccccacggcggcgtcatcgccaccggcaccagagatggccacgtgcagttctggacagccccccgggtgctgagcagcctgaagcacctgtgcaggaaggccctgcgctccttcctgaccacctaccaggtgctggccctgcccatccccaagaagatgaaggagttcctgacctaccgcaccttctag

SEQ ID NO: 43533 - DNA, 1458 bp, Artificial Sequence
  Description of Artificial Sequence: Synthetic coding sequence
atggctgctgtgtggcagcaggtgctggccgtggatgcccgctacaatgcctaccgcacccccaccttcccccagttccgcacccagtacatcagaagaagaagccagctgctgcgggagaatgccaaggccggccaccccccagccctgcggcggcagtacctgcggctgcggggccagctgctgggccagagatatggccccctgtctgagcccggcagcgcccgggcctacagcaacagcatcgtgcgcagcagcaggaccaccctggacaggatggaggactttgaagatgacccccgggccctgggcgcccggggccacagaagatctgtgtcccggggcagctaccagctgcaggcccagatgaacagagctgtgtatgaagatcggcccccaggctctgtggtgcccaccagcgctgctgaggccagccgggccatggccggggacaccagcctgtctgagaactatgcctttgctggcatgtaccacgtgtttgaccagcacgtggatgaggccgtgccccgggtgcgctttgccaatgatgacagacaccggctggcctgctgcagcctggatggcagcatcagcctgtgccagctggtgcctgccccacccaccgtgctgcgggtgctgcggggccacacccggggcgtgtctgactttgcctggagcctgagcaatgacatcctggtgtccaccagcctggatgccaccatgaggatctgggcctctgaagatggccgctgcatccgggagatcccagaccctgacagcgctgagctgctgtgctgcaccttccagcctgtgaacaacaacctgactgtggtgggcaatgccaagcacaacgtgcacgtgatgaacatcagcacaggcaagaaggtgaagggcggcagcagcaagctgaccggccgggtgctggccctgagctttgatgcccctggccgcctgctgtgggccggagatgaccacggctctgtgttctccttcctgtttgacatggccaccgggaagctgaccaaggccaagaggctggtggtgcatgagggcagccctgtgaccagcatcagcgcccgctcctgggtgtcccgggaggcccgggaccccagcctgctgatcaatgcctgcctgaacaagctgctgctgtacagagtggtggacaatgaaggcaccctgcagctgaagaggagcttccccatcgagcagagcagccaccctgtgcgcagcatcttctgccccctgatgtccttccggcagggcgcctgtgtggtgacaggcagcgaggacatgtgtgtgcacttctttgatgtggagagagctgccaaggctgctgtgaacaagctgcagggccacagcgcccctgtgctggatgtgtccttcaactgtgatgagagcctgctggccagcagtgatgccagcggcatggtgattgtgtggaggcgggagcagaagtag

SEQ ID NO: 43534 - DNA, 1299 bp, Artificial Sequence
  Description of Artificial Sequence: Synthetic coding sequence
atggccgcccccatggaggtggccgtgtgcacagattctgctgcccccatgtggagctgcatcgtgtgggagctgcacagcggggccaacctgctgacctaccggggcggccaggccggcccccggggcctggccctgctgaatggagagtacctgctggccgcccagctgggcaagaactacatcagcgcctgggagctgcagaggaaggaccagctgcagcagaagatcatgtgccccggccctgtgacctgcctgacagccagccccaacggcctgtatgtgctggccggcgtggccgagagcatccacctgtgggaggtgtccacaggcaacctgctggtgatcctgagccgccactaccaggatgtgtcctgcctgcagttcaccggggacagcagccacttcatcagcggcggcaaggactgcctggtgctggtgtggagcctgtgcagcgtgctgcaggccgaccccagccgcatcccagcccccaggcatgtgtggagccaccacgccctgcccatcacagacctgcactgcggctttggaggccccctggcccgggtggccaccagcagcctggaccagacagtgaagctgtgggaggtgtcctctggagagctgctgctgtctgtgctgtttgatgtgtccatcatggctgtgaccatggacctggccgagcaccacatgttctgtggcggcagcgagggcagcatcttccaggtggacctcttcacctggccaggccagcgggagaggagcttccaccctgagcaggatgctgggaaggtgttcaagggccacaggaaccaggtgacctgcctgtctgtgtccacagatggctctgtgctgctgagcggcagccatgatgagaccgtgcggctgtgggatgtgcagagcaagcagtgcatcagaacagtggccctgaagggccctgtgaccaatgctgccatcctgctggcccctgtgtccatgctgagcagtgacttccggcccagcctgcccctgccccacttcaacaagcacctgctgggcgctgagcacggagatgagcccaggcatggaggcctgaccctgcggctgggcctgcaccagcagggcagcgagcccagctacctggacagaacagagcagctgcaggccgtgctgtgcagcaccatggagaagtctgtgctgggcggccaggaccagctgcgggtgcgggtgacagagctggaggatgaggtgaggaacctgaggaagatcaacagagacctgtttgacttcagcacccgcttcatcaccaggcctgccaagtag

SEQ ID NO: 43535 - DNA, 1746 bp, Artificial Sequence
  Description of Artificial Sequence: Synthetic coding sequence
atggccacagaaggaggcggcaaggagatgaatgagatcaagacccagttcaccacccgggagggcctgtacaagctgctgccccacagcgagtacagccggcccaacagagtgcccttcaacagccagggcagcaaccctgtgcgggtgtcctttgtgaacctgaatgaccagagcggaaatggagaccggctgtgcttcaacgtgggccgggagctgtacttctacatctacaagggcgtgaggaaggctgctgacctgagcaagcccatcgacaagaggatctacaagggcacccagcccacctgccacgacttcaaccacctgacagccacagctgagagcgtgtccctgctggtgggcttctctgctggccaggtgcagctgattgaccccatcaagaaggagaccagcaagctgttcaatgaggagcggctgattgacaagagccgggtgacctgtgtgaagtgggtgcccggcagcgagagcctcttcctggtggcccacagcagcggcaacatgtacctgtacaacgtggagcacacctgtggcaccacagccccccactaccagctgctgaagcagggcgagagctttgctgtgcacacctgcaagagcaagagcaccaggaaccccctgctgaagtggacagtgggggagggcgccctgaatgaatttgccttctccccagatggcaagttcctggcctgtgtgtcccaggacggcttcctgcgggtcttcaactttgattctgtggagctgcacggcaccatgaagagctactttggaggcctgctgtgtgtgtgctggagcccagatggcaagtacatcgtgactggaggagaagatgacctggtgacagtgtggagctttgtggactgccgggtgattgcccggggccacggccacaagtcctgggtgtctgtggtggcctttgacccctacaccacctctgtggaggagggggaccccatggagttcagcggcagtgatgaggacttccaggacctgctgcacttcggccgggaccgggccaacagcacccagagccggctgagcaagaggaacagcacagacagcaggcctgtgtctgtgacctacagatttggatctgtgggccaggacacccagctgtgcctgtgggacctgacagaggacatcctcttcccccaccagcccctgagccgggcccggacccacaccaacgtgatgaatgccaccagccccccagctggcagcaatggaaattctgtgaccaccccaggcaacagcgtgcccccacccctgcccaggagcaacagcctgccccacagcgctgtgtccaatgccggcagcaagagctctgtgatggatggagccatcgccagcggcgtgtccaagtttgccaccctgagcctgcatgacaggaaggagcggcaccacgagaaggaccacaagaggaaccacagcatgggccacatcagcagcaagagcagtgacaagctgaacctggtgaccaagaccaagacagatcctgccaagaccctgggcacccccctgtgccccaggatggaggatgtgcccctgctggagcccctcatctgcaagaagatcgcccacgagcggctgactgtgctgatcttcctggaggactgcatcgtgacagcctgccaggagggcttcatctgcacctggggccggcctgggaaggtgggcagcctgagcagccccagccaggccagcagccctgggggcaccgtggtgtag

SEQ ID NO: 43536 - DNA, 1710 bp, Artificial Sequence
  Description of Artificial Sequence: Synthetic coding sequence
atggccacagaaggaggcggcaaggagatgaatgagatcaagacccagttcaccacccgggagggcctgtacaagctgctgccccacagcgagtacagccggcccaacagagtgcccttcaacagccagggcagcaaccctgtgcgggtgtcctttgtgaacctgaatgaccagagcggaaatggagaccggctgtgcttcaacgtgggccgggagctgtacttctacatctacaagggcgtgaggaaggctgctgacctgagcaagcccatcgacaagaggatctacaagggcacccagcccacctgccacgacttcaaccacctgacagccacagctgagagcgtgtccctgctggtgggcttctctgctggccaggtgcagctgattgaccccatcaagaaggagaccagcaagctgttcaatgaggagcggctgattgacaagagccgggtgacctgtgtgaagtgggtgcccggcagcgagagcctcttcctggtggcccacagcagcggcaacatgtacctgtacaacgtggagcacacctgtggcaccacagccccccactaccagctgctgaagcagggcgagagctttgctgtgcacacctgcaagagcaagagcaccaggaaccccctgctgaagtggacagtgggggagggcgccctgaatgaatttgccttctccccagatggcaagttcctggcctgtgtgtcccaggacggcttcctgcgggtcttcaactttgattctgtggagctgcacggcaccatgaagagctactttggaggcctgctgtgtgtgtgctggagcccagatggcaagtacatcgtgactggaggagaagatgacctggtgacagtgtggagctttgtggactgccgggtgattgcccggggccacggccacaagtcctgggtgtctgtggtggcctttgacccctacaccacctctgtggaggagggggaccccatggagttcagcggcagtgatgaggacttccaggacctgctgcacttcggccgggaccgggccaacagcacccagagccggctgagcaagaggaacagcacagacagcaggcctgtgtctgtgacctacagatttggatctgtgggccaggacacccagctgtgcctgtgggacctgacagaggacatcctcttcccccaccagcccctgagccgggcccggacccacaccaacgtgatgaatgccaccagccccccagctggcagcaatggaaattctgtgaccaccccaggcaacagcgtgcccccacccctgcccaggagcaacagcctgccccacagcgctgtgtccaatgccggcagcaagagctctgtgatggatggagccatcgccagcggcgtgtccaagtttgccaccctgagcctgcatgacaggaaggagcggcaccacgagaaggaccacaagaggaaccacagcatgggccacatcagcagcaagagcagtgacaagctgaacctggtgaccaagaccaagacagatcctgccaagaccctgggcacccccctgtgccccaggatggaggatgtgcccctgctggagcccctcatctgcaagaagatcgcccacgagcggctgactgtgctgatcttcctggaggactgcatcgtgacagcctgccaggagggcttcatctgcacctggggccggcctgggaaggtggtgtccttcaacccctag

SEQ ID NO: 43537 - DNA, 1536 bp, Artificial Sequence
  Description of Artificial Sequence: Synthetic coding sequence
atgaatgagatcaagacccagttcaccacccgggagggcctgtacaagctgctgccccacagcgagtacagccggcccaacagagtgcccttcaacagccagggcagcaaccctgtgcgggtgtcctttgtgaacctgaatgaccagagcggaaatggagaccggctgtgcttcaacgtgggccgggagctgtacttctacatctacaagggcgtgaggaagaggctgattgacaagagccgggtgacctgtgtgaagtgggtgcccggcagcgagagcctcttcctggtggcccacagcagcggcaacatgtacctgtacaacgtggagcacacctgtggcaccacagccccccactaccagctgctgaagcagggcgagagctttgctgtgcacacctgcaagagcaagagcaccaggaaccccctgctgaagtggacagtgggggagggcgccctgaatgaatttgccttctccccagatggcaagttcctggcctgtgtgtcccaggacggcttcctgcgggtcttcaactttgattctgtggagctgcacggcaccatgaagagctactttggaggcctgctgtgtgtgtgctggagcccagatggcaagtacatcgtgactggaggagaagatgacctggtgacagtgtggagctttgtggactgccgggtgattgcccggggccacggccacaagtcctgggtgtctgtggtggcctttgacccctacaccacctctgtggaggagggggaccccatggagttcagcggcagtgatgaggacttccaggacctgctgcacttcggccgggaccgggccaacagcacccagagccggctgagcaagaggaacagcacagacagcaggcctgtgtctgtgacctacagatttggatctgtgggccaggacacccagctgtgcctgtgggacctgacagaggacatcctcttcccccaccagcccctgagccgggcccggacccacaccaacgtgatgaatgccaccagccccccagctggcagcaatggaaattctgtgaccaccccaggcaacagcgtgcccccacccctgcccaggagcaacagcctgccccacagcgctgtgtccaatgccggcagcaagagctctgtgatggatggagccatcgccagcggcgtgtccaagtttgccaccctgagcctgcatgacaggaaggagcggcaccacgagaaggaccacaagaggaaccacagcatgggccacatcagcagcaagagcagtgacaagctgaacctggtgaccaagaccaagacagatcctgccaagaccctgggcacccccctgtgccccaggatggaggatgtgcccctgctggagcccctcatctgcaagaagatcgcccacgagcggctgactgtgctgatcttcctggaggactgcatcgtgacagcctgccaggagggcttcatctgcacctggggccggcctgggaaggtgggcagcctgagcagccccagccaggccagcagccctgggggcaccgtggtgtag

SEQ ID NO: 43538 - DNA, 1338 bp, Artificial Sequence
  Description of Artificial Sequence: Synthetic coding sequence
atgtgggccggcagctgcaccagcatcagcacccggggcagcgcccggcagagccatgagcggctgattgacaagagccgggtgacctgtgtgaagtgggtgcccggcagcgagagcctcttcctggtggcccacagcagcggcaacatgtacctgtacaacgtggagcacacctgtggcaccacagccccccactaccagctgctgaagcagggcgagagctttgctgtgcacacctgcaagagcaagagcaccaggaaccccctgctgaagtggacagtgggggagggcgccctgaatgaatttgccttctccccagatggcaagttcctggcctgtgtgtcccaggacggcttcctgcgggtcttcaactttgattctgtggagctgcacggcaccatgaagagctactttggaggcctgctgtgtgtgtgctggagcccagatggcaagtacatcgtgactggaggagaagatgacctggtgacagtgtggagctttgtggactgccgggtgattgcccggggccacggccacaagtcctgggtgtctgtggtggcctttgacccctacaccacctctgtggaggagggggaccccatggagttcagcggcagtgatgaggacttccaggacctgctgcacttcggccgggaccgggccaacagcacccagagccggctgagcaagaggaacagcacagacagcaggcctgtgtctgtgacctacagatttggatctgtgggccaggacacccagctgtgcctgtgggacctgacagaggacatcctcttcccccaccagcccctgagccgggcccggacccacaccaacgtgatgaatgccaccagccccccagctggcagcaatggaaattctgtgaccaccccaggcaacagcgtgcccccacccctgcccaggagcaacagcctgccccacagcgctgtgtccaatgccggcagcaagagctctgtgatggatggagccatcgccagcggcgtgtccaagtttgccaccctgagcctgcatgacaggaaggagcggcaccacgagaaggaccacaagaggaaccacagcatgggccacatcagcagcaagagcagtgacaagctgaacctggtgaccaagaccaagacagatcctgccaagaccctgggcacccccctgtgccccaggatggaggatgtgcccctgctggagcccctcatctgcaagaagatcgcccacgagcggctgactgtgctgatcttcctggaggactgcatcgtgacagcctgccaggagggcttcatctgcacctggggccggcctgggaaggtggtgtccttcaacccctag

SEQ ID NO: 43539 - DNA, 1803 bp, Artificial Sequence
  Description of Artificial Sequence: Synthetic coding sequence
atggccacagaaggaggcggcaaggagatgaatgagatcaagacccagttcaccacccgggagggcctgtacaagctgctgccccacagcgagtacagccggcccaacagagtgcccttcaacagccagggcagcaaccctgtgcgggtgtcctttgtgaacctgaatgaccagagcggaaatggagaccggctgtgcttcaacgtgggccgggagctgtacttctacatctacaagggcgtgaggaaggctgctgacctgagcaagcccatcgacaagaggatctacaagggcacccagcccacctgccacgacttcaaccacctgacagccacagctgagagcgtgtccctgctggtgggcttctctgctggccaggtgcagctgattgaccccatcaagaaggagaccagcaagctgttcaatgaggagaacagctgccagcacctgtggaaggtggactggaatgaggagcggcagaatgaaggcagcaagaccagcgaggaggccctggtgacagtgcagaggctgattgacaagagccgggtgacctgtgtgaagtgggtgcccggcagcgagagcctcttcctggtggcccacagcagcggcaacatgtacctgtacaacgtggagcacacctgtggcaccacagccccccactaccagctgctgaagcagggcgagagctttgctgtgcacacctgcaagagcaagagcaccaggaaccccctgctgaagtggacagtgggggagggcgccctgaatgaatttgccttctccccagatggcaagttcctggcctgtgtgtcccaggacggcttcctgcgggtcttcaactttgacagcgtggagctgcacggcaccatgaagagctactttggaggcctgctgtgtgtgtgctggagcccagatggcaagtacatcgtgactggaggagaagatgacctggtgacagtgtggagctttgtggactgcagggtcatcgcccggggccacggccacaagtcctgggtgtctgtggtggcctttgacccctacaccacctctgtggaggagggggaccccatggagttcagcggcagtgatgaggacttccaggacctgctgcacttcggccgggaccgggccaacagcacccagagccggctgagcaagaggaacagcacagacagcaggcctgtgtctgtgacctaccgcttcggctctgtgggccaggacacccagctgtgcctgtgggacctgacagaggacatcctcttcccccaccagcccctgagccgggcccggacccacaccaacgtgatgaatgccaccagccccccagctggcagcaatggaaacagcgtgaccaccccaggcaacagcgtgcccccacccctgcccaggagcaacagcctgccccacagcgctgtgtccaatgccggcagcaagagctctgtgatggatggagccatcgccagcggcgtgtccaagtttgccaccctgagcctgcatgacaggaaggagcggcaccacgagaaggaccacaagaggaaccacagcatgggccacatcagcagcaagagcagtgacaagctgaacctggtgaccaagaccaagacagatcctgccaagaccctgggcacccccctgtgccccaggatggaggatgtgcccctgctggagcccctcatctgcaagaagatcgcccacgagcggctgactgtgctgatcttcctggaggactgcatcgtgacagcctgccaggagggcttcatctgcacctggggccggcctgggaaggtggtgtccttcaacccctag

SEQ ID NO: 43540 - DNA, 939 bp, Artificial Sequence
  Description of Artificial Sequence: Synthetic coding sequence
atgaagagctactttggaggcctgctgtgtgtgtgctggagcccagatggcaagtacatcgtgactggaggagaagatgacctggtgacagtgtggagctttgtggactgcagggtcatcgcccggggccacggccacaagtcctgggtgtctgtggtggcctttgacccctacaccacctctgtggaggagggggaccccatggagttcagcggcagtgatgaggacttccaggacctgctgcacttcggccgggaccgggccaacagcacccagagccggctgagcaagaggaacagcacagacagcaggcctgtgtctgtgacctaccgcttcggctctgtgggccaggacacccagctgtgcctgtgggacctgacagaggacatcctcttcccccaccagcccctgagccgggcccggacccacaccaacgtgatgaatgccaccagccccccagctggcagcaatggaaacagcgtgaccaccccaggcaacagcgtgcccccacccctgcccaggagcaacagcctgccccacagcgctgtgtccaatgccggcagcaagagctctgtgatggatggagccatcgccagcggcgtgtccaagtttgccaccctgagcctgcatgacaggaaggagcggcaccacgagaaggaccacaagaggaaccacagcatgggccacatcagcagcaagagcagtgacaagctgaacctggtgaccaagaccaagacagatcctgccaagaccctgggcacccccctgtgccccaggatggaggatgtgcccctgctggagcccctcatctgcaagaagatcgcccacgagcggctgactgtgctgatcttcctggaggactgcatcgtgacagcctgccaggagggcttcatctgcacctggggccggcctgggaaggtggtgtccttcaacccctag

SEQ ID NO: 43541 - DNA, 1191 bp, Artificial Sequence
  Description of Artificial Sequence: Synthetic coding sequence
atgtacctgtacaacgtggagcacacctgtggcaccacagccccccactaccagctgctgaagcagggcgagagctttgctgtgcacacctgcaagagcaagagcaccaggaaccccctgctgaagtggacagtgggggagggcgccctgaatgaatttgccttctccccagatggcaagttcctggcctgtgtgtcccaggacggcttcctgcgggtcttcaactttgacagcgtggagctgcacggcaccatgaagagctactttggaggcctgctgtgtgtgtgctggagcccagatggcaagtacatcgtgactggaggagaagatgacctggtgacagtgtggagctttgtggactgcagggtcatcgcccggggccacggccacaagtcctgggtgtctgtggtggcctttgacccctacaccacctctgtggaggagggggaccccatggagttcagcggcagtgatgaggacttccaggacctgctgcacttcggccgggaccgggccaacagcacccagagccggctgagcaagaggaacagcacagacagcaggcctgtgtctgtgacctaccgcttcggctctgtgggccaggacacccagctgtgcctgtgggacctgacagaggacatcctcttcccccaccagcccctgagccgggcccggacccacaccaacgtgatgaatgccaccagccccccagctggcagcaatggaaacagcgtgaccaccccaggcaacagcgtgcccccacccctgcccaggagcaacagcctgccccacagcgctgtgtccaatgccggcagcaagagctctgtgatggatggagccatcgccagcggcgtgtccaagtttgccaccctgagcctgcatgacaggaaggagcggcaccacgagaaggaccacaagaggaaccacagcatgggccacatcagcagcaagagcagtgacaagctgaacctggtgaccaagaccaagacagatcctgccaagaccctgggcacccccctgtgccccaggatggaggatgtgcccctgctggagcccctcatctgcaagaagatcgcccacgagcggctgactgtgctgatcttcctggaggactgcatcgtgacagcctgccaggagggcttcatctgcacctggggccggcctgggaaggtggtgtccttcaacccctag

SEQ ID NO: 43542 - DNA, 1527 bp, Artificial Sequence
  Description of Artificial Sequence: Synthetic coding sequence
atggccacagaaggaggcggcaaggagatgaatgagatcaagacccagttcaccacccgggagggcctgtacaagctgctgccccacagcgagtacagccggcccaacagagtgcccttcaacagccagggcagcaaccctgtgcgggtgtcctttgtgaacctgaatgaccagagcggaaatggagaccggctgtgcttcaacgtgggccgggagctgtacttctacatctacaagggcgtgaggaagaggctgattgacaagagccgggtgacctgtgtgaagtgggtgcccggcagcgagagcctcttcctggtggcccacagcagcggcaacatgtacctgtacaacgtggagcacacctgtggcaccacagccccccactaccagctgctgaagcagggcgagagctttgctgtgcacacctgcaagagcaagagcaccaggaaccccctgctgaagtggacagtgggggagggcgccctgaatgaatttgccttctccccagatggcaagttcctggcctgtgtgtcccaggacggcttcctgcgggtcttcaactttgacagcgtggagctgcacggcaccatgaagagctactttggaggcctgctgtgtgtgtgctggagcccagatggcaagtacatcgtgactggaggagaagatgacctggtgacagtgtggagctttgtggactgcagggtcatcgcccggggccacggccacaagtcctgggtgtctgtggtggcctttgacccctacaccacctctgtggaggagggggaccccatggagttcagcggcagtgatgaggacttccaggacctgctgcacttcggccgggaccgggccaacagcacccagagccggctgagcaagaggaacagcacagacagcaggcctgtgtctgtgacctaccgcttcggctctgtgggccaggacacccagctgtgcctgtgggacctgacagaggacatcctcttcccccaccagcccctgagccgggcccggacccacaccaacgtgatgaatgccaccagccccccagctggcagcaatggaaacagcgtgaccaccccaggcaacagcgtgcccccacccctgcccaggagcaacagcctgccccacagcgctgtgtccaatgccggcagcaagagctctgtgatggatggagccatcgccagcggcgtgtccaagtttgccaccctgagcctgcatgacaggaaggagcggcaccacgagaaggaccacaagaggaaccacagcatgggccacatcagcagcaagagcagtgacaagctgaacctggtgaccaagaccaagacagatcctgccaagaccctgggcacccccctgtgccccaggatggaggatgtgcccctgctggagcccctcatctgcaagaagatcgcccacgagcggctgactgtgctgatcttcctggaggactgcatcgtgacagcctgccaggagggcttcatctgcacctggggccggcctgggaaggtggtgtccttcaacccctag

SEQ ID NO: 43543 - DNA, 588 bp, Artificial Sequence
  Description of Artificial Sequence: Synthetic coding sequence
atggccacagaaggaggcggcaaggagatgaatgagatcaagacccagttcaccacccgggagggcctgtacaagctgctgccccacagcgagtacagccggcccaacagagtgcccttcaacagccagggcagcaaccctgtgcgggtgtcctttgtgaacctgaatgaccagagcggaaatggagaccggctgtgcttcaacgtgggccgggagctgtacttctacatctacaagggcgtgaggaaggctgctgacctgagcaagcccatcgacaagaggatctacaagggcacccagcccacctgccacgacttcaaccacctgacagccacagctgagagcgtgtccctgctggtgggcttctctgctggccaggtgcagctgattgaccccatcaagaaggagaccagcaagctgttcaatgaggagaacagctgccagcacctgtggaaggtggactggaatgaggagcggcagaatgaaggcagcaagaccagcgaggaggccctggtgacagtgcagcctgctgagcacttctgccggcaggaggacaggatgcagggcgtgctgcaggaccagaactag

SEQ ID NO: 43544 - DNA, 1563 bp, Artificial Sequence
  Description of Artificial Sequence: Synthetic coding sequence
atggccacagaaggaggcggcaaggagatgaatgagatcaagacccagttcaccacccgggagggcctgtacaagctgctgccccacagcgagtacagccggcccaacagagtgcccttcaacagccagggcagcaaccctgtgcgggtgtcctttgtgaacctgaatgaccagagcggaaatggagaccggctgtgcttcaacgtgggccgggagctgtacttctacatctacaagggcgtgaggaagaggctgattgacaagagccgggtgacctgtgtgaagtgggtgcccggcagcgagagcctcttcctggtggcccacagcagcggcaacatgtacctgtacaacgtggagcacacctgtggcaccacagccccccactaccagctgctgaagcagggcgagagctttgctgtgcacacctgcaagagcaagagcaccaggaaccccctgctgaagtggacagtgggggagggcgccctgaatgaatttgccttctccccagatggcaagttcctggcctgtgtgtcccaggacggcttcctgcgggtcttcaactttgacagcgtggagctgcacggcaccatgaagagctactttggaggcctgctgtgtgtgtgctggagcccagatggcaagtacatcgtgactggaggagaagatgacctggtgacagtgtggagctttgtggactgcagggtcatcgcccggggccacggccacaagtcctgggtgtctgtggtggcctttgacccctacaccacctctgtggaggagggggaccccatggagttcagcggcagtgatgaggacttccaggacctgctgcacttcggccgggaccgggccaacagcacccagagccggctgagcaagaggaacagcacagacagcaggcctgtgtctgtgacctaccgcttcggctctgtgggccaggacacccagctgtgcctgtgggacctgacagaggacatcctcttcccccaccagcccctgagccgggcccggacccacaccaacgtgatgaatgccaccagccccccagctggcagcaatggaaacagcgtgaccaccccaggcaacagcgtgcccccacccctgcccaggagcaacagcctgccccacagcgctgtgtccaatgccggcagcaagagctctgtgatggatggagccatcgccagcggcgtgtccaagtttgccaccctgagcctgcatgacaggaaggagcggcaccacgagaaggaccacaagaggaaccacagcatgggccacatcagcagcaagagcagtgacaagctgaacctggtgaccaagaccaagacagatcctgccaagaccctgggcacccccctgtgccccaggatggaggatgtgcccctgctggagcccctcatctgcaagaagatcgcccacgagcggctgactgtgctgatcttcctggaggactgcatcgtgacagcctgccaggagggcttcatctgcacctggggccggcctgggaaggtgggcagcctgagcagccccagccaggccagcagccctgggggcaccgtggtgtag

SEQ ID NO: 43545 - DNA, 2763 bp, Artificial Sequence
  Description of Artificial Sequence: Synthetic coding sequence
atgggcaagaagaggaccaccagcggggagggccgggagcggcagaggctgcctgcccggcgcttccgcaccaccagccctgctgccctgcgggctgacagcgtggatggcggcagcctgctggcccccctgctgggcctgacagaccgggccttcagtgactgcccagacctggctgatggagccatggagaagatgagccgggtgaccacagccctgggcggctctgtgctgactggaagaaccatgcactgccacctggatgccccagccaatgccatctctgtgtgcagagatgctgcccaggtggtggtggccggccgcagcatcttcaagatctatgccatcgaggaggagcagtttgtggagaagctgaacctgcgggtgggcaggaagcccagcctgaacctgagctgtgctgatgtggtgtggcaccagatggatgagaacctgctggccacagctgccaccaacggggtggtggtgacctggaacctgggccggcccagcaggaacaagcaggaccagctgttcacagagcacaagaggacagtgaacaaggtgtgcttccaccccacagaggcccacgtgctgctgagcggcagccaggacggcttcatgaagtgctttgacctgcggaggaaggacagcgtgtccaccttcagcggggaggccacagaggccggcccccgggagtgggccatggccggctgtgtgcccatcctgcctgtgctgagctgccgcatcctgcggctgcaccacagctttgcccacggccccatgcaggatgctgagagcacagccaatgatgcccgggagagctggggctgccccctgtaccccctgggcctgtgcagcggcccccaggccggccagagcgagagcgtgagagatgtgcagttcagcatccgggactacttcacctttgccagcacctttgaaaatggaaatgtgcagctgtgggacatccggcggccagacagatgtgagaggatgttcaccgcccacaatggacctgtgttctgctgtgactggcaccctgaggaccggggctggctggccactggaggccgggacaagatggtgaaggtgtgggacatgaccacccaccgggccaaggagatgcactgtgtgcagaccatcgcctctgtggcccgggtgaagtggaggcctgagtgccgccaccacctggccacctgcagcatgatggtggaccacaacatctacgtgtgggatgtgcggcggccctttgtgcctgctgccatgtttgaggagcacagagatgtgaccactggaattgcctggaggcacccccatgaccccagcttcctgctgagcggcagcaaggacagcagcctgtgccagcacctgttcagagatgccagccagcctgtggagcgggccaaccctgagggcctgtgctacggcctgtttggagacctggcctttgctgccaaggagagcctggtggccgctgagagcggcaggaagccctacaccggggacagaagacaccccatcttcttcaagaggaagctggaccctgctgagccctttgctggcctggccagcagcgccctgtctgtgtttgaaacagagcccggcggcggcggcatgcgctggtttgtggacacagctgagagatatgccctggccggccggcccctggccgagctgtgtgaccacaatgccaaggtggcccgggagctgggcaggaaccaggtggcccagacctggaccatgctgcgcatcatctactgcagccctggcctggtgcccacagccaacctgaaccacagcgtgggcaaaggaggcagctgtggcctgcccctgatgaacagcttcaacctgaaggacatggcccctggcctgggcagcgagacccggctggacaggagcaaaggagatgcccggagtgacacagtgctgctggacagcagcgccaccctcatcaccaatgaagataatgaggagacagagggcagtgatgtgcctgctgactacctgctgggagatgtggagggggaggaggatgagctgtacctgctggaccctgagcacgcccacccagaagatcctgaatgtgtgctgccccaggaggccttccccctgcggcatgagatcgtggacaccccacctggccctgagcacctgcaggacaaggctgacagcccccacgtgtctggcagcgaggctgatgtggccagcctggcccctgtggacagcagcttcagcctgctgtctgtgtcccatgccctgtatgacagccggctgcccccagacttctttggagtgctggtgcgggacatgctgcacttctatgcagagcagggagatgtgcagatggctgtgtctgtgctgattgtgctgggggagcgggtgaggaaggacattgatgagcagacccaggagcactggtacaccagctacatcgacctgctgcagcgcttccggctgtggaatgtgtccaatgaggtggtgaagctgagcaccagcagagctgtgtcctgcctgaaccaggccagcaccaccctgcacgtgaactgcagccactgcaagaggcccatgagcagccggggctgggtgtgtgaccgctgccaccgctgtgcctccatgtgtgctgtgtgccaccacgtggtgaagggcctgtttgtgtggtgccagggctgcagccacggcggccacctgcagcacatcatgaagtggctggagggcagcagccactgcccagctggctgcggccacctgtgtgagtacagctag

SEQ ID NO: 43546 - DNA, 2373 bp, Artificial Sequence
  Description of Artificial Sequence: Synthetic coding sequence
atggagaagatgagccgggtgaccacagccctgggcggctctgtgctgactggaagaaccatgcactgccacctggatgccccagccaatgccatctctgtgtgcagagatgctgcccaggtggtggtggccggccgcagcatcttcaagatctatgccatcgaggaggagcagtttgtggagaagctgaacctgcgggtgggcaggaagcccagcctgaacctgagctgtgctgatgtggtgtggcaccagatggatgagaacctgctggccacagctgccaccaacggggtggtggtgacctggaacctgggccggcccagcaggaacaagcaggaccagctgttcacagagcacaagaggacagtgaacaaggtgtgcttccaccccacagaggcccacgtgctgctgagcggcagccaggacggcttcatgaagtgctttgacctgcggaggaaggacagcgtgtccaccttcagcggccagagcgagagcgtgagagatgtgcagttcagcatccgggactacttcacctttgccagcacctttgaaaatggaaatgtgcagctgtgggacatccggcggccagacagatgtgagaggatgttcaccgcccacaatggacctgtgttctgctgtgactggcaccctgaggaccggggctggctggccactggaggccgggacaagatggtgaaggtgtgggacatgaccacccaccgggccaaggagatgcactgtgtgcagaccatcgcctctgtggcccgggtgaagtggaggcctgagtgccgccaccacctggccacctgcagcatgatggtggaccacaacatctacgtgtgggatgtgcggcggccctttgtgcctgctgccatgtttgaggagcacagagatgtgaccactggaattgcctggaggcacccccatgaccccagcttcctgctgagcggcagcaaggacagcagcctgtgccagcacctgttcagagatgccagccagcctgtggagcgggccaaccctgagggcctgtgctacggcctgtttggagacctggcctttgctgccaaggagagcctggtggccgctgagagcggcaggaagccctacaccggggacagaagacaccccatcttcttcaagaggaagctggaccctgctgagccctttgctggcctggccagcagcgccctgtctgtgtttgaaacagagcccggcggcggcggcatgcgctggtttgtggacacagctgagagatatgccctggccggccggcccctggccgagctgtgtgaccacaatgccaaggtggcccgggagctgggcaggaaccaggtggcccagacctggaccatgctgcgcatcatctactgcagccctggcctggtgcccacagccaacctgaaccacagcgtgggcaaaggaggcagctgtggcctgcccctgatgaacagcttcaacctgaaggacatggcccctggcctgggcagcgagacccggctggacaggagcaaaggagatgcccggagtgacacagtgctgctggacagcagcgccaccctcatcaccaatgaagataatgaggagacagagggcagtgatgtgcctgctgactacctgctgggagatgtggagggggaggaggatgagctgtacctgctggaccctgagcacgcccacccagaagatcctgaatgtgtgctgccccaggaggccttccccctgcggcatgagatcgtggacaccccacctggccctgagcacctgcaggacaaggctgacagcccccacgtgtctggcagcgaggctgatgtggccagcctggcccctgtggacagcagcttcagcctgctgtctgtgtcccatgccctgtatgacagccggctgcccccagacttctttggagtgctggtgcgggacatgctgcacttctatgcagagcagggagatgtgcagatggctgtgtctgtgctgattgtgctgggggagcgggtgaggaaggacattgatgagcagacccaggagcactggtacaccagctacatcgacctgctgcagcgcttccggctgtggaatgtgtccaatgaggtggtgaagctgagcaccagcagagctgtgtcctgcctgaaccaggccagcaccaccctgcacgtgaactgcagccactgcaagaggcccatgagcagccggggctgggtgtgtgaccgctgccaccgctgtgcctccatgtgtgctgtgtgccaccacgtggtgaagggcctgtttgtgtggtgccagggctgcagccacggcggccacctgcagcacatcatgaagtggctggagggcagcagccactgcccagctggctgcggccacctgtgtgagtacagctag

SEQ ID NO: 43547 - DNA, 1635 bp, Artificial Sequence
  Description of Artificial Sequence: Synthetic coding sequence
atgacagcccggaccctgagcctgatggccagcctggtggcctatgatgacagcgacagcgaggccgagacagagcacgccggcagcttcaatgccaccggccagcagaaggacaccagcggcgtggcccggcccccaggccaggactttgccagcggcaccctggatgtgcccaaggccggggcccagcccaccaagcacggcagctgtgaagatcctgggggctaccgcctgcccctggcccagctgggccgcagtgactggggcagctgccccagccagaggctgcagtggccaggcaaggagccccaggtgaccttccccatcaaggagcccagctgcagcagcctgtggaccagccacgtgcctgccagccacatgcccctggccgccgcccgcttcaagcaggtgaagctgagcaggaacttccccaagagcagcttccacgcccagagcgagagcgagaccgtgggcaagaatggcagcagcttccagaagaagaagtgtgaggactgtgtggtgccctacaccccccggcggctgcggcagaggcaggccctgagcacagaaacaggcaagggcaaggatgtggagccccagggccccccagctggccgggccccagcccccctgtatgtgggccctggggtgtctgagttcatccagccctacctgaacagccactacaaggagaccaccgtgcccaggaaggtgctcttccacctgcggggccaccggggccctgtgaacaccatccagtggtgccctgtgctgagcaagagccacatgctgctgagcacctccatggacaagaccttcaaggtgtggaatgctgtggacagcggccactgcctgcagacctacagcctgcacacagaggccgtgcgggccgcccgctgggccccctgtggccgccgcatcctgagcggcggctttgattttgccctgcacctgacagacctggagaccggcacccagctgttcagcggccgcagtgacttccgcatcaccaccctgaagttccaccccaaggaccacaacatcttcctgtgtggcggcttcagcagcgagatgaaggcctgggacatcagaacaggcaaggtgatgaggagctacaaggccaccatccagcagaccctggacatcctcttcctgcgggagggcagcgagttcctgagcagcacagatgccagcacccgggacagcgctgacaggaccatcatcgcctgggacttccgcaccagcgccaagatcagcaaccagatcttccacgagcgcttcacctgccccagcctggccctgcacccccgggagcctgtgttcctggcccagaccaacggcaactacctggccctcttcagcacagtgtggccctacaggatgagcagaagaagaagatatgagggccacaaggtggagggctacagcgtgggctgtgagtgcagccctggaggagacctgctggtgacaggcagcgcagatggccgggtgctgatgtacagcttcagaacagccagccgggcctgcaccctgcagggccacacccaggcctgtgtgggcaccacctaccaccctgtgctgcccagcgtgctggccacctgctcctggggcggggacatgaagatctggcactag

SEQ ID NO: 43548 - DNA, 1635 bp, Artificial Sequence; identical to SEQ ID NO: 43547
  Description of Artificial Sequence: Synthetic coding sequence

SEQ ID NO: 43549 - DNA, 864 bp, Artificial Sequence
  Description of Artificial Sequence: Synthetic coding sequence
atgcctgccctgtgcctggtgctgtgctggttccagggcctgctgggggaggtgtggaatgctgtggacagcggccactgcctgcagacctacagcctgcacacagaagctgtgcgggccgcccgctgggccccctgtggccgccgcatcctgagcggcggctttgattttgccctgcacctgacagacctggagaccggcacccagctgttcagcggccgcagtgacttccgcatcaccaccctgaagttccaccccaaggaccacaacatcttcctgtgtggcggcttcagcagcgagatgaaggcctgggacatcagaacaggcaaggtgatgaggagctacaaggccaccatccagcagaccctggacatcctcttcctgcgggagggcagcgagttcctgagcagcacagatgccagcacccgggacagcgctgacaggaccatcatcgcctgggacttccgcaccagcgccaagatcagcaaccagatcttccacgagcgcttcacctgccccagcctggccctgcacccccgggagcccgtcttcctggcccagaccaatggaaactacctggccctcttcagcacagtgtggccctacaggatgagcagaagaagaagatatgagggccacaaggtggagggctacagcgtgggctgtgaatgttctcctggaggagacctgctggtgactggatctgcagatggccgggtgctgatgtacagcttcagaacagccagccgggcctgcaccctgcagggccacacccaggcctgtgtgggcaccacctaccaccctgtgctgcccagcgtgctggccacctgctcctggggcggggacatgaagatctggcactag

SEQ ID NO: 43550 - DNA, 1635 bp, Artificial Sequence; identical to SEQ ID NO: 43547
  Description of Artificial Sequence: Synthetic coding sequence

SEQ ID NO: 43551 - DNA, 2574 bp, Artificial Sequence
  Description of Artificial Sequence: Synthetic coding sequence
atggagaacccccaggacatcttcagcagcaatggaggctgcctgagtgacatcgtcatcgagaagtacctggtggagagcaaggagagcgtgagccacgtgcagctggcctgcagcatgcaggactgtgccttccccctggatggaacagagctgtgcatctggaacaccaaggaccccagccaccagctgctgatcctgcggggccaccaccagcccatcacagccatggcctttggaaacaaggtgaaccccctgctgatctgcagcgccagcctggactatgtgatcatgtggaacctggatgaatgtcgggagaaggtgctgcagggcctggtgccccggggcaccgtgatgggcagcctgctgggcaaggtgctgtgcctgcagctgagcctggatgaccacgtggtggccgtgtgtgccggcaacaagatcttcatgctggacatcgagcagcgcttctctgtgacctacatcgagaggccagatgtgaacaacagacacaaggtgcccccacccaccttcctgcacaccttcagccagacccaggccgtgcgggcagagctgcagggccacctgggccctgtgacagctgtggagttctgcccctggagggctggcaccctcatcagcgcctctgaagatcggggcttcaaggtgtgggaccactgcaccggcagcctcatctacagcagctctgtgctgagcgcctaccccctgctgagcctcttcattgatgctgagagccggcagctggtgacaggctgtgctgatggccagctgtggatcttcagcctgatggatggccaccactaccgccgggtggcccgggtggacctgaggaagaagacagagaccttcagcaccaggagagtgaagagcggcctgtgcagccagcctgaggagagccagctgcccagcaccagcgccctgggcaagggggagcaggtggaggtgaccttccctgtgctgcggctggccccctgtgacctgagcctcatccccaacagcgcctgtggctgcctgagcagcgagaacacccgctgtgtgtggattggcagctctgtgggcctgtttgtgttcaacctggccaacctggaggtggaggccgccctgtactacaaggacttccagagcctgagcatcctgctggccggcagctgtgccctgaggaacagaacagctgaccagaaggtgctgtgcctgctggccagcctgtttggaggcaagattgctgtgctggagatcaacccagctgccctggtgcgggcccagcagtgccccagcatgggccagagcctgtctgtgcctgccagcagctgtgtgctgcccaccagccccctgtacctgggcatcgccaaggagaagagcaccaaggccgccagcgagcagaggcgggccgccagaaatgtgatgaaggaccagaggctggtgttccacagcaaggtgcgcagcagcggctacgccagcgccccccacgtgaccatgttcagccccaagaccaacatcaagtctgagggcaagggcagcagccgcagccgcagcagctgtgcccgggaggcctaccctgtggagtgtgctgtgcccaccaagccaggcccccaggtggccgccgcccccacctgcaccagggtgtgctgcatccagtacagcggagatggccagtggctggcctgtggcctggccaaccacctgctgctggtgtttgatgccagcctgaccggcaccccagctgtgttcagcggccatgatggagctgtgaatgctgtgtgctggagccaggaccggcgctggctgctgtctgctgccagagatggcaccctgaggatgtggagcgcccggggagctgagctggccctgctgctgggcaaggacatgttcagcaagcccatccagagcgcccagttctactacattgatgccttcatcctgctgagcagcggccctgagttccagctgctgcgctaccacatcgacacctgcaaggatgagatcaagcgctacaagcagaagagcaagagcaagctgatctgccgcctgagcaccaccggggctgtggacatgaccagcctgtctgctgtgaatgacttctacagccacatcgtgctggccgccggcaggaacagaacagtggaggtgtttgacctgaatgccggctgcagcgctgctgtgattgctgaggcccacagcaggcctgtgcaccagatctgccagaacaagggcagcagcttcaccacccagcagccccaggcctacaacctcttcctgaccacagccatcggagatggcatgaggctgtgggacctgcggaccctgcgctgtgagcggcactttgagggccaccccacccggggctacccctgtggcatcgccttcagcccctgtggccgctttgctgcctgtggggctgaagatagacatgcctacgtgtatgagatgggcagcagcaccttcagccaccggctggccggccacacagacacagtgactggagtggccttcaaccccagcgccccccagctggccacagccaccctggatggcaagctgcagctgttcctggccgagtag

SEQ ID NO: 43552 - DNA, 546 bp, Artificial Sequence
  Description of Artificial Sequence: Synthetic coding sequence
atggagaacccccaggacatcttcagcagcaatggaggctgcctgagtgacatcgtcatcgagaagtacctggtggagagcaaggagagcgtgagccacgtgcagctggcctgcagcatgcaggactgtgccttccccctggatggaacagagctgtgcatctggaacaccaaggaccccagccaccagctgctgatcctgcggggccaccaccagcccatcacagccatggcctttggaaacaaggtgaaccccctgctgatctgcagcgccagcctggactatgtgatcatgtggaacctggatgaatgtcgggagaaggtgctgcagggcctggtgccccggggcaccgtgatgggcagcctgctgggcaaggtgctgtgcctgcagctgagcctggatgaccacgtggtggccgtgtgtgccggcaacaagatcttcatgctggacatcgagcacatcctcttctctgtgtacagcctgatgcagaaggccggctcctggagccctggggtgctgacagccagctttggcagctctgtgtag

SEQ ID NO: 43553 - DNA, 2193 bp, Artificial Sequence
  Description of Artificial Sequence: Synthetic coding sequence
atggagaacccccaggacatcttcagcagcaatggaggctgcctgagtgacatcgtcatcgagaagtacctggtggagagcaaggagagcgtgagccacgtgcagctggcctgcagcatgcaggactgtgccttccccctggatggaacagagctgtgcatctggaacaccaaggaccccagccaccagctgctgatcctgcggggccaccaccagcccatcacagccatggcctttggaaacaaggtgaaccccctgctgatctgcagcgccagcctggactatgtgatcatgtggaacctggatgaatgtcgggagaaggtgctgcaggcctaccccctgctgagcctcttcattgatgctgagagccggcagctggtgacaggctgtgctgatggccagctgtggatcttcagcctgatggatggccaccactacagaagagtggcccgggtggacctgaggaagaagacagagaccttcagcacccggcgggtgaagagcggcctgtgcagccagcctgaggagagccagctgcccagcaccagcgccctgggcaaaggagagcaggtggaggtgaccttccctgtgctgcggctggccccctgtgacctgagcctcatccccaacagcgcctgtggctgcctgagcagcgagaacacccgctgtgtgtggattggcagctctgtgggcctgtttgtgttcaacctggccaacctggaggtggaggccgccctgtactacaaggacttccagagcctgagcatcctgctggccggcagctgtgccctgaggaacagaacagctgaccagaaggtgctgtgcctgctggccagcctgtttggaggcaagattgctgtgctggagatcaacccagctgccctggtgcgggcccagcagtgccccagcatgggccagagcctgtctgtgcctgccagcagctgtgtgctgcccaccagccccctgtacctgggcatcgccaaggagaagagcaccaaggccgccagcgagcagaggagagctgccagaaatgtgatgaaggaccagaggctggtgttccacagcaaggtgcgcagcagcggctacgccagcgcccctcatgtgaccatgttcagccccaagaccaacatcaagtctgagggcaagggcagcagccgcagccgcagcagctgtgcccgggaggcctaccctgtggagtgtgctgtgcccaccaagccaggcccccaggtggccgccgcccccacctgcaccagggtgtgctgcatccagtacagcggagatggccagtggctggcctgtggcctggccaaccacctgctgctggtgtttgatgccagcctgaccggcaccccagctgtgttttctggccatgatggagctgtgaatgctgtgtgctggagccaggaccggcgctggctgctgtctgctgccagagatggcaccctgaggatgtggagcgcccggggagctgagctggccctgctgctgggcaaggacatgttcagcaagcccatccagagcgcccagttctactacattgatgccttcatcctgctgagcagcggccctgagttccagctgctgcgctaccacatcgacacctgcaaggatgagatcaagcgctacaagcagaagagcaagagcaagctgatctgccgcctgagcaccactggagctgtggacatgaccagcctgtctgctgtgaatgacttctacagccacatcgtgctggccgccggcaggaacagaacagtggaggtgtttgacctgaatgccggctgcagcgctgctgtgattgctgaggcccacagcaggcctgtgcaccagatctgccagaacaagggcagcagcttcaccacccagcagccccaggcctacaacctcttcctgaccacagccatcggagatggcatgaggctgtgggacctgcggaccctgcgctgtgagcggcactttgagggccaccccacccggggctacccctgtggcatcgccttcagcccctgtggccgctttgctgcctgtggggctgaggacagacatgcctacgtgtatgagatgggcagcagcaccttcagccaccggctggccggccacacagacacagtgactggagtggccttcaaccccagcgccccccagctggccacagccaccctggatggcaagctgcagctgttcctggccgagtag

SEQ ID NO: 43554 - DNA, 2688 bp, Artificial Sequence
  Description of Artificial Sequence: Synthetic coding sequence
atggagaacccccaggacatcttcagcagcaatggaggctgcctgagtgacatcgtcatcgagaagtacctggtggagagcaaggagagcgtgagccacgtgcagctggcctgcagcatgcaggactgtgccttccccctggatggaacagagctgtgcatctggaacaccaaggaccccagccaccagctgctgatcctgcggggccaccaccagcccatcacagccatggcctttggaaacaaggtgaaccccctgctgatctgcagcgccagcctggactatgtgatcatgtggaacctggatgaatgtcgggagaaggtgctgcagggcctggtgccccggggcaccgtgatgggcagcctgctgggcaaggtgctgtgcctgcagctgagcctggatgaccacgtggtggccgtgtgtgccggcaacaagatcttcatgctggacatcgagcagcgcttctctgtgacctacatcgagaggccagatgtgaacaacagacacaaggtgcccccacccaccttcctgcacaccttcagccagacccaggccgtgcgggcagagctgcagggccacctgggccctgtgacagctgtggagttctgcccctggagggctggcaccctcatcagcgcctctgaagatcggggcttcaaggtgtgggaccactgcaccggcagcctcatctacagcagctctgtgctgagcgcctaccccctgctgagcctcttcattgatgctgagagccggcagctggtgacaggctgtgctgatggccagctgtggatcttcagcctgatggatggccaccactaccgccgggtggcccgggtggacctgaggaagaagacagagaccttcagcaccaggagagtgaagagcggcctgtgcagccagcctgaggagagccagctgcccagcaccagcgccctgggcaagggggagcaggtggaggtgaccttccctgtgctgcggctggccccctgtgacctgagcctcatccccaacagcgcctgtggctgcctgagcagcgagaacacccgctgtgtgtggattggcagctctgtgggcctgtttgtgttcaacctggccaacctggaggtggaggccgccctgtactacaaggacttccagagcctgagcatcctgctggccggcagctgtgccctgaggaacagaacagctgaccagaaggtgctgtgcctgctggccagcctgtttggaggcaagattgctgtgctggagatcaacccagctgccctggtgcgggcccagcagtgccccagcatgggccagagcctgtctgtgcctgccagcagctgtgtgctgcccaccagccccctgtacctgggcatcgccaaggagaagagcaccaaggccgccagcgagcagaggcgggccgccagaaatgtgatgaaggaccagaggctggtgttccacagcaaggtgcgcagcagcggctacgccagcgccccccacgtgaccatgttcagccccaagaccaacatcaagtctgagggcaagggcagcagccgcagccgcagcagctgtgcccgggaggcctaccctgtggagtgtgctgtgcccaccaagccaggcccccaggtggccgccgcccccacctgcaccagggtgtgctgcatccagtacagcggagatggccagtggctggcctgtggcctggccaaccacctgctgctggtgtttgatgccagcctgaccggcaccccagctgtgttcagcggccatgatggagctgtgaatgctgtgtgctggagccaggaccggcgctggctgctgtctgctgccagagatggcaccctgaggatgtggagcgcccggggagctgagctggccctgctgctgggcaaggacatgttcagcaagcccatccagagcgcccagttctactacattgatgccttcatcctgctgagcagcggccctgagttccagctgctgcgctaccacatcgacacctgcaaggatgagatcaagcgctacaagcagaagagcaagagcaagctgatctgccgcctgagcaccaccggggctgtggacatgaccagcctgtctgctgtgaatgacttctacagccacatcgtgctggccgccggcaggaacagaacagtggaggtgtttgacctgaatgccggctgcagcgctgctgtgattgctgaggcccacagcaggcctgtgcaccagatctgccagaacaagggcagcagcttcaccacccagcagccccaggcctacaacctcttcctgaccacagccatcggagatggcatgaggctgtgggacctgcggaccctgcgctgtgagcggcactttgagggccaccccacccggggctacccctgtggcatcgccttcagcccctgtggccgctttgctgcctgtggggctgaagatagacatgcctacgtgtatgagatgggcagcagcaccttcagccaccggctggccggccacacagacacagtgactggagtggccttcaaccccagcgccccccagatggagagccgctctgtggcccacgccggcgtgcagtggcatgacctgggcagcctgcagcccccacccagccgcttcaagcagttcttctgcctgagcctgcccagctcctgggactacagcctgccccagctgccctggatggtgaacagcagcagcttctag

SEQ ID NO: 43555 - DNA, 267 bp, Artificial Sequence
  Description of Artificial Sequence: Synthetic coding sequence
atggagaacccccaggacatcttcagcagcaatggaggctgcctgagtgacatcgtcatcgagaagtacctggtggagagcaaggagagcgtgagccacgtgcagctggcctgcagcatgcaggactgtgccttccccctggatggaacagagctgtgcatctggaacaccaaggaccccagccaccagctgctgatcctgcggggccaccaccagcccatcacagccatggcctttggaaacaaggtgaaccccctgctgatctag

SEQ ID NO: 43556 - DNA, 1101 bp, Artificial Sequence
  Description of Artificial Sequence: Synthetic coding sequence
atgctgctgctgcgctgccagctgaagcaggccccaccccagaaggtgtccttccgcttctgtgtggtgatgggcaagcagcagagcaagctgaagcacagcacctacaagtatggcccagatgagatcatcgaggagcgcatccagaccaaggccttccaggagtacagccctgcccacatggacacagtgtctgtggtggccgccctgaacagcgacctgtgtgtgtctgggggcaaggacaagacagtggtggcctacaactggaagacaggaaatgtggtgaagcgcttcaagggccatgaacatgagatcaccaaggtggcctgcatccccaagagcagccagttcttcagcgccagccgggacaggatggtgatgatgtgggacctgcacggcagcagccagccccggcagcagctgtgtggccacgccatggtggtgacaggcctggccgtgtccccagacagcagccagctgtgcaccggcagccgggacaacaccctgctgctgtgggatgtggtgacaggccagagcgtggagcgggcctctgtgtccagaaatgtggtgacccacctgtgctgggtgccccgggagccctacatcctgcagaccagcgaggacaagaccctgcggctgtgggacagccggggcctgcaggtggcccacatgtttcctgccaagcagcacatccagacctactgtgaggtgtctgtggatggccacaagtgcatcagctgcagcaatggatttggaggagagggctgtgaggccaccctgtgggacctgcggcagaccaggaaccgcatctgtgagtacaagggccacttccagacagtggccagctgtgtgttcctgccccgggccctggccctgatgcccctcatcgccaccagcagccatgactgcaaggtgaagatctggaaccaggacaccggggcctgcctcttcaccctgagcctggatggcagcggccccctgaccagcctggccgtgggagatgccatcagcctgctgtgtgccagcttcaacagaggcatccacctgctgaggatggaccacagccagggcctggagctgcaggaggtggccgccttctag

SEQ ID NO: 43557 - DNA, 1104 bp, Artificial Sequence
  Description of Artificial Sequence: Synthetic coding sequence
atgctgctgctgcgctgccagctgaagcaggccccaccccagaaggtgtccttccgcttctgtgtggtgatgggcaagcagcagagcaagctgaagcacagcacctacaagtatggccgcccagatgagatcatcgaggagcgcatccagaccaaggccttccaggagtacagccctgcccacatggacacagtgtctgtggtggccgccctgaacagcgacctgtgtgtgtctgggggcaaggacaagacagtggtggcctacaactggaagacaggaaatgtggtgaagcgcttcaagggccacgagcacgagatcaccaaggtggcctgcatccccaagagcagccagttcttcagcgccagccgggacaggatggtgatgatgtgggacctgcacggcagcagccagccccggcagcagctgtgtggccacgccatggtggtgacaggcctggccgtgtccccagacagcagccagctgtgcaccggcagccgggacaacaccctgctgctgtgggatgtggtgacaggccagagcgtggagcgggcctctgtgtccagaaatgtggtgacccacctgtgctgggtgccccgggagccctacatcctgcagaccagcgaggacaagaccctgcggctgtgggacagccggggcctgcaggtggcccacatgtttcctgccaagcagcacatccagacctactgtgaggtgtctgtggatggccacaagtgcatcagctgcagcaatggatttggaggagagggctgtgaggccaccctgtgggacctgcggcagaccaggaaccgcatctgtgagtacaagggccacttccagacagtggccagctgtgtgttcctgccccgggccctggccctgatgcccctgattgccaccagcagccatgactgcaaggtgaagatctggaaccaggacacaggagcctgcctcttcaccctgagcctggatggcagcggccccctgaccagcctggccgtgggagatgccatcagcctgctgtgtgccagcttcaacagaggcatccacctgctgaggatggaccacagccagggcctggagctgcaggaggtggccgccttctag

SEQ ID NO: 43558 - DNA, 729 bp, Artificial Sequence
  Description of Artificial Sequence: Synthetic coding sequence
atggtgatgatgtgggacctgcacggcagcagccagccccggcagcagctgtgtggccacgccatggtggtgacaggcctggccgtgtccccagacagcagccagctgtgcaccggcagccgggacaacaccctgctgctgtgggatgtggtgacaggccagagcgtggagcgggcctctgtgtccagaaatgtggtgacccacctgtgctgggtgccccgggagccctacatcctgcagaccagcgaggacaagaccctgcggctgtgggacagccggggcctgcaggtggcccacatgtttcctgccaagcagcacatccagacctactgtgaggtgtctgtggatggccacaagtgcatcagctgcagcaatggatttggaggagagggctgtgaggccaccctgtgggacctgcggcagaccaggaaccgcatctgtgagtacaagggccacttccagacagtggccagctgtgtgttcctgccccgggccctggccctgatgcccctcatcgccaccagcagccatgactgcaaggtgaagatctggaaccaggacaccggggcctgcctcttcaccctgagcctggatggcagcggccccctgaccagcctggccgtgggagatgccatcagcctgctgtgtgccagcttcaacagaggcatccacctgctgaggatggaccacagccagggcctggagctgcaggaggtggccgccttctag

SEQ ID NO: 43559 - DNA, 4011 bp, Artificial Sequence
  Description of Artificial Sequence: Synthetic coding sequence
atggccacagaaattggcagccccccacgcttcttccacatgccccgcttccagcaccaggccccccggcagctgttctacaagaggccagactttgcccagcagcaggccatgcagcagctgacctttgatggcaagaggatgaggaaggctgtgaacaggaagaccatcgactacaaccccagcgtcatcaagtacctggagaaccgcatctggcagagggaccagagggacatgagggccatccagccagatgctggctactacaatgacctggtgccccccatcggcatgctgaacaaccccatgaatgctgtgaccaccaagtttgtgaggaccagcaccaacaaggtgaagtgccctgtgtttgtggtgcgctggaccccagagggccggcggctggtgactggagccagcagcggggagttcaccctgtggaatggcctgaccttcaactttgagaccatcctgcaggcccatgacagccctgtgcgggccatgacctggagccacaatgacatgtggatgctgacagctgaccatggaggctacgtgaagtactggcagagcaacatgaacaacgtgaagatgttccaggcccacaaggaggccatccgggaggccagcttcagccccacagacaacaagtttgccacctgcagtgatgatggcaccgtgcgcatctgggacttcctgcgctgccacgaggagcgcatcctgcggggccatggagcagatgtgaagtgtgtggactggcaccccaccaagggcctggtggtgtctggcagcaaggacagccagcagcccatcaagttctgggaccccaagacaggccagagcctggccaccctgcacgcccacaagaacacagtgatggaggtgaagctgaacctgaatggaaactggctgctgacagccagccgggaccacctgtgcaagctgtttgacatccggaacctgaaggaggagctgcaggtgttccggggccacaagaaggaggccacagctgtggcctggcaccctgtgcatgagggcctgtttgccagcggcggcagtgatggcagcctgctcttctggcacgtgggcgtggagaaggaggtgggcggcatggagatggcccacgagggcatgatctggagcctggcctggcaccccctgggccacatcctgtgcagcggcagcaatgaccacaccagcaagttctggaccaggaacagacctggggacaagatgagggaccgctacaacctgaacctgctgcccggcatgtctgaagatggagtggagtatgatgacctggagcccaacagcctggccgtcatccctggcatgggcatccctgagcagctgaagctggccatggagcaggagcagatgggcaaggatgagagcaatgaaattgagatgaccatccctggcctggactggggcatggaggaggtgatgcagaaggaccagaagaaggtgccccagaagaaggtgccctatgccaagcccatcccagcccagttccagcaggcctggatgcagaacaaggtgcccatcccagccccaaatgaggtgctgaatgacagaaaagaagacatcaagctggaggagaagaagaagacccaggccgagattgagcaggagatggccaccctgcagtacaccaacccccagctgctggagcagctgaagattgagcggctggcccagaagcaggtggagcagatccagcccccacccagcagcggcacccccctgctgggcccccagcccttccctggccagggccccatgagccagatcccccagggcttccagcagccccaccccagccagcagatgcccatgaacatggcccagatgggccccccaggcccccagggccagttccggcccccaggcccccagggccagatgggcccccagggcccccccctgcaccagggcggcggcggcccccagggcttcatgggcccccagggcccccagggccccccccagggcctgccccggccccaggacatgcacggcccccagggcatgcagaggcaccctggcccccacggccccctgggcccccagggccccccaggcccccagggcagcagcggcccccagggccacatgggcccccagggccccccaggcccccagggccacatcggcccccagggccccccaggcccccagggccacctgggcccccagggccccccaggcacccagggcatgcagggccccccaggcccccggggcatgcagggccccccccacccccacggcatccagggcggccctggcagccagggcatccagggccctgtgtcccagggccccctgatgggcctgaacccccggggcatgcagggccccccaggcccccgggagaaccagggccctgccccccagggcatgatcatgggccaccccccccaggagatgaggggcccccaccccccaggcggcctgctgggccacggcccccaggagatgaggggcccccaggagatccggggcatgcagggccccccaccccagggctccatgctgggccccccccaggagctgcggggccccccaggcagccagagccagcagggccccccccagggcagcctgggccccccaccccagggcggcatgcagggccccccaggcccccagggccagcagaacccagcccggggcccccaccccagccagggccccatccccttccagcagcagaagacccccctgctgggagatggcccccgggcccccttcaaccaggagggccagagcactggacctccacccctcatccctggcctgggccagcagggcgcccagggccgcatcccccccctgaaccctggccagggccctggccccaacaagggggacagccggggcccccccaaccaccacatgggccccatgtctgaaagaagacatgagcagagcggcggccctgagcacggccctgagcggggccccttccggggcggccaggactgccggggccccccagaccggcggggcccccacccagacttcccagatgacttcagcaggccagatgacttccacccagacaagagatttggccaccggctgcgggagtttgagggccggggcggccccctgccccaggaggagaagtggaggcggggcggccctggcccccccttccccccagaccaccgggagttctctgaaggagatggaagaggagctgcccggggccccccaggggcctgggagggccggcggcctggagatgagcgcttcccccgggaccctgaggacccccgcttccggggcagaagagaggagagcttcagaagaggagccccacccaggcatgagggccgggccccaccccggggcagagatggcttccctggccctgaggactttggacctgaggagaactttgatgccagcgaggaggccgcccggggccgggacctgcggggccggggccggggcaccccccggggcggcaggaagggcctgctgcccaccccagatgagttccccaggtttgaaggaggcaggaagccagacagctgggatggcaaccgggagcccggccctggccacgagcacttccgggacacccccaggccagaccacccccctcatgatggccacagccctgccagccgggagaggagcagcagcctgcagggcatggacatggccagcctgccccccaggaagaggccctggcatgatggccctggcaccagcgagcaccgggagatggaggcccctgggggccccagtgaagatcggggcggcaagggccggggcggccctggccctgcccagagggtgcccaagagcggccgcagcagcagcctggatggagagcaccatgatggctaccacagagatgagccctttggaggccccccaggcagcggcacccccagccggggcggccgcagcggcagcaactggggccggggcagcaacatgaacagcggccccccaagaagaggagccagcagaggaggcggccggggccgctag

SEQ ID NO: 43560 - DNA, 774 bp, Artificial Sequence
  Description of Artificial Sequence: Synthetic coding sequence
atggccacagaaattggcagccccccacgcttcttccacatgccccgcttccagcaccaggccccccggcagctgttctacaagaggccagactttgcccagcagcaggccatgcagcagctgacctttgatggcaagaggatgaggaaggctgtgaacaggaagaccatcgactacaaccccagcgtcatcaagtacctggagaaccgcatctggcagagggaccagagggacatgagggccatccagccagatgctggctactacaatgacctggtgccccccatcggcatgctgaacaaccccatgaatgctgtgaccaccaagtttgtgaggaccagcaccaacaaggtgaagtgccctgtgtttgtggtgcgctggaccccagagggccggcggctggtgactggagccagcagcggggagttcaccctgtggaatggcctgaccttcaactttgagaccatcctgcaggcccatgacagccctgtgcgggccatgacctggagccacaatgacatgtggatgctgacagctgaccatggaggctacgtgaagtactggcagagcaacatgaacaacgtgaagatgttccaggcccacaaggaggccatccgggaggccagcttcagccccacagacaacaagtttgccacctgcagtgatgatggcaccgtgcgcatctgggacttcctgcgctgccacgaggagcgcatcctgcgggacacctgcttccaccactgccgctgctacttcctgtctgtgaagaggtag

SEQ ID NO: 43561 - DNA, 357 bp, Artificial Sequence
  Description of Artificial Sequence: Synthetic coding sequence
atggccacagaaattggcagccccccacgcttcttccacatgccccgcttccagcaccaggccccccggcagctgttctacaagaggccagactttgcccagcagcaggccatgcagcagctgacctttgatggcaagaggatgaggaaggctgtgaacaggaagaccatcgactacaaccccagcgtcatcaagtacctggagaaccgcatctggcagagggaccagagggacatgagggccatccagccagatgctggctactacaatgacctggtgccccccatcggcatgctgaacaaccccatgaatgctgtgaccaccaagtttgtgaggaccagcaccaacaaggtgtag

SEQ ID NO: 43562 - DNA, 981 bp, Artificial Sequence
  Description of Artificial Sequence: Synthetic coding sequence
atggccacagaaattggcagccccccacgcttcttccacatgccccgcttccagcaccaggccccccggcagctgttctacaagaggccagactttgcccagcagcaggccatgcagcagctgacctttgatggcaagaggatgaggaaggctgtgaacaggaagaccatcgactacaaccccagcgtcatcaagtacctggagaaccgcatctggcagagggaccagagggacatgagggccatccagccagatgctggctactacaatgacctggtgccccccatcggcatgctgaacaaccccatgaatgctgtgaccaccaagtttgtgaggaccagcaccaacaaggtgaagtgccctgtgtttgtggtgcgctggaccccagagggccggcggctggtgactggagccagcagcggggagttcaccctgtggaatggcctgaccttcaactttgagaccatcctgcaggcccatgacagccctgtgcgggccatgacctggagccacaatgacatgtggatgctgacagctgaccatggaggctacgtgaagtactggcagagcaacatgaacaacgtgaagatgttccaggcccacaaggaggccatccgggaggcccgcttcatccacaacatccccttctctgtggtgcccatcgtgatggtgaagctgttcagcaagtgcatcctgggcgctgagatgcacggcctgtgccagttcctgggcaacttcctgcaccccatcaacaccatcttcttctttgtgttcacccacagccccttctgctggcacctgtctgaggtggtgctgagccgctaccagcccctgcagtatgtgagagatgtgctgtctgctgccttctgcaccggcttcctgttctccttcatgatcaacaacgtgtacaccctcttcctgttcatcatctactgtgtgcggcaggagtacttcatccccaacaaggagttcagcctgtag

SEQ ID NO: 43563 - DNA, 1485 bp, Artificial Sequence
  Description of Artificial Sequence: Synthetic coding sequence
atgcccacagaaagtgccagctgcagcacagcccggcagaccaagcagaagaggaagagccacagcctgagcatccggaggaccaacagcagcgagcaggagaggacaggcctgccccgggacatgctggagggccaggacagcaagctgcccagctctgtgcgcagcaccctgctggagctgtttggccagatcgagcgggagtttgagaacctgtacatcgagaacctggagctgcggcgggagattgacaccctgaatgaaaggctggccgctgagggccaggccattgatggagctgagctgagcaagggccagctgaagaccaaggccagccacagcaccagccagctgagccagaagctgaagaccacctacaaggccagcaccagcaagatcgtgagcagcttcaagaccaccaccagccgggccgcctgccagctggtgaaggagtacatcggccacagagatggcatctgggatgtgtctgtggccaagacccagcctgtggtgctgggcacagccagcgctgaccacacagccctgctgtggagcattgagaccgggaagtgcctggtgaagtatgccggccacgtgggctctgtgaacagcatcaagttccaccccagcgagcagctggccctgacagccagcggggaccagacagcccacatctggaggtatgctgtgcagctgcccaccccccagcctgtggccgacaccagcatcagcggggaggatgaggtggagtgcagcgacaaggatgagccagacctggatggagatgtgtccagtgactgccccaccatccgggtgcccctgaccagcctgaagagccaccagggcgtggtgattgccagtgactggctggtgggcggcaagcaggccgtgacagcctcctgggacagaacagccaacctgtatgatgtggagaccagcgagctggtgcacagcctgaccggccatgaccaggagctgacccactgctgcacccaccccacccagaggctggtggtgaccagcagccgggacaccaccttccggctgtgggacttccgggaccccagcatccacagcgtgaatgtgttccagggccacacagacacagtgaccagcgctgtgttcaccgtgggggacaacgtggtgtctggcagtgatgacagaacagtgaaggtgtgggacctgaagaacatgaggagccccatcgccaccatcagaacagattctgccatcaaccgcatcaacgtgtgtgtgggccagaagatcatcgccctgccccatgacaaccggcaggtgcggctgtttgacatgtctggagtgcggctggcccggctgcccaggagcagccggcagggccacaggaggatggtgtgctgcagcgcctggagcgaggaccaccctgtgtgcaacctcttcacctgtggctttgaccggcaggccatcggctggaacatcaacatcccagccctgctgcaggagaagtag

SEQ ID NO: 43564 - DNA, 1485 bp, Artificial Sequence; identical to SEQ ID NO: 43563
  Description of Artificial Sequence: Synthetic coding sequence

SEQ ID NO: 43565 - DNA, 750 bp, Artificial Sequence
  Description of Artificial Sequence: Synthetic coding sequence
atgcccacagaaagtgccagctgcagcacagcccggcagaccaagcagaagaggaagagccacagcctgagcatccggaggaccaacagcagcgagcaggagaggacaggcctgccccgggacatgctggagggccaggacagcaagctgcccagctctgtgcgcagcaccctgctggagctgtttggccagatcgagcgggagtttgagaacctgtacatcgagaacctggagctgcggcgggagattgacaccctgaatgaaaggctggccgctgagggccaggccattgatggagctgagctgagcaagggccagctgaagaccaaggccagccacagcaccagccagctgagccagaagctgaagaccacctacaaggccagcaccagcaagatcgtgagcagcttcaagaccaccaccagccgggccgcctgccagctggtgaaggagtacatcggccacagagatggcatctgggatgtgtctgtggccaagacccagcctgtggtgctgggcacagccagcgctgaccacacagccctgctgtggagcattgagaccgggaagtgcctggtgaagtatgccggccacgtgggctctgtgaacagcatcaagttccaccccagcgagcagctggccctgacagccagcggggaccagacagcccacatctggaggtatgctgtgcagctgcccaccccccagcctgtggccgacacctctgtgtccaccttcccctacctgtag

SEQ ID NO: 43566 - DNA, 630 bp, Artificial Sequence
  Description of Artificial Sequence: Synthetic coding sequence
atgagcagtgacagcgagtgggacagaagtgcctgcagcgacagcaagctgcccagctctgtgcgcagcaccctgctggagctgtttggccagatcgagcgggagtttgaaaatctctacatcgagaacctggagctgcggcgggagattgacaccctgaatgaaaggctggccgctgagggccaggccattgatggagctgagctgagcaagggccagctgaagaccaaggccagccacagcaccagccagctgagccagaagctgaagaccacctacaaggccagcaccagcaagatcgtgtcctccttcaagaccaccaccagcagagctgcctgccagctggtgaaggagtacatcggccacagagatggcatctgggatgtgtctgtggccaagacccagcctgtggtgctgggcacagccagcgctgaccacacagccctgctgtggagcattgaaacaggcaagtgcctggtgaagtatgccggccacgtgggctctgtgaacagcatcaagttccaccccagcgagcagctggccctgacagccagcggggaccagacagcccacatctggaggtatgctgtgcagctgcccaccccccagcctgtggccgacaccagctag

SEQ ID NO: 43567 - DNA, 945 bp, Artificial Sequence
  Description of Artificial Sequence: Synthetic coding sequence
atgaacagcggcgtgcctgccaccctggccgtgcggcgggtgaagttcttcggccagcacggcggggaggtgaacagcagcgccttctccccagatggccagatgctgctgaccggctctgaagatggctgtgtgtatggctgggagaccaggagcggccagctgctgtggaggctgggcggccacactggacctgtgaagttctgccgcttctccccagatggccacctgtttgccagcgccagctgtgactgcaccgtgcggctgtgggatgtggcccgggccaagtgcctgcgggtgctgaagggccaccagaggtctgtggagaccgtgtccttctccccagacagccggcagctggccagcggcggctgggacaagagggtgatgctgtgggatgtgcagagcggccagatgctgcggctgctggtgggccaccgggacagcatccagagcagtgacttcagccccaccgtgaactgcctggccaccggctcctgggacagcacagtgcacatctgggacctgaggatggtgaccccagctgtgagccaccaggccctggagggccacagcgccaacatcagctgcctgtgctacagcgccagcggcctgctggccagcggctcctgggacaagaccatccacatctggaagcccaccaccagcagcctgctgatccagctgaagggccacgtgacctgggtgaagagcatcgccttctccccagatgagctgtggctggccagcgctggctacagcaggatggtgaaggtgtgggactgcaacacaggcaagtgcctggagaccctgaagggcgtgctggatgtggcccacacctgtgccttcaccccagatggcaagatcctggtgtctggagctgctgaccagacccggcggcagatcagcaggaccagcaagagcccccgggacccccagacctag

SEQ ID NO: 43568 - DNA, 1380 bp, Artificial Sequence
  Description of Artificial Sequence: Synthetic coding sequence
atgctgcgctggctgattggaggcggccgggagccccagggcctggccgagaagagccccctgcagaccatcggggaggagcagacccagaacccctacacagagctgctggtgctgaaggcccaccacgacatcgtgcgcttcctggtgcagctggatgactacagatttgccagcgctggagatgatggcatcgtggtggtgtggaatgcccagacaggagagaagctgctggagctgaatggccacacccagaagatcacagccatcatcaccttccccagcctggagagctgtgaggagaagaaccagctgatcctgacagccagcgctgacagaactgtcatcgtgtgggatggagacaccacccggcaggtgcagaggatcagctgcttccagagcacagtgaagtgcctgactgtgctgcagaggctggatgtgtggctgagcggcggcaatgacctgtgtgtgtggaacaggaagctggacctgctgtgcaagaccagccacctgagtgacaccggcatcagcgccctggtggagatccccaagaactgtgtggtggccgctgtgggcaaggagctgatcatcttccggctggtggcccccacagagggcagcctggagtgggacatcctggaggtgaagaggctgctggaccaccaggacaacatcctgagcctcatcaacgtgaatgacctgagctttgtgacaggcagccacgtgggggagctgatcatctgggatgccctggactggaccatgcaggcctatgaaagaaacttctgggaccccagcccccagctggacacccagcaggagatcaagctgtgccagaagagcaatgacatcagcatccaccacttcacctgtgatgaggagaatgtgtttgctgctgtgggccggggcctgtatgtgtacagcctgcagatgaagagggtgattgcctgccagaagacagcccatgacagcaatgtgctgcacgtggcccggctgcccaaccggcagctgatcagctgcagtgaagatggctctgtgcgcatctgggagctgcgggagaagcagcagctggccgctgagcctgtgcccaccggcttcttcaacatgtggggcttcggccgggtgtccaagcaggccagccagcctgtgaagaagcagcaggagaatgccaccagctgcagcctggagctgattggagacctgattggccacagcagctctgtggagatgttcctgtactttgaagatcatggcctggtgacctgcagcgctgaccacctgatcatcctgtggaagaatggagagcgggagagcggcctgcggagcctgcggctcttccagaagctggaggagaatggagacctgtacctggccgtgtag

SEQ ID NO: 43569 - DNA, 618 bp, Artificial Sequence
  Description of Artificial Sequence: Synthetic coding sequence
atgcaggcctatgaaagaaacttctgggaccccagcccccagctggacacccagcaggagatcaagctgtgccagaagagcaatgacatcagcatccaccacttcacctgtgatgaggagaatgtgtttgctgctgtgggccggggcctgtatgtgtacagcctgcagatgaagagggtgattgcctgccagaagacagcccatgacagcaatgtgctgcacgtggcccggctgcccaaccggcagctgatcagctgcagtgaagatggctctgtgcgcatctgggagctgcgggagaagcagcagctggccgctgagcctgtgcccaccggcttcttcaacatgtggggcttcggccgggtgtccaagcaggccagccagcctgtgaagaagcagcaggagaatgccaccagctgcagcctggagctgattggagacctgattggccacagcagctctgtggagatgttcctgtactttgaagatcatggcctggtgacctgcagcgctgaccacctgatcatcctgtggaagaatggagagcgggagagcggcctgcggagcctgcggctcttccagaagctggaggagaatggagacctgtacctggccgtgtag

SEQ ID NO: 43570 - DNA, 1086 bp, Artificial Sequence
  Description of Artificial Sequence: Synthetic coding sequence
atgacccagcagcccctgcggggcgtgaccagcctgcgcttcaaccaggaccagagctgcttctgctgtgccatggagactggagtgcgcatctacaacgtggagcccctgatggagaagggccacctggaccacgagcaggtgggctccatgggcctggtggagatgctgcacaggagcaacctgctggccctggtgggcggcggcagcagccccaagttcagcgagatctctgctgtgctgatctgggatgatgcccgggagggcaaggacagcaaggagaagctggtgctggagttcaccttcaccaagcctgtgctgtctgtgaggatgagacatgacaagatcgtcatcgtgctgaagaaccgcatctacgtgtacagcttcccagacaaccccaggaagctgtttgaatttgacacccgggacaaccccaagggcctgtgtgacctgtgccccagcctggagaagcagctgctggtgtttcctggccacaagtgtggcagcctgcagctggtggacctggccagcaccaagccaggcaccagcagcgcccccttcaccatcaatgcccaccagagcgacatcgcctgtgtgtccctgaaccagcccggcaccgtggtggccagcgccagccagaagggcaccctcatccggctgtttgacacccagagcaaggagaagctggtggagctgcggcggggcacagatcctgccaccctgtactgcatcaacttcagccatgacagcagcttcctgtgtgccagcagtgacaagggcaccgtgcacatctttgccctgaaggacacccggctgaacagaagaagtgccctggcccgggtgggcaaggtgggccccatgattggccagtatgtggacagccagtggagcctggccagcttcaccgtgcctgctgagagcgcctgcatctgtgcctttggaagaaacaccagcaagaatgtgaacagcgtgattgccatctgtgtggatggcaccttccacaagtatgtgttcaccccagatggcaactgcaaccgggaggcctttgatgtgtacctggacatctgtgatgatgatgacttctag

SEQ ID NO: 43571 - DNA, 1833 bp, Artificial Sequence
  Description of Artificial Sequence: Synthetic coding sequence
atggagacagcccccaagccaggcaaggatgtgccccccaagaaggacaagctgcagaccaagaggaagaagccccggcgctactgggaggaggagaccgtgcccaccacagctggggccagccctggcccccccaggaacaagaagaaccgggagctgcggccccagaggcccaagaatgcctacatcctgaagaagagccgcatcagcaagaagccccaggtgcccaagaagccccgggagtggaagaaccctgagagccagaggggcctgagcggcacccaggaccccttccctggccctgcccctgtgcctgtggaggtggtgcagaagttctgcagaattgacaagagcaggaagctgccccacagcaaggccaagaccaggagccggctggaggtggccgaggccgaggaggaggagaccagcatcaaggccgcccggtctgagctgctgctggccgaggagcccggcttcctggagggagaagatggagaggacacagccaagatctgccaggccgacatcgtggaggccgtggacatcgccagcgctgccaagcactttgacctgaacctgcggcagtttggcccctaccgcctgaactacagcaggacaggccgccacctggccttcggcggcagaagaggccacgtggccgccctggactgggtgaccaagaagctgatgtgtgagatcaacgtgatggaggccgtgcgggacatccgcttcctgcacagcgaggccctgctggccgtggcccagaaccgctggctgcacatctatgacaaccagggcatcgagctgcactgcatcagaagatgtgacagagtgacccggctggagttcctgcccttccacttcctgctggccacagccagcgagaccggcttcctgacctacctggatgtgtctgtgggcaagatcgtggccgccctgaatgcccgggccggccgcctggatgtgatgagccagaacccctacaatgctgtgatccacctgggccacagcaatggcaccgtgtccctgtggagccctgccatgaaggagcccctggccaagatcctgtgccaccggggcggcgtgcgggctgtggccgtggacagcacaggcacctacatggccaccagcggcctggaccaccagctgaagatctttgacctgcggggcacctaccagcccctgagcaccaggaccctgccccacggggccggccacctggccttcagccagaggggcctgctggtggccggcatgggagatgtggtgaacatctgggccggccagggcaaggccagcccccccagcctggagcagccctacctgacccaccggctgagcggccctgtgcacggcctgcagttctgcccctttgaagatgtgctgggcgtgggccacactggaggcatcacctccatgctggtgcctggggccggggagcccaactttgatggcctggagagcaacccctaccgcagcaggaagcagaggcaggagtgggaggtgaaggccctgctggagaaggtgcctgctgagctgatctgcctggacccccgggccctggccgaggtggatgtgatcagcctggagcagggcaagaaggagcagatcgagcggctgggctatgacccccaggccaaggcccccttccagcccaagcccaagcagaagggccgcagcagcacagccagcctggtgaagaggaagaggaaggtgatggatgaggagcaccgggacaaggtgcggcagagcctgcagcagcagcaccacaaggaggccaaggccaagcccaccggggcccggcccagcgccctggacagatttgtgaggtag

SEQ ID NO: 43572 - DNA, 1833 bp, Artificial Sequence
  Description of Artificial Sequence: Synthetic coding sequence
atggagacagcccccaagccaggcaaggatgtgccccccaagaaggacaagctgcagaccaagaggaagaagccccggcgctactgggaggaggagaccgtgcccaccacagctggggccagccctggcccccccaggaacaagaagaaccgggagctgcggccccagaggcccaagaatgcctacatcctgaagaagagccgcatcagcaagaagccccaggtgcccaagaagccccgggagtggaagaaccctgagagccagaggggcctgagcggggcccaggaccccttccctggccctgcccctgtgcctgtggaggtggtgcagaagttctgcagaattgacaagagcaggaagctgccccacagcaaggccaagaccaggagccggctggaggtggccgaggccgaggaggaggagaccagcatcaaggccgcccggtctgagctgctgctggccgaggagcccggcttcctggagggagaagatggagaggacacagccaagatctgccaggccgacatcgtggaggccgtggacatcgccagcgctgccaagcactttgacctgaacctgcggcagtttggcccctaccgcctgaactacagcaggacaggccgccacctggccttcggcggcagaagaggccacgtggccgccctggactgggtgaccaagaagctgatgtgtgagatcaacgtgatggaggccgtgcgggacatccgcttcctgcacagcgaggccctgctggccgtggcccagaaccgctggctgcacatctatgacaaccagggcatcgagctgcactgcatcagaagatgtgacagagtgacccggctggagttcctgcccttccacttcctgctggccacagccagcgagaccggcttcctgacctacctggatgtgtctgtgggcaagatcgtggccgccctgaatgcccgggccggccgcctggatgtgatgagccagaacccctacaatgctgtgatccacctgggccacagcaatggaacagccagcctgtggagccctgccatgaaggagcccctggccaagatcctgtgccaccggggcggcgtgcgggctgtggccgtggacagcacaggcacctacatggccaccagcggcctggaccaccagctgaagatctttgacctgcggggcacctaccagcccctgagcaccaggaccctgccccacggggccggccacctggccttcagccagaggggcctgctggtggccggcatgggagatgtggtgaacatctgggccggccagggcaaggccagcccccccagcctggagcagccctacctgacccaccggctgagcggccctgtgcacggcctgcagttctgcccctttgaagatgtgctgggcgtgggccacactggaggcatcacctccatgctggtgcctggggccggggagcccaactttgatggcctggagagcaacccctaccgcagcaggaagcagaggcaggagtgggaggtgaaggccctgctggagaaggtgcctgctgagctgatctgcctggacccccgggccctggccgaggtggatgtgatcagcctggagcagggcaagaaggagcagatcgagcggctgggctatgacccccaggccaaggcccccttccagcccaagcccaagcagaagggccgcagcagcacagccagcctggtgaagaggaagaggaaggtgatggatgaggagcaccgggacaaggtgcggcagagcctgcagcagcagcaccacaaggaggccaaggccaagcccaccggggcccggcccagcgccctggacagatttgtgaggtag

SEQ ID NO: 43573 - DNA, 969 bp, Artificial Sequence
  Description of Artificial Sequence: Synthetic coding sequence
aagagccgcatcagcaagaagccccaggtgcccaagaagccccgggagtggaagaaccctgagagccagaggggcctgagcggggcccaggaccccttccctggccctgcccctgtgcctgtggaggtggtgcagaagttctgcagaattgacaagagcaggaagctgccccacagcaaggccaagaccaggagccggctggaggtggccgaggccgaggaggaggagaccagcatcaaggccgcccggtctgagctgctgctggccgaggagcccggcttcctggagggggaggatggagaggacacagccaagatctgccaggccgacatcgtggaggccgtggacatcgccagcgctgccaagtttggcccctaccgcctgaactacagcaggacaggccgccacctggcctttggaggccggcggggccacgtggccgccctggactgggtgaccaagaagctgatgtgtgagatcaacgtgatggaggccgtgcgggacatccgcttcctgcacagcgaggccctgctggccgtggcccagaaccgctggctgcacatctatgacaaccagggcatcgagctgcactgcatccgccgctgtgacagagtgacccggctggagttcctgcccttccacttcctgctggccacagccagcgagaccggcttcctgacctacctggatgtgtctgtgggcaagatcgtggccgccctgaatgcccgggccggccgcctggatgtgatgagccagaacccctacaatgctgtgatccacctgggccacagcaatggaacagccagcctgtggagccctgccatgaaggagcccctggccaagatcctgtgccacagaggaggagtgcgggctgtggccgtggacagcacaggcacctacatggccaccagcggcctggaccaccagctgaagatctttgacctgcggggcacctaccagcccctgtag

SEQ ID NO: 43574 - DNA, 1833 bp, Artificial Sequence
  Description of Artificial Sequence: Synthetic coding sequence
atggagacagcccccaagccaggcaaggatgtgccccccaagaaggacaagctgcagaccaagaggaagaagccccggcgctactgggaggaggagaccgtgcccaccacagctggggccagccctggcccccccaggaacaagaagaaccgggagctgcggccccagaggcccaagaatgcctacatcctgaagaagagccgcatcagcaagaagccccaggtgcccaagaagccccgggagtggaagaaccctgagagccagaggggcctgagcggggcccaggaccccttccctggccctgcccctgtgcctgtggaggtggtgcagaagttctgcagaattgacaagagcaggaagctgccccacagcaaggccaagaccaggagccggctggaggtggccgaggccgaggaggaggagaccagcatcaaggccgcccggtctgagctgctgctggccgaggagcccggcttcctggagggagaagatggagaggacacagccaagatctgccaggccgacatcgtggaggccgtggacatcgccagcgctgccaagcactttgacctgaacctgcggcagtttggcccctaccgcctgaactacagcaggacaggccgccacctggccttcggcggcagaagaggccacgtggccgccctggactgggtgaccaagaagctgatgtgtgagatcaacgtgatggaggccgtgcgggacatccgcttcctgcacagcgaggccctgctggccgtggcccagaaccgctggctgcacatctatgacaaccagggcatcgagctgcactgcatcagaagatgtgacagagtgacccggctggagttcctgcccttccacttcctgctggccacagccagcgagaccggcttcctgacctacctggatgtgtctgtgggcaagatcgtggccgccctgaatgcccgggccggccgcctggatgtgatgagccagaacccctacaatgctgtgatccacctgggccacagcaatggcaccgtgtccctgtggagccctgccatgaaggagcccctggccaagatcctgtgccaccggggcggcgtgcgggctgtggccgtggacagcacaggcacctacatggccaccagcggcctggaccaccagctgaagatctttgacctgcggggcacctaccagcccctgagcaccaggaccctgccccacggggccggccacctggccttcagccagaggggcctgctggtggccggcatgggagatgtggtgaacatctgggccggccagggcaaggccagcccccccagcctggagcagccctacctgacccaccggctgagcggccctgtgcacggcctgcagttctgcccctttgaagatgtgctgggcgtgggccacactggaggcatcacctccatgctggtgcctggggccggggagcccaactttgatggcctggagagcaacccctaccgcagcaggaagcagaggcaggagtgggaggtgaaggccctgctggagaaggtgcctgctgagctgatctgcctggacccccgggccctggccgaggtggatgtgatcagcctggagcagggcaagaaggagcagatcgagcggctgggctatgacccccaggccaaggcccccttccagcccaagcccaagcagaagggccgcagcagcacagccagcctggtgaagaggaagaggaaggtgatggatgaggagcaccgggacaaggtgcggcagagcctgcagcagcagcaccacaaggaggccaaggccaagcccaccggggcccggcccagcgccctggacagatttgtgaggtag

SEQ ID NO: 43575 - DNA, 1833 bp, Artificial Sequence; identical to SEQ ID NO: 43574
  Description of Artificial Sequence: Synthetic coding sequence

SEQ ID NO: 43576 - DNA, 969 bp, Artificial Sequence
  Description of Artificial Sequence: Synthetic coding sequence
aagagccgcatcagcaagaagccccaggtgcccaagaagccccgggagtggaagaaccctgagagccagaggggcctgagcggggcccaggaccccttccctggccctgcccctgtgcctgtggaggtggtgcagaagttctgcagaattgacaagagcaggaagctgccccacagcaaggccaagaccaggagccggctggaggtggccgaggccgaggaggaggagaccagcatcaaggccgcccggtctgagctgctgctggccgaggagcccggcttcctggagggggaggatggagaggacacagccaagatctgccaggccgacatcgtggaggccgtggacatcgccagcgctgccaagtttggcccctaccgcctgaactacagcaggacaggccgccacctggcctttggaggccggcggggccacgtggccgccctggactgggtgaccaagaagctgatgtgtgagatcaacgtgatggaggccgtgcgggacatccgcttcctgcacagcgaggccctgctggccgtggcccagaaccgctggctgcacatctatgacaaccagggcatcgagctgcactgcatccgccgctgtgacagagtgacccggctggagttcctgcccttccacttcctgctggccacagccagcgagaccggcttcctgacctacctggatgtgtctgtgggcaagatcgtggccgccctgaatgcccgggccggccgcctggatgtgatgagccagaacccctacaatgctgtgatccacctgggccacagcaatggaacagtgtccctgtggagccctgccatgaaggagcccctggccaagatcctgtgccacagaggaggagtgcgggctgtggccgtggacagcacaggcacctacatggccaccagcggcctggaccaccagctgaagatctttgacctgcggggcacctaccagcccctgtag

SEQ ID NO: 43577 - DNA, 969 bp, Artificial Sequence
  Description of Artificial Sequence: Synthetic coding sequence
aagagccgcatcagcaagaagccccaggtgcccaagaagccccgggagtggaagaaccctgagagccagaggggcctgagcggcacccaggaccccttccctggccctgcccctgtgcctgtggaggtggtgcagaagttctgcagaattgacaagagcaggaagctgccccacagcaaggccaagaccaggagccggctggaggtggccgaggccgaggaggaggagaccagcatcaaggccgcccggtctgagctgctgctggccgaggagcccggcttcctggagggggaggatggagaggacacagccaagatctgccaggccgacatcgtggaggccgtggacatcgccagcgctgccaagtttggcccctaccgcctgaactacagcaggacaggccgccacctggcctttggaggccggcggggccacgtggccgccctggactgggtgaccaagaagctgatgtgtgagatcaacgtgatggaggccgtgcgggacatccgcttcctgcacagcgaggccctgctggccgtggcccagaaccgctggctgcacatctatgacaaccagggcatcgagctgcactgcatccgccgctgtgacagagtgacccggctggagttcctgcccttccacttcctgctggccacagccagcgagaccggcttcctgacctacctggatgtgtctgtgggcaagatcgtggccgccctgaatgcccgggccggccgcctggatgtgatgagccagaacccctacaatgctgtgatccacctgggccacagcaatggaacagtgtccctgtggagccctgccatgaaggagcccctggccaagatcctgtgccacagaggaggagtgcgggctgtggccgtggacagcacaggcacctacatggccaccagcggcctggaccaccagctgaagatctttgacctgcggggcacctaccagcccctgtag

SEQ ID NO: 43578 - DNA, 969 bp, Artificial Sequence; identical to SEQ ID NO: 43576
  Description of Artificial Sequence: Synthetic coding sequence

SEQ ID NO: 43579 - DNA, 969 bp, Artificial Sequence; identical to SEQ ID NO: 43576
  Description of Artificial Sequence: Synthetic coding sequence

SEQ ID NO: 43580 - DNA, 1833 bp, Artificial Sequence; identical to SEQ ID NO: 43574
  Description of Artificial Sequence: Synthetic coding sequence

SEQ ID NO: 43581 - DNA, 2676 bp, Artificial Sequence
  Description of Artificial Sequence: Synthetic coding sequence
atgacagctgaggagaccgtgaatgtgaaggaggtggagatcatcaagctgatcctggacttcctgaacagcaagaagctgcacatctccatgctggccctggagaaggagagcggggtcatcaatggcctcttcagtgatgacatgctgttcctgcgcttccgctacatcatcctgaagcagaagttcctggaggccctgtgtgtgaacaatgccatgtctgcagaagatgagccccagcacctggagttcaccatgcaggaggccgtgcagtgcctgcacgccctggaggagtactgccccagcaaggatgactacagcaagctgtgcctgctgctgaccctgccccggctgaccaaccacgccgagttcaaggactggaaccccagcacagcccgggtgcactgctttgaggaggcctgtgtgatggtggccgagttcatcccagctgacaggaagctgtctgaggccggcttcaaggccagcaacaacagactcttccagctggtgatgaagggcctgctgtatgagtgctgcgtggagttctgccagagcaaggccaccggggaggagatcacagaaagtgaggtgctgctgggcatcgacctgctgtgtggaaatggctgtgatgacctggacctgagcctgctgtcctggctgcagaacctgcccagcagcgtcttcagctgtgcctttgagcagaagatgctgaacatccacgtggacaagctgctgaagcccaccaaggccgcctatgctgacctgctgacccccctcatcagcaagctgagcccctaccccagcagccccatgaggcggccccagagcgcagatgcctacatgaccaggagcctgaacccagccctggatggcctgacctgtggcctgaccagccatgacaagaggatcagtgacctgggcaacaagaccagccccatgagccacagctttgccaacttccactacccaggagtgcagaacctgagccgcagcctgatgctggagaacacagagtgccacagcatctatgaggagagccctgagcgggacacccctgtggatgcccagaggcccatcggcagcgagatcctgggccagagctctgtgtctgagaaggagcccgccaacggggcccagaaccctggccctgccaagcaggagaagaatgagctgcgggacagcacagagcagttccaggagtactaccggcagaggctgcgctaccagcagcacctggagcagaaggagcagcagaggcagatctaccagcagatgctgctggagggcggcgtgaaccaggaggatggccctgaccagcagcagaacctgacagagcagttcctgaacagaagcatccagaagctgggggagctgaacatcggcatggatggcctgggcaatgaggtgtctgccctgaaccagcagtgcaatggcagcaaaggaaatggcagcaatggcagctctgtgaccagcttcaccaccccaccccaggacagcagccagaggctgacccatgatgccagcaacatccacaccagcacccccaggaaccctggcagcaccaaccacatccccttcctggaggagagcccctgtggcagccagatcagcagcgagcacagcgtcatcaagccacccctgggggacagccctggcagcctgagccgcagcaagggggaggaggatgacaagagcaagaagcagtttgtgtgcatcaacatcctggaggacacccaggccgtgcgggctgtggccttccaccctgctgggggcctgtatgctgtgggcagcaacagcaagaccctgcgggtgtgtgcctacccagatgtgattgaccccagcgcccacgagacccccaagcagcctgtggtgcgcttcaagaggaacaagcaccacaagggcagcatctactgtgtggcctggagcccctgtggccagctgctggccaccggcagcaatgacaagtatgtgaaggtgctgcccttcaatgctgagacctgcaatgccaccggccctgacctggagttctccatgcatgatggcaccatccgggacctggccttcatggagggccctgagagcggcggggccatcctgatctctgctggggccggggactgcaacatctacaccacagactgccagaggggccagggcctgcacgccctgagcggccacacaggccacatcctggccctgtacacctggagcggctggatgattgccagcggcagccaggacaagacagtgcgcttctgggacctgcgggtgcccagctgtgtgcgggtggtgggcaccaccttccatggaactggatctgctgtggcctctgtggccgtggaccccagcggccgcctgctggccaccggccaggaggacagcagctgcatgctgtatgacatccggggcggccgcatggtgcagagctaccacccccacagcagtgatgtgcgctctgtgcgcttcagccctggggcccactacctgctgaccggcagctatgacatgaagatcaaggtgacagacctgcagggcgacctgaccaagcagctgcccatcatggtggtgggggagcacaaggacaaggtgatccagtgccgctggcacacccaggacctgtccttcctgagcagcagcgctgacagaacagtgaccctgtggacctacaacggctag

SEQ ID NO: 43582 - DNA, 2676 bp, Artificial Sequence; identical to SEQ ID NO: 43581
  Description of Artificial Sequence: Synthetic coding sequence

SEQ ID NO: 43583 - DNA, 2760 bp, Artificial Sequence
  Description of Artificial Sequence: Synthetic coding sequence
atgacagctgaggagaccgtgaatgtgaaggaggtggagatcatcaagctgatcctggacttcctgaacagcaagaagctgcacatctccatgctggccctggagaaggagagcggggtcatcaatggcctcttcagtgatgacatgctgttcctgcggcagctgatcctggatggccagtgggatgaggtgctgcagttcatccagcccctggagtgcatggagaagtttgacaagaagcgcttccgctacatcatcctgaagcagaagttcctggaggccctgtgtgtgaacaatgccatgtctgcagaagatgagccccagcacctggagttcaccatgcaggaggccgtgcagtgcctgcacgccctggaggagtactgccccagcaaggatgactacagcaagctgtgcctgctgctgaccctgccccggctgaccaaccacgccgagttcaaggactggaaccccagcacagcccgggtgcactgctttgaggaggcctgtgtgatggtggccgagttcatcccagctgacaggaagctgtctgaggccggcttcaaggccagcaacaacagactcttccagctggtgatgaagggcctgctgtatgagtgctgcgtggagttctgccagagcaaggccaccggggaggagatcacagaaagtgaggtgctgctgggcatcgacctgctgtgtggaaatggctgtgatgacctggacctgagcctgctgtcctggctgcagaacctgcccagcagcgtcttcagctgtgcctttgagcagaagatgctgaacatccacgtggacaagctgctgaagcccaccaaggccgcctatgctgacctgctgacccccctcatcagcaagctgagcccctaccccagcagccccatgaggcggccccagagcgcagatgcctacatgaccaggagcctgaacccagccctggatggcctgacctgtggcctgaccagccatgacaagaggatcagtgacctgggcaacaagaccagccccatgagccacagctttgccaacttccactacccaggagtgcagaacctgagccgcagcctgatgctggagaacacagagtgccacagcatctatgaggagagccctgagcgggacacccctgtggatgcccagaggcccatcggcagcgagatcctgggccagagctctgtgtctgagaaggagcccgccaacggggcccagaaccctggccctgccaagcaggagaagaatgagctgcgggacagcacagagcagttccaggagtactaccggcagaggctgcgctaccagcagcacctggagcagaaggagcagcagaggcagatctaccagcagatgctgctggagggcggcgtgaaccaggaggatggccctgaccagcagcagaacctgacagagcagttcctgaacagaagcatccagaagctgggggagctgaacatcggcatggatggcctgggcaatgaggtgtctgccctgaaccagcagtgcaatggcagcaaaggaaatggcagcaatggcagctctgtgaccagcttcaccaccccaccccaggacagcagccagaggctgacccatgatgccagcaacatccacaccagcacccccaggaaccctggcagcaccaaccacatccccttcctggaggagagcccctgtggcagccagatcagcagcgagcacagcgtcatcaagccacccctgggggacagccctggcagcctgagccgcagcaagggggaggaggatgacaagagcaagaagcagtttgtgtgcatcaacatcctggaggacacccaggccgtgcgggctgtggccttccaccctgctgggggcctgtatgctgtgggcagcaacagcaagaccctgcgggtgtgtgcctacccagatgtgattgaccccagcgcccacgagacccccaagcagcctgtggtgcgcttcaagaggaacaagcaccacaagggcagcatctactgtgtggcctggagcccctgtggccagctgctggccaccggcagcaatgacaagtatgtgaaggtgctgcccttcaatgctgagacctgcaatgccaccggccctgacctggagttctccatgcatgatggcaccatccgggacctggccttcatggagggccctgagagcggcggggccatcctgatctctgctggggccggggactgcaacatctacaccacagactgccagaggggccagggcctgcacgccctgagcggccacacaggccacatcctggccctgtacacctggagcggctggatgattgccagcggcagccaggacaagacagtgcgcttctgggacctgcgggtgcccagctgtgtgcgggtggtgggcaccaccttccatggaactggatctgctgtggcctctgtggccgtggaccccagcggccgcctgctggccaccggccaggaggacagcagctgcatgctgtatgacatccggggcggccgcatggtgcagagctaccacccccacagcagtgatgtgcgctctgtgcgcttcagccctggggcccactacctgctgaccggcagctatgacatgaagatcaaggtgacagacctgcagggcgacctgaccaagcagctgcccatcatggtggtgggggagcacaaggacaaggtgatccagtgccgctggcacacccaggacctgtccttcctgagcagcagcgctgacagaacagtgaccctgtggacctacaacggctag

SEQ ID NO: 43584 - DNA, 2763 bp, Artificial Sequence
  Description of Artificial Sequence: Synthetic coding sequence
atgacagctgaggagaccgtgaatgtgaaggaggtggagatcatcaagctgatcctggacttcctgaacagcaagaagctgcacatctccatgctggccctggagaaggagagcggggtcatcaatggcctcttcagtgatgacatgctgttcctgcggcagctgatcctggatggccagtgggatgaggtgctgcagttcatccagcccctggagtgcatggagaagtttgacaagaagcgcttccgctacatcatcctgaagcagaagttcctggaggccctgtgtgtgaacaatgccatgtctgcagaagatgagccccagcacctggagttcaccatgcaggaggccgtgcagtgcctgcacgccctggaggagtactgccccagcaaggatgactacagcaagctgtgcctgctgctgaccctgccccggctgaccaaccacgccgagttcaaggactggaaccccagcacagcccgggtgcactgctttgaggaggcctgtgtgatggtggccgagttcatcccagctgacaggaagctgtctgaggccggcttcaaggccagcaacaacagactcttccagctggtgatgaagggcctgctgtatgagtgctgcgtggagttctgccagagcaaggccaccggggaggagatcacagaaagtgaggtgctgctgggcatcgacctgctgtgtggaaatggctgtgatgacctggacctgagcctgctgtcctggctgcagaacctgcccagcagcgtcttcagctgtgcctttgagcagaagatgctgaacatccacgtggacaagctgctgaagcccaccaaggccgcctatgctgacctgctgacccccctcatcagcaagctgagcccctaccccagcagccccatgaggcggccccagagcgcagatgcctacatgaccaggagcctgaacccagccctggatggcctgacctgtggcctgaccagccatgacaagaggatcagtgacctgggcaacaagaccagccccatgagccacagctttgccaacttccactacccaggagtgcagaacctgagccgcagcctgatgctggagaacacagagtgccacagcatctatgaggagagccctgagaggagtgacacccctgtggatgcccagaggcccatcggcagcgagatcctgggccagagctctgtgtctgagaaggagcccgccaatggagcccagaaccctggccctgccaagcaggagaagaatgagctgcgggacagcacagagcagttccaggagtactaccggcagaggctgcgctaccagcagcacctggagcagaaggagcagcagaggcagatctaccagcagatgctgctggagggcggcgtgaaccaggaggatggccctgaccagcagcagaacctgacagagcagttcctgaacagaagcatccagaagctgggggagctgaacatcggcatggatggcctgggcaatgaggtgtctgccctgaaccagcagtgcaatggcagcaaaggaaatggcagcaatggcagctctgtgaccagcttcaccaccccaccccaggacagcagccagaggctgacccatgatgccagcaacatccacaccagcaccccaagaaatcctggcagcaccaaccacatccccttcctggaggagagcccctgtggcagccagatcagcagcgagcacagcgtcatcaagccacccctgggggacagccctggcagcctgagccgcagcaaaggagaggaggatgacaagagcaagaagcagtttgtgtgcatcaacatcctggaggacacccaggccgtgcgggctgtggccttccaccctgctgggggcctgtatgctgtgggcagcaacagcaagaccctgcgggtgtgtgcctacccagatgtgattgaccccagcgcccacgagacccccaagcagcctgtggtgcgcttcaagaggaacaagcaccacaagggcagcatctactgtgtggcctggagcccctgtggccagctgctggccaccggcagcaatgacaagtatgtgaaggtgctgcccttcaatgctgagacctgcaatgccactggaccagacctggagttctccatgcatgatggcaccatccgggacctggccttcatggagggccctgagagcggcggggccatcctgatctctgctggagctggggactgcaacatctacaccacagactgccagaggggccagggcctgcacgccctgagcggccacacaggccacatcctggccctgtacacctggagcggctggatgattgccagcggcagccaggacaagacagtgcgcttctgggacctgcgggtgcccagctgtgtgcgggtggtgggcaccaccttccacggcaccggcagcgctgtggcctctgtggccgtggaccccagcggccgcctgctggccaccggccaggaggacagcagctgcatgctgtatgacatccggggcggccgcatggtgcagagctaccacccccacagcagtgatgtgcgctctgtgcgcttcagccctggggcccactacctgctgaccggcagctatgacatgaagatcaaggtgacagacctgcagggcgacctgaccaagcagctgcccatcatggtggtgggggagcacaaggacaaggtgatccagtgccgctggcacacccaggacctgtccttcctgagcagcagcgctgacagaacagtgaccctgtggacctacaatggatag

SEQ ID NO: 43585 - DNA, 2784 bp, Artificial Sequence
  Description of Artificial Sequence: Synthetic coding sequence
atgacagctgaggagaccgtgaatgtgaaggaggtggagatcatcaagctgatcctggacttcctgaacagcaagaagctgcacatctccatgctggccctggagaaggagagcggggtcatcaatggcctcttcagtgatgacatgctgttcctgcggcagctgatcctggatggccagtgggatgaggtgctgcagttcatccagcccctggagtgcatggagaagtttgacaagaagcgcttccgctacatcatcctgaagcagaagttcctggaggccctgtgtgtgaacaatgccatgtctgcagaagatgagccccagcacgtgcgcttcctgttcctgaagctggagttcaccatgcaggaggccgtgcagtgcctgcacgccctggaggagtactgccccagcaaggatgactacagcaagctgtgcctgctgctgaccctgccccggctgaccaaccacgccgagttcaaggactggaaccccagcacagcccgggtgcactgctttgaggaggcctgtgtgatggtggccgagttcatcccagctgacaggaagctgtctgaggccggcttcaaggccagcaacaacagactcttccagctggtgatgaagggcctgctgtatgagtgctgcgtggagttctgccagagcaaggccactggagaggagatcacagagagcgaggtgctgctgggcatcgacctgctgtgtggaaatggctgtgatgacctggacctgagcctgctgtcctggctgcagaacctgcccagctctgtgttcagctgtgcctttgagcagaagatgctgaacatccacgtggacaagctgctgaagcccaccaaggccgcctatgctgacctgctgacccccctcatcagcaagctgagcccctaccccagcagccccatgagaagaccccagagcgcagatgcctacatgaccaggagcctgaacccagccctggatggcctgacctgtggcctgaccagccatgacaagaggatcagtgacctgggcaacaagaccagccccatgagccacagctttgccaacttccactacccaggagtgcagaacctgagccgcagcctgatgctggagaacacagagtgccacagcatctatgaggagagccctgagaggagtgacacccctgtggatgcccagaggcccatcggcagcgagatcctgggccagagctctgtgtctgagaaggagcccgccaacggggcccagaaccctggccctgccaagcaggagaagaatgagctgcgggacagcacagagcagttccaggagtactaccggcagaggctgcgctaccagcagcacctggagcagaaggagcagcagaggcagatctaccagcagatgctgctggagggcggcgtgaaccaggaggatggccctgaccagcagcagaacctgacagagcagttcctgaacagaagcatccagaagctgggggagctgaacatcggcatggatggcctgggcaatgaggtgtctgccctgaaccagcagtgcaatggcagcaaaggaaatggcagcaatggcagctctgtgaccagcttcaccaccccaccccaggacagcagccagaggctgacccatgatgccagcaacatccacaccagcacccccaggaaccctggcagcaccaaccacatccccttcctggaggagagcccctgtggcagccagatcagcagcgagcacagcgtcatcaagccacccctgggggacagccctggcagcctgagccgcagcaagggggaggaggatgacaagagcaagaagcagtttgtgtgcatcaacatcctggaggacacccaggccgtgcgggctgtggccttccaccctgctgggggcctgtatgctgtgggcagcaacagcaagaccctgcgggtgtgtgcctacccagatgtgattgaccccagcgcccacgagacccccaagcagcctgtggtgcgcttcaagaggaacaagcaccacaagggcagcatctactgtgtggcctggagcccctgtggccagctgctggccaccggcagcaatgacaagtatgtgaaggtgctgcccttcaatgctgagacctgcaatgccaccggccctgacctggagttctccatgcatgatggcaccatccgggacctggccttcatggagggccctgagagcggcggggccatcctgatctctgctggggccggggactgcaacatctacaccacagactgccagaggggccagggcctgcacgccctgagcggccacacaggccacatcctggccctgtacacctggagcggctggatgattgccagcggcagccaggacaagacagtgcgcttctgggacctgcgggtgcccagctgtgtgcgggtggtgggcaccaccttccatggaactggatctgctgtggcctctgtggccgtggaccccagcggccgcctgctggccaccggccaggaggacagcagctgcatgctgtatgacatccggggcggccgcatggtgcagagctaccacccccacagcagtgatgtgcgctctgtgcgcttcagccctggggcccactacctgctgaccggcagctatgacatgaagatcaaggtgacagacctgcagggcgacctgaccaagcagctgcccatcatggtggtgggggagcacaaggacaaggtgatccagtgccgctggcacacccaggacctgtccttcctgagcagcagcgctgacagaacagtgaccctgtggacctacaacggctag

SEQ ID NO: 43586 - DNA, 321 bp, Artificial Sequence
  Description of Artificial Sequence: Synthetic coding sequence
atgacagctgaggagaccgtgaatgtgaaggaggtggagatcatcaagctgatcctggacttcctgaacagcaagaagctgcacatctccatgctggccctggagaaggagagcggggtcatcaatggcctcttcagtgatgacatgctgttcctgcggcagctgatcctggatggccagtgggatgaggtgctgcagttcatccagcccctggagtgcatggagaagtttgacaagaagcgcttccgctacatcatcctgaagcagaagttcctggaggccctgtgtgtgaacaatgccatgtctgcagaagatgaatag

SEQ ID NO: 43587 - DNA, 522 bp, Artificial Sequence
  Description of Artificial Sequence: Synthetic coding sequence
atgacagctgaggagaccgtgaatgtgaaggaggtggagatcatcaagctgatcctggacttcctgaacagcaagaagctgcacatctccatgctggccctggagaaggagagcggggtcatcaatggcctcttcagtgatgacatgctgttcctgcggcagctgatcctggatggccagtgggatgaggtgctgcagttcatccagcccctggagtgcatggagaagtttgacaagaagcgcttccgctacatcatcctgaagcagaagttcctggaggccctgtgtgtgaacaatgccatgtctgcagaagatgagccccagcacctggagttcaccatgcaggaggccgtgcagtgcctgcacgccctggaggagtactgccccagcaaggatgactacagcaagctgtgcctgctgctgaccctgccccggctgaccaaccacgccgagttcaaggactggaaccccagcacagcccgggtgcactgctttgaggaggcctgtgtgatggtggcctag

SEQ ID NO: 43588 - DNA, 2094 bp, Artificial Sequence
  Description of Artificial Sequence: Synthetic coding sequence
atggcctggagggagaagagcaagaagaggctgaacatgaccagcttcaacatcgcccagggcatccacgcctttgactaccacagccggctgaacctgattgccacagctggcatcaacaacaaggtgtgcctgtggaacccctacgtggtgtccaagcctgtgggcgtgctgtggggccacagcgcctctgtgattgctgtgcagttctttgtggagaggaagcagctgttctccttcagcaaggacaaggtgctgcggctgtgggacatccagcaccagctgagcatccagagaattgcctgcagcttccccaagagccaggacttccgctgcctcttccactttgatgaggcccacggccgcctcttcatctccttcaacaaccagctggccctgctggccatgaagtctgaggccagcaagagggtgaagagccatgagaaggctgtgacctgtgtgctgtacaacagcatcctgaagcaggtgatcagcagtgacaccggcagcacagtgtccttctggatgattgacaccggccagaagatcaagcagttcaccggctgccacggcaatgctgagatcagcaccatggccctggatgccaatgagacccggctgctgaccggcagcacagatggcaccgtgaagatctgggacttcaacggctactgccaccacaccctgaatgtgggccaggatggagctgtggacatcagccagatcctgatcctgaagaagaagatcctggtgacaggctgggagcgggccatcaccgtcttccggccccagaacttcaaccagttcttcatccagcctgaggagtggaagggcggcatccagcaccatgatgacatcctgtgtgccgccttcctgcccccccagaccctggtgacaggcagctatgatggagagatcgtgctgtggaacaacagcacagaaaatgcccaccacgtgctgcacccagactaccagaggctgctgaagagcaagctggacaccaagccccagaagctgctgtctgctggccgcagccagcccagccaccccatggctgaccacagcaccactggagtgaggaactttgaaattgacacagagggcaagaatgctgtgatgaggctgtgcttcctgaaggccaggaagaacacagctgtgactggaggagccaacctggtgtcctgtggcggcagcggctacgtgcgcttctgggacatctacaagaagcagctgctggccgagttcctggcccacagcggcgtgggcagcatcatcatgagcacagacaagatgaaccgctacctgaccactggagacctggatggctggctgaagatctggaacatcgaggagtactgcctgaacagcagcaagaacaagatcaccaaggcccccaccctcatccgctccttccagccccatgaagatcgcatcagcagcctggagatgtgtgagcccggcggccagctgctgatcatcagcagcagcgctgactgcagcatctgtgtgactggagtgtgcaatgcccctgtgtggatcttcggccaggccaagcactggcacatcgagaactgcctcttcctgcccaagagggacaccaacctggtggagagcgagatccagaaggagatcagcctcttcagcaaggaggagagctgcctggaccccacagagcacagcctgctgaacaagaagaacaaggatgacagcacctacaacgtgcggcccagcgaggacatcaacctggacatcaagtacaaggagaggagcacctgcatgaaggagacccagaagccctactatggagaggtgatcaagaagagcttcagcaccttccgcagcctgaacattggagccctggaggagctgcctgaggtgaacaagccagccttcctgctggaccctgagaagtacttcaggaaggagcctgaggaggagcggccccagatcctggaggcccccagcctcttcaagaccctgaaggctgtgtttgatgagaagaacctcttccccaaggagatcctgcaccacgagaggaaggccaagcagctgtgccaggagaagagctgtgaggtgaagaagaacaagaagtag

SEQ ID NO: 43589 - DNA, 1989 bp, Artificial Sequence
  Description of Artificial Sequence: Synthetic coding sequence
atgaccatcaactgggccgagctgctgagcggctgccacaagtgctgccacatcctggagcacaagctgcaccagggcgactgggtgcggcaggtgacctacaatgccagcctggatgccatcatcagcagcaccaccagcaacaccaacagcgtggtgatggcctggagggagaagagcaagaagaggctgaacatgaccagcttcaacatcgcccagggcatccacgcctttgactaccacagccggctgaacctgattgccacagctggcatcaacaacaaggtgtgcctgtggaacccctacgtggtgtccaagcctgtgggcgtgctgtggggccacagcgcctctgtgattgctgtgcagttctttgtggagaggaagcagctgttctccttcagcaaggacaaggtgctgcggctgtgggacatccagcaccagctgagcatccagagaattgcctgcagcttccccaagagccaggacttccgctgcctcttccactttgatgaggcccacggccgcctcttcatctccttcaacaaccagctggccctgctggccatgaagtctgaggccagcaagagggtgaagagccatgagaaggctgtgacctgtgtgctgtacaacagcatcctgaagcaggtgatcagcagtgacaccggcagcacagtgtccttctggatgattgacaccggccagaagatcaagcagttcaccggctgccacggcaatgctgagatcagcaccatggccctggatgccaatgagacccggctgctgaccggcagcacagatggcaccgtgaagatctgggacttcaacggctactgccaccacaccctgaatgtgggccaggatggagctgtggacatcagccagatcctgatcctgaagaagaagatcctggtgacaggctgggagagatatgactatgcctcctggaagaccatcggccgggccatcaccgtcttccggccccagaacttcaaccagttcttcatccagcctgaggagtggaagggcggcatccagcaccatgatgacatcctgtgtgccgccttcctgcccccccagaccctggtgacaggcagctatgatggagagatcgtgctgtggaacaacagcacagaaaatgcccaccacgtgctgcacccagactaccagaggctgctgaagagcaagctggacaccaagccccagaagctgctgtctgctggccgcagccagcccagccaccccatggctgaccacagcaccactggagtgaggaactttgaaattgacacagagggcaagaatgctgtgatgaggctgtgcttcctgaaggccaggaagaacacagctgtgactggaggagccaacctggtgtcctgtggcggcagcggctacgtgcgcttctgggacatctacaagaagcagctgctggccgagttcctggcccacagcggcgtgggcagcatcatcatgagcacagacaagatgaaccgctacctgaccactggagacctggatggctggctgaagatctggaacatcgaggaggagagctgcctggaccccacagagcacagcctgctgaacaagaagaacaaggatgacagcacctacaacgtgcggcccagcgaggacatcaacctggacatcaagtacaaggagaggagcacctgcatgaaggagacccagaagccctactacggggaggtgatcaagaagagcttcagcaccttccgcagcctgaacatcggggccctggaggagctgcctgaggtgaacaagccagccttcctgctggaccctgagaagtacttcaggaaggagcctgaggaggagcggccccagatcctggaggcccccagcctcttcaagaccctgaaggctgtgtttgatgagaagaacctcttccccaaggagatcctgcaccacgagaggaaggccaagcagctgtgccaggagaagagctgtgaggtgaagaagaacaagaagtag

SEQ ID NO: 43590 - DNA, 2949 bp, Artificial Sequence
  Description of Artificial Sequence: Synthetic coding sequence
atgaaggagccagatgaccaggacacagatggagagaagtctgtgaccagcaagagtgatggcaagaagagcctgcggagcagcaagtctgagagccgcagccctgtgcaggaggacaacaccttcctggaggatgacacagatgagaccttcaccaagggggagggcagctacctggaggaggacagtgatgaggagcggctggagggcagcctgagcagcttccagtatggagacctgcagagcaccaccgtgccccagcagaccccagccccagctgtggaggaggccgaggaggaggtgaagaagaagatcagcgagagcttcttctatgactacatggagctggcctccatgccctttgtgaccctggacagcaacatccccctggacctgctgaccctggtgcacagctttggctatgactgcaggaagagggccaacctgcagctgctggatgacagcatcgccatctacatcgccggcaaccagctgatcttcctgaacctgaagaccaaggagcagatctacctgcggagcagcagcggggagggcatcggcgtgattggagtgcacccccacaagacctacttcaccgtggccgagaagggcagcttcccagacatcatcatctatgagtaccccagcctgcggccctacagagtgctgagagatggaacagagaagggctacgcctacgtggacttcaactacagcggcaacctgctggcctctgtgggcagcaacccagactacaccctgaccatctggaactggaaggaggagcagcccatcctgcggaccaaggccttcagccaggaggtgttcaaggtgaccttcaacccagacaaggaggagcagctgaccaccagcggcagcggccacatcaagttctgggagatggccttcaccttcaccggcctgaagctgcagggcagcctgggccgctttgggaagaccatcaccacagacatcgagggctacatggagctgcctgatggcaaggtgctgagcggcagcgagtggggcaacatgctgctgtgggagggcggcctcatcaaggtggagctgtgccggggcaccagcaagagctgccacaacggccccatcaaccagatcatgctgtatgaaggagaggtgatcaccgtgggcagtgatggctacgtgcgcatctgggactttgagaccatcgacacagcagatgtgattgatgagaccggcctgctggagattgagcccatcaatgagctgcaggtggacaagaatgtgaacctcttctccatgatcaagatgaatgagaccggcaacaacttctggctggcccaggatgccaatggagccatctggaagctggacctgtccttcagcaacatcacccaggaccctgaatgtctcttctccttccacagcggggccattgaagctgtggccgtgagccccctgacctacctgatggccaccacagccctggactgcagcgtgcgcatctatgactttgccagcaagacccccctggcccagatgaagttcaagcagggcggcacagccctggtgtgggtgcccaggatggtgaacttcaccggggcccagatcatcgtgggctttgaagatggagtggtgcgcatcctggagctgtatgaccccaagggcctgaccatctttgctggcaggaagaagatcctggatgctgacatccagctgaagcaggtgttcaagccccacacagcctgtgtgacagccctggcctatgaaagagatggagagatcctggccaccggcagcaaggaccagaccgtcttcttctttgaggtggagcgggactacaagcccatcggctacatcaacaccccaggccctgtgtgccagctgatgtggagccccatgagccaccctgagagcaccctgctgatcatctgtgaaaatggctacatcctggaggcccccctgcccaccatcaagcaggaggaggatgaccatgatgtggtgtcctatgagatcaaggacatgtgcatcaagtgcttccacttcagctctgtgaagagcaagatcctgcggctgattgaaattgagaagcgggagcggcagcgggagctgaaggagaagatccgggaggagaggaggaacaagctggccgctgagatgggagaagatggagagaaggagttccaggaggaggaggaggagaaggaggaggaggaggaggaggaggagcccctgcctgagatcttcatccccagcacccccagccccatcctgtgtggcttctacagcgagcccgggaagttctgggtgtccctgggcggctatgattctggcttcctgtaccactgtgagttccccccctgtgatgagagcagtgacttcaaggagcagaaggatgagcccattgatgtgcgctacctggccgacacagaggacaaccccatccagaccatcaccttcaacatcaacaaggtgatgatgttctgtggcatgaagaatggagccatccgggtgtatgtgctgaaccagaatgaccccagcctgaccagcctggtggactactggcacttcaacatgcatgacaacaactacggctgcatcaagagcatcgccaacagctttgatgaccgcttcctggtgacagctggagcagatggcaacatctttgtgttcaacatcttcagcgagttcatgctgaggaaggacatgaaggccaaggtgcccagcccccgcttcggcatcgagacagagcccatcccagaagatattgaggaccccaaggcctacagcattgaaaatgcccggaggaagcgggagcatgacaagctgatgaaggaggtgggggagatcaaggccaggaagcgggagcagatcaaggccctgcggtctgagttctgcaacctgctggagatgaatgagaagctgcccaagcacatgcagttcaagaggacagtgtccctcatctag

SEQ ID NO: 43591 - DNA, 1206 bp, Artificial Sequence
  Description of Artificial Sequence: Synthetic coding sequence
atgaagctgagtgacctgcaccacgtgaccctcttccaggagatcctgctgctgaagaactttgagaagcaggagaacatcctgcaggagcgggtgaacagcctggacaaggaggagcagtacatgcagtggaagatcaatgagaccctgaaggagatggaggagaagaagaatgagatcaccaagctgcaggagcaggagaaggccctgtatgccggcttccaggccgccatcggggagaacaacaagtttgccaacttcctgatgaaggtgctgaagaagaagatcaagagggtgaagaagaaggaggtggagggagatgctgatgaagatgaggagagcgaggagagcagcgaggaggagagcagcctggagagtgatgaagatgaaagtgaaagtgaagatgaggtgtttgatgacagcatctgccccaccaactgtgatgtggccctgtttgagctggccctgcacctgcgggagaagaggctggacatcgaggaggccctggtggaggagaagaagatcgtggacaacctgaagaaggagtatgacaccctgagcaagaaggtgaagatcgtggccaccaacctgaatgctgctgaggaggccctggaggcctaccagcgggagaagcagcagaggctgaatgagctgctggtggtgatccccctgaagctgcaccagattgaatatgtggtgtttggagagatccccagcgacctgagcggcaccctggtgttcagcaaccacgccctgcggcggctgcaggagcgcatccacgagctgcaggaggagaacagcaagcagcagaagctgaacaaggagtggagggagaggaggaagcagctgatccgggagaagcgggagatgaccaagaccatccacaagatggaggagaccgtgcggcagctgatgatcagcaagtttggccgggtggtgaacctggaggccctgcagaccctgtctgtgaacaccaccctggaggagctgaagatcaggaagctgaggaaggagctggccaatgccaaggagatgaagatgtgggaggagaagatcgcccagatgcgctgggagctgatgatgaagaccaaggagcacaccaggaagctgtaccagatgaatgacctgtgcatcgagaagaagaagctggacagccggctgaacaccctgcagaaccagcagaaccctggaaatggcctgtcctag

SEQ ID NO: 43592 - DNA, 5565 bp, Artificial Sequence
  Description of Artificial Sequence: Synthetic coding sequence
atgaaggagccagatgaccaggacacagatggagagaagtctgtgaccagcaagagtgatggcaagaagagcctgcggagcagcaagtctgagagccgcagccctgtgcaggaggacaacaccttcctggaggatgacacagatgagaccttcaccaagggggagggcagctacctggaggaggacagtgatgaggagcggctggagggcagcctgagcagcttccagtatggagacctgcagagcaccaccgtgccccagcagaccccagccccagctgtggaggaggccgaggaggaggtgaagaagaagatcagcgagagcttcttctatgactacatggagctggcctccatgccctttgtgaccctggacagcaacatccccctggacctgctgaccctggtgcacagctttggctatgactgcaggaagagggccaacctgcagctgctggatgacagcatcgccatctacatcgccggcaaccagctgatcttcctgaacctgaagaccaaggagcagatctacctgcggagcagcagcggggagggcatcggcgtgattggagtgcacccccacaagacctacttcaccgtggccgagaagggcagcttcccagacatcatcatctatgagtaccccagcctgcggccctacagagtgctgagagatggaacagagaagggctacgcctacgtggacttcaactacagcggcaacctgctggcctctgtgggcagcaacccagactacaccctgaccatctggaactggaaggaggagcagcccatcctgcggaccaaggccttcagccaggaggtgttcaaggtgaccttcaacccagacaaggaggagcagctgaccaccagcggcagcggccacatcaagttctgggagatggccttcaccttcaccggcctgaagctgcagggcagcctgggccgctttgggaagaccatcaccacagacatcgagggctacatggagctgcctgatggcaaggtgctgagcggcagcgagtggggcaacatgctgctgtgggagggcggcctcatcaaggtggagctgtgccggggcaccagcaagagctgccacaacggccccatcaaccagatcatgctgtatgaaggagaggtgatcaccgtgggcagtgatggctacgtgcgcatctgggactttgagaccatcgacacagcagatgtgattgatgagaccggcctgctggagattgagcccatcaatgagctgcaggtggacaagaatgtgaacctcttctccatgatcaagatgaatgagaccggcaacaacttctggctggcccaggatgccaatggagccatctggaagctggacctgtccttcagcaacatcacccaggaccctgaatgtctcttctccttccacagcggggccattgaagctgtggccgtgagccccctgacctacctgatggccaccacagccctggactgcagcgtgcgcatctatgactttgccagcaagacccccctggcccagatgaagttcaagcagggcggcacagccctggtgtgggtgcccaggatggtgaacttcaccggggcccagatcatcgtgggctttgaagatggagtggtgcgcatcctggagctgtatgaccccaagggcctgaccatctttgctggcaggaagaagatcctggatgctgacatccagctgaagcaggtgttcaagccccacacagcctgtgtgacagccctggcctatgaaagagatggagagatcctggccaccggcagcaaggaccagaccgtcttcttctttgaggtggagcgggactacaagcccatcggctacatcaacaccccaggccctgtgtgccagctgatgtggagccccatgagccaccctgagagcaccctgctgatcatctgtgaaaatggctacatcctggaggcccccctgcccaccatcaagcaggaggaggatgaccatgatgtggtgtcctatgagatcaaggacatgtgcatcaagtgcttccacttcagctctgtgaagagcaagatcctgcggctgattgaaattgagaagcgggagcggcagcgggagctgaaggagaagatccgggaggagaggaggaacaagctggccgctgagatgggagaagatggagagaaggagttccaggaggaggaggaggagaaggaggaggaggaggaggaggaggagcccctgcctgagatcttcatccccagcacccccagccccatcctgtgtggcttctacagcgagcccgggaagttctgggtgtccctgggcggctatgattctggcttcctgtaccactgtgagttccccccctgtgatgagagcagtgacttcaaggagcagaaggatgagcccattgatgtgcgctacctggccgacacagaggacaaccccatccagaccatcaccttcaacatcaacaaggtgatgatgttctgtggcatgaagaatggagccatccgggtgtatgtgctgaaccagaatgaccccagcctgaccagcctggtggactactggcacttcaacatgcatgacaacaactacggctgcatcaagagcatcgccaacagctttgatgaccgcttcctggtgacagctggagcagatggcaacatctttgtgttcaacatcttcagcgagttcatgctgaggaaggacatgaaggccaaggtgcccagcccccgcttcggcatcgagacagagcccatcccagaagatattgaggaccccaaggcctacagcattgaaaatgcccggaggaagcgggagcatgacaagctgatgaaggaggtgggggagatcaaggccaggaagcgggagcagatcaaggccctgcggtctgagttctgcaacctgctggagatgaatgagaagctgcccaagcacatgcagttcaagaggacagactttgatgtggacagccagatccgggcagagatgcacaggaagacagccttcaagatccagcaggtggagaaggagctggcctgggagaaggagaagcatgagctgggcctgatgaagctgaagaaccgcttccgggaccccctggagagtgacaccatcgtggtgcacgccatcctgagtgaccacaagatcagcagctaccgcctggtgcagcccagcaagtacagcaagttcaagagggccagccagagcgagaggaagcccagcaagctggacagatttgagaaggagggccctggcaggaaggacagccagagagatgctgggggctctgtgaccatccaggaggagagcatcatcgagaagggcaagaagttccggcccaagaccctgtctgagatcatcgtggagaaccagatcgagaagaccaggaagctgatcctgaaggccgagcgggcccagctgaagatccagcagaggaagaaggagtgggaggagctgtacaagagcaagccaggagatgattatgaggaccccaaggacctgcaggccatcaaggaggcccaggtgtacatgggagacttcaacctgaagacagccccagactacaagatccctgagcacatgaggatcaatgctgccaagaaggaggaggagctgggccacctggacagcctggtgcacggcaacaagaggcacatgaacaagtgcatcctgagcctgcgggacctgaaggtggccgtggtggaggagatccagtgcctggtgcaggagctgaagaacatccagagcaccctgcacatcagcaagcacatccccatccccaagatcccccagatccaccctgaggaggtgcctgagaagcgcttccagtatgatgaggagaccctgctgaacttcaagcagcagcagatgaagagcaaggatgagaagagccctggggtggagcagacaggcagcggcggccctgtgggcggcttcctgaagctgagcagcaggaaggatggagacctgaccacccgggacagcatcagccgcagcagcaaggccagcaccttcagcctggacatccccaagtgcctggagtttgagaaggccgagcccacagatgtggagctggagatcatgaagagagatgagatcaagcacgtgtacatgcagcagtacctggtgaaccgcatcaaggagctggtggtgacctttgatgctgagctgcggctgctgcggcaccagaagctgaagctggacacccagatgaagctgagtgacctgcaccacgtgaccctcttccaggagatcctgctgctgaagaactttgagaagcaggagaacatcctgcaggagcgggtgaacagcctggacaaggaggagcagtacatgcagtggaagatcaatgagaccctgaaggagatggaggagaagaagaatgagatcaccaagctgcaggagcaggagaaggccctgtatgccggcttccaggccgccatcggggagaacaacaagtttgccaacttcctgatgaaggtgctgaagaagaagatcaagagggtgaagaagaaggaggtggagggagatgctgatgaagatgaggagagcgaggagagcagcgaggaggagagcagcctggagagtgatgaagatgagagcgagagtgaagatgaggtgtttgatgacagcatctgccccaccaactgtgatgtggccctgtttgagctggccctgcacctgcgggagaagaggctggacatcgaggaggccctggtggaggagaagaagatcgtggacaacctgaagaaggagtatgacaccctgagcaagaaggtgaagatcgtggccaccaacctgaatgctgctgaggaggccctggaggcctaccagcgggagaagcagcagaggctgaatgagctgctggtggtgatccccctgaagctgcaccagatcgagtatgtggtgtttggagagatccccagcgacctgagcggcaccctggtgttcagcaaccacgccctgcggcggctgcaggagcgcatccacgagctgcaggaggagaacagcaagcagcagaagctgaacaaggagtggagggagaggaggaagcagctgatccgggagaagcgggagatgaccaagaccatccacaagatggaggagaccgtgcggcagctgatgatcagcaagtttggccgggtggtgaacctggaggccctgcagaccctgtctgtgaacaccaccctggaggagctgaagatcaggaagctgaggaaggagctggccaatgccaaggagatgaagatgtgggaggagaagatcgcccagatgcgctgggagctgatgatgaagaccaaggagcacaccaggaagctgtaccagatgaatgacctgtgcatcgagaagaagaagctggacagccggctgaacaccctgcagaaccagcagggcaatgccttccagggcccccgggaggctgatgtggtggcccgggaggaggtgacagagctgatccagctgcaggccgagcgcatcagcgccctgaaggaggagatcgccctgctgcggaggaagggcagcctcatcctgccccccatccagagcccccgggagaaggagatccagcctgctgacctgtag

SEQ ID NO: 43593 - DNA, 255 bp, Artificial Sequence
  Description of Artificial Sequence: Synthetic coding sequence
atgaaggagccagatgaccaggacacagatggagagaagtctgtgaccagcaagagtgatggcaagaagagcctgcggagcagcaagtctgagagccgcagccctgtgcaggaggacaacaccttcctggaggatgacacagatgagaccttcaccaagggggagggcagctacctggaggaggacagtgatgaggagcggctggagggcagcctgagcagcttccagtatggagacctgcagagcaccacctag

SEQ ID NO: 43594 - DNA, 1077 bp, Artificial Sequence
  Description of Artificial Sequence: Synthetic coding sequence
atggctgtgaagtggacaggaggccacagcagccctgtgctgtgcctgaatgccagcaaggagggcctgctggccagcggggctgagggcggggacctgacagcctggggagaagatggcacccccctgggccacacccgcttccagggcgcagatgatgtgacctctgtgctcttcagccccagctgccccaccaagctgtatgccagccatggagagaccatctctgtgctggatgtgcgcagcctgaaggacagcctggaccacttccacgtgaatgaggaggagatcaactgcctgagcctgaaccagacagagaacctgctggccagcgcagatgattctggggccatcaagatcctggacctggagaacaagaaggtgatccgcagcctgaagaggcacagcaacatctgcagctctgtggccttccggccccagaggccccagagcctggtgtcctgtggcctggacatgcaggtgatgctgtggagcctgcagaaggcccggcccctgtggatcaccaacctgcaggaggatgaaacagaggagatggagggcccccagagccctggccagctgctgaacccagccctggcccacagcatctctgtggccagctgtggcaacatcttcagctgtggggctgaagatggcaaggtgcgcatcttccgggtgatgggcgtgaagtgtgagcaggagctgggcttcaagggccacaccagcggcgtgtcccaggtgtgcttcctgcctgagagctacctgctgctgaccggcggcaatgatggcaagatcaccctgtgggatgccaacagcgaggtggagaagaagcagaagagccccaccaagaggacccacaggaagaagcccaagaggggcacctgcaccaagcagggcggcaacaccaatgcctctgtgacagatgaggaggagcacggcaacatcctgcccaagctgaacattgaacatggagagaaggtgaactggctgctgggcaccaagatcaagggccaccagaacatcctggtggccgaccagaccagctgcatctctgtgtaccccctgaatgagttctag

SEQ ID NO: 43595 - DNA, 465 bp, Artificial Sequence
  Description of Artificial Sequence: Synthetic coding sequence
atggctgtgaagtggacaggaggccacagcagccctgtgctgtgcctgaatgccagcaaggagggcctgctggccagcggggctgagggcggggacctgacagcctggggagaagatggcacccccctgggccacacccgcttccagggcgcagatgatgtgacctctgtgctcttcagccccagctgccccaccaagctgtatgccagccatggagagaccatctctgtgctggatgtgcgcagcctgaaggacagcctggaccacttccacgtgaatgaggaggagatcaactgcctgagcctgaaccagacagagaacctgctggccagcgcagatgattctggggccatcaagatcctggacctggagaacaagaaggtgatccgcagcctgaagaggcacagcaacatctgcagctctgtggccttccggccccagaggccccagagcctggtgtcctag

SEQ ID NO: 43596 - DNA, 483 bp, Artificial Sequence
  Description of Artificial Sequence: Synthetic coding sequence
atggctgtgaagtggacaggaggccacagcagccctgtgctgtgcctgaatgccagcaaggagggcctgctggccagcggggctgagggcggggacctgacagcctggggagaagatggcacccccctgggccacacccgcttccagggcgcagatgatgtgacctctgtgctcttcagccccagctgccccaccaagctgtatgccagccatggagagaccatctctgtgctggatgtgcgcagcctgaaggacagcctggaccacttccacgtgaatgaggaggagatcaactgcctgagcctgaaccagacagagaacctgctggccagcgcagatgattctggggccatcaagatcctggacctggagaacaagaaggtgatccgcagcctgaagaggcacagcaacatctgcagctctgtggccttccggccccagaggccccagagcctggtgtcctgtggcctggacatgcagtag

SEQ ID NO: 43597 - DNA, 1005 bp, Artificial Sequence
  Description of Artificial Sequence: Synthetic coding sequence
atgttccgctgggagaggagcatccccctgcggggcagcgctgctgccctgtgcaacaacctgtctgtgctgcagctgcctgccaggaacctgacctactttggagtggtgcacggccccagcgcccagctgctgtctgctgcccctgagggcgtgcccctggcccagaggcagctgcacgccaaggagggcgccggcgtgtccccacccctcatcacccaggtgcactggtgtgtgctgcccttccgggtgctgctggtgctgaccagccaccggggcatccagatgtatgagagcaatggctacaccatggtgtactggcacgccctggacagcggagatgccagccctgtgcaggccgtgtttgcccggggcattgctgccagcggccacttcatctgtgtgggcacctggagcggccgggtgctggtgtttgacatcccagccaagggccccaacatcgtgctgtctgaggagctggccggccaccagatgcccatcacagacatcgccacagagcccgcccagggccaggactgtgtggccgacatggtgacagcagatgacagcggcctgctgtgtgtgtggaggagcggccctgagttcaccctgctgacccgcatccctggctttggagtgccctgccccagcgtgcagctgtggcagggcatcatcgctgctggctatggaaatggccaggtgcacctgtatgaggccaccactggaaacctgcacgtgcagatcaatgcccacgcccgggccatctgtgccctggacctggccagcgaggtgggcaagctgctgtctgctggggaggacacctttgtgcacatctggaagctgagcagaaatcctgagagcggctacatcgaggtggagcactgccacggggagtgtgtggccgacacccagctgtgtggggcccgcttctgtgacagcagcggcaacagctttgctgtgacaggctatgacctggccgagatccgccgcttcagctctgtgtag

SEQ ID NO: 43598 - DNA, 2925 bp, Artificial Sequence
  Description of Artificial Sequence: Synthetic coding sequence
atggccgcccgctggagcagtgaaaatgtggtggtggagttccgggacagccaggccacagccatgtctgtggactgcctgggccagcacgctgtgctgagcggccgccgcttcctgtacatcgtgaacctggatgccccctttgagggccacaggaagatcagccggcagagcaagtgggacatcggggctgtgcagtggaacccccatgacagctttgcccactactttgctgccagcagcaaccagagggtggacctgtacaagtggaaggatggcagcggggaggtgggcaccaccctgcagggccacaccagggtcatcagtgacctggactgggccgtgtttgagccagacctgctggtgaccagctctgtggacacctacatctacatctgggacatcaaggacaccaggaagcccaccgtggccctgtctgctgtggccggggccagccaggtgaagtggaacaagaagaatgccaactgcctggccaccagccatgatggagatgtgcgcatctgggacaagaggaagcccagcacagctgtggagtacctggccgcccacctgagcaagatccacggcctggactggcacccagattctgagcacatcctggccaccagcagccaggacaacagcgtgaagttctgggactaccggcagcccaggaagtacctgaacatcctgccctgccaggtgcctgtgtggaaggcccgctacacccccttcagcaatggcctggtgacagtgatggtgccccagctgcggcgggagaacagcctgctgctgtggaatgtgtttgacctgaacacccctgtgcacacctttgtgggccatgatgatgtggtgctggagttccagtggaggaagcagaaggagggcagcaaggactaccagctggtgacctggagccgggaccagaccctgaggatgtggagggtggacagccagatgcagaggctgtgtgccaatgacatcctggatggagtggatgagttcatcgagagcatcagcctgctgcctgagcctgagaagaccctgcacacagaggacacagaccaccagcacacagccagccacggggaggaggaggccctgaaggaggacccccccaggaacctgctggaggagaggaagagtgaccagctgggcctgccccagaccctgcagcaggagttcagcctcatcaacgtgcagatcagaaatgtgaatgtggagatggatgctgctgacaggagctgcaccgtgtctgtgcactgcagcaaccaccgggtgaagatgctggtgaagtttcctgcccagtaccccaacaatgctgcccccagcttccagttcatcaaccccaccaccatcaccagcaccatgaaggccaagctgctgaagatcctgaaggacacagccctgcagaaggtgaagaggggccagagctgcctggagccctgcctgcggcagctggtgtcctgcctggagagctttgtgaaccaggaggacagcgccagcagcaacccctttgccctgcccaacagcgtgaccccacccctgcccacctttgcccgggtgaccacagcctacggcagctaccaggatgccaacatccccttccccaggaccagcggggcccgcttctgtggggccggctacctggtgtacttcacccggcccatgaccatgcacagagctgtgagccccacagagcccacccccaggagcctgagcgccctgagcgcctaccacacaggcctcatcgcccccatgaagatcagaacagaggcccctggcaacctgcggctgtacagcggcagccccaccaggtctgagaaggagcaggtgtccatcagcagcttctactacaaggagaggaagagccgccgctggaagagcaagcgggagggcagtgacagcggcaaccggcagatcaaggccgccggcaaggtgatcatccaggacatcgcctgcctgctgcctgtgcacaagagcctgggggagctgtacatcctgaatgtgaatgacatccaggagacctgccagaagaatgctgccagcgccctgctggtgggcaggaaggacctggtgcaggtgtggagcctggccaccgtggccacagacctgtgcctgggccccaagagtgaccctgacctggagaccccctgggcccggcaccccttcggccggcagctgctggagagcctgctggcccactactgccgcctgagagatgtgcagaccctggccatgctgtgcagcgtgtttgaggcccagagccggccccagggcctgcccaaccccttcggccccttccccaacagaagcagcaacctggtggtgagccacagccgctaccccagcttcaccagcagcggcagctgcagctccatgtctgaccccggcctgaacacaggaggctggaacattgctggccgggaggccgagcacctgagcagcccctggggcgagagcagccctgaggagctgcgcttcggcagcctgacctacagcgacccccgggagcgggagcgggaccagcacgacaagaacaagaggctgctggaccctgccaacacccagcagtttgatgacttcaagaagtgctacggggagatcctgtaccgctggggcctgcgggagaagagagctgaggtgctgaagtttgtgtcctgccccccagacccccacaagggcatcgagtttggagtgtactgcagccactgccgctctgaggtgcggggcacccagtgtgccatctgcaagggcttcaccttccagtgtgccatctgccacgtggccgtgcggggcagcagcaacttctgcctgacctgtggccatggaggccacaccagccacatgatggagtggttccgcacccaggaggtgtgccccaccggctgcggctgccactgcctgctggagagcaccttctag

SEQ ID NO: 43599 - DNA, 1377 bp, Artificial Sequence
  Description of Artificial Sequence: Synthetic coding sequence
atgtctgtggactgcctgggccagcacgctgtgctgtctggaagacgcttcctgtacatcgtgaacctggatgccccctttgagggccacaggaagatcagccggcagagcaagtgggacattggagctgtgcagtggaacccccatgacagctttgcccactactttgctgccagcagcaaccagagggtggacctgtacaagtggaaggatggcagcggggaggtgggcaccaccctgcagggccacaccagggtcatcagtgacctggactgggccgtgtttgagccagacctgctggtgaccagctctgtggacacctacatctacatctgggacatcaaggacaccaggaagcccaccgtggccctgtctgctgtggccggggccagccaggtgaagtggaacaagaagaatgccaactgcctggccaccagccatgatggagatgtgcgcatctgggacaagaggaagcccagcacagctgtggagtacctggccgcccacctgagcaagatccacggcctggactggcacccagacagcgagcacatcctggccaccagcagccaggacaacagcgtgaagttctgggactaccggcagcccaggaagtacctgaacatcctgccctgccaggtgcctgtgtggaaggcccgctacacccccttcagcaatggcctggtgacagtgatggtgccccagctgcggcgggagaacagcctgctgctgtggaatgtgtttgacctgaacacccctgtgcacacctttgtgggccatgatgatgtggtgctggagttccagtggaggaagcagaaggagggcagcaaggactaccagctggtgacctggagccgggaccagaccctgaggatgtggagggtggacagccagatgcagaggctgtgtgccaatgacatcctggatggagtggatgagttcatcgagagcatcagcctgctgcctgagcctgagaagaccctgcacacagaggacacagaccaccagcacacagccagccatggagaggaggaggccctgaaggaggaccccccaagaaacctgctggaggagaggaagagtgaccagctgggcctgccccagaccctgcagcaggagttcagcctcatcaacgtgcagatcagaaatgtgaatgtggagatggatgctgctgacaggagctgcaccgtgtctgtgcactgcagcaaccaccgggtgaagatgctggtgaagtttcctgcccagtaccccaacaatgctgcccccagcttccagttcatcaaccccaccaccatcaccagcaccatgaaggccaagctgctgaaggtgggcgtgtgggtgcccaagttcagcctgctcttctgcatcatcgtgtag

SEQ ID NO: 43600 - DNA, 993 bp, Artificial Sequence
  Description of Artificial Sequence: Synthetic coding sequence
atggccaccaaggagagcagagatgccaaggcccagctggccctgagcagcagcgccaaccagagcaaggaggtgcctgagaaccccaactatgccctgaagtgcaccctggtgggccacacagaagctgtgtcctctgtgaagttcagccccaacggggagtggctggccagcagcagcgctgacaggctcatcatcatctggggcgcctatgatggcaagtatgagaagaccctgtatggccacaacctggagatcagtgatgtggcctggagcagtgacagcagccggctggtgtctgccagtgatgacaagaccctgaagctgtgggatgtgcgcagcggcaagtgcctgaagaccctgaagggccacagcaactacgtgttctgctgcaacttcaacccccccagcaacctgatcatcagcggcagctttgatgagaccgtgaagatctgggaggtgaagacaggcaagtgcctgaagaccctgagcgcccacagcgaccctgtgtctgctgtgcacttcaactgcagcggcagcctcatcgtgtctggcagctatgatggcctgtgccgcatctgggatgctgccagcggccagtgcctgaagaccctggtggatgatgacaacccccctgtgtcctttgtgaagttcagccccaacgggaagtacatcctgacagccaccctggacaacaccctgaagctgtgggactacagccggggccgctgcctgaagacctacacaggccacaagaatgagaagtactgcatctttgccaacttctctgtgactggaggcaagtggatcgtgtctggcagcgaggacaacctggtgtacatctggaacctgcagaccaaggagatcgtgcagaagctgcagggccacacagatgtggtgatctctgctgcctgccaccccacagaaaatctcatcgccagcgctgccctggagaatgacaagaccatcaagctgtggatgagcaaccactag

SEQ ID NO: 43601 - DNA, 3201 bp, Artificial Sequence
  Description of Artificial Sequence: Synthetic coding sequence
atggagcccgggaagaggaggaccaaggatgacacctggaaggcagatgacctgaggaagcacctgtgggccatccagagcggcggcagcaaggaggagaggaagcaccgggagaagaagctgaggaaggagagcgagatggacctgcctgagcacaaggagccccgctgccgggaccctgaccaggatgcccggagccgggacagagtggccgaggtgcacacagccaaggagagccccagaggagagcgggaccgggaccggcagcgggagaggagaagagatgccaaggaccgggagaaggagaagctgaaggagaagcaccgggaggccgagaagagccacagccggggcaaggaccgggagaaggagaaggacagaagagccaggaaggaggagctgcggcagacagtggcccaccacaacctgctgggccaggagacccgggaccggcagctgctggagagagctgagaggaagggccgctctgtgtccaaggtgcgctctgaggagaaggatgaggacagcgagagaggagatgaagatcgggagcggcgctaccgggagaggaagctgcagtacggggacagcaaggacaaccccctgaagtactggctgtacaaggaggagggggagaggaggcacaggaagccccgggagccagaccgggacaacaagcaccgggagaagagcagcacccgggagaagcgggagaagtacagcaaggagaagagcaacagcttcagtgacaagggggaggagcggcacaaggagaagaggcacaaggagggcttccactttgatgatgagcggcaccagagcaatgtggacaggaaggagaagagcgccaaggatgagcccaggaagcgggagagccagaatggagagcacaggaacagaggagccagcagcaagagagatggcaccagcagccagcacgccgagaacctggtgagaaatcatggcaaggacaaggacagcaggaggaagcacggccacgaggagggcagctctgtgtggtggaagctggaccagaggcctggaggagaggagaccgtggagattgagaaggaggagacagacctggagaatgcccgggcagatgcctacacagccagctgtgaagatgactttgaagattatgaagatgactttgaggtgtgtgatggagatgatgatgagagcagcaatgaacctgagagccgggagaagctggaggagctgcccctggcccagaagaaggagatccaggagatccagagggccatcaatgcagaaaatgaaagaattggagagctgagcctgaagctgttccagaagaggggccgcacagaatttgagaaggagcccaggacagacaccaacagcagccccagccgggcctctgtgtgtggcatctttgtggactttgccagcgccagccaccggcagaagagcaggacccaggccctgaagcagaagatgaggagcaccaagctgctgcggctgattgacctggacttctccttcaccttcagcctgctggacctgccccctgtgaatgaatatgacatgtacatccggaactttgggaagaagaacaccaagcaggcctacgtgcagtgcaatgaagataatgtggagcgggacatccagacagaggagattgagacccgggaggtgtggacccagcaccctggagagagcacagtggtgtctgggggcagcgagcagagggacaccagtgatgctgtggtgatgcccaagattgacaccccccggctgtgcagcttcctgcgggccgcctgccaggtgatggctgtgctgctggaggaggaccggctggccgctgagcccagctggaacctgcgggcccaggaccgggccctgtacttcagtgacagcagcagccagctgaacaccagcctgcccttcctgcagaacaggaaggtgagcagcctgcacaccagccgggtgcagaggcagatggtggtgtctgtgcatgacctgcctgagaagagctttgtgcccctgctggacagcaaatatgtgctgtgtgtgtgggacatctggcagcccagcggcccccagaaggtgctgatctgtgagagccaggtgacctgctgctgcctgagccccctgaaggccttcctgctgtttgctggaacagcccacggctctgtggtggtgtgggacctgcgggaggacagccggctgcactacagcgtgaccctgagtgatggcttctggaccttcagaacagccaccttcagcacagatggcatcctgacctctgtgaaccacaggagccccctgcaggccgtggagcccatcagcacctctgtgcacaagaagcagagctttgtgctgagccccttcagcacccaggaggagatgagcggcctgtccttccacatcgccagcctggatgaaagtggagtgctgaatgtgtgggtggtggtggagctgcccaaggctgacattgctggcagcatcagtgacctgggcctgatgcctgggggccgggtgaagctggtgcacagcgccctgatccagctgggggacagcctgagccacaagggaaatgagttctggggcaccacccagaccctgaatgtgaagttcctgcccagcgaccccaaccacttcatcatcggcacagacatgggcctcatcagccacggcacccggcaggacctgcgggtggcccccaagctgttcaagccccagcagcacggcatccggcctgtgaaggtgaatgtgattgacttcagcccctttggagagcccatcttcctggccggctgcagtgatggcagcatccggctgcaccagctgagcagcgccttccccctgctgcagtgggacagcagcacagacagccatgctgtgacaggcctgcagtggagccccaccaggcctgctgtgttcctggtgcaggatgacaccagcaacatctacatctgggacctgctgcagagcgacctgggccctgtggccaagcagcaggtgagccccaaccggctggtggccatggctgctgtgggggagcctgagaaggccggcggcagcttcctggccctggtgctggcccgggccagcggcagcattgacatccagcacctgaagaggcgctgggccgcccctgaggtggatgagtgcaaccggctgcggctgctgctgcaggaggccctgtggccagagggcaagctgcacaagtag

SEQ ID NO: 43602 - DNA, 918 bp, Artificial Sequence
  Description of Artificial Sequence: Synthetic coding sequence
atgaccaaccagtatggcatcctcttcaagcaggagcaggcccatgatgatgccatctggagcgtggcctggggcaccaacaagaaggagaacagcgagaccgtggtgacaggcagcctggatgacctggtgaaggtgtggaagtggagagatgagcggctggacctgcagtggagcctggagggccaccagctgggcgtggtgtctgtggacatcagccacaccctgcccatcgccgccagcagcagcctggatgcccacatccggctgtgggacctggagaatggcaagcagatcaagagcattgatgctggccctgtggatgcctggaccctggccttctccccagacagccagtacctggccaccggcacccacgtgggcaaggtgaacatctttggagtggagagcggcaagaaggagtacagcctggacacccggggcaagttcatcctgagcatcgcctacagcccagatggcaagtacctggccagcggggccattgatggcatcatcaacatctttgatattgccaccgggaagctgctgcacaccctggagggccacgccatgcccatccgcagcctgaccttctccccagacagccagctgctggtgacagccagtgatgatggctacatcaagatctatgatgtgcagcacgccaacctggccggcaccctgagcggccacgcctcctgggtgctgaatgtggccttctgcccagatgacacccactttgtgagcagcagcagtgacaagtctgtgaaggtgtgggatgtgggcaccaggacctgtgtgcacaccttctttgaccaccaggaccaggtgtggggcgtgaagtacaatggaaatggcagcaagatcgtgtctgtgggagatgaccaggagatccacatctatgactgccccatctag

SEQ ID NO: 43603 - DNA, 918 bp, Artificial Sequence; identical to SEQ ID NO: 43602
  Description of Artificial Sequence: Synthetic coding sequence

SEQ ID NO: 43604 - DNA, 885 bp, Artificial Sequence
  Description of Artificial Sequence: Synthetic coding sequence
atgaccaaccagtatggcatcctcttcaagcaggagcaggcccatgatgatgccatctggagcgtggcctggggcaccaacaagaaggagaacagcgagaccgtggtgacaggcagcctggatgacctggtgaaggtgtggaagtggagagatgagcggctggacctgcagtggagcctggagggccaccagctgggcgtggtgtctgtggacatcagccacaccctgcccatcgccgccagcagcagcctggatgcccacatccggctgtgggacctggagaatggcaagcagatcaagagcattgatgctggccctgtggatgcctggaccctggccttctccccagacagccagtacctggccaccggcacccacgtgggcaaggtgaacatctttggagtggagagcggcaagaaggagtacagcctggacacccggggcaagttcatcctgagcatcgcctacagcccagatggcaagtacctggccagcggggccattgatggcatcatcaacatctttgatattgccaccgggaagctgctgcacaccctggagggccacgccatgcccatccgcagcctgaccttctccccagacagccagctgctggtgacagccagtgatgatggctacatcaagatctatgatgtgcagcacgccaacctggccggcaccctgagcggccacgcctcctgggtgctgaatgtggccttctgcccagatgacacccactttgtgagcagcagcagtgacaagtctgtgaaggtgtgggatgtgggcaccaggacctgtgtgcacaccttctttgaccaccaggaccaggtgtggggcgtgaagtacaatggaaatggcagcaagatcgtgtctgtgggggactag

SEQ ID NO: 43605 - DNA, 2676 bp, Artificial Sequence
  Description of Artificial Sequence: Synthetic coding sequence
atggcccccaagcagaagaagaagaccagccggggcaagaagaggctgaagcctgtgctggccgccagcgaggacatggagcctgtgaacatggagagcatgggccaccctgagatctaccccctggtgctgaccaccaagacccaggagatcttcaactgcagaattgatgaagatgtgacagatgagcagccctacaagctgatcaacaaggaggacatctttgaggacctgaggaacagagctgctgtgtctgacttccaccctgtgaagaagatcgtgcaggagtacccaggaaatgagctgctgctggtgtatgacaaggacttcaagtatggcctgaacttctacctgattgccacagaggagggcaaggagaactacctgaaccccccagaggtgcctgaggagcaggaggagtacaaggagcacatcccagaagatgtgtacatctacaagccccctgtgtccaagccctgggtgtccctgggcagcgagaaggagattgaggaggagagcgtgacagagagcaccaagcagatcacctacatgatcagcaggaagagaagtgaatttggagcccccatcaagttcagtgaccagaatgccagctctgtgaaggatgcctacatcgagtgcacagcctacccagacaagaacttcaccctgaagcagctggagaaggatgtgggcatgcaggtgatcccccagatcaaggacatcagcacccagaccaagtggacctaccccaagaatgccaccacccagtactacccccgggagttcagcgaggaggagaaggagaccctgaagcagagcaagcccctggtggacttcctgaacaatgccagcatctctgtggagatcgccctgcagcagaatgagatcatgaacaccttcattgatgactggaagtacctggccgaggaggagggcaccttcggggacaagacagacacccacctgaaggagtaccagagcttcacagacctgcacagccccacagagaagatgatcacctgtgtgtcctggcaccccaccatctacggcctgattgctgtgtctgtggccgtgcggctgagctttgaagatagagtgcacttcagcggcaagctgctgctgcagcccagcctcatcctcttctggagcttcagtgaccccatccacccccagctgatgctggagagcccagatgacatcttctgcttcaagttctgccccagcgaccccaacatcatcgccggcggctgcatcaatggccagatcgtgatgtgggacatcacagcccatgctgacagaattgagaacatcaaggccggcggcagccgcagcaagagggccaccctgaagcccatgttcctgctggagcctgagagcaacaaggaggccatgtacatccgccactgtgctgtgagcagcattgaaaatggccacaagaaggtgatcacagacatccactggctgagtgacacctttgagatcaacaggatgggctctgtgtttgagaacagaagtggcatctgctgccagctggtgacctgcagcgctgactgcaccatctgcttctgggacatccggccccagaagcccctgaccccccagaccacagagaagaagaaggaggagagcattgagatcccctttgatgtgcccagcaccttcctgcacctggacctgtcctggaagcccctgaccaaggtgcggctgagcaaaggagagaccagcctggaccactgccccaccaagatcagcctgaatgaagaccacctgctgtgcaagacccaggacaagatgctggcccagagcaagacagagaaggccgaggagatgaacccctaccacaacctggagagcggcatggccaacctgctgaagcccattgatgacttctgcaccaagttctttgtgggcacagaggagggggaggtgatctacacagactggaagatggagaaggaccctgagaccggccgcctgatgagcaagaagcctgtgagccaccacaccatccatgatggcaccgtgcacaccatccagaggagccccttctacaatgacatcatcctgactgtgggcggctggaatgtggccatctggaaggagggcgtgatgacaggccccctgctgcagagctgctgtgcccccaagcgctacaccagcggccactggagcctgaccaggcctggggtcttctacatcggccgggaggatggctacatcgacatctgggacctgctggagaagacccatgagcccgcccagagccagaacatctgcatcaccatgatcacctacatcaagccctggatcttcagcagcaagcagcagttcatcgccacagctgactactacggcaccctgcacatcctggagatcccctggaccctgagccggcccagcaccaatgagatggcctctgtgaaccactactttgagcgggaggtgaagcacctggagtatgtggagcagaggaagaagatccgggagcaggagaagaaggagatggagctggagatggccaagaagaaggtgaagacctaccagaagagcaaggagcagatgcaggccgagctgaagatggactatgagagctacctggagctggagaagacagtgctgatcaacctgggcctcatcaaggtgacagagaagggcagctacatggaggtgatgtag

SEQ ID NO: 43606 - DNA, 2559 bp, Artificial Sequence
  Description of Artificial Sequence: Synthetic coding sequence
atggcccccaagcagaagaagaagaccagccggggcaagaagaggctgaagcctgtgctggccgccagcgaggacatggagcctgtgaacatggagagcatgggccaccctgagatctaccccctggtgctgaccaccaagacccaggagatcttcaactgcagaattgatgaagatgtgacagatgagcagccctacaagctgatcaacaaggaggacatctttgaggacctgaggaacagagctgctgtgtctgacttccaccctgtgaagaagatcgtgcaggagtacccaggaaatgagctgctgctggtgtatgacaaggacttcaagtatggcctgaacttctacctgattgccacagaggagggcaaggagaactacctgaaccccccagaggtgcctgaggagcaggaggagtacaaggagcacatcccagaagatgtgtacatctacaagccccctgtgtccaagccctgggtgtccctgggcagcgagaaggagattgaggaggagagcgtgacagagagcaccaagcagatcacctacatgatcagcaggaagagaagtgaatttggagcccccatcaagttcagtgaccagaatgccagctctgtgaaggatgcctacatcgagtgcacagcctacccagacaagaacttcaccctgaagcagctggagaaggatgtgggcatgcaggtgatcccccagatcaaggacatcagcacccagaccaagtgtgtggagatcgccctgcagcagaatgagatcatgaacaccttcattgatgactggaagtacctggccgaggaggagggcacctttggagacaagacagacacccacctgaaggagtaccagagcttcacagacctgcacagccccacagagaagatgatcacctgtgtgtcctggcaccccaccatctacggcctgattgctgtgtctgtggccgtgcggctgagctttgaggacagagtgcacttcagcggcaagctgctgctgcagcccagcctcatcctcttctggagcttcagtgaccccatccacccccagctgatgctggagagcccagatgacatcttctgcttcaagttctgccccagcgaccccaacatcatcgccggcggctgcatcaatggccagatcgtgatgtgggacatcacagcccacgccgacagaattgagaacatcaaggccggcggcagccgcagcaagagggccaccctgaagcccatgttcctgctggagcctgagagcaacaaggaggccatgtacatccgccactgtgctgtgagcagcattgaaaatggccacaagaaggtgatcacagacatccactggctgagtgacacctttgagatcaacaggatgggctctgtgtttgaaaatagaagtggcatctgctgccagctggtgacctgcagcgctgactgcaccatctgcttctgggacatccggccccagaagcccctgaccccccagaccacagagaagaagaaggaggagagcattgagatcccctttgatgtgcccagcaccttcctgcacctggacctgtcctggaagcccctgaccaaggtgcggctgagcaagggggagaccagcctggaccactgccccaccaagatcagcctgaatgaagaccacctgctgtgcaagacccaggacaagatgctggcccagagcaagacagagaaggccgaggagatgaacccctaccacaacctggagagcggcatggccaacctgctgaagcccattgatgacttctgcaccaagttctttgtgggcacagaggagggggaggtgatctacacagactggaagatggagaaggaccctgagaccggccgcctgatgagcaagaagcctgtgagccaccacaccatccatgatggcaccgtgcacaccatccagaggagccccttctacaatgacatcatcctgactgtgggcggctggaatgtggccatctggaaggagggcgtgatgacaggccccctgctgcagagctgctgtgcccccaagcgctacaccagcggccactggagcctgaccaggcctggggtcttctacatcggcagagaagatggctacatcgacatctgggacctgctggagaagacccatgagcccgcccagagccagaacatctgcatcaccatgatcacctacatcaagccctggatcttcagcagcaagcagcagttcatcgccacagctgactactacggcaccctgcacatcctggagatcccctggaccctgagccggcccagcaccaatgagatggcctctgtgaaccactactttgagcgggaggtgaagcacctggagtatgtggagcagaggaagaagatccgggagcaggagaagaaggagatggagctggagatggccaagaagaaggtgaagacctaccagaagagcaaggagcagatgcaggccgagctgaagatggactatgagagctacctggagctggagaagacagtgctgatcaacctgggcctcatcaaggtgacagagaagggcagctacatggaggtgatgtag

SEQ ID NO: 43607 - DNA, 2559 bp, Artificial Sequence; identical to SEQ ID NO: 43606
  Description of Artificial Sequence: Synthetic coding sequence

SEQ ID NO: 43608 - DNA, 3246 bp, Artificial Sequence
  Description of Artificial Sequence: Synthetic coding sequence
atggacatcaggaaggagaagaggctgaacatggccctgcagatgagcaacttcaagaaggccctgaacagatttgagaagctggtggagcagacagctgcccagaagagagatgaaagagctggcctcttcatccacaaggaggatgccatcggctatgacaagttctacgcctctgtgcagaagctgtttggaccagatgtgaagaaccaggatgtgaagcgcttctacaggaagctgtgcaacaacacagatgccagcgctgactggtgtgagatcttcggctacttcagcagcgaggaggaccccatcgccagccagctggatgaggagaacctggtgttctttgtgtccaggaagaggcgcatcctgatcagcggcagcagaagaagagatgtgatcaagagcatcgtgaagatcccccacctggacctgctgatcacagccacccagaagggcctcatcaccgtcttcaacaaccaggacacctcctggatcaccggctgtgactacctgctgcagctgaagagaattgtggccaccacagagaggaccatcatcgtgtgggactacaaggcccagggcagcagccaggagaactacttcgtcatcaagcccatggaccactgcctgctgtgtgtgtgtgtggtgcccctgcctgaccacctgtgcagagatgacatcctgctgggagatgatggcggctttgtgaaccgcttcaccgtgaacagtgatgactttggcatcaagcaggccaagagcaagaggaagctgcagaaccaggtgctggacagcaagaacttcaagtctgtgaagaggaagctgcacaatgactgggtgatgaagatccgctacatcagcgccctgaactgcttcggcagctgcagcctggacagcaaccacagcctggtgctggagagcctgaagaggctggaggacaacctgcctgtgcgggagttctccatgcccaggggggccaacaccttctgctactgtgtgaaggccaacgtcatcgtgactggaggagatgacaaggtgatccggctgtggcaccccaacatcagcaccaagcctgtgggcaagctggtgggccacatgttcagcattgctgagatcgtgaccaatgagaaggaccagcacgtggtgtccctgagcagcgccaaggtgttccgggtgtgggacatccagaccctgagcctgctgcaggtgttccatgacagccagggcggccctggggacatgcagatctacagcatgatctatgatgccaaccacggcatgctgatcaccggcagctctgtgatggacatgtaccccctgaccaggatgatccaggacaccaagcaggtgccccacacccatgagcgggagatcaacgtgatgctgtacaacaagtacttccaccaggtgctgaccatctgcagcgagagcatcatccgggtgtgggagctggagaccggcctgcaggtgtaccagatcctggagccccacggcttcaacacagaggtgaccagcgctgctgtggatgaaagtggcttcctgtttgccactggagcctacaatggaacagtgcgcatctgggactttggaagtggccaggagatgaaggtgctgcctgagggcaaggactggaaggaggatgagcactgcctgcggcggctcatcttcctgaaggcccaggagaagcaccagcagctggtgctggccctggagagaaatggcaccatcaagatgatccagggcaaggaggatgacatctacctgatggtgatctgggagctgcctgatgtggtgcccttcctgcaggacggcaagcatgctgtgcacctgaggatgagcacccgggacaggaacatggccatccccttcccagatgtggagctgattgtggagaggaacttcagccagcccacagacaaccccaccatggacctgctgcgggtgaactgcatcgacctgctgcaggtggagggctacaacctgattgctgctggcaccctgaatggagtcatcatcctgtggaactttgtgaccagcacagtgaagaaggtgtacagacctgaggactgcttcaccgtgaacccagacctgcaccccaagcacttcaagatcaatgacatcctcttcctgttccgcaccccagaatgtgcccggcgcagcagccaggacagcatctgcagcagcagccagtgtgagagcagcaagggcccccagagcagcaagggcagcaagcagagcatccatgacagcgaggtgaagggggagcagacagatgtgatggtgggcaagcagcagcccatggacaagaagcaccctggcatcgccaacctgcctgaggcccagccccccatcctggtgacagcccatgaagatggccacctgcggctgtggaccctggagggccgcctgctgaaggacatgctgcccttcaccaagcacagcgccatcagcctgaccagcctgtacacagacagctgcacccgcatcctgctggccggaaatgtggagggccacgtgatcctgtgcaacatcagcagcttcctggacccccctcatgatgagaagaagttcaagcagctgctgtcctggagggcccacagcctggagatcatccaggtgatctacgtggaggagaagcaggtggtgctgacagccagcattgatggctctgtgcggctgtggcacgccctgaatggccactactgcggctacttcggccagaggcggctgtttgagctgagccagacccgggacttcatcctgccctgtgatgtgacagagtaccccatcgagatcaaggaggagagcaagttcacagagaagcagaagtatgagtaccccctcatctttgaccgggagaagtggaggaagatgagctctgtgtccctgctcttcaagaggaccccacccaaggcctttgaggtggagcaggacttcaagttcttcaagagcctgagcagccccaagatccgccgctaccccctggagggctttgtgacagaaaatcgggaggccggcatcgtgtttggcagcctgcccatctacagcatcagcagccccaccagcctgcgcttcctgcccctgattggagtggaggcccagaaggacagcagtgatggcatcaccgggaagaagaagggcggccacgtgcagcgggagaaggccccccggcggcgcagcctgaagaagaacctggtgccccagatcaacctggccagcagcttcttccctgccatccccaagtag

SEQ ID NO: 43609 - DNA, 2745 bp, Artificial Sequence
  Description of Artificial Sequence: Synthetic coding sequence
atggacatcaggaaggagaagaggctgaacatggccctgcagatgagcaacttcaagaaggccctgaacagatttgagaagctggtggagcagacagctgcccagaagagagatgaaagagctggcctcttcatccacaaggaggatgccatcggctatgacaagttctacgcctctgtgcagaagctgtttggaccagatgtgaagaaccaggatgtgaagcgcttctacaggaagctgtgcaacaacacagatgccagcgctgactggtgtgagatcttcggctacttcagcagcgaggaggaccccatcgccagccagctggatgaggagaacctggtgttctttgtgtccaggaagaggcgcatcctgatcagcggcagcagaagaagagatgtgatcaagagcatcgtgaagatcccccacctggacctgctgatcacagccacccagaagggcctcatcaccgtcttcaacaaccaggacacctcctggatcaccggctgtgactacctgctgcagctgaagagaattgtggccaccacagagaggaccatcatcgtgtgggactacaaggcccagggcagcagccaggagaactacttcgtcatcaagcccatggaccactgcctgctgtgtgtgtgtgtggtgcccctgcctgaccacctgtgcagagatgacatcctgctgggagatgatggcggctttgtgaaccgcttcaccgtgaacagtgatgactttggcatcaagcaggccaagagcaagaggaagctgcagaaccaggtgctggacagcaagaacttcaagtctgtgaagaggaagctgcacaatgactgggtgatgaagatccgctacatcagcgccctgaactgcttcggcagctgcagcctggacagcaaccacagcctggtgctggagagcctgaagaggctggaggacaacctgcctgtgcgggagttctccatgcccaggggggccaacaccttctgctactgtgtgaaggccaacgtcatcgtgactggaggagatgacaaggtgatccggctgtggcaccccaacatcagcaccaagcctgtgggcaagctggtgggccacatgttcagcattgctgagatcgtgaccaatgagaaggaccagcacgtggtgtccctgagcagcgccaaggtgttccgggtgtgggacatccagaccctgagcctgctgcaggtgttccatgacagccagggcggccctggggacatgcagatctacagcatgatctatgatgccaaccacggcatgctgatcaccggcagctctgtgatggacatgtaccccctgaccaggatgatccaggacaccaagcaggtgccccacacccatgagcgggagatcaacgtgatgctgtacaacaagtacttccaccaggtgctgaccatctgcagcgagagcatcatccgggtgtgggagctggagaccggcctgcaggtgtaccagatcctggagccccacggcttcaacacagaggtgaccagcgctgctgtggatgaaagtggcttcctgtttgccactggagcctacaatggaacagtgcgcatctgggactttggaagtggccaggagatgaaggtgctgcctgagggcaaggactggaaggaggatgagcactgcctgcggcggctcatcttcctgaaggcccaggagaagcaccagcagctggtgctggccctggagagaaatggcaccatcaagatgatccagggcaaggaggatgacatctacctgatggtgatctgggagctgcctgatgtggtgcccttcctgcaggacggcaagcatgctgtgcacctgaggatgagcacccgggacaggaacatggccatccccttcccagatgtggagctgattgtggagaggaacttcagccagcccacagacaaccccaccatggacctgctgcgggtgaactgcatcgacctgctgcaggtggagggctacaacctgattgctgctggcaccctgaatgaaggacatgtgatcctgtgcaacatcagcagcttcctggacccccctcatgatgagaagaagttcaagcagctgctgtcctggagggcccacagcctggagatcatccaggtgatctacgtggaggagaagcaggtggtgctgacagccagcattgatggctctgtgcggctgtggcacgccctgaatggccactactgcggctacttcggccagaggcggctgtttgagctgagccagacccgggacttcatcctgccctgtgatgtgacagagtaccccatcgagatcaaggaggagagcaagttcacagagaagcagaagtatgagtaccccctcatctttgaccgggagaagtggaggaagatgagctctgtgtccctgctcttcaagaggaccccacccaaggcctttgaggtggagcaggacttcaagttcttcaagagcctgagcagccccaagatccgccgctaccccctggagggctttgtgacagagaaccgggaggccggcatcgtgtttggcagcctgcccatctacagcatcagcagccccaccagcctgcgcttcctgcccctcatcggcgtggaggcccagaaggacagcagtgatggcatcaccgggaagaagaagggcggccacgtgcagcgggagaaggcccccaggagaagaagcctgaagaagaacctggtgccccagatcaacctggccagcagcttcttccctgccatccccaagtag

SEQ ID NO: 43610 - DNA, 3450 bp, Artificial Sequence
  Description of Artificial Sequence: Synthetic coding sequence
atgtctgatgctgctgaggccccccgggaggccaccggggagaatggagaaacagagatgaaggaggaggaggagcccaaccccaactacaaggaggtggaggacccccagcaggagagcaaggatgacaccatcgcctggagggagagccaggaggaggagaggaagacaggagaggaggagggggaggaggagggcaaggaggacaagaagatcgtgatggaggagacagaggagaaggccggggaggtgcaggagaaggaggccagcggcatccaggaggagaccaccgtggagccccaggaggtgacagcctccatgatccggctggagacccagatcacagacagccagagcatcaccagcggcatcttccccaagacccagaggggcagcaagagcaagctgagcctgcagctggaggatgctgagacagatgagctgctgcgggacctgagcacccagatcgagttcctggacctggaccagatcagccctgaggagcagcagatcagcagccctgagcggcagcccagcggggagctggaggagaagacagacaggatgccccaggatgagctgggccaggagcggcgggacctggagcctgagaaccgggaggagggccaggagcggcgggtgtctgacatccagagcaaggccggcatcagccgggagagcctggtgagcagcaccacagaggacatcctcttccagaaggacaagagcacccctgtgtaccccctgaccatgacctggagctttggctggaacagcagcctgcctgtgtactacatccgggaggagcggcagagggtgctgctgtatgtgtgtgcccacacagccatcatctacaacgtgttcaggaacaaccagtaccacctgcagggccacgccaacatcatcagctgcctgtgtgtgtctgaagatcggcgctggatcgccacagctgacaagggccctgactgcctggtgatcatctgggacagcttcaccggcatccctgtgcacaccatctttgacagctgcccagagggcaatggcatcatggccatggccatgacccatgatgccaagtacctggccaccatcagtgatgctgaggtgcagaaggtgtgcatctggaagtggaccctggccgtggagaccccagcctgcaccctggagctgcccacagaatatggagtgcagaactacgtgaccttcaaccccaccaacaacaaggagctggtgagcaacagcaagacccgggccatctactatgcctggtatgaggagcgggacaccctggcccacagcgcccccctgctgacagagaagaccttcaacaagctggtgggcaagttcagccagagcatcttccacctgaacctgacccagatcctgagcgccaccatggagggcaagctggtggtgtgggacatccaccggccccccagcagcgccagcaccttcctgggcttcccctacatcaagccctgcaagctggtgcacctgcagaaggagggcatcaccgtgctgaccaccatcgacagctacatcgtgactggagacatcaagggcaacatcaagttctatgaccacaccctgagcatcgtgaactggtacagccacctgaagctgggcgccatccgcaccctgtccttcagcaagaccccagccaccccacccacagagaagagcaactaccccccagactgcaccctgaagggggacctgtttgtgctgaggaacttcatcatcggcaccagtgatgctgctgtgtaccacctgaccacagatggcaccaagctggagaagctgtttgtggagcccaaggatgccatctgtgccatcagctgccacccctaccagcccctgattgccatcggcagcatctgtggcatgatcaaggtgtggaactatgagaacaagcagtacctgttcagccgggtgtttgagaagggcctgggcgtgcagagcctgacctacaaccctgagggcgccctgctgggcgccggcttcacagagggcaccgtgtacatcctggatgccatgagcctggagaatgaaagccctgagcccttcaagtacagcaggacctctgtgacccacatctccttcagccatgacagccagtacatggccacagctgacaggagcttcaccgtggccgtgtacatgctggtggtgagaaatggccagagggtgtgggagtacctggcccggctgcggagccacaggaagagcatccgcagcctgctgtttggagtgtacctggacagcaatgagccccggctgctgagcctgggcacagaccggctgctgattgaatatgacctgctgcggagctacaaggaccacctggaggtgctggacatccaccacacagaccagggctgctaccccacctgcatggtgtggtacccacccctgacccgggagctgttcctgctgatctgcaacagcggctacaaggtgaagctgttcaatgccaccaccaagatgtgcaggaagaccctgctgggccctgcctacggcagccccatcgagcagacccaggtgctgcctgtgcgctccatggccgagctgcagaagcgctacctggtgttcatcaacagagacaaggtgggcctgcagatcctgcctgtggatggcaacccccacaagaccagcgccatcgtgtgccaccccaacggggtggccggcatggctgtgtcctatgatggctgctacgccttcaccgctgggggccatgacagatctgtggtgcagtggaagatcaccctgtctgtgctggaggccgctgtgtccctgggcggggaggacctgacccccttctacggcctgctgagcggcggccgggagggcaagttctaccgggagctggaggactacttctactacagccagctgcggagccagggcatcgacaccatggagaccaggaaggtgtctgagcacatctgcctgtctgagctgccctttgtgatgagggccatcggcttctaccccagcgaggagaagattgatgacatcttcaatgagatcaagtttggagaatatgtggacaccgggaagctgattgacaagatcaacctgcctgacttcctgaaggtgtacctgaaccacaagcccccatttggaaacaccatgagcggcatccacaagagctttgaggtgctgggctacaccaacagcaagggcaagaaggccatcagaagagaggacttcctgcggctgctggtgaccaagggggagcacatgacagaggaggagatgctggactgctttgccagcctgtttggcctgaaccctgagggctggaagtctgagcccgccacctgcagcgtgaagggcagcgagatctgcctggaggaggagctgcctgatgagatcacagctgagatctttgccacagagatcctgggcctgaccatcagcgaggacagcggccaggacggccagtag

SEQ ID NO: 43611 - DNA, 2826 bp, Artificial Sequence
  Description of Artificial Sequence: Synthetic coding sequence
atgtctgatgctgctgaggccccccgggaggccaccggggagaatggagaaacagagatgaaggaggaggaggagcccaaccccaactacaaggaggtggaggacccccagcaggagagcaaggatgacaccatcgcctggagggagagccaggaggaggagaggaagacaggagaggaggagggggaggaggagggcaaggaggacaagaagatcgtgatggaggagacagaggagaaggccggggaggtgcaggagaaggaggccagcggcatccaggaggagaccaccgtggagccccaggaggtgacagcctccatgatccggctggagacccagatcacagacagccagagcatcaccagcggcatcttccccaagacccagaggggcagcaagagcaagctgagcctgcagctggaggatgctgagacagatgagctgctgcgggacctgagcacccagatcgagttcctggacctggaccagatcagccctgaggagcagcagatcagcagccctgagcggcagcccagcggggagctggaggagaagacagacaggatgccccaggatgagctgggccaggagcggcgggacctggagcctgagaaccgggaggagggccaggagcggcgggtgtctgacatccagagcaaggccggcatcagccgggagagcctggtgagcagcaccacagaggacatcctcttccagaaggacaagagcacccctgtgtaccccctgaccatgacctggagctttggctggaacagcagcctgcctgtgtactacatccgggaggagcggcagagggtgctgctgtatgtgtgtgcccacacagccatcatctacaacgtgttcaggaacaaccagtaccacctgcagggccacgccaacatcatcagctgcctgtgtgtgtctgaagatcggcgctggatcgccacagctgacaagggccctgactgcctggtgatcatctgggacagcttcaccggcatccctgtgcacaccatctttgacagctgcccagagggcaatggcatcatggccatggccatgacccatgatgccaagtacctggccaccatcagtgatgctgaggtgcagaaggtgtgcatctggaagtggaccctggccgtggagaccccagcctgcaccctggagctgcccacagaatatggagtgcagaactacgtgaccttcaaccccaccaacaacaaggagctggtgagcaacagcaagacccgggccatctactatgcctggtatgaggagcgggacaccctggcccacagcgcccccctgctgacagagaagaccttcaacaagctggtgggcaagttcagccagagcatcttccacctgaacctgacccagatcctgagcgccaccatggagggcaagctggtggtgtgggacatccaccggccccccagcagcgccagcaccttcctgggcttcccctacatcaagccctgcaagctggtgcacctgcagaaggagggcatcaccgtgctgaccaccatcgacagctacatcgtgactggagacatcaagggcaacatcaagttctatgaccacaccctgagcatcgtgaactggtacagccacctgaagctgggcgccatccgcaccctgtccttcagcaagaccccagccaccccacccacagagaagagcaactaccccccagactgcaccctgaagggggacctgtttgtgctgaggaacttcatcatcggcaccagtgatgctgctgtgtaccacctgaccacagatggcaccaagctggagaagctgtttgtggagcccaaggatgccatctgtgccatcagctgccacccctaccagcccctgattgccatcggcagcatctgtggcatgatcaaggtgtggaactatgagaacaagcagtacctgttcagccgggtgtttgagaagggcctgggcgtgcagagcctgacctacaaccctgagggcgccctgctgggcgccggcttcacagagggcaccgtgtacatcctggatgccatgagcctggagaatgaaagccctgagcccttcaagtacagcaggacctctgtgacccacatctccttcagccatgacagccagtacatggccacagctgacaggagcttcaccgtggccgtgtacatgctggtggtgagaaatggccagagggtgtgggagtacctggcccggctgcggagccacaggaagagcatccgcagcctgctgtttggagtgtacctggacagcaatgagccccggctgctgagcctgggcacagaccggctgctgattgaatatgacctgctgcggagctacaaggaccacctggaggtgctggacatccaccacacagaccagggctgctaccccacctgcatggtgtggtacccacccctgacccgggagctgttcctgctgatctgcaacagcggctacaaggtgaagctgttcaatgccaccaccaagatgtgcaggaagaccctgctgggccctgcctacggcagccccatcgagcagacccaggtgctgcctgtgcgctccatggccgagctgcagaagcgctacctggtgttcatcaacagagacaaggtgggcctgcagatcctgcctgtggatggcaacccccacaagaccagcgccatcgtgtgccaccccaacggggtggccggcatggctgtgtcctatgatggctgctacgccttcaccgctgggggccatgacagatctgtggtgcagtggaagatcaccctgagccaccctggcagccaggcccccatcctgagccccagcgacaccagccgctcctag

SEQ ID NO: 43612 - DNA, 1248 bp, Artificial Sequence
  Description of Artificial Sequence: Synthetic coding sequence
atgaagctgaagagcctgctgctgcgctactacccacctggcatcatgctggagtatgagaagcacggggagctgaagaccaagagcattgacctgctggacctgggccccagcacagatgtgtctgccctggtggaggagatccagaaggccgagcccctgctgacagccagcaggacagagcaggtgaagctgctgatccagaggctgcaggagaagctgggccagaacagcaaccacaccttctacctgttcaaggtgctgaaggcccacatcctgcccctgaccaacgtggccctgaacaagagcggcagctgcttcatcaccggcagctatgacaggacctgcaagctgtgggacacagccagcggggaggagctgaacaccctggagggccacagaaatgtggtgtatgccatcgccttcaacaacccctacggggacaagatcgccaccggcagctttgacaagacctgcaagctgtggagcgtggagaccgggaagtgctaccacaccttccggggccacacagctgagatcgtgtgcctgtccttcaacccccagagcaccctggtggccaccggctccatggacaccacagccaagctgtgggacatccagaatggagaggaggtgtacaccctgcggggccacagcgctgagatcatcagcctgtccttcaacaccagcggggaccgcatcatcaccggcagctttgaccacacagtggtggtgtgggatgctgacaccggcaggaaggtgaacatcctgattggccactgtgccgagatcagcagcgccagcttcaactgggactgcagcctcatcctgaccggctccatggacaagacctgcaagctgtgggatgccaccaacgggaaatgtgtggccaccctgaccggccatgatgatgagatcctggacagctgctttgactacaccgggaagctgattgccacagccagcgcagatggaacagcccgcatcttctctgctgccaccaggaagtgcatcgccaagctggagggccacgagggggagatcagcaagatctccttcaacccccagggcaaccacctgctgaccggcagcagtgacaagacagcccgcatctgggatgcccagacaggccagtgcctgcaggtgctggagggccacacagatgagatcttcagctgtgccttcaactacaagggcaacatcgtcatcaccggcagcaaggacaacacctgccgcatctggaggtag

SEQ ID NO: 43613 - DNA, 1203 bp, Artificial Sequence
  Description of Artificial Sequence: Synthetic coding sequence
atgctggagtatgagaagcatggagagctgaagaccaagagcattgacctgctggacctgggccccagcacagatgtgtctgccctggtggaggagatccagaaggccgagcccctgctgacagccagcaggacagagcaggtgaagctgctgatccagaggctgcaggagaagctgggccagaacagcaaccacaccttctacctgttcaaggtgctgaaggcccacatcctgcccctgaccaacgtggccctgaacaagagcggcagctgcttcatcaccggcagctatgacaggacctgcaagctgtgggacacagccagcggggaggagctgaacaccctggagggccacagaaatgtggtgtatgccatcgccttcaacaacccctatggagacaagatcgccaccggcagctttgacaagacctgcaagctgtggagcgtggagaccgggaagtgctaccacaccttccggggccacacagctgagatcgtgtgcctgtccttcaacccccagagcaccctggtggccaccggctccatggacaccacagccaagctgtgggacatccagaatggagaggaggtgtacaccctgcggggccacagcgctgagatcatcagcctgtccttcaacaccagcggggaccgcatcatcaccggcagctttgaccacacagtggtggtgtgggatgctgacaccggcaggaaggtgaacatcctgattggccactgtgccgagatcagcagcgccagcttcaactgggactgcagcctcatcctgaccggctccatggacaagacctgcaagctgtgggatgccaccaatggaaaatgtgtggccaccctgactggacatgatgatgagatcctggacagctgctttgactacacaggcaagctgattgccacagccagcgcagatggaacagcccgcatcttctctgctgccaccaggaaatgtattgccaagctggagggccatgaaggagagatcagcaagatctccttcaacccccagggcaaccacctgctgaccggcagcagtgacaagacagcccgcatctgggatgcccagacaggccagtgcctgcaggtgctggagggccacacagatgagatcttcagctgtgccttcaactacaagggcaacatcgtcatcaccggcagcaaggacaacacctgccgcatctggaggtag

SEQ ID NO: 43614 - DNA, 1965 bp, Artificial Sequence
  Description of Artificial Sequence: Synthetic coding sequence
atggagaggagcggccccagcgaggtgacaggcagtgatgccagcggccctgacccccagctggccgtgaccatgggcttcaccggctttgggaagaaggcccggacctttgacctggaggccatgtttgagcagaccaggagaacagctgtggagaggagcaggaagaccctggaggcccgggagaaggaggaggagatgaaccgggagaaggagctgcggcggcagaatgaagacatcgagcccaccagcagccgcagcaatgtggtgcgggactgcagcaagagcagcagccgggacaccagcagcagcgagagcgagcagagcagtgacagcagtgatgatgagctgattggcccccccctgccccccaagatggtgggcaagcctgtgaacttcatggaggaggacatcctgggccccctgcccccacccctgaatgaggaggaggaggaggccgaggaggaggaggaggaggaggaggaggaggagaaccctgtgcacaagatcccagacagccatgagatcaccctgaagcacggcaccaagacagtgtctgccctgggcctggaccccagcggggcccggctggtgactggaggctatgactatgatgtgaagttctgggactttgctggcatggatgccagcttcaaggccttccgcagcctgcagccctgtgagtgccaccagatcaagagcctgcagtacagcaacacaggagacatgatcctggtggtgtctggcagcagccaggccaaggtgattgacagagatggctttgaggtgatggagtgcatcaagggggaccagtacatcgtggacatggccaacaccaagggccacacagccatgctgcacacaggctcctggcaccccaagatcaagggggagttcatgacctgcagcaatgatgccaccgtgaggacctgggaggtggagaaccccaagaagcagaagtctgtgttcaagcccaggaccatgcagggcaagaaggtgatccccaccacctgcacctacagcagagatggcaacctgattgctgctgcctgccagaatggcagcatccagatctgggacaggaacctgactgtgcaccccaagttccactacaagcaggcccatgattctggaacagacaccagctgtgtgaccttctcctatgatggaaatgtgctggccagcagaggaggagatgacagcctgaagctgtgggacatccggcagttcaacaagcccctcttcagcgccagcggcctgcccaccatgttccccatgacagactgctgcttctccccagatgacaagctgattgtgacaggcaccagcatccagaggggctgcggcagcggcaagctggtgttctttgagaggaggaccttccagagggtgtatgaaattgacatcacagatgcctctgtggtgcgctgcctgtggcaccccaagctgaaccagatcatggtgggcactggaaatggcctggccaaggtgtactatgaccccaacaagagccagagaggagccaagctgtgtgtggtgaagacccagaggaaggccaagcaggccgagaccctgacccaggactacatcatcaccccccacgccctgcccatgttccgggagccccggcagaggagcaccaggaagcagctggagaaggaccggctggaccccctgaagagccacaagccagagccccctgtggccggccctggccggggcggccgggtgggcacccacggcggcaccctgagcagctacatcgtgaagaacatcgccctggacaagacagatgacagcaacccccgggaggccatcctgcggcatgccaaggctgctgaggacagcccctactgggtgtccccagcctacagcaagacccagcccaagaccatgtttgcccaggtggagagtgatgatgaggaggccaagaatgaacctgagtggaagaagaggaagatctag

SEQ ID NO: 43615 - DNA, 1137 bp, Artificial Sequence
  Description of Artificial Sequence: Synthetic coding sequence
atggaccctggagatgactggctggtggagagcctgcggctgtaccaggacttctacgcctttgacctgagcggggccaccagggtgctggagtggattgatgacaagggcgtgtttgtggccggctatgagagcctgaagaagaatgagatcctgcacctgaagctgcccctgcggctgtctgtgaaggagaacaagggcctcttccctgagcgggacttcaaggtgcgccacggcggcttcagtgacaggagcatctttgacctgaagcacgtgccccacacccggctgctggtgaccagcggcctgcccggctgctacctgcaggtgtggcaggtggctgaagattctgatgtgatcaaggctgtgtccaccatcgctgtgcatgagaaggaggagagcctgtggccccgggtggccgtgttcagcaccctggcccctggggtgctgcatggagcccggctgcggagcctgcaggtggtggacctggagagcaggaagaccacctacaccagtgatgtgtctgattctgaggagctgagcagcctgcaggtgctggatgctgacacctttgccttctgctgtgccagcggccgcctgggcctggtggacacccggcagaagtgggcccccctggagaacagaagccctggccctggcagcggcggggagcgctggtgtgccgaggtgggctcctggggccagggccctggccccagcatcgccagcctgggcagtgatggccgcctgtgcctgctggacccccgggacctgtgccaccctgtgtcctctgtgcagtgccctgtgtctgtgcccagcccagaccctgagctgctgcgggtgacctgggcccctggcctgaagaactgcctggccatcagcggctttgatggcaccgtgcaggtgtatgatgccacctcctgggatggcaccaggagccaggacggcaccaggagccaggtggagcccctcttcacccaccggggccacatcttcctggatggaaatggcatggaccctgcccccctggtgaccacccacacctggcacccctgccggcccaggaccctgctgagcgccaccaatgatgccagcctgcacgtgtgggactgggtggacctgtgtgcccccaggtag

SEQ ID NO: 43616 - DNA, 1881 bp, Artificial Sequence
  Description of Artificial Sequence: Synthetic coding sequence
atgagccgcagcggggctgctgctgagaaggctgacagccggcagaggccccagatgaaggtgaatgagtacaaggagaaccagaacatcgcctacgtgtccctgcggcctgcccagaccaccgtgctgatcaagacagccaaggtgtacctggcccccttcagcctgagcaactaccagctggaccagctgatgtgccccaagagcctgtctgagaagaacagcaacaatgaggtggcctgcaagaagaccaagatcaagaagacctgccgccgcatcatcccccccaagatgaagaacaccagcagcaaggccgagagcaccctgcagaacagcagcagcgctgtgcacacagagagcaacaagctgcagcccaagaggacagcagatgccatgaacctgtctgtggatgtggagagcagccaggatggagacagtgatgaggacaccacccccagcctggacttcagcggcctgagcccctatgaaaggaagaggctgaagaacatcagtgaaaatgctgacttctttgccagcctgcagctgtctgagagcgctgcccggctgcgggagatgattgagaagaggcagccccccaagagcaagaggaagaagcccaagagagaaaatggcatcggctgcagaagatccatgaggctgctgaaggtggaccccagcggcgtgtccctgcctgctgcccccaccccacccaccctggtggctgatgagacccccctgctgcccccaggccccctggagatgaccagcgagaaccaggaggacaacaatgaacgcttcaagggcttcctgcacacctgggccggcatgagcaagcccagcagcaagaacacagagaagggcctgagcagcatcaagagctacaaggccaacctgaatggcatggtgatcagtgaagatactgtgtacaaggtgaccaccggccccatcttctccatggccctgcaccccagcgagaccaggaccctggtggccgtgggcgccaagtttggccaggtgggcctgtgtgacctgacccagcagcccaaggaggatggagtgtatgtgttccacccccacagccagcctgtgtcctgcctgtacttcagccctgccaacccagcccacatcctgagcctgtcctatgatggcaccctgcgctgtggggacttcagccgggccatctttgaggaggtgtacagaaatgaaagaagcagcttcagcagctttgacttcctggccgaggatgccagcaccctcatcgtgggccactgggatggcaacatgagcctggtggacaggaggaccccaggcaccagctatgagaagctgaccagcagctccatgggcaagatcagaacagtgcacgtgcaccctgtgcaccggcagtacttcatcacagctggcctgcgggacacccacatctatgatgcccggcggctgaacagcagaagaagccagcccctcatcagcctgacagagcacaccaagagcatcgccagcgcctacttcagccccctgactggaaacagagtggtgaccacctgtgccgactgcaacctgcgcatctttgacagcagctgcatcagcagcaagatccccctgctgaccaccatccgccacaacaccttcaccggccgctggctgacccgcttccaggccatgtgggaccccaagcaggaggactgtgtgattgtgggctccatggcccacccccggcgggtggagatcttccacgagaccgggaagagggtgcacagctttggaggagagtacctggtgtctgtgtgcagcatcaatgccatgcaccccacccgctacatcctggccggcggcaacagcagcggcaagatccacgtgttcatgaatgagaagagctgctag

SEQ ID NO: 43617 - DNA, 1689 bp, Artificial Sequence
  Description of Artificial Sequence: Synthetic coding sequence
atgtgccccaagagcctgtctgagaagaacagcaacaatgaggtggcctgcaagaagaccaagatcaagaagacctgccgccgcatcatcccccccaagatgaagaacaccagcagcaaggccgagagcaccctgcagaacagcagcagcgctgtgcacacagagagcaacaagctgcagcccaagaggacagcagatgccatgaacctgtctgtggatgtggagagcagccaggatggagacagtgatgaggacaccacccccagcctggacttcagcggcctgagcccctatgaaaggaagaggctgaagaacatcagtgaaaatgctgacttctttgccagcctgcagctgtctgagagcgctgcccggctgcgggagatgattgagaagaggcagccccccaagagcaagaggaagaagcccaagagagaaaatggcatcggctgcagaagatccatgaggctgctgaaggtggaccccagcggcgtgtccctgcctgctgcccccaccccacccaccctggtggctgatgagacccccctgctgcccccaggccccctggagatgaccagcgagaaccaggaggacaacaatgaacgcttcaagggcttcctgcacacctgggccggcatgagcaagcccagcagcaagaacacagagaagggcctgagcagcatcaagagctacaaggccaacctgaatggcatggtgatcagtgaagatactgtgtacaaggtgaccaccggccccatcttctccatggccctgcaccccagcgagaccaggaccctggtggccgtgggcgccaagtttggccaggtgggcctgtgtgacctgacccagcagcccaaggaggatggagtgtatgtgttccacccccacagccagcctgtgtcctgcctgtacttcagccctgccaacccagcccacatcctgagcctgtcctatgatggcaccctgcgctgtggggacttcagccgggccatctttgaggaggtgtacagaaatgaaagaagcagcttcagcagctttgacttcctggccgaggatgccagcaccctcatcgtgggccactgggatggcaacatgagcctggtggacaggaggaccccaggcaccagctatgagaagctgaccagcagctccatgggcaagatcagaacagtgcacgtgcaccctgtgcaccggcagtacttcatcacagctggcctgcgggacacccacatctatgatgcccggcggctgaacagcagaagaagccagcccctcatcagcctgacagagcacaccaagagcatcgccagcgcctacttcagccccctgactggaaacagagtggtgaccacctgtgccgactgcaacctgcgcatctttgacagcagctgcatcagcagcaagatccccctgctgaccaccatccgccacaacaccttcaccggccgctggctgacccgcttccaggccatgtgggaccccaagcaggaggactgtgtgattgtgggctccatggcccacccccggcgggtggagatcttccacgagaccgggaagagggtgcacagctttggaggagagtacctggtgtctgtgtgcagcatcaatgccatgcaccccacccgctacatcctggccggcggcaacagcagcggcaagatccacgtgttcatgaatgagaagagctgctag

SEQ ID NO: 43618 - DNA, 1638 bp, Artificial Sequence
  Description of Artificial Sequence: Synthetic coding sequence
atgaccccaggcaagcacagcggggccagcgcccgggccgccaatggaggagcctggggctacagagacttccggggcggccagaagaagggctggtgcaccaccccccagctggtggccaccatgcctgtgtccccagctggcagccacaagcagcagaactttggcctgaacaatgccacccagcccaagaagagcatctccttctttgccaccatgaaggccacctctgtgaagggctacaccggggccaaccagagcaggatggctgtgtccaagacagtgctgatccccccagagctgaagacagtggagaagcccaaccccaacatcaagaccacccaggtgtttgacatcaatggaacagatgtgaccccccggcccctgtaccacccagaccccctgaccggcacagccaagcccagcaagctgctgaccagccaggagggcagcctgggcagcgagttcatcagcagctacagcctgtaccagaacaccatcaaccccagcaccctgggccagttcaccaggtctgtgctgggcagcagcacagtgtccaagagctctgtgtctgccagcgagagcattgctgaggacctggaggagcccagctacaagcgggagcggctgaccagcttcacagacctgcaggtgatccgggccgcccctgagaagatcgtgaccaaggaggacctggagaagaacatcgagatcatcctgacagaaacagagaccctgcgcttctttgacctgcccaccgtgatggtgtctgtggagagcgaggaggccgagaaggtgacccagaggaacaagaactatgaggtgctgtgcaggaaccggctgggcaatgacctgtatgtggagaggatgatgcagaccttcaatggagcccccaagaacaaggatgtgcagtgtgacaagatcatcatggaggacaagggcatcatgagcacagcctgggacctgtatgacagctacaatgccatggagctggtgtccctgtctgtgaagcagagcgtggtggagagcagcagcaaggccaacgtgctgcccaaggaccaggaccagaggctgcccggcagcaccacagagaagaacagcgagaccagcagcctgatggacattgaaaatgtcatcctggccaagatccatgaagatgaggaggaccacagtgatgccatcctgaagagtgacaagttccaccaggacctcttcttcatggagcgggtgctgatggagaacatcttccagcccaagctggccgcctaccggcagctgcctgtgctgaaggagcctgagcctgaggagccagaagatgtgctggagagcgccaagcatgaggaggtggaggaggagagcaagaaggaggaggaggaggagatccatgctgaggagagcaccatcccagccaacctggagcggctgtggagcttcagctgtgacctgaccaagggcctgaatgtgagcagcctggcctggaacaagaccaacccagacctgctggccgtgggctacggccacttcggcttcaaggagcagaagaggggcctggcctgctgctggagcatcaagaaccccatggtgacccagacccgcatccgcagcatcttcatctggctgctgaccaagttctcctag

SEQ ID NO: 43619 - DNA, 2547 bp, Artificial Sequence
  Description of Artificial Sequence: Synthetic coding sequence
atgaccccaggcaagcacagcggggccagcgcccgggccgccaatggaggagcctggggctacagagacttccggggcggccagaagaagggctggtgcaccaccccccagctggtggccaccatgcctgtgtccccagctggcagccacaagcagcagaactttggcctgaacaatgccacccagcccaagaagagcatctccttctttgccaccatgaaggccacctctgtgaagggctacaccggggccaaccagagcaggatggctgtgtccaagacagtgctgatccccccagagctgaagacagtggagaagcccaaccccaacatcaagaccacccaggtgtttgacatcaatggaacagatgtgaccccccggcccctgtaccacccagaccccctgaccggcacagccaagcccagcaagctgctgaccagccaggagggcagcctgggcagcgagttcatcagcagctacagcctgtaccagaacaccatcaaccccagcaccctgggccagttcaccaggtctgtgctgggcagcagcacagtgtccaagagctctgtgtctgccagcgagagcattgctgaggacctggaggagcccagctacaagcgggagcggctgaccagcttcacagacctgcaggtgatccgggccgcccctgagaagatcgtgaccaaggaggacctggagaagaacatcgagatcatcctgacagaaacagagaccctgcgcttctttgacctgcccaccgtgatggtgtctgtggagagcgaggaggccgagaaggtgacccagaggaacaagaactatgaggtgctgtgcaggaaccggctgggcaatgacctgtatgtggagaggatgatgcagaccttcaatggagcccccaagaacaaggatgtgcagtgtgacaagatcatcatggaggacaagggcatcatgagcacagcctgggacctgtatgacagctacaatgccatggagctggtgtccctgtctgtgaagcagagcgtggtggagagcagcagcaaggccaacgtgctgcccaaggaccaggaccagaggctgcccggcagcaccacagagaagaacagcgagaccagcagcctgatggacattgaaaatgtcatcctggccaagatccatgaagatgaggaggaccacagtgatgccatcctgaagagtgacaagttccaccaggacctcttcttcatggagcgggtgctgatggagaacatcttccagcccaagctggccgcctaccggcagctgcctgtgctgaaggagcctgagcctgaggagccagaagatgtgctggagagcgccaagcatgaggaggtggaggaggagagcaagaaggaggaggaggaggagatccatgctgaggagagcaccatcccagccaacctggagcggctgtggagcttcagctgtgacctgaccaagggcctgaatgtgagcagcctggcctggaacaagaccaacccagacctgctggccgtgggctacggccacttcggcttcaaggagcagaagaggggcctggcctgctgctggagcatcaagaaccccatgtggccagagcgcatctaccagagcccctatggagtgacagctgtggacttcagcatcggggcccccaacctgctggccgtgggctaccacaacggcaccatcgccatctacaacgtgcgcagcaacagcaatgtgcctgtgctggacagcagcgagagcccccagaagcacctgggccctgtgtggcagctgcagtggattgagcaggaccggggcaccactggagatggcaagcgggagatcctggtgtccatctctgcagatggccgcatcagcaagtgggtgatcaggaagggcctggactgctatgacctgatgaggctgaagaggaccacagctgccagcaacaagaagggcggggagaaggagaagaaggatgaggccctgatcagccggcaggcccctggcatgtgctttgccttccaccccaaggacaccaacatctacctggccggcacagaggagggccacatccacaagtgcagctgcagctacaatgagcagtacctggacacctaccggggccacaagggccctgtgtacaaggtgacctggaaccccttctgccatgatgtgttcctgagctgcagcgctgactggggcgtcatcatctggcagcaggagaatgtgaagcccagcctgtccttctacccagccacctctgtggtgtatgatgtggcctggagccccaagagcagctacatctttgctgctgccaatgaaaatagagtggagatctgggacctgcacatcagcaccctggaccccctgattgtgaacacagccaaccctggcatcaagttcaccaccatcctgtttgccaagcagacagactgcctgctggtgggggacagtgatggccaggtgtctgtgtatgagctgaggaacatgcccaccgtgctggagaccggccgcggggacatcatggacaccctgctgggcagcaagagcaaccagagcgcctag

SEQ ID NO: 43620 - DNA, 1686 bp, Artificial Sequence
  Description of Artificial Sequence: Synthetic coding sequence
atggtgtctgtggagagcgaggaggccgagaaggtgacccagaggaacaagaactatgaggtgctgtgcaggaaccggctgggcaatgacctgtatgtggagaggatgatgcagaccttcaatggagcccccaagaacaaggatgtgcagtgtgacaagatcatcatggaggacaagggcatcatgagcacagcctgggacctgtatgacagctacaatgccatggagctggtgtccctgtctgtgaagcagagcgtggtggagagcagcagcaaggccaacgtgctgcccaaggaccaggaccagaggctgcccggcagcaccacagagaagaacagcgagaccagcagcctgatggacattgaaaatgtcatcctggccaagatccatgaagatgaggaggaccacagtgatgccatcctgaagagtgacaagttccaccaggacctcttcttcatggagcgggtgctgatggagaacatcttccagcccaagctggccgcctaccggcagctgcctgtgctgaaggagcctgagcctgaggagccagaagatgtgctggagagcgccaagcatgaggaggtggaggaggagagcaagaaggaggaggaggaggagatccatgctgaggagagcaccatcccagccaacctggagcggctgtggagcttcagctgtgacctgaccaagggcctgaatgtgagcagcctggcctggaacaagaccaacccagacctgctggccgtgggctacggccacttcggcttcaaggagcagaagaggggcctggcctgctgctggagcatcaagaaccccatgtggccagagcgcatctaccagagcccctatggagtgacagctgtggacttcagcatcggggcccccaacctgctggccgtgggctaccacaacggcaccatcgccatctacaacgtgcgcagcaacagcaatgtgcctgtgctggacagcagcgagagcccccagaagcacctgggccctgtgtggcagctgcagtggattgagcaggaccggggcaccactggagatggcaagcgggagatcctggtgtccatctctgcagatggccgcatcagcaagtgggtgatcaggaagggcctggactgctatgacctgatgaggctgaagaggaccacagctgccagcaacaagaagggcggggagaaggagaagaaggatgaggccctgatcagccggcaggcccctggcatgtgctttgccttccaccccaagggccctgtgtacaaggtgacctggaaccccttctgccatgatgtgttcctgagctgcagcgctgactggggcgtcatcatctggcagcaggagaatgtgaagcccagcctgtccttctacccagccacctctgtggtgtatgatgtggcctggagccccaagagcagctacatctttgctgctgccaatgaaaatagagtggagatctgggacctgcacatcagcaccctggaccccctcatcgtgaacacagccaaccctggcatcaagttcaccaccatcctgtttgccaagcagacagactgcctgctggtgggggacagtgatggccaggtgtctgtgtatgagctgaggaacatgcccaccgtgctggagaccggccgcggggacatcatggacaccctgctgggcagcaagagcaaccagagcgcctag

SEQ ID NO: 43621 - DNA, 2673 bp, Artificial Sequence
  Description of Artificial Sequence: Synthetic coding sequence
atggatggagagcccccagccagcagcggcctgggcctgcctgactacaccagcggcgtgtccttccatgaccaggccgacctgcctgagacagaggacttccaggccggcctgtatgtgacagagagcccccagccccaggaggccgaggccgtgtccctgggccgcctgagtgacaagagcagcaccagcgagaccagcctgggggaggagcgggccccagatgaaggaggagcccctgtggacaagagcagcctgcggagcggggacagcagccaggacctgaagcagagcgagggcagcgaggaggaggaggaggaggaggacagctgtgtggtgctggaggaggaggagggggagcaggaggaggtgactggagccagcgagctgaccctgagtgacacagtgctgtccatggagaccgtggtggccggcggcagcggaggagatggagaggaggaggaggaggccctgcctgagcagagcgagggcaaggagcagaagatcctgctggacacagcctgcaagatggtgcgctggctgagcgccaagctgggccccaccgtggccagcagacatgtggccaggaacctgctgcggctgctgaccagctgctacgtgggccccacccggcagcagttcaccgtgagcagcggggagagcccccccctgtctgctggcaacatctaccagaagaggcctgtgctgggggacatcgtgtctggccctgtgctgagctgcctgctgcacatcgcccggctgtatggagagcctgtgctgacctaccagtacctgccctacatctcctacctggtggcccctggcagcgccagcggccccagccggctgaacagcaggaaggaggccggcctgctggccgctgtgaccctgacccagaagatcatcgtgtacctgagtgacaccaccctgatggacatcctgccccgcatcagccatgaggtgctgctgcctgtgctgtccttcctgaccagcctggtgacaggcttccccagcggggcccaggcccggaccatcctgtgtgtgaagaccatcagcctcatcgccctgatctgcctgagaattggccaggagatggtgcagcagcacctgtctgagcctgtggccaccttcttccaggtgttcagccagctgcacgagctgcggcagcaggacctgaagctggaccctgctggccgcggggagggccagctgccccaggtggtgttcagtgatggccagcagaggcctgtggaccctgccctgctggatgagctgcagaaggtgttcaccctggagatggcctacaccatctacgtgcccttcagctgcctgctgggggacatcatcaggaagatcatccccaaccacgagctggtgggggagctggccgccctgtacctggagagcatcagccccagcagcagaaatcctgcctctgtggagcccaccatgcctggcactggacctgagtgggacccccacggcggcggctgcccccaggatgatggccacagcggcaccttcggctctgtgctggtgggcaaccgcatccagatccccaatgacagcaggcctgagaaccctggccccctgggccccatctctggagtgggcggcggcggcctgggcagcggcagtgatgacaatgccctgaagcaggagctgcccaggtctgtgcacggcctgagcggcaactggctggcctactggcagtatgaaattggagtgtcccagcaggatgcccacttccacttccaccagatccggctgcagagcttccctggccacagcggggctgtgaagtgtgtggcccccctgagcagcgaggacttcttcctgagcggcagcaaggacagaacagtgcggctgtggcccctgtacaactatggagatggcaccagcgagacagccccccggctggtgtacacccagcacaggaagagcgtcttctttgtgggccagctggaggccccccagcacgtggtgtcctgtgatggagctgtgcacgtgtgggaccccttcaccgggaagaccctgaggacagtggagcccctggacagccgggtgcccctgacagctgtggccgtgatgcctgccccccacaccagcatcaccatggccagcagtgacagcaccctgcgctttgtggactgcaggaagccaggcctgcagcacgagttccggctgggcggcggcctgaaccctggcctggtgcgggccctggccatcagccccagcggccgctctgtggtggccggcttcagcagcggcttcatggtgctgctggacaccaggacaggcctggtgctgcggggctggccagcccacgagggggacatcctgcagatcaaggctgtggagggctctgtgctggtgagcagcagcagtgaccacagcctgactgtgtggaaggagctggagcagaagcccacccaccactacaagagcgccagtgaccccatccacacctttgacctgtatggcagcgaggtggtgactggaacagtgagcaacaagattggagtgtgcagcctgctggagccccccagccaggccaccaccaagctgagcagcgagaacttccggggcaccctgaccagcctggccctgctgcccaccaagaggcacctgctgctgggcagtgacaatggagtcatccggctgctggcctag

SEQ ID NO: 43622 - DNA, 2079 bp, Artificial Sequence
  Description of Artificial Sequence: Synthetic coding sequence
atggatggagagcccccagccagcagcggcctgggcctgcctgactacaccagcggcgtgtccttccatgaccaggccgacctgcctgagacagaggacttccaggccggcctgtatgtgacagagagcccccagccccaggaggccgaggccgtgtccctgggccgcctgagtgacaagagcagcacctaccagtacctgccctacatctcctacctggtggcccctggcagcgccagcggccccagccggctgaacagcaggaaggaggccggcctgctggccgctgtgaccctgacccagaagatcatcgtgtacctgagtgacaccaccctgatggacatcctgccccgcatcagccatgaggtgctgctgcctgtgctgtccttcctgaccagcctggtgacaggcttccccagcggggcccaggcccggaccatcctgtgtgtgaagaccatcagcctcatcgccctgatctgcctgagaattggccaggagatggtgcagcagcacctgtctgagcctgtggccaccttcttccaggtgttcagccagctgcacgagctgcggcagcaggacctgaagctggaccctgctggccgcggggagggccagctgccccaggtggtgttcagtgatggccagcagaggcctgtggaccctgccctgctggatgagctgcagaaggtgttcaccctggagatggcctacaccatctacgtgcccttcagctgcctgctgggggacatcatcaggaagatcatccccaaccacgagctggtgggggagctggccgccctgtacctggagagcatcagccccagcagcagaaatcctgcctctgtggagcccaccatgcctggcactggacctgagtgggacccccacggcggcggctgcccccaggatgatggccacagcggcaccttcggctctgtgctggtgggcaaccgcatccagatccccaatgacagcaggcctgagaaccctggccccctgggccccatctctggagtgggcggcggcggcctgggcagcggcagtgatgacaatgccctgaagcaggagctgcccaggtctgtgcacggcctgagcggcaactggctggcctactggcagtatgaaattggagtgtcccagcaggatgcccacttccacttccaccagatccggctgcagagcttccctggccacagcggggctgtgaagtgtgtggcccccctgagcagcgaggacttcttcctgagcggcagcaaggacagaacagtgcggctgtggcccctgtacaactatggagatggcaccagcgagacagccccccggctggtgtacacccagcacaggaagagcgtcttctttgtgggccagctggaggccccccagcacgtggtgtcctgtgatggagctgtgcacgtgtgggaccccttcaccgggaagaccctgaggacagtggagcccctggacagccgggtgcccctgacagctgtggccgtgatgcctgccccccacaccagcatcaccatggccagcagtgacagcaccctgcgctttgtggactgcaggaagccaggcctgcagcacgagttccggctgggcggcggcctgaaccctggcctggtgcgggccctggccatcagccccagcggccgctctgtggtggccggcttcagcagcggcttcatggtgctgctggacaccaggacaggcctggtgctgcggggctggccagcccacgagggggacatcctgcagatcaaggctgtggagggctctgtgctggtgagcagcagcagtgaccacagcctgactgtgtggaaggagctggagcagaagcccacccaccactacaagagcgccagtgaccccatccacacctttgacctgtatggcagcgaggtggtgactggaacagtgagcaacaagattggagtgtgcagcctgctggagccccccagccaggccaccaccaagctgagcagcgagaacttccggggcaccctgaccagcctggccctgctgcccaccaagaggcacctgctgctgggcagtgacaatggagtcatccggctgctggcctag

SEQ ID NO: 43623 - DNA, 2217 bp, Artificial Sequence
  Description of Artificial Sequence: Synthetic coding sequence
atgctggtgcgggtggtgctgagcctgacccccagcttccctgagcccagcgccctgtacacagcctgcaagatggtgcgctggctgagcgccaagctgggccccaccgtggccagcagacatgtggccaggaacctgctgcggctgctgaccagctgctacgtgggccccacccggcagcagttcaccgtgagcagcggggagagcccccccctgtctgctggcaacatctaccagaagaggcctgtgctgggggacatcgtgtctggccctgtgctgagctgcctgctgcacatcgcccggctgtatggagagcctgtgctgacctaccagtacctgccctacatctcctacctggtggcccctggcagcgccagcggccccagccggctgaacagcaggaaggaggccggcctgctggccgctgtgaccctgacccagaagatcatcgtgtacctgagtgacaccaccctgatggacatcctgccccgcatcagccatgaggtgctgctgcctgtgctgtccttcctgaccagcctggtgacaggcttccccagcggggcccaggcccggaccatcctgtgtgtgaagaccatcagcctcatcgccctgatctgcctgagaattggccaggagatggtgcagcagcacctgtctgagcctgtggccaccttcttccaggtgttcagccagctgcacgagctgcggcagcaggacctgaagctggaccctgctggccgcggggagggccagctgccccaggtggtgttcagtgatggccagcagaggcctgtggaccctgccctgctggatgagctgcagaaggtgttcaccctggagatggcctacaccatctacgtgcccttcagctgcctgctgggggacatcatcaggaagatcatccccaaccacgagctggtgggggagctggccgccctgtacctggagagcatcagccccagcagcagaaatcctgcctctgtggagcccaccatgcctggcactggacctgagtgggacccccacggcggcggctgcccccaggatgatggccacagcggcaccttcggctctgtgctggtgggcaaccgcatccagatccccaatgacagcaggcctgagaaccctggccccctgggccccatctctggagtgggcggcggcggcctgggcagcggcagtgatgacaatgccctgaagcaggagctgcccaggtctgtgcacggcctgagcggcaactggctggcctactggcagtatgaaattggagtgtcccagcaggatgcccacttccacttccaccagatccggctgcagagcttccctggccacagcggggctgtgaagtgtgtggcccccctgagcagcgaggacttcttcctgagcggcagcaaggacagaacagtgcggctgtggcccctgtacaactatggagatggcaccagcgagacagccccccggctggtgtacacccagcacaggaagagcgtcttctttgtgggccagctggaggccccccagcacgtggtgtcctgtgatggagctgtgcacgtgtgggaccccttcaccgggaagaccctgaggacagtggagcccctggacagccgggtgcccctgacagctgtggccgtgatgcctgccccccacaccagcatcaccatggccagcagtgacagcaccctgcgctttgtggactgcaggaagccaggcctgcagcacgagttccggctgggcggcggcctgaaccctggcctggtgcgggccctggccatcagccccagcggccgctctgtggtggccggcttcagcagcggcttcatggtgctgctggacaccaggacaggcctggtgctgcggggctggccagcccacgagggggacatcctgcagatcaaggctgtggagggctctgtgctggtgagcagcagcagtgaccacagcctgactgtgtggaaggagctggagcagaagcccacccaccactacaagagcgccagtgaccccatccacacctttgacctgtatggcagcgaggtggtgactggaacagtgagcaacaagattggagtgtgcagcctgctggagccccccagccaggccaccaccaagctgagcagcgagaacttccggggcaccctgaccagcctggccctgctgcccaccaagaggcacctgctgctgggcagtgacaatggagtcatccggctgctggcctag

SEQ ID NO: 43624 - DNA, 1719 bp, Artificial Sequence
  Description of Artificial Sequence: Synthetic coding sequence
atgggcagcctgagcagccccaccagcacctgccccaccagcgccacctggttccccagcggggcccaggcccggaccatcctgtgtgtgaagaccatcagcctcatcgccctgatctgcctgagaattggccaggagatggtgcagcagcacctgtctgagcctgtggccaccttcttccaggtgttcagccagctgcacgagctgcggcagcaggacctgaagctggaccctgctggccgcggggagggccagctgccccaggtggtgttcagtgatggccagcagaggcctgtggaccctgccctgctggatgagctgcagaaggtgttcaccctggagatggcctacaccatctacgtgcccttcagctgcctgctgggggacatcatcaggaagatcatccccaaccacgagctggtgggggagctggccgccctgtacctggagagcatcagccccagcagcagaaatcctgcctctgtggagcccaccatgcctggcactggacctgagtgggacccccacggcggcggctgcccccaggatgatggccacagcggcaccttcggctctgtgctggtgggcaaccgcatccagatccccaatgacagcaggcctgagaaccctggccccctgggccccatctctggagtgggcggcggcggcctgggcagcggcagtgatgacaatgccctgaagcaggagctgcccaggtctgtgcacggcctgagcggcaactggctggcctactggcagtatgaaattggagtgtcccagcaggatgcccacttccacttccaccagatccggctgcagagcttccctggccacagcggggctgtgaagtgtgtggcccccctgagcagcgaggacttcttcctgagcggcagcaaggacagaacagtgcggctgtggcccctgtacaactatggagatggcaccagcgagacagccccccggctggtgtacacccagcacaggaagagcgtcttctttgtgggccagctggaggccccccagcacgtggtgtcctgtgatggagctgtgcacgtgtgggaccccttcaccgggaagaccctgaggacagtggagcccctggacagccgggtgcccctgacagctgtggccgtgatgcctgccccccacaccagcatcaccatggccagcagtgacagcaccctgcgctttgtggactgcaggaagccaggcctgcagcacgagttccggctgggcggcggcctgaaccctggcctggtgcgggccctggccatcagccccagcggccgctctgtggtggccggcttcagcagcggcttcatggtgctgctggacaccaggacaggcctggtgctgcggggctggccagcccacgagggggacatcctgcagatcaaggctgtggagggctctgtgctggtgagcagcagcagtgaccacagcctgactgtgtggaaggagctggagcagaagcccacccaccactacaagagcgccagtgaccccatccacacctttgacctgtatggcagcgaggtggtgactggaacagtgagcaacaagattggagtgtgcagcctgctggagccccccagccaggccaccaccaagctgagcagcgagaacttccggggcaccctgaccagcctggccctgctgcccaccaagaggcacctgctgctgggcagtgacaatggagtcatccggctgctggcctag

SEQ ID NO: 43625 - DNA, 5826 bp, Artificial Sequence
  Description of Artificial Sequence: Synthetic coding sequence
atggcccagggcagcggcggccgggagggcgccctgcggaccccagctgggggctggcacagcccccccagcccagacatgcaggagctgctgcggtctgtggagcgggacctgagcattgacccccggcagctggccccagcccctgggggcacccacgtggtggccctggtgcctgcccgctggctggccagcctgcgggaccggcggctgcccctgggcccctgccccagggctgagggcctgggggaggccgaggtgaggaccctgctgcagaggtctgtgcagaggctgcctgctggctggaccagggtggaggtgcacggcctgaggaagaggcggctgagctaccccctgggcggcggcctgccctttgaagatggcagctgtggccctgagaccctgacccgcttcatgcaggaggtggccgcccagaactacagaaacctgtggaggcatgcctaccacacctacggccagccctacagccacagccctgcccccagcgctgtgcctgccctggacagcgtgcggcaggccctgcagagggtgtatggctgcagcttcctgcctgtgggggagaccacccagtgccccagctatgcccgggagggcccctgccccccccggggcagccctgcctgccccagcctgctgcgggcagaggccctgctggagagccctgagatgctgtatgtggtgcacccctacgtgcagttcagcctgcatgatgtggtgaccttcagccctgccaagctgaccaacagccaggccaaggtgctcttcatcctcttccgggtgctgcgggccatggatgcctgccaccggcagggcctggcctgtggggccctgagcctgtaccacatcgctgtggatgagaagctgtgcagcgagctgcggctggacctgagcgcctatgaaagaccagaagaagatgaaaatgaggaggcccctgtggccagagatgaggccggcatcgtgtcccaggaggagcagggcggccagcccggccagcccaccggccaggaggagctgcggagcctggtgctggactgggtgcacggccgcatcagcaacttccactacctgatgcagctgaaccggctggccggccggcggcagggcgaccccaactaccaccctgtgctgccctgggtggtggacttcaccacccctcatggccgcttccgggacctgaggaagagcaagttccggctgaacaagggggacaagcagctggacttcacctatgagatgacccggcaggcctttgtggccggcggggccggcggcggggagcccccccacgtgccccaccacatcagtgatgtgctgagtgacatcacctactacgtgtacaaggcccggaggacccccaggtctgtgctgtgtggccacgtgcgggcccagtgggagccccatgagtacccagcctccatggagaggatgcagaactggaccccagatgagtgcatccctgagttctacacagaccccagcatcttccgcagcatccacccagacatgccagacctggatgtgcctgcctggtgcagcagcagccaggagtttgtggccgcccaccgggccctgctggagagccgggaggtgtcccgggacctgcaccactggattgacctgaccttcggctacaagctgcagggcaaggaggccgtgaaggagaagaatgtgtgcctgcacctggtggatgcccacacccacctggccagctatggagtggtgcagctgtttgaccagccccacccccagaggctggccggggccccagccctggcccctgagcccccactcatccccaagctgctggtgcagaccatccaggagaccaccggccgggaggacttcacagagaaccctggccagctgcccaatggagtgggccggcctgtgctggaggccaccccctgtgaggcctcctggacccgggacaggcctgtggccggggaggatgacctggagcaggccacagaggccctggacagcatcagcctggccggcaaggccggggaccagctgggcagcagcagccaggccagccctggcctgctgtccttctctgtggccagcgccagccggcccggcagaagaaacaaggctgctggagctgaccctggagagggggaggagggccgcatcctgctgcctgagggcttcaaccccatgcaggccctggaggagctggagaagacaggcaacttcctggccaagggcctgggcggcctgctggaggtgcctgagcagccccgggtgcagcctgctgtgcccctgcagtgcctgctgcaccgggacatgcaggccctgggcgtgctgctggccgagatggtgtttgccaccagggtgaggaccctgcagccagatgcccccctgtgggtgcgcttccaggccgtgcggggcctgtgcaccaggcaccccaaggaggtgcctgtgtccctgcagcctgtgctggacaccctgctgcagatgagcggccctgaggtgcccatgggcgctgagcggggcaagctggaccagctgtttgagtacagacctgtgtcccagggcctgcccccaccctgccccagccagctgctgagccccttcagctctgtggtgcccttccccccctacttccctgccctgcaccgcttcatcctgctgtaccaggcccggcgggtggaggatgaggcccagggccgggagctggtgtttgccctgtggcagcagctgggcgctgtgctgaaggacatcaccccagagggcctggagatcctgctgccctttgtgctgagcctgatgtctgaggagcacacagctgtgtacacagcctggtacctgtttgagcctgtggccaaggccctgggccccaagaatgccaacaagtacctgctgaagcccctgattggagcctatgagagcccctgccagctgcacggccgcttctacctgtacacagactgctttgtggcccagctgatggtgcggctgggcctgcaggccttcctgacccacctgctgccccacgtgctgcaggtgctggccggggctgaggccagccaggaggagagcaaggacctggccggggctgctgaggaggaggagagcggcctgcctggagctggccctggcagctgtgccttcggggaggagatccccatggatggagagcccccagccagcagcggcctgggcctgcctgactacaccagcggcgtgtccttccatgaccaggccgacctgcctgagacagaggacttccaggccggcctgtatgtgacagagagcccccagccccaggaggccgaggccgtgtccctgggccgcctgagtgacaagagcagcaccagcgagaccagcctgggggaggagcgggccccagatgagggcggggcccctgtggacaagagcagcctgcggagcggggacagcagccaggacctgaagcagagcgagggcagcgaggaggaggaggaggaggaggacagctgtgtggtgctggaggaggaggagggggagcaggaggaggtgactggagccagcgagctgaccctgagtgacacagtgctgtccatggagaccgtggtggccggcggcagcggaggagatggagaggaggaggaggaggccctgcctgagcagagcgagggcaaggagcagaagatcctgctggacacagcctgcaagatggtgcgctggctgagcgccaagctgggccccaccgtggccagccgccacgtggccaggaacctgctgcggctgctgaccagctgctacgtgggccccacccggcagcagttcaccgtgtcctctggagagagcccccccctgtctgctggcaacatctaccagaagaggcctgtgctgggggacatcgtgtctggccctgtgctgagctgcctgctgcacatcgcccggctgtatggagagcctgtgctgacctaccagtacctgccctacatctcctacctggtggcccctggcagcgccagcggccccagccggctgaacagcaggaaggaggccggcctgctggccgctgtgaccctgacccagaagatcatcgtgtacctgagtgacaccaccctgatggacatcctgccccgcatcagccatgaggtgctgctgcctgtgctgtccttcctgaccagcctggtgacaggcttccccagcggggcccaggcccggaccatcctgtgtgtgaagaccatcagcctgattgccctgatctgcctgcgcatcggccaggagatggtgcagcagcacctgtctgagcctgtggccaccttcttccaggtgttcagccagctgcacgagctgcggcagcaggacctgaagctggaccctgctggccgcggggagggccagctgccccaggtggtgttcagtgatggccagcagaggcctgtggaccctgccctgctggatgagctgcagaaggtgttcaccctggagatggcctacaccatctacgtgcccttcagctgcctgctgggggacatcatcaggaagatcatccccaaccacgagctggtgggggagctggccgccctgtacctggagagcatcagccccagcagcaggaacccagcctctgtggagcccaccatgcctggcaccggccctgagtgggacccccatggaggcggctgcccccaggatgatggccacagcggcacctttggatctgtgctggtgggcaaccgcatccagatccccaatgacagcaggccagaaaatcctggccccctgggccccatcagcggcgtgggcggcggcggcctgggcagcggcagtgatgacaatgccctgaagcaggagctgcccaggtctgtgcacggcctgagcggcaactggctggcctactggcagtatgaaattggagtgtcccagcaggatgcccacttccacttccaccagatccggctgcagagcttccctggccacagcggggctgtgaagtgtgtggcccccctgagcagcgaggacttcttcctgagcggcagcaaggacagaacagtgcggctgtggcccctgtacaactatggagatggcaccagcgagacagccccccggctggtgtacacccagcacaggaagtctgtgttctttgtgggccagctggaggccccccagcacgtggtgtcctgtgatggagctgtgcacgtgtgggaccccttcaccgggaagaccctgaggacagtggagcccctggacagccgggtgcccctgacagctgtggccgtgatgcctgccccccacaccagcatcaccatggccagcagtgacagcaccctgcgctttgtggactgcaggaagccaggcctgcagcacgagttccggctgggcggcggcctgaaccctggcctggtgcgggccctggccatcagccccagcggccgctctgtggtggccggcttcagcagcggcttcatggtgctgctggacaccaggacaggcctggtgctgcggggctggccagcccatgaaggagacatcctgcagatcaaggctgtggagggctctgtgctggtgagcagcagcagtgaccacagcctgactgtgtggaaggagctggagcagaagcccacccaccactacaagagcgccagtgaccccatccacacctttgacctgtatggcagcgaggtggtgacaggcaccgtgagcaacaagattggagtgtgcagcctgctggagccccccagccaggccaccaccaagctgagcagcgagaacttccggggcaccctgaccagcctggccctgctgcccaccaagaggcacctgctgctgggcagtgacaacggggtcatccggctgctggcctag

SEQ ID NO: 43626 - DNA, 2145 bp, Artificial Sequence
  Description of Artificial Sequence: Synthetic coding sequence
atggtgcgctggctgagcgccaagctgggccccaccgtggccagcagacatgtggccaggaacctgctgcggctgctgaccagctgctacgtgggccccacccggcagcagttcaccgtgagcagcggggagagcccccccctgtctgctggcaacatctaccagaagaggcctgtgctgggggacatcgtgtctggccctgtgctgagctgcctgctgcacatcgcccggctgtatggagagcctgtgctgacctaccagtacctgccctacatctcctacctggtggcccctggcagcgccagcggccccagccggctgaacagcaggaaggaggccggcctgctggccgctgtgaccctgacccagaagatcatcgtgtacctgagtgacaccaccctgatggacatcctgccccgcatcagccatgaggtgctgctgcctgtgctgtccttcctgaccagcctggtgacaggcttccccagcggggcccaggcccggaccatcctgtgtgtgaagaccatcagcctcatcgccctgatctgcctgagaattggccaggagatggtgcagcagcacctgtctgagcctgtggccaccttcttccaggtgttcagccagctgcacgagctgcggcagcaggacctgaagctggaccctgctggccgcggggagggccagctgccccaggtggtgttcagtgatggccagcagaggcctgtggaccctgccctgctggatgagctgcagaaggtgttcaccctggagatggcctacaccatctacgtgcccttcagctgcctgctgggggacatcatcaggaagatcatccccaaccacgagctggtgggggagctggccgccctgtacctggagagcatcagccccagcagcagaaatcctgcctctgtggagcccaccatgcctggcactggacctgagtgggacccccacggcggcggctgcccccaggatgatggccacagcggcaccttcggctctgtgctggtgggcaaccgcatccagatccccaatgacagcaggcctgagaaccctggccccctgggccccatctctggagtgggcggcggcggcctgggcagcggcagtgatgacaatgccctgaagcaggagctgcccaggtctgtgcacggcctgagcggcaactggctggcctactggcagtatgaaattggagtgtcccagcaggatgcccacttccacttccaccagatccggctgcagagcttccctggccacagcggggctgtgaagtgtgtggcccccctgagcagcgaggacttcttcctgagcggcagcaaggacagaacagtgcggctgtggcccctgtacaactatggagatggcaccagcgagacagccccccggctggtgtacacccagcacaggaagagcgtcttctttgtgggccagctggaggccccccagcacgtggtgtcctgtgatggagctgtgcacgtgtgggaccccttcaccgggaagaccctgaggacagtggagcccctggacagccgggtgcccctgacagctgtggccgtgatgcctgccccccacaccagcatcaccatggccagcagtgacagcaccctgcgctttgtggactgcaggaagccaggcctgcagcacgagttccggctgggcggcggcctgaaccctggcctggtgcgggccctggccatcagccccagcggccgctctgtggtggccggcttcagcagcggcttcatggtgctgctggacaccaggacaggcctggtgctgcggggctggccagcccacgagggggacatcctgcagatcaaggctgtggagggctctgtgctggtgagcagcagcagtgaccacagcctgactgtgtggaaggagctggagcagaagcccacccaccactacaagagcgccagtgaccccatccacacctttgacctgtatggcagcgaggtggtgactggaacagtgagcaacaagattggagtgtgcagcctgctggagccccccagccaggccaccaccaagctgagcagcgagaacttccggggcaccctgaccagcctggccctgctgcccaccaagaggcacctgctgctgggcagtgacaatggagtcatccggctgctggcctag

SEQ ID NO: 43627 - DNA, 834 bp, Artificial Sequence
  Description of Artificial Sequence: Synthetic coding sequence
atgagccgggagttccggggccacaggaactgtgtgctgaccctggcctacagcgccccctgggacctgcccagcaccccctgtgccgaggaggccgccgccggcggcctgctggtgacaggcagcacagatggaacagccaaggtgtggcaggtggccagcggctgctgccaccagaccctgcggggccacactggagctgtgctgtgcctggtgctggacaccccaggccacacagccttcaccggcagcacagatgccaccatccgggcctgggacatcctgagcggggagcagctgcgggtcttccgggagcaccggggcagcgtcatctgcctggagtgcagcagagctgctggcaccctggcccctggccccagcaccaggagcctggagagctgtggcggctgcagcggggccacccacagcagcagcacagccagccgctgcacagcccgctgcagcaccccacccaggaccacagccccctgtgccagcggcacctgtgccggcagcgaggtgccccggggccccctgcggccctgtgccgccagccggggcagcagcgccacccgctgggccgccccaccccggccctgcagcaggccagaccctgctggccccctgcagaccccagcccagaccccatctggcagccagagcgccccaccctgctacccccgctggtggaggcccatggccggggagggccgcggggccaggaagccaggccgggaggagagccccagccaggccagcggcttcagcctggtggcccggcggcgctgggagcgggagtgcagcccctggggccccccacccttccccttctag

SEQ ID NO: 43628 - DNA, 1131 bp, Artificial Sequence
  Description of Artificial Sequence: Synthetic coding sequence
atgggcggcggcggcagcgccctgcgggtgtgtgccgaccaccggggcggcatcaactggctgagcctgagcccagatggccagaggctgctgaccggctctgaagatggaacagcccggctgtggagcacagcagatggccagtgctgtgccctgctgcagggccacgagagctatgtgaccttctgccagctggaggatgaagctgccttcacctgcagcgctgactgcaccatccgccgctgggatgtgctgaccggccagtgcctgcaggtgtaccggggccacaccagcatcgtgaaccgcatcctggtggccaacaaccagctgttcagcagcagctatgacagaacagcccgggtgtggagcgtggacaagggccagatgagccgggagttccggggccacaggaactgtgtgctgaccctggcctacagcgccccctgggacctgcccagcaccccctgtgccgaggaggccgccgccggcggcctgctggtgacaggcagcacagatggaacagccaaggtgtggcaggtggccagcggctgctgccaccagaccctgcggggccacactggagctgtgctgtgcctggtgctggacaccccaggccacacagccttcaccggcagcacagatgccaccatccgggcctgggacatcctgagcggggagcagctgcgggtcttccgggagcaccggggcagcgtcatctgcctggagctggtgaaccggctggtgtacagcggcagcgctgacagaacagtgaagtgctggctggccgacaccggggagtgtgtgaggaccttcaccgcccacagaagaaatgtgtctgccctgaagtaccacgccggcaccctcttcaccggcagcggagatgcctgtgcccgggcctttgatgcccagagcggggagctgcggcgggtcttccggggccacaccttcatcatcaactgcatccaggtgcacggccaggtgctgtacacagccagccatgatggagccctgcggctgtgggatgtgcggggcctgcggggggcccccaggcctcctccacccatgaggagcctgagccgcctcttcagcaacaaggtgggctgtgccgccgcccccctgcagcctgcctag

SEQ ID NO: 43629 - DNA, 8622 bp, Artificial Sequence
  Description of Artificial Sequence: Synthetic coding sequence
atgagcagccccaggctcatccccctgtggaaggacctgaagctgctgctgaatgacaccatcaacaagagcaagcagcccagcgaggaccccaagaactgcctgattgtgctgagtgacaggagccaggccgtggcctggatgaagagcaagacagaggacatggtggagaagaggaccttctccatgacagagcggctgccccccatccagagcatggtgcacgccggcagcttccacatcctggtggtgtactgtggggacctgatcctgcggctgtttggagaccacttccgggccttcaagcccctgggcaaggtgccctgccgcttcaacatcagctgcctgtgctatgaccctgagatgaagatgctgctgagcggcatcctgggcgctgtggtgacctgggtgattgagctgggcggcaccggcctgcagatcgcccacatggtgtccatgcctggagatgagctggtgcaggacatcgtgctgaatggccccagcggcagcctgctggccctgtgtgaaacagtggtgcgggtgctgatgcaccagggcaagggccagctgggggaggtgaagcgcttcaccagcaccagcagcggcagcagcatcacctgctgcttcacctgctttgaccagggcttcctgtatgccggcaaccaggccggggagatccaggtgtggagcctgcagcagggccaccccctgcacagcttccaggcccaccagagcggggtcatctgcatccgcagcaggcctgaggcccacaccctgctgacagctggcagtgacagcctcatcaaggagtggaacctgaccagcggcagcctgctgcggcggctggagctgggggaggagctgtaccgcctgcagttcatcgacagcatcaccttcttctgccagacagcccacagcttcagcctgcaccggctgccctgcttctacagcctcttcaacgtgtgtggcagcgccccccagcagctgcggcgggtgtgctgcggcaacaactggttccgcatcctgtgcaccacagaagatggcctgctgcgctttgtgtcccctgtgactggagacctgctggtgatcacctggcccttcagcatcctggaccaggccgtggactgggcctatgaccccgggaaggaggagctgtttgtggccaccggcagcagcgaggtgctggtgtttgacaccacccgctgcccctgcccagccaagtacctgctgggcaccagccccaacagccaggactttgtgcagtgcctggcctacggccacttcaacctgggccggggcctggagggcctcatcttcagcggccaccagagcggggtcatccgggtgctgagccagcacagctgtgcccggctggagaagttcatgcactttggagctgtgctggccctgagcaccctgagcggcggcatctttggaggccagggcaacagcctgctgtgcagctatggcatggatgattatgtgcacctgtctgaggccgtgctggatggagtgaaggtgcagctgcggcccctggccagcatcctgagcagctgccacctgacccacctgatcctgctgcccaagtctgtgggcgccatcacagagaccaactgcctgcggctgtggaagttccatgacttcctgagcagcggcagccagaatggcctgaagttcatcgagaccctgcccctgcacctgtgtgccatcaccagctttgatgtgtgcctgagcctgagcctgtttgtgacaggcagcgcagatggctctgtgcgcatctgggacttccacggccgcctgattggcatcctggacagcagcctgcacttcggccctgtgtgctttgccaatgacagaggagacctgctggtgaccttcaaccagagcctgtacctggtgtcctgcctgaagctgctgcccccagccctgctgacccggctgtccttcatgagcatcagtgatgaggtgctggaggtgcccaagcccttcatccccagcttcttcttctcctttgagaccatgtttgtgcccaagtacatctacccaggccaggcccagcagaagctggtgggcctggagaagctggtgaacaacagagccatcgcctttgaccacagcgtgccccacgtgattgaagaagatgaggagggcagccctgtgctgctgcggagctccatgcactacagcctgcaggacatggaggactggatgcaggtgtccaagcgctaccagtgccactacgtgctgcccccccagctgcagctgacctcctgggatggcctgaacccctaccagatcctgcgctactactttggacatggccgggagtggctgtttgccccagactgctacatccccaacagcgtcatccgggcccggctgtggccagagggcacccccatctacctgcagtgcaacctgcacgccccccagcgggagctggagtgggacaggagccaggagttcttcttctggcacagccgggtgcgggccatcagcaacacagagtaccccaagaacaaggaggaggatgagcacttcctggagatgaggctgagcaaggatgtgacctacagcgtgctgacagatggagccaacagatcctggctgggcaggaagatgtctgagatcaccatcaacagcatgattgagaccatgctgaacatcatggtgcacgccagcctgctgaagtaccagtgctgcgtgggcgccctgggccagatctttgccagctaccaggtgtccccagccctgcggagtgaaacagcccggcggctgctgaatgacaccaccaacagcaaccccctcatccgggagctggcctgggagggcctgaagaggctgggcatgatcacccacctgtttgccatgcccctggcccagggcctgatggacaaggatgagcgggtgcgcatcaagaccctgagcctgatggccgagatcggcatccacagcaggaccagcctgctgcagctgacccagaagcaggagaccttccgggagatgcagcagcagatgattggagaggagcccctggaccacctgctgggcatgagggccacagacctgcagatcctgagcacccaggtggagcagaggctgaatgaaaacctgaccctgagccacagagatgagaagccagccttcagcctggatgtgtccatgcccagcgagctgaagagcagcctgaagcccccaacagtgtctgaggagagcgaggtggccatcaagcccagcaagggccagaggcggggccaggccggcgtgaagaagcacagccagaagtggctgcggggcctgaagaagaccaaggagcgggacagcaagcagatgagcacagagcccggcctgctggaggatgagagcggcacagaggccgcccccatcgagatggaggaggcctctgtgtacagccagtggagcagcagcaccagcgtcatcaagctgagcaaggatgtggacagccaggagaaggacatcagcaaggaccacatcgccctgaccctgaagaggctgcagaagatccgggacaagagggacaagaaggccacagcccagaagctgaagaagaagcacaagaagaagggcaaggaggccaaggtgatcaatgaggagaccaccccacctgtgatggagcagcctgtgaccaagaaggtgaagatccagggccgcggggccagcggcatcagcggccgccgcagcacagctggagatggcagctcctggagagatgacctgtgccgcctgatggccctgcgcatcagcggcagccagaccaagatgtctgagaacctgaatgctgagctggtgacctttgcccaggagatgctggtggacagacaccccagctgggagctgttccaggagatctgccccctgctgaagaaggagagcaaggtgctgctggaggacctggactgggatgtggtgcccccagagaagaagcccatcttcatccaggagggcgccatccgggaggacatgatccagggcgtgacccaggaggtgatccgccacaaggaggtgatgccccgggaggaggagcaggcccagaagaaggcccgggacatgctgggcctggaggagacccaggtgatcctgaagaagggcaagaaggtgatcttcctggagcctggaaatgtgaccatgggcaaggagatcagcaagaaggaggagaagaagaccttccagaagagccccaagcagggcaggaaggctgtgcagaaggagaggaaggtgggcaagatcaagcgggagatgaccaaggaggagcgggacatgtctgaggaggtggaggagatggccaccctggaggagaaggtggtgaagcaggagggcaagctggtgatgattgaaagaacacccagctggcaggactggaagaaggcctgggatgagtggaagcaggtgcatggagagaccaggaagtcctggaaggcctggaaggaggagtgggagaagaggctgctgcaggaggaggagaagctgcaccaggccggggagaagctgagccctgaggaggagatgctgcaggaggacaagaagctgaagtgggaggagtggaagcaggtgtgggagaacatgctgagcagcaagagcaaggagcagcagtacaaggatgaggaggaggtgaccctggaggaggaggtgtcccgggagggggaggagaaggagcagcaggtgacagaggagcagaggcacatccaggaggagcacaagtgggcccgcatccacaggaagagggcccgggcagagaagaagagggcccaggaggagaggaagctggcccaggaggaggagaagctggcccaggaggagcggcagctggcccaggaggagaggaagctggcccaggcctacgtgaagatcacccaggatgaccgggagatggcccaggccgagggcaagtttgcccagaaggaggagaccctggcccagagaggagagaagctgagccaggaggccgagaagctggcccagaagaggaagaagctggccaagaagtgggagaaggtggcccgggaggaggagaagctggccaagaagggcggcaagctggccgaggtgaagaacatcctggcccagaaggtggaggagctgccccagcgggagcagaacctggactggcaggagaaggagctggcccaggagctggaggagctggagtgggacatggaggagctgtcctggaaggaggaggagctgaaccaggaggagggcaagctggtggaggagaagaagaagctggccgaggaggaggaggccctggcctggcagcgggagaagctgtctgaggaggagaccaagctggcccaggaggaggagctgctgatccaggagaaggagaagctggcccagcacaaggagaagatgcctgaggaggaggagcggctgggcaggaagcgggagcagctgattgagaagaagatgaagctggcccagaagcgggagcgctggatcaacagcatggaggagctgaccaagaacaagatgatcctgtaccagaagaagaacctggcccaggagaagaagaacctggcccaggagaaggagaagctggcccagaggaaggagaacctgctgtacaacaaggagcggctgacccacagcaagaagcagctggtgcaggtgaagaacaagctgggcatgttcaacaagatcctggcccaggtggaggagaagctgacccaggagaaggagaccgtcatcaagaagaaggagaagctggccgagacagagaagaagctggtgcaggtggaggacagcctggccaagaagcaggagaagctggcccaggagaagatgaagctggccctggagaaggccatggtgcagggcaagaagaggctgcggggggagctggacatcgccaaggaggagaaggccctgaacctggagatgaagaggctggccgaggagaagatgaggctggtggagggcaaggagaccctgagcaagggggagaccccagagaccagccggcagaggaagatgacccaggtggagcaggagctgtttgagaggaagctgagcctggaggagaagatcctgctgcacgaggaccgcatcctggccatggaggagagcgagatcgccaagggcaagctggagttcacccggggccagaggatctttgtgcagggccagaggaagctggccaaggccagcaggaagctgatcaagaagcgggagagcctgagcaaggagcccgccaagctgaacaagatcctgaaggccctgcagaagctgaccagagatgagaggaagctgacccaggaggagatcaagatgaccaagatgaagagggccctgtttgtgaaggagcggcggctgagcattgagcagagcaagctggacatcaaggagtgggacttcagcgagaagaggtctgagctgaccaaggatgagaagaagctggccaggaagcagaggaagctggccaacaagatgaggaggatgatcaacaaggaggagaagatgacagaggaggagagcaagctggccaggaagcacagcgaggtgatcctggatgatgaggaggagggcggcatcgaggaggaggaggtgatccccttcctgaagaggcgctggaggaagaggaaggaggccaagagaggagacaagcccaaggagaagttcagcagccaggtggatgaggtggagagcgaggagcacttcagcgaggagatggagagcctgctggatgagctggagaagcaggagagcctgagcagcgaggaggaggaggagcgggaggaggaggaggagcgggaggaggaggaggtgcgggaggaggaggaggagaggaaggaggaggaggagggggaggagaagcaggtggagaaggaggaggaggagaagaagaagaagaagaaggagaagaagaaggaggaggtgcaggagaaggaggaggtgtttgaggagaaggaggagatcatgtctgaggaggagacagagagcctgagtgatgaggaggaggaggaggagagctgcagcctggaggaggaggtggaccgggagaaggagatcctgaagaaggagaagcagttcaagctgcaggagcagaggaggaagagcctgcggggccgggagcgggtgctgagcatcctgcggggcgtgccccacggcaagggccgggccatccggctgggcgtgctgaagagccccctgaagaagctgatgagcacagccctggagatgaaggagaagacccctgtgcctgtgcctgagaagcagatctcctgggaggacaagaaggccaccgtggtggagatccccaggaagttcctgggcaccatggacaaggagcgggaggtgatgggcaagtatgagcccatcccccctcatgtgctgggcaccgtgctggagagccaggcccaggacctgaagacccccttcatgagccacatcctgcggaggacagtggaggccgaggagctgcagcacaagcccctgggcgcctggtggaagtggttcctgcagcacccccccctgatgggccagacagaggtgcagctgcccctgagccagatcccagccaaggagcagcacgcagatgtgtccctgagtgatgtggagtggatccgccacgtgctggagaggatggaggccggggagcagctgagcagagatggcttccaccggctgtgccagctgctgaaggacctggccagcaaaggaaacctggagtggctgcacctggccaagcatgaggccatcgtgtaccgccaccggcaggccctggagagccaggacacccgcatcagcagccggcagagcatgagccccaagtacctgaaggtgattcctcccatcaaggccaaggagaaggagagctggcccaagcccctggccgtgcccacccagaagagccccctggccaccaagaggatcccagacccccgggccaagaactggcacctgctgggggagccctacagaagtgagcgggcccagcagatcagcatcgcccacaaggagatggagatgcagtacttctacccagccacccgggacatcttccccagcgcccacgcctctgtggagaagcagaccctggccctgatgttccagaaggacttctgggacttcaaggacaagaggcgcttccccaagctgcccaagctggagaagaagacccagcccatcagcaagaagaaggaggagctgcccctgtgggagacctttgtggccctgtaccacgtgctgaggatgctgcagcagcgctaccccaaggacagcacagcctggatggagcagttctaccagctgatggacctgtaccagctgaagagcccccgcatccagaagctgctgcaggagctgctgatgagggaggagccccagccccaggagatcatctatgaggaggccctgaaggccacagagctggtgcctggagagcggctcttctgctgcctcttctgtggcagcagccacacccccaggagcccccaggagttccagggcgctgtgcccctgccctggcagaactgtgtgaggaccatcctgcctgtgggcatcgcccgctatggcatcctggagctggcctggaagagcctgcctgaggccgacctgcacctgaccaaggccctgacccacacagtggcccccaccctgtag

SEQ ID NO: 43630 - DNA, 8739 bp, Artificial Sequence
  Description of Artificial Sequence: Synthetic coding sequence
atgagcagccccaggctcatccccctgtggaaggacctgaagctgctgctgaatgacaccatcaacaagagcaagcagcccagcgaggaccccaagaactgcctgattgtgctgagtgacaggagccaggtgctcttcaaggagagccgctacccccagaacatgccctgtgtgtgctactacttcagtgatgcccacttctttgccagcctgtcctgggtgaccagcaacaccaaggagatccaggccgtggcctggatgaagagcaagacagaggacatggtggagaagaggaccttctccatgacagagcggctgccccccatccagagcatggtgcatgctggcagcttccacatcctggtggtgtactgtggggacctgatcctgcggctgtttggagaccacttccgggccttcaagcccctgggcaaggtgccctgccgcttcaacatcagctgcctgtgctatgaccctgagatgaagatgctgctgagcggcatcctgggcgctgtggtgacctgggtgattgagctgggcggcaccggcctgcagatcgcccacatggtgtccatgcctggagatgagctggtgcaggacatcgtgctgaatggccccagcggcagcctgctggccctgtgtgagaccgtggtgcgggtgctgatgcaccagggcaagggccagctgggggaggtgaagcgcttcaccagcaccagcagcggcagcagcatcacctgctgcttcacctgctttgaccagggcttcctgtatgccggcaaccaggccggggagatccaggtgtggagcctgcagcagggccaccccctgcacagcttccaggcccaccagagcggggtcatctgcatccgcagcaggcctgaggcccacaccctgctgacagctggcagtgacagcctcatcaaggagtggaacctgaccagcggcagcctgctgcggcggctggagctgggggaggagctgtaccgcctgcagttcatcgacagcatcaccttcttctgccagacagcccacagcttcagcctgcaccggctgccctgcttctacagcctcttcaacgtgtgtggcagcgccccccagcagctgcggcgggtgtgctgcggcaacaactggttccgcatcctgtgcaccacagaagatggcctgctgcgctttgtgtcccctgtgactggagacctgctggtgatcacctggcccttcagcatcctggaccaggccgtggactgggcctatgaccccgggaaggaggagctgtttgtggccaccggcagcagcgaggtgctggtgtttgacaccacccgctgcccctgcccagccaagtacctgctgggcaccagccccaacagccaggactttgtgcagtgcctggcctacggccacttcaacctgggccggggcctggagggcctcatcttcagcggccaccagagcggggtcatccgggtgctgagccagcacagctgtgcccggctggagaagttcatgcactttggagctgtgctggccctgagcaccctgagcggcggcatctttggaggccagggcaacagcctgctgtgcagctatggcatggatgattatgtgcacctgtctgaggccgtgctggatggagtgaaggtgcagctgcggcccctggccagcatcctgagcagctgccacctgacccacctgatcctgctgcccaagtctgtgggcgccatcacagagaccaactgcctgcggctgtggaagttccatgacttcctgagcagcggcagccagaatggcctgaagttcatcgagaccctgcccctgcacctgtgtgccatcaccagctttgatgtgtgcctgagcctgagcctgtttgtgactggatctgcagatggctctgtgcgcatctgggacttccacggccgcctcatcggcatcctggacagcagcctgcactttggacctgtgtgctttgccaatgacagaggagacctgctggtgaccttcaaccagagcctgtacctggtgtcctgcctgaagctgctgcccccagccctgctgacccggctgtccttcatgagcatcagtgatgaggtgctggaggtgcccaagcccttcatccccagcttcttcttctcctttgagaccatgtttgtgcccaagtacatctacccaggccaggcccagcagaagctggtgggcctggagaagctggtgaacaacagagccatcgcctttgaccacagcgtgccccacgtgattgaggaggatgaggagggcagccctgtgctgctgcggagctccatgcactacagcctgcaggacatggaggactggatgcaggtgtccaagcgctaccagtgccactacgtgctgcccccccagctgcagctgacctcctgggatggcctgaacccctaccagatcctgcgctactacttcggccacggccgggagtggctgtttgccccagactgctacatccccaacagcgtcatccgggcccggctgtggccagagggcacccccatctacctgcagtgcaacctgcacgccccccagcgggagctggagtgggacaggagccaggagttcttcttctggcacagccgggtgcgggccatcagcaacacagagtaccccaagaacaaggaggaggatgagcacttcctggagatgaggctgagcaaggatgtgacctacagcgtgctgacagatggagccaacagatcctggctgggcaggaagatgtctgagatcaccatcaacagcatgattgagaccatgctgaacatcatggtgcacgccagcctgctgaagtaccagtgctgcgtgggcgccctgggccagatctttgccagctaccaggtgtccccagccctgcggagtgaaacagcccggcggctgctgaatgacaccaccaacagcaaccccctcatccgggagctggcctgggagggcctgaagaggctgggcatgatcacccacctgtttgccatgcccctggcccagggcctgatggacaaggatgagcgggtgcgcatcaagaccctgagcctgatggccgagatcggcatccacagcaggaccagcctgctgcagctgacccagaagcaggagaccttccgggagatgcagcagcagatgattggagaggagcccctggaccacctgctgggcatgagggccacagacctgcagatcctgagcacccaggtggagcagaggctgaatgaaaacctgaccctgagccacagagatgagaagccagccttcagcctggatgtgtccatgcccagcgagctgaagagcagcctgaagccacccaccgtgtctgaggagagcgaggtggccatcaagcccagcaagggccagaggcggggccaggccggcgtgaagaagcacagccagaagtggctgcggggcctgaagaagaccaaggagcgggacagcaagcagatgagcacagagcccggcctgctggaggatgaaagtggcacagaagctgcccccatcgagatggaggaggcctctgtgtacagccagtggagcagcagcaccagcgtcatcaagctgagcaaggatgtggacagccaggagaaggacatcagcaaggaccacatcgccctgaccctgaagaggctgcagaagatccgggacaagagggacaagaaggccacagcccagaagctgaagaagaagcacaagaagaagggcaaggaggccaaggtgatcaatgaggagaccaccccacctgtgatggagcagcctgtgaccaagaaggtgaagatccagggccgcggggccagcggcatctctggaagaagaagcacagctggagatggcagctcctggagagatgacctgtgccgcctgatggccctgcgcatcagcggcagccagaccaagatgtctgagaacctgaatgctgagctggtgacctttgcccaggagatgctggtggacagacaccccagctgggagctgttccaggagatctgccccctgctgaagaaggagagcaaggtgctgctggaggacctggactgggatgtggtgcccccagagaagaagcccatcttcatccaggagggcgccatccgggaggacatgatccagggcgtgacccaggaggtgatccgccacaaggaggtgatgccccgggaggaggagcaggcccagaagaaggcccgggacatgctgggcctggaggagacccaggtgatcctgaagaagggcaagaaggtgatcttcctggagcctggaaatgtgaccatgggcaaggagatcagcaagaaggaggagaagaagaccttccagaagagccccaagcagggcaggaaggctgtgcagaaggagaggaaggtgggcaagatcaagcgggagatgaccaaggaggagcgggacatgtctgaggaggtggaggagatggccaccctggaggagaaggtggtgaagcaggagggcaagctggtgatgattgaaagaacacccagctggcaggactggaagaaggcctgggatgagtggaagcaggtgcacggggagaccaggaagtcctggaaggcctggaaggaggagtgggagaagaggctgctgcaggaggaggagaagctgcaccaggccggggagaagctgagccctgaggaggagatgctgcaggaggacaagaagctgaagtgggaggagtggaagcaggtgtgggagaacatgctgagcagcaagagcaaggagcagcagtacaaggatgaggaggaggtgaccctggaggaggaggtgtcccgggagggggaggagaaggagcagcaggtgacagaggagcagaggcacatccaggaggagcacaagtgggcccgcatccacaggaagagggcccgggcagagaagaagagggcccaggaggagaggaagctggcccaggaggaggagaagctggcccaggaggagcggcagctggcccaggaggagaggaagctggcccaggcctacgtgaagatcacccaggatgaccgggagatggcccaggccgagggcaagtttgcccagaaggaggagaccctggcccagagaggagagaagctgagccaggaggccgagaagctggcccagaagaggaagaagctggccaagaagtgggagaaggtggcccgggaggaggagaagctggccaagaagggcggcaagctggccgaggtgaagaacatcctggcccagaaggtggaggagctgccccagcgggagcagaacctggactggcaggagaaggagctggcccaggagctggaggagctggagtgggacatggaggagctgtcctggaaggaggaggagctgaaccaggaggagggcaagctggtggaggagaagaagaagctggccgaggaggaggaggccctggcctggcagcgggagaagctgtctgaggaggagaccaagctggcccaggaggaggagctgctgatccaggagaaggagaagctggcccagcacaaggagaagatgcctgaggaggaggagcggctgggcaggaagcgggagcagctgattgagaagaagatgaagctggcccagaagcgggagcgctggatcaacagcatggaggagctgaccaagaacaagatgatcctgtaccagaagaagaacctggcccaggagaagaagaacctggcccaggagaaggagaagctggcccagaggaaagaaaacctgctgtacaacaaggagcggctgacccacagcaagaagcagctggtgcaggtgaagaacaagctgggcatgttcaacaagatcctggcccaggtggaggagaagctgacccaggagaaggagaccgtcatcaagaagaaggagaagctggccgagacagagaagaagctggtgcaggtggaggacagcctggccaagaagcaggagaagctggcccaggagaagatgaagctggccctggagaaggccatggtgcagggcaagaagaggctgcggggggagctggacatcgccaaggaggagaaggccctgaacctggagatgaagaggctggccgaggagaagatgaggctggtggagggcaaggagaccctgagcaaaggagagaccccagagaccagccggcagaggaagatgacccaggtggagcaggagctgtttgagaggaagctgagcctggaggagaagatcctgctgcatgaagatcgcatcctggccatggaggagagcgagatcgccaagggcaagctggagttcacccggggccagaggatctttgtgcagggccagaggaagctggccaaggccagcaggaagctgatcaagaagcgggagagcctgagcaaggagcccgccaagctgaacaagatcctgaaggccctgcagaagctgaccagagatgagaggaagctgacccaggaggagatcaagatgaccaagatgaagagggccctgtttgtgaaggagcggcggctgagcattgagcagagcaagctggacatcaaggagtgggacttcagcgagaagaggtctgagctgaccaaggatgagaagaagctggccaggaagcagaggaagctggccaacaagatgaggaggatgatcaacaaggaggagaagatgacagaggaggagagcaagctggccaggaagcacagcgaggtgatcctggatgatgaggaggagggcggcatcgaggaggaggaggtgatccccttcctgaagaggcgctggaggaagaggaaggaggccaagagaggagacaagcccaaggagaagttcagcagccaggtggatgaggtggagagcgaggagcacttcagcgaggagatggagagcctgctggatgagctggagaagcaggagagcctgagcagcgaggaggaggaggagcgggaggaggaggaggagcgggaggaggaggaggtgcgggaggaggaggaggagaggaaggaggaggaggagggggaggagaagcaggtggagaaggaggaggaggagaagaagaagaagaagaaggagaagaagaaggaggaggtgcaggagaaggaggaggtgtttgaggagaaggaggagatcatgtctgaggaggagacagagagcctgagtgatgaggaggaggaggaggagagctgcagcctggaggaggaggtggaccgggagaaggagatcctgaagaaggagaagcagttcaagctgcaggagcagaggaggaagagcctgcggggccgggagcgggtgctgagcatcctgcggggcgtgccccacggcaagggccgggccatccggctgggcgtgctgaagagccccctgaagaagctgatgagcacagccctggagatgaaggagaagacccctgtgcctgtgcctgagaagcagatctcctgggaggacaagaaggccaccgtggtggagatccccaggaagttcctgggcaccatggacaaggagcgggaggtgatgggcaagtatgagcccatccccccccacgtgctgggcaccgtgctggagagccaggcccaggacctgaagacccccttcatgagccacatcctgcggaggacagtggaggccgaggagctgcagcacaagcccctgggcgcctggtggaagtggttcctgcagcacccccccctgatgggccagacagaggtgcagctgcccctgagccagatcccagccaaggagcagcacgcagatgtgtccctgagtgatgtggagtggatcagacatgtgctggagaggatggaggccggggagcagctgagcagagatggcttccaccggctgtgccagctgctgaaggacctggccagcaagggcaacctggagtggctgcacctggccaagcatgaggccatcgtgtaccgccaccggcaggccctggagagccaggacacccgcatcagcagccggcagagcatgagccccaagtacctgaaggtgatcccccccatcaaggccaaggagaaggagagctggcccaagcccctggccgtgcccacccagaagagccccctggccaccaagaggatcccagacccccgggccaagaactggcacctgctgggggagccctacagaagtgagcgggcccagcagatcagcatcgcccacaaggagatggagatgcagtacttctacccagccacccgggacatcttccccagcgcccacgcctctgtggagaagcagaccctggccctgatgttccagaaggacttctgggacttcaaggacaagaggcgcttccccaagctgcccaagctggagaagaagacccagcccatcagcaagaagaaggaggagctgcccctgtgggagacctttgtggccctgtaccacgtgctgaggatgctgcagcagcgctaccccaaggacagcacagcctggatggagcagttctaccagctgatggacctgtaccagctgaagagcccccgcatccagaagctgctgcaggagctgctgatgagggaggagccccagccccaggagatcatctatgaggaggccctgaaggccacagagctggtgcctggagagcggctcttctgctgcctcttctgtggcagcagccacacccccaggagcccccaggagttccagggcgctgtgcccctgccctggcagaactgtgtgaggaccatcctgcctgtgggcatcgcccgctatggcatcctggagctggcctggaagagcctgcctgaggccgacctgcacctgaccaaggccctgacccacacagtggcccccaccctgtag

SEQ ID NO: 43631 - DNA, 1419 bp, Artificial Sequence
  Description of Artificial Sequence: Synthetic coding sequence
atggccagccccccacgctgcagccccacagcccatgaccgggagtgcaagctgcccccacccagcgccccagccagcgagtactgccctgggaagctgtcctggggcaccatggcccgggccctgggccgcttcaagctgagcatcccccacacccacctgctggccaccctggaccccctggccctggaccgggagcccccaccccacctgctgcctgagaagcaccaggtgcctgagaagctgatctggggagaccaggaccccctgagcaagatccccttcaagatcctgagcggccatgaacatgctgtgtccacctgccacttctgtgtggatgacaccaagctgctgagcggcagctatgactgcaccgtgaagctgtgggaccctgtggatggctctgtggtgcgggactttgagcaccggcccaaggcccctgtggtggagtgcagcatcaccggggacagcagccgggtgattgctgccagctatgacaagacagtgcgggcctgggacctggagaccgggaagctgctgtggaaggtgcgctatgacaccttcatcgtgtcctgcaagttctccccagatggcaagtatgtggtgtctggctttgatgtggaccacggcatctgcatcatggatgctgagaacatcaccaccgtgtctgtcatcaaggaccaccacaccaggagcatcaccagctgctgctttgatcctgacagccagagggtggcctctgtgtccctggaccgctgcatcaagatctgggatgtgaccagccaggccaccctgctgaccatcaccaaggcccacagcaatgccatcagcaactgctgcttcaccttcagcggccacttcctgtgcaccagctcctgggacaagaacctgaagatctggaatgtgcacactggagagttcaggaactgtggggcctgtgtgaccctgatgcagggccacgagggctctgtgagcagctgccactttgcccgggacagcagcttcctgatcagcggcggctttgacagaacagtggccatctgggatgtggccgagggctacaggaagctgagcctgaagggccacaatgactgggtgatggatgtggccatcagcaacaacaagaagtggatcctgagcgccagcaaggacaggaccatgaggctgtggaacatcgaggagattgatgagatccccctggtgatcaagtacaagaaggctgtgggcctgaagctgaagcagtgtgagcgctgtgaccggcccttcagcatcttcaagagtgacaccagcagcgagatgttcacccagtgtgtgttctgcagaattgacacccggggcctgcctgctgacaccagcagcagcagcagcagcagcgagcgggagaacagccccccaccccggggcagcaaggatgactag

SEQ ID NO: 43632 - DNA, 1281 bp, Artificial Sequence
  Description of Artificial Sequence: Synthetic coding sequence
atggccagccccccacgctgcagccccacagcccatgaccgggagtgcaagctgcccccacccagcgccccagccagcgagtactgccctgggaagctgtcctggggcaccatggcccgggccctgggccgcttcaagctgagcatcccccacacccacctgctggccaccctggaccccctggccctggaccgggagcccccaccccacctgctgcctgagaagcaccaggtgcctgagaagctgatctggggagaccaggaccccctgagcaagatccccttcaagatcctgagcggccatgaacatgctgtgtccacctgccacttctgtgtggatgacaccaagctgctgagcggcagctatgactgcaccgtgaagctgtgggaccctgtggatggctctgtggtgcgggactttgagcaccggcccaaggcccctgtggtggagtgcagcatcaccggggacagcagccgggtgattgctgccagctatgacaagacagtgcgggcctgggacctggagaccgggaagctgctgtggaaggtgcgctatgacaccttcatcgtgtcctgcaagttctccccagatggcaagtatgtggtgtctggctttgatgtggaccacggcatctgcatcatggatgctgagaacatcaccaccgtgtctgtcatcaaggaccaccacaccaggagcatcaccagctgctgctttgatcctgacagccagagggtggcctctgtgtccctggaccgctgcatcaagatctgggatgtgaccagccaggccaccctgctgaccatcaccaaggcccacagcaatgccatcagcaactgctgcttcaccttcagcggccacttcctgtgcaccagctcctgggacaagaacctgaagatctggaatgtgcacactggagagttcaggaactgtggggcctgtgtgaccctgatgcagggccacgagggctctgtgagcagctgccactttgcccgggacagcagcttcctgatcagcggcggctttgacagaacagtggccatctgggatgtggccgagggctacaggaagctgagcctgaagggccacaatgactgggtgatggatgtggccatcagcaacaacaagaagtggatcctgagcgccagcaaggacaggaccatgaggctgtggaacatcgaggagattgatgagatccccctggtgatcaagtacaagaaggctgtgggcctgaagctgaagcaggagaagaaggaggcctacctgaagctgaagcagggctag

SEQ ID NO: 43633 - DNA, 1164 bp, Artificial Sequence
  Description of Artificial Sequence: Synthetic coding sequence
atggagaagattgaggagcagtttgccaacctgcacatcgtgaagtgcagcctgggcaccaaggagcccacctacctgctgggcatcgacaccagcaagacagtgcaggccggcaaggagaacctggtggccgtgctgtgcagcaatggcagcatccgcatctatgacaaggagcggctgaatgtgctgcgggagttcagcggctacccaggcctgctgaatggagtgcgctttgccaacagctgtgacagcgtgtacagcgcctgcacagatggcaccgtgaagtgctgggatgcccgggtggcccgggagaagcctgtgcagctgttcaagggctaccccagcaacatcttcatcagctttgacatcaactgcaatgaccacatcatctgtgccggcacagagaaggtggatgatgatgccctgctggtgttctgggatgccaggatgaacagccagaacctgagcaccaccaaggacagcctgggcgcctacagcgagacccacagtgatgatgtgacccaggtgcgcttccaccccagcaaccccaacatggtggtgtctggcagcagtgatggcctggtgaatgtgtttgacatcaacatcgacaatgaggaggatgccctggtgaccacctgcaacagcatcagctctgtgtcctgcatcggctggagcggcaagggctacaagcagatctactgcatgacccatgatgagggcttctactggtgggacctgaaccacctggacacagatgagcctgtgacccggctgaacatccaggatgtgcgggaggtggtgaacatgaaggaggatgccctggactacctgattggaggcctgtaccacgagaagacagacaccctgcacgtgattggaggcaccaacaagggccgcatccacctgatgaactgcagcatgagcggcctgacccacgtgaccagcctgcagggcggccatgctgccaccgtgcgctccttctgctggaatgtgcaggatgacagcctgctgactggaggagaagatgcccagctgctgctgtggaagccaggggccatcgagaagaccttcaccaagaaggagagcatgaagatcgccagctctgtgcaccagagggtgcgggtgcacagcaatgacagctacaagaggaggaagaagcagtag

SEQ ID NO: 43634 - DNA, 1164 bp, Artificial Sequence; identical to SEQ ID NO: 43633
  Description of Artificial Sequence: Synthetic coding sequence

SEQ ID NO: 43635 - DNA, 900 bp, Artificial Sequence
  Description of Artificial Sequence: Synthetic coding sequence
atgctgtggtttggccagcccggccctgggggctggaacaggaagtgcctgcggcccttcaccctgccccggggccagcacccccagcccagctatggcttcccccaggtgaatgaggtggtgttcagccctggagagagccactgtgccacctgcagtgaagatggctctgtgcgggtgtgggccctggcctccatggagctggtgatccagttccaggtgctgaaccagagctgcctgtgcctggcctggagccccccctgctgcggccggcctgagcagcagaggctggccgccggctatggagatggcagcctgcgcatcttctctgtgtccaggacagccatggagctgaagatgcacccccaccctgtggccctgaccaccgtggccttcagcacagatggccagacagtgctgagcggggacaaggatggcctggtggccgtgagccacccctgcaccggcaccaccttccgggtgctgagtgaccaccagggcgcccccatcagcaccatctgtgtgacctgcaaggagacccagggccacctgccccccagcctggccgccttctgcccctgggatggagccctgctgatgtatgtgggccctggggtgtacaaggaggtgatcatctacaacctgtgccagaagcaggtggtggagaagatccccctgcccttctttgccatgagcctgagcctgagccctggcacccacctgctggccgtgggctttgctgagtgcatgctgcggctggtggactgtgccatgggcacagcccaggactttgctggccatgacaatgctgtgcacctgtgccgcttcaccccatctgcccggctgctcttcaccgctgccagaaatgagatcctggtgtgggaggtgcccggcctgtag

SEQ ID NO: 43636 - DNA, 5247 bp, Artificial Sequence
  Description of Artificial Sequence: Synthetic coding sequence
atggcccgggcctggcagcaccccttcctgaatgtgttccgccacttccgggtggatgagtggaagaggtctgccaagcagggagatgtggccgtggtgacagacaagaccctgaagggagctgtgtaccgcatccggggctctgtgtctgctgccaactacatccagctgcccaagagcagcacccagagcctgggcctgaccggccgctacctgtatgtgctcttccggcccctgcccagcaagcacttcgtcatccacctggatgtgagcagcaaggacaaccaggtgatccgggtgtccttcagcaacctcttcaaggagttcaagagcacagccacctggctgcagttccccctggtgctggaggcccggaccccccagagggacctggtgggcctggcccccagcggggcccgctggacctgcctgcagctggacctgcaggatgtgctgctggtgtacctgaaccgctgctacggccacctgaagagcatccggctgtgtgccagcctgctggtgaggaacctgtacaccagtgacctgtgctttgagcccgccatcagcggggcccagtgggccaagctgcctgtgacccccatgccccgggagatggccttccctgtgcccaagggggagagctggcatgaccgctacatccacgtgcgcttccccagcgagagcctgaaggtgcccagcaagcccatcgagaagagctgcagccccccagaggccgtgctgctgggccctggcccccagcccctgccctgccctgtggccagcagcaagcctgtgcgcttctctgtgtcccctgtggtgcagacccccagccccacagccagcggccgggccgccctggccccccggcccttccctgaggtgtccctgagccaggagaggagtgatgccagcaatgctgatggccctggcttccacagcctggagccctgggcccagctggaggccagtgacatccacacagctgctgctggcacccacgtgctgacccatgaatctgctgaggtgcctgtggccaggacaggcagctgtgagggcttcctgcctgaccctgtgctgcggctgaagggcgtgattggatttggaggccacggcacccggcaggccctgtggaccccagatggagctgctgtggtgtacccctgccacgccgtcatcgtggtgctgctggtggacacaggagagcagcgcttcttcctgggccacacagacaaggtgtctgccctggccctggatggcagcagcagcctgctggccagcgcccaggcccgggcccccagcgtgatgaggctgtgggacttccagacaggccgctgcctgtgcctcttccgcagccccatgcacgtggtgtgcagcctgtccttcagtgacagcggggccctgctgtgtggggtgggcaaggaccaccacggccgcaccatggtggtggcctggggcaccggccaggtgggcctgggcggggaggtggtggtgctggccaaggcccacacagactttgatgtgcaggccttccgggtgaccttctttgatgagaccaggatggccagctgtggccagggctctgtgcggctgtggaggctgcggggcggcgtgctgcggagctgccctgtggacctgggggagcaccacgccctgcagttcacagacctggccttcaagcaggccagagatggctgcccagagcccagcgctgccatgctgtttgtgtgcagccgcagcggccacatcctggagattgactgccagaggatggtggtgagacatgcccggcggctgctgcccaccaggacccctgggggcccccacccccagaagcagaccttcagcagcggccctggcatcgccatcagcagcctgtctgtgtccccagccatgtgtgctgtgggctctgaagatggcttcctgcggctgtggcccctggacttcagctctgtgctgctggaggccgagcacgagggccctgtgtcctctgtgtgtgtgtccccagatggcctgcgggtgctgagcgccaccagcagcggccacctgggcttcctggacaccctgagccgggtgtaccacatgctggcccggagccacacagcccctgtgctggccctggccatggagcagaggcggggccagctggccaccgtgtcccaggacagaacagtgcgcatctgggacctggccaccctgcagcagctgtatgacttcaccagcagtgaagatgccccctgtgctgtgaccttccaccccacccggcccaccttcttctgtggcttcagcagtggagctgtgcgctccttcagcctggaggccgctgaggtgctggtggagcacacctgccacagaggagctgtgacaggcctgacagccaccccagatggccgcctgctcttcagcagctgcagccagggcagcctggcccagtacagctgtgccgacccccagtggcacgtgctgcgggtggccgctgacatggtgtgcccagatgccccagccagccccagcgccctggccgtgtccagagatggccgcctgctggcctttgtgggccccagccgctgcaccgtgacagtgatgggcagcgccagcctggatgagctgctgcgggtggacatcggcaccctggacctggccagcagccggctggacagcgccatggctgtgtgcttcggccctgctgccctgggccacctgctggtgtccaccagcagcaacagagtggtggtgctggatgctgtgtctggccgcatcatccgggagctgcccggggtgcaccctgagccctgccccagcctgaccctgtctgaagatgcccgcttcctgctgattgctgctggccgcaccatcaaggtgtgggactatgccacccaggccagccctggcccccaggtgtacatcggccacagcgagcctgtgcaggccgtggccttctccccagaccagcagcaggtgctgtctgctggagatgctgtgttcctgtgggatgtgctggcccccacagaaagtgaccagagcttccctggggcccccccagcctgcaagacaggccctggagctggccccctggaggatgctgccagccgggccagcgagctgccccggcagcaggtgcccaagccctgccaggccagccccccccggctgggcgtgtgtgcccggcccccagagggcggagatggagcccgggacaccagaaattctggggcccccaggaccacctacctggccagctgcaaggccttcaccccagcccgggtgtcctgcagcccccacagcgccaagggcacctgccccccaccagccagcggcggctggctgcggctgaaggctgtggtgggctacagcggaaatggccgggccaacatggtgtggaggccagacaccggcttctttgcctacacctgtggccgcctggtggtggtggaggacctgcacagcggggcccagcagcactggagcggccacagcgctgagatcagcaccctggccctgagccacagcgcccaggtgctggccagcgccagcggccgcagcagcaccacagcccactgccagatccgggtgtgggatgtgtctgggggcctgtgccagcacctgatcttcccccacagcaccaccgtgctggccctggccttctccccagatgaccggctgctggtgaccctgggggaccatgatggccgcaccctggccctgtggggcacagccacctatgacctggtgagcagcacccggctgcctgagcctgtgcatggagtggccttcaacccctgggatgctggggagctgacctgtgtgggccagggcaccgtgaccttctggctgctgcagcagagaggagctgacatcagcctgcaggtgcggcgggagcctgtgcctgaggccgtgggcgctggggagctgaccagcctgtgctacggggccccacccctgctgtactgcggcaccagcagcggccaggtgtgtgtgtgggacacccgggccggccgctgcttcctgtcctgggaggctgatgatggcggcatcggcctgctgctcttcagcggcagccggctggtgtctggcagcagcacaggccgcctgcggctgtgggccgtgggcgctgtgtctgagctgcgctgcaagggcagcggggccagctctgtgttcatggagcacgagctggtgctggatggagctgtggtgtctgccagctttgatgacagcgtggacatgggcgtggtgggcaccacagctggcaccctgtggtttgtgtcctgggccgagggcaccagcaccaggctcatcagcggccacaggagcaaggtgaatgaggtggtgttcagccctggagagagccactgtgccacctgcagtgaagatggctctgtgcgggtgtgggccctggcctccatggagctggtgatccagttccaggtgctgaaccagagctgcctgtgcctggcctggagccccccctgctgcggccggcctgagcagcagaggctggccgccggctatggagatggcagcctgcgcatcttctctgtgtccaggacagccatggagctgaagatgcacccccaccctgtggccctgaccaccgtggccttcagcacagatggccagacagtgctgagcggggacaaggatggcctggtggccgtgagccacccctgcaccggcaccaccttccgggtgctgagtgaccaccagggcgcccccatcagcaccatctgtgtgacctgcaaggaatgtgaggacctgggcgtggagggcacagacctgtggctggccgccagcggggaccagagggtgtctgtgtgggccagtgactggctgaggaaccactgtgagctggtggactggctgtccttccccatgcctgccaccacagagacccagggccacctgccccccagcctggccgccttctgcccctgggatggagccctgctgatgtatgtgggccctggggtgtacaaggaggtgatcatctacaacctgtgccagaagcaggtggtggagaagatccccctgcccttctttgccatgagcctgagcctgagccctggcacccacctgctggccgtgggctttgctgagtgcatgctgcggctggtggactgtgccatgggcacagcccaggactttgctggccatgacaatgctgtgcacctgtgccgcttcacccccagcgcccggctgctcttcaccgctgccagaaatgagatcctggtgtgggaggtgcccggcctgtag

SEQ ID NO: 43637 - DNA, 1911 bp, Artificial Sequence
  Description of Artificial Sequence: Synthetic coding sequence
atggccgaggccgtggagaggacagatgagctggtgcgggagtacctgctcttccggggcttcacccacaccctgcggcagctggatgctgagatcaaggctgacaaggagaagggcttccgggtggacaagatcgtggaccagctgcagcagctgatgcaggtgtatgacctggccgccctgcgggactactggagctacctggagcggcggctcttcagccggctggaggacatctaccggcccaccatccacaagctgaagaccagcctcttccgcttctacctggtgtacaccatccagaccaacagaaatgacaaggcccaggagttctttgccaagcaggccacagagctgcagaaccaggccgagtggaaggactggtttgtgctgcccttcctgcccagcccagacaccaaccccacctttgccacctacttcagccggcagtgggccgacaccttcatcgtgtccctgcacaacttcctgtctgtgctcttccagtgcatgcctgtgcctgtgatcctgaactttgatgctgagtgccagaggaccaaccaggtgcaggaggagaatgaggtgctgcggcagaagctgtttgccctgcaggccgagatccaccggctgaagaaggaggagcagcagcctgaggaggaggaggccctggtgcagcacaagctgcccccctacgtgagcaacatggaccggctgggggacagcgagctggccatggtgtgcagccagagaaatgccagcctgagccagagcccccgggtgggcttcctgagcagcctgctgccccagagcaagaagagccccagccggctgagccctgcccagggccccccccagccccagagcagcgccaagaaggagagctttggaggccagggcaccaagggcaaggaccccaccagcggggccaaggatggcaagagcctgctgagcggcctggccaccggggagagcggctggagccagcaccggcagaggcggctgcaggaccacggcaaggagaggaaggagctgttcagcaccaccaccagccagtgtgccgagaagaagccagaggccagcggccctgaggccgagccctgcccagagctgcacacagagcctgtggagcccctgacccgggccagcagcgctggccctgagggcggcggcgtgcggcctgagcagcccttcatcgtgctgggccaggaggagtatggagagcaccacagcagcatcatgcactgccgggtggactgcagcggcagaagagtggccagcctggatgtggatggagtcatcaaggtgtggagcttcaaccccatcatgcagaccaaggccagcagcatcagcaagagccccctgctgagcctggagtgggccaccaagagggaccggctgctgctgctgggcagcggcgtgggcaccgtgcggctgtatgacacagaggccaagaagaacctgtgtgagatcaacatcaatgacaacatgccccgcatcctgagcctggcctgcagccccaacggggccagctttgtgtgcagcgctgctgcccccagcctgaccagccaggtggacttcagcgccccagacatcggcagcaagggcatgaaccaggtgcccggccgcctgctgctgtgggacaccaagaccatgaagcagcagctgcagttcagcctggaccctgagcccatcgccatcaactgcacagccttcaaccacaatggaaacctgctggtgactggagctgctgatggagtcatccggctgtttgtgcaccctgtggagcacccccaggagtggccccagggcatccgggtgcagccccccctgcgctgccacggccccctgtgtgctgtgtggatccagaggctgcaggccggcagcagcccccagggccccaccctgcgcttctag

SEQ ID NO: 43638 - DNA, 2244 bp, Artificial Sequence
  Description of Artificial Sequence: Synthetic coding sequence
atggccgaggccgtggagaggacagatgagctggtgcgggagtacctgctcttccggggcttcacccacaccctgcggcagctggatgctgagatcaaggctgacaaggagaagggcttccgggtggacaagatcgtggaccagctgcagcagctgatgcaggtgtatgacctggccgccctgcgggactactggagctacctggagcggcggctcttcagccggctggaggacatctaccggcccaccatccacaagctgaagaccagcctcttccgcttctacctggtgtacaccatccagaccaacagaaatgacaaggcccaggagttctttgccaagcaggccacagagctgcagaaccaggccgagtggaaggactggtttgtgctgcccttcctgcccagcccagacaccaaccccacctttgccacctacttcagccggcagtgggccgacaccttcatcgtgtccctgcacaacttcctgtctgtgctcttccagtgcatgcctgtgcctgtgatcctgaactttgatgctgagtgccagaggaccaaccaggtgcaggaggagaatgaggtgctgcggcagaagctgtttgccctgcaggccgagatccaccggctgaagaaggaggagcagcagcctgaggaggaggaggccctggtgcagcacaagctgcccccctacgtgagcaacatggaccggctgggggacagcgagctggccatggtgtgcagccagagaaatgccagcctgagccagagcccccgggtgggcttcctgagcagcctgctgccccagagcaagaagagccccagccggctgagccctgcccagggccccccccagccccagagcagcgccaagaaggagagctttggaggccagggcaccaagggcaaggaccccaccagcggggccaaggatggcaagagcctgctgagcggcctggccaccggggagagcggctggagccagcaccggcagaggcggctgcaggaccacggcaaggagaggaaggagctgttcagcaccaccaccagccagtgtgccgagaagaagccagaggccagcggccctgaggccgagccctgcccagagctgcacacagagcctgtggagcccctgacccgggccagcagcgctggccctgagggcggcggcgtgcggcctgagcagcccttcatcgtgctgggccaggaggagtatggagagcaccacagcagcatcatgcactgccgggtggactgcagcggcagaagagtggccagcctggatgtggatggagtcatcaaggtgtggagcttcaaccccatcatgcagaccaaggccagcagcatcagcaagagccccctgctgagcctggagtgggccaccaagagggaccggctgctgctgctgggcagcggcgtgggcaccgtgcggctgtatgacacagaggccaagaagaacctgtgtgagatcaacatcaatgacaacatgccccgcatcctgagcctggcctgcagccccaacggggccagctttgtgtgcagcgctgctgcccccagcctgaccagccaggtggacttcagcgccccagacatcggcagcaagggcatgaaccaggtgcccggccgcctgctgctgtgggacaccaagaccatgaagcagcagctgcagttcagcctggaccctgagcccatcgccatcaactgcacagccttcaaccacaatggaaacctgctggtgactggagctgctgatggagtcatccggctgtttgacatgcagcagcatgaatgtgccatgtcctggagggcccactacggggaggtgtacagcgtggagttctcctatgatgagaacacagtgtacagcatcggggaggatggcaagttcatccagtggaacatccacaagagcggcctgaaggtgtctgagtacagcctgcccagtgatgccaccggcccctttgtgctgagcggctacagcggctacaagcaggtgcaggtgccccggggccgcctgtttgcctttgacagcgagggcaactacatgctgacctgcagcgccactggaggagtcatctacaagctgggcggagatgagaaggtgctggagagctgcctgagcctgggcggccaccgggcccctgtggtgacagtggactggagcacagccatggactgtggcacctgcctgacagcctccatggatggcaagatcaagctgaccaccctgctggcccacaaggcctag

SEQ ID NO: 43639 - DNA, 2613 bp, Artificial Sequence
  Description of Artificial Sequence: Synthetic coding sequence
atggccaccaacatcccctgtgaggtggtggccttcagtgacaggaagctgaagcccctcatctacgtgtacagcttccctggcctgaccaggaggaccaagctgaagggcaacatcctgctggactacaccctgctgtccttctcctactgcggcacctacctggccagctacagcagcctgcctgagtttgagctggccctgtggaactgggagagcagcatcatcctgtgcaagaagagccagcccggcatggatgtgaaccagatgtccttcaaccccatgaactggaggcagctgtgcctgagcagccccagcacagtgtctgtgtggaccatcgagaggagcaaccaggagcactgcttccgggcccggtctgtgaagctgcccctggaggatggcagcttcttcaatgaaacagatgtggtgttcccccagagcctgcccaaggacctgatctacggccctgtgctgcccctgagcgccatcgccggcctggtgggcaaggaggccgagaccttccggcccaaggatgacctgtaccccctgctgcaccccaccatgcactgctggacccccaccagtgacctgtacatcggctgtgaggagggccacctgctgatgatcaacggggacaccctgcaggtgacagtgctgaacaagattgaggaggagagccccctggaggacagaagaaacttcatcagccctgtgaccctggtgtaccagaaggagggcgtgctggccagcggcattgatggctttgtgtacagcttcatcatcaaggacaggagctacatgattgaggacttcctggagattgaaagacctgtggagcacatgaccttcagccccaactacacagtgctgctgatccagacagacaagggctctgtgtacatctacaccttcggcaaggagcccaccctgaacaaggtgctggatgcctgtgatggcaagttccaggccatcgacttcatcaccccaggcacccagtacttcatgaccctgacctacagcggggagatctgtgtgtggtggctggaggactgtgcctgtgtgtccaagatctacctgaacaccctggccaccgtgctggcctgctgccccagcagcctgtctgctgctgtgggcacagaagatggctctgtgtacttcatctctgtgtatgacaaggagagcccccaggtggtgcacaaggccttcctgtctgagagctctgtgcagcacgtggtgtatgaccagcagggcatcttcctgctggtgggcacagctgagggcaaggtgttcatcatcaatgccaacagcagcagcagcttccagatcatcggcttcacagaggtggccaaggacatcctgcagatcagcacagtgtccctgctggagacagacatcgtggaggtgatggtgctgagcagcctgcctgaggccggccgcagccggctggagatgttcaccctgcccaccctgctgccccaggtgtccaccacctttgctgatgagcggggccgcctgaaggatgagatcatccacaagtacctgtatgagctggagcacgccctgagcagcgctgtgctgggcttccagagcaaccagatctacggcttctgcagccaggtgccctacatctgcagctacctgctgcctgaggaggagcacacaggcatctacatcctgaagccctacaagaaggtgcagagccggcagtatggccctggcctgctgtacctgagcagccacggcctgtggctgatcaccatcgccaagtgtggcatcctgtgcatcagagatgtgtacaccctggagacctttgcctggtgccgcagccacagccaccagggccacggcatccagagcatgaggatctccatggatggccagaacatcctggtgaatggaagagatgatggcaccctggtgtacctgaagtggaagagatttggaggccacctggccagcgagatcctggactactaccagaagctgctgatcagcctgagcagcgccatggacaaggagaaccactacctgagcaccacccccaaggtgtctgtggacctgggcagtgacagcgagcacaccaagcagaaggccagcacagacctgagccaggatgagctggtgctgacagatgtgaagaaggagatcccctggatccagcagaagagccaggaggccatcaagaaggaggtgaacctcttcagcaagaagaggaaggagatcaagcagggcatcaagagcctgagcaagaccatcctgaacatgatggaggagaatgacaagctggagaacatcgccaagctggaccagcaggagtttggcctggacctggaggagctggagcggctgcatgatgagagccaggaggaggtggccaagatgatcaaggatgtggagatgcacaacctggccaagagctacctggccgagctgatcaaggaggagtgctggaacagcatggctgtgaagggccgggccctgaagtgcttccacatcccctgtgtggtggagaacttccccatgaaggccaggacagtggaggagctgaaggagctggagcgggtgctgcagcagaagaagattgaagctgagtgcctgaaggtgctcttctag

SEQ ID NO: 43640 - DNA, 4998 bp, Artificial Sequence
  Description of Artificial Sequence: Synthetic coding sequence
atggcccagggccgggagagagatgagggcccccacagcgctgggggcgccagcctgtctgtgcgctgggtgcagggcttccccaagcagaatgtgcactttgtgaatgacaacaccatctgctacccctgtggcaactacgtgatcttcatcaacatcgagaccaagaagaagacagtgctgcagtgcagcaatggaattgtgggcgtgatggccaccaacatcccctgtgaggtggtggccttcagtgacaggaagctgaagcccctcatctacgtgtacagcttccctggcctgaccaggaggaccaagctgaagggcaacatcctgctggactacaccctgctgtccttctcctactgcggcacctacctggccagctacagcagcctgcctgagtttgagctggccctgtggaactgggagagcagcatcatcctgtgcaagaagagccagcccggcatggatgtgaaccagatgtccttcaaccccatgaactggaggcagctgtgcctgagcagccccagcacagtgtctgtgtggaccatcgagaggagcaaccaggagcactgcttccgggcccggtctgtgaagctgcccctggaggatggcagcttcttcaatgaaacagatgtggtgttcccccagagcctgcccaaggacctgatctacggccctgtgctgcccctgagcgccatcgccggcctggtgggcaaggaggccgagaccttccggcccaaggatgacctgtaccccctgctgcaccccaccatgcactgctggacccccaccagtgacctgtacatcggctgtgaggagggccacctgctgatgatcaacggggacaccctgcaggtgacagtgctgaacaagattgaggaggagagccccctggacagaagaaacttcatcagccctgtgaccctggtgtaccagaaggagggcgtgctggccagcggcattgatggctttgtgtacagcttcatcatcaaggacaggagctacatgattgaggacttcctggagattgaaagacctgtggagcacatgaccttcagccccaactacacagtgctgctgatccagacagacaagggctctgtgtacatctacaccttcggcaaggagcccaccctgaacaaggtgctggatgcctgtgatggcaagttccaggccatcgacttcatcaccccaggcacccagtacttcatgaccctgacctacagcggggagatctgtgtgtggtggctggaggactgtgcctgtgtgtccaagatctacctgaacaccctggccaccgtgctggcctgctgccccagcagcctgtctgctgctgtgggcacagaagatggctctgtgtacttcatctctgtgtatgacaaggagagcccccaggtggtgcacaaggccttcctgtctgagagctctgtgcagcacgtggtgtatgaccagcagggcatcttcctgctggtgggcacagctgagggcaaggtgttcatcatcaatgccaacagcagcagcagcttccagatcatcggcttcacagaggtggccaaggacatcctgcagatcagcacagtgtccctgctggagacagacatcgtggaggtgatggtgctgagcagcctgcctgaggccggccgcagccggctggagatgttcaccctgcccaccctgctgccccaggtgtccaccacctttgctgatgagcggggccgcctgaaggatgagatcatccacaagtacctgtatgagctggagcacgccctgagcagcgctgtgctgggcttccagagcaaccagatctacggcttctgcagccaggtgccctacatctgcagctacctgctgcctgaggaggagcacacaggcatctacatcctgaagccctacaagaaggtgcagagccggcagtatggccctggcctgctgtacctgagcagccacggcctgtggctgatcaccatcgccaagtgtggcatcctgtgcatcagagatgtgtacaccctggagacctttgcctggtgccgcagccacagccaccagggccacggcatccagagcatgaggatctccatggatggccagaacatcctggtgaatggaagagatgatggcaccctggtgtacctgaagtggaagagatttggaggccacctggccagcgagatcctggactactaccagaagctgctgatcagcctgagcagcgccatggacaaggagaaccactacctgagcaccacccccaaggtgtctgtggacctgggcagtgacagcgagcacaccaagcagaaggccagcacagacctgagccaggatgagctggtgctgacagatgtgaagaaggagatcccctggatccagcagaagagccaggaggccatcaagaaggaggtgaacctcttcagcaagaagaggaaggagatcaagcagggcatcaagagcctgagcaagaccatcctgaacatgatggaggagaatgacaagctggagaacatcgccaagctggaccagcaggagtttggcctggacctggaggagctggagcggctgcatgatgagagccaggaggaggtggccaagatgatcaaggatgtggagatgcacaacctggccaagagctacctggccgagctgatcaaggaggagtgctggaacagcatggctgtgaagggccgggccctgaagtgcttccacatcccctgtgtggtggagaacttccccatgaaggccaggacagtggaggagctgaaggagctggagcgggtgctgcagcagaagaagattgaagcagaatgtctgaagctgaggaaggagatcgtggaggcccagagcggcgtgaagctgatcaagcagagacatgaagaagatgatgaggaggaggaggaggaggacaagacagtgaagtacagcaacctgcccaactacctgctgggcagcctgagcacagactttggagtggacaccagcctgctgagcagccagctggagctgcacagccgggaggagaagatcaaccagatcatcctgctgaaggacatcatctacaaggtgaagacagtgttcaacaatgaatttgatgctgcctacaagcagaaggagtttgagatcgcccgggtgaaggagagaaatgtgcgcatccgggagatcatcctggacctggagctggaggaggccgtgtggcagcctgagtttgaggactgtgagaagccagagaggaccctggtggtgcaggatgaggagatcacagcccacaagcacatcaagccctggcacaaggccaaggagctgattgtgaaccacgagaaggagcactggctgctgatccaggatgccagcacccggctgcgggccctgatggacatgatgggcggcgtgctggaggtgaagaaggaggacatcctgaggatggtgatcccccagcctgccttcatggccaagccagatgctgtgtggacagaggaggagaggaagcagttcaaggactatgagaagaaggtgaaggagctgaatgaggagcgggacaagtacaggaagagcctggaggccgagctgaagaagctgcagaacagcatccaggagagcacccaggcctttgatgagcacctgaagaggctgtttgagcggcgggtgaaggccgagatggtgaccaaccaggaggagctgaagatcagcaacctggccttcagcctgctgctggatgaggagctgagcagccgggagaagttcctgaacaactacctgaccaggaagcagcacgagaagagccagaccagcgaggccgtgaggaagagccgggaggacctggatgtgtgcaaggagcactatgacaacctgctggccgaggacaaggtgatggacaggagcttcaagaaggagttcagcgagatccctggccaccaggtggacatcctgtacaagctgttcaagaggcggccccgcatcagcaagcagaagacccacagcgagaccacctctgtggtgccctttggagagctgcccggcagcggcaagctgaacaaggatgcctttgcccagctgatgaaggccatggatgagctggacaacatcagcaacatgcctgagggcctggaccccctggtgtggaaccacttctgcatgacccggcgggccaaggtggagaatgagcagaaggtgaagcagaaggctgctgacctgctggagatggccaccttcctgcagaagagggtggaggaggaggagaaggtgcagcaggagattgaaagagtcttccacgagctgatcctgctgcaggaggagaaggtgcgcttccagctgaacctgaccatccagatcctgctgaagcagggccaggtggagctggagaacttccagctggtgctggagtacagtgatgccatcctgatcaacaagaacatcatcgaggacctgaacagcgtcatccgcacccagggccagaagaaggtggcctccatgatggagagcaaggatgtgcacaagaggatcctgcagatcgagtgggagcacaagaagatggagatggagcgggaggacctgaaccagaaggcctgggacatccagatgctgttcttcagccgggaccggcagaagtacctgaatgagcccaactatgaggccctgatcagcatccagatcggcatcatggagcagaccatcgctgtgctggacaagatgcacaagaagaatgtggagaactgcaagaagctgctgaagaagctgggcaagttcagcaaccagaaggacatcgccaactatgccctgagctgcaacctgcgggaggagctggtggccgtgtctgagaggaaggacatctgcaatgccatgggcagcaagctgacctgtgagaagatcgtgaaggagagatatgagaacatgatgcagcagcagaagctgaccaacatcagcaagcagcaggccgagcagatcagcatcctgcagacagaggtggagcggctgaggatgaagaccttccctgccctggtgcagatgtag

SEQ ID NO: 43641 - DNA, 912 bp, Artificial Sequence
  Description of Artificial Sequence: Synthetic coding sequence
atggccaccaacatcccctgtgaggtggtggccttcagtgacaggaagctgaagcccctcatctacgtgtacagcttccctggcctgaccaggaggaccaagctgaagggcaacatcctgctggactacaccctgctgtccttctcctactgcggcacctacctggccagctacagcagcctgcctgagtttgagctggccctgtggaactgggagagcagcatcatcctgtgcaagaagagccagcccggcatggatgtgaaccagatgtccttcaaccccatgaactggaggcagctgtgcctgagcagccccagcacagtgtctgtgtggaccatcgagaggagcaaccaggagcactgcttccgggcccggtctgtgaagctgcccctggaggatggcagcttcttcaatgaaacagatgtggtgttcccccagagcctgcccaaggacctgatctacggccctgtgctgcccctgagcgccatcgccggcctggtgggcaaggaggccgagaccttccggcccaaggatgacctgtaccccctgctgcaccccaccatgcactgctggacccccaccagtgacctgtacatcggctgtgaggagggccacctgctgatgatcaacggggacaccctgcaggtgacagtgctgaacaagattgaggaggagagccccctggaggacagaagaaacttcatcagccctgtgaccctggtgtaccagaaggagggcgtgctggccagcggcattgatggctttgtgtacagcttcatcatcaaggacaggagctacatgattgaggacttcctggagattgaaagacctgtggagcacatgaccttcagccccaactacacagtgctgctgatccagacagacaaggtgtgctggatggtgatctcctag

SEQ ID NO: 43642 - DNA, 1239 bp, Artificial Sequence
  Description of Artificial Sequence: Synthetic coding sequence
atggccaccaacatcccctgtgaggtggtggccttcagtgacaggaagctgaagcccctcatctacgtgtacagcttccctggcctgaccaggaggaccaagctgaagggcaacatcctgctggactacaccctgctgtccttctcctactgcggcacctacctggccagctacagcagcctgcctgagtttgagctggccctgtggaactgggagagcagcatcatcctgtgcaagaagagccagcccggcatggatgtgaaccagatgtccttcaaccccatgaactggaggcagctgtgcctgagcagccccagcacagtgtctgtgtggaccatcgagaggagcaaccaggagcactgcttccgggcccggtctgtgaagctgcccctggaggatggcagcttcttcaatgaaacagatgtggtgttcccccagagcctgcccaaggacctgatctacggccctgtgctgcccctgagcgccatcgccggcctggtgggcaaggaggccgagaccttccggcccaaggatgacctgtaccccctgctgcaccccaccatgcactgctggacccccaccagtgacctgtacatcggctgtgaggagggccacctgctgatgatcaacggggacaccctgcaggtgacagtgctgaacaagattgaggaggagagccccctggaggacagaagaaacttcatcagccctgtgaccctggtgtaccagaaggagggcgtgctggccagcggcattgatggctttgtgtacagcttcatcatcaaggacaggagctacatgattgaggacttcctggagattgaaagacctgtggagcacatgaccttcagccccaactacacagtgctgctgatccagacagacaagggctctgtgtacatctacaccttcggcaaggagcccaccctgaacaaggtgctggatgcctgtgatggcaagttccaggccatcgacttcatcaccccaggcacccagtacttcatgaccctgacctacagcggggagatctgtgtgtggtggctggaggactgtgcctgtgtgtccaagatctacctgaacaccctggccaccgtgctggcctgctgccccagcagcctgtctgctgctgtgggcacagaagatggctctgtgtacttcatctctgtgtatgacaaggagagcccccaggtggtgcacaaggccttcctgtctgagagctctgtgcagcacgtggtgtag

SEQ ID NO: 43643 - DNA, 4914 bp, Artificial Sequence
  Description of Artificial Sequence: Synthetic coding sequence
atggcccagggccgggagagagatgagggcccccacagcgctgggggcgccagcctgtctgtgcgctgggtgcagggcttccccaagcagaatgtgcactttgtgaatgacaacaccatctgctacccctgtggcaactacgtgatcttcatcaacatcgagaccaagaagaagacagtgctgcagtgcagcaatggaattgtgggcgtgatggccaccaacatcccctgtgaggtggtggccttcagtgacaggaagctgaagcccctcatctacgtgtacagcttccctggcctgaccaggaggaccaagctgaagggcaacatcctgctggactacaccctgctgtccttctcctactgcggcacctacctggccagctacagcagcctgcctgagtttgagctggccctgtggaactgggagagcagcatcatcctgtgcaagaagagccagcccggcatggatgtgaaccagatgtccttcaaccccatgaactggaggcagctgtgcctgagcagccccagcacagtgtctgtgtggaccatcgagaggagcaaccaggagcactgcttccgggcccggtctgtgaagctgcccctggaggatggcagcttcttcaatgaaacagatgtggtgttcccccagagcctgcccaaggacctgatctacggccctgtgctgcccctgagcgccatcgccggcctggtgggcaaggaggccgagaccttccggcccaaggatgacctgtaccccctgctgcaccccaccatgcactgctggacccccaccagtgacctgtacatcggctgtgaggagggccacctgctgatgatcaacggggacaccctgcaggtgacagtgctgaacaagattgaggaggagagccccctggaggacagaagaaacttcatcagccctgtgaccctggtgtaccagaaggagggcgtgctggccagcggcattgatggctttgtgtacagcttcatcatcaaggacaggagctacatgattgaggacttcctggagattgaaagacctgtggagcacatgaccttcagccccaactacacagtgctgctgatccagacagacaagggctctgtgtacatctacaccttcggcaaggagcccaccctgaacaaggtgctggatgcctgtgatggcaagttccaggccatcgacttcatcaccccaggcacccagtacttcatgaccctgacctacagcggggagatctgtgtgtggtggctggaggactgtgcctgtgtgtccaagatctacctgaacaccctggccaccgtgctggcctgctgccccagcagcctgtctgctgctgtgggcacagaagatggctctgtgtacttcatctctgtgtatgacaaggagagcccccaggtggtgcacaaggccttcctgtctgagagctctgtgcagcacgtggtgtatgaccagcagggcatcttcctgctggtgggcacagctgagggcaaggtgttcatcatcaatgccaacagcagcagcagcttccagatcatcggcttcacagaggtggccaaggacatcctgcagatcagcacagtgtccctgctggagacagacatcgtggaggtgatggtgctgagcagcctgcctgaggccggccgcagccggctggagatgttcaccctgcccaccctgctgccccaggtgtccaccacctttgctgatgagcggggccgcctgaaggatgagatcatccacaagtacctgtatgagctggagcacgccctgagcagcgctgtgctgggcttccagagcaaccagatctacggcttctgcagccaggtgccctacatctgcagctacctgctgcctgaggaggagcacacaggcatctacatcctgaagccctacaagaaggtgcagagccggcagtatggccctggcctgctgtacctgagcagccacggcctgtggctgatcaccatcgccaagtgtggcatcctgtgcatcagagatgtgtacaccctggagacctttgcctggtgccgcagccacagccaccagggccacggcatccagagcatgaggatctccatggatggccagaacatcctggtgaatggaagagatgatggcaccctggtgtacctgaagtggaagagatttggaggccacctggccagcgagatcctggactactaccagaagctgctgatcagcctgagcagcgccatggacaaggagaaccactacctgagcaccacccccaaggtgtctgtggacctgggcagtgacagcgagcacaccaagcagaaggccagcacagacctgagccaggatgagctggtgctgacagatgtgaagaaggagatcccctggatccagcagaagagccaggaggccatcaagaaggaggtgaacctcttcagcaagaagaggaaggagatcaagcagggcatcaagagcctgagcaagaccatcctgaacatgatggaggagaatgacaagctggagaacatcgccaagctggaccagcaggagtttggcctggacctggaggagctggagcggctgcatgatgagagccaggaggaggtggccaagatgatcaaggatgtggagatgcacaacctggccaagagctacctggccgagctgatcaaggaggagtgctggaacagcatggctgtgaagggccgggccctgaagtgcttccacatcccctgtgtggtggagaacttccccatgaaggccaggacagtggaggagctgaaggagctggagcgggtgctgcagcagaagaagattgaagctgagtgcctgaagctgaggaaggagatcgtggaggcccagagcggcgtgaagctgatcaagcagagacatgaggaggatgatgaggaggaggaggaggaggacaagacagtgaagtacagcaacctgcccaactacctgctgggcagcctgagcacagactttggagtggacaccagcctgctgagcagccagctggagctgcacagccgggaggagaagatcaaccagatcatcctgctgaaggacatcatctacaaggtgaagacagtgttcaacaatgaatttgatgctgcctacaagcagaaggagtttgaaattgcccgggtgaaggagagaaatgtgcgcatccgggagatcatcctggacctggagctggaggaggccgtgtggcagcctgagtttgaggactgtgagaagccagagaggaccctggtggtgcaggatgaggagatcacagcccacaagcacatcaagccctggcacaaggccaaggagctgattgtgaaccacgagaaggagcactggctgctgatccaggatgccagcacccggctgcgggccctgatggacatgatgggcggcgtgctggaggtgaagaaggaggacatcctgaggatggtgatcccccagcctgccttcatggccaagccagatgctgtgtggacagaggaggagaggaagcagttcaaggactatgagaagaaggtgaaggagctgaatgaggagcgggacaagtacaggaagagcctggaggccgagctgaagaagctgcagaacagcatccaggagagcacccaggcctttgatgagcacctgaagaggctgtttgaaagaagagtgaaggccgagatggtgaccaaccaggaggagctgaagatcagcaacctggccttcagcctgctgctggatgaggagctgagcagccgggagaagttcctgaacaactacctgaccaggaagcagcacgagaaggtgatggacaggagcttcaagaaggagttcagcgagatccctggccaccaggtggacatcctgtacaagctgttcaagaggcggccccgcatcagcaagcagaagacccacagcgagaccacctctgtggtgccctttggagagctgcccggcagcggcaagctgaacaaggatgcctttgcccagctgatgaaggccatggatgagctggacaacatcagcaacatgcctgagggcctggaccccctggtgtggaaccacttctgcatgacccggcgggccaaggtggagaatgagcagaaggtgaagcagaaggctgctgacctgctggagatggccaccttcctgcagaagagggtggaggaggaggagaaggtgcagcaggagattgaaagagtcttccacgagctgatcctgctgcaggaggagaaggtgcgcttccagctgaacctgaccatccagatcctgctgaagcagggccaggtggagctggagaacttccagctggtgctggagtacagtgatgccatcctgatcaacaagaacatcatcgaggacctgaacagcgtcatccgcacccagggccagaagaaggtggcctccatgatggagagcaaggatgtgcacaagaggatcctgcagatcgagtgggagcacaagaagatggagatggagcgggaggacctgaaccagaaggcctgggacatccagatgctgttcttcagccgggaccggcagaagtacctgaatgagcccaactatgaggccctgatcagcatccagatcggcatcatggagcagaccatcgctgtgctggacaagatgcacaagaagaatgtggagaactgcaagaagctgctgaagaagctgggcaagttcagcaaccagaaggacatcgccaactatgccctgagctgcaacctgcgggaggagctggtggccgtgtctgagaggaaggacatctgcaatgccatgggcagcaagctgacctgtgagaagatcgtgaaggagagatatgagaacatgatgcagcagcagaagctgaccaacatcagcaagcagcaggccgagcagatcagcatcctgcagacagaggtggagcggctgaggatgaagaccttccctgccctggtgcagatgtag

SEQ ID NO: 43644 - DNA, 2994 bp, Artificial Sequence
  Description of Artificial Sequence: Synthetic coding sequence
tgaccaggcctgctgtacctgagcagccacggcctgtggctgatcaccatcgccaagtgtggcatcctgtgcatcagagatgtgtacaccctggagacctttgcctggtgccgcagccacagccaccagggccacggcatccagagcatgaggatctccatggatggccagaacatcctggtgaatggaagagatgatggcaccctggtgtacctgaagtggaagagatttggaggccacctggccagcgagatcctggactactaccagaagctgctgatcagcctgagcagcgccatggacaaggagaaccactacctgagcaccacccccaaggtgtctgtggacctgggcagtgacagcgagcacaccaagcagaaggccagcacagacctgagccaggatgagctggtgctgacagatgtgaagaaggagatcccctggatccagcagaagagccaggaggccatcaagaaggaggtgaacctcttcagcaagaagaggaaggagatcaagcagggcatcaagagcctgagcaagaccatcctgaacatgatggaggagaatgacaagctggagaacatcgccaagctggaccagcaggagtttggcctggacctggaggagctggagcggctgcatgatgagagccaggaggaggtggccaagatgatcaaggatgtggagatgcacaacctggccaagagctacctggccgagctgatcaaggaggagtgctggaacagcatggctgtgaagggccgggccctgaagtgcttccacatcccctgtgtggtggagaacttccccatgaaggccaggacagtggaggagctgaaggagctggagcgggtgctgcagcagaagaagattgaagctgagtgcctgaagctgaggaaggagatcgtggaggcccagagcggcgtgaagctgatcaagcagagacatgaggaggatgatgaggaggaggaggaggaggacaagacagtgaagtacagcaacctgcccaactacctgctgggcagcctgagcacagactttggagtggacaccagcctgctgagcagccagctggagctgcacagccgggaggagaagatcaaccagatcatcctgctgaaggacatcatctacaaggtgaagacagtgttcaacaatgaatttgatgctgcctacaagcagaaggagtttgaaattgcccgggtgaaggagagaaatgtgcgcatccgggagatcatcctggacctggagctggaggaggccgtgtggcagcctgagtttgaggactgtgagaagccagagaggaccctggtggtgcaggatgaggagatcacagcccacaagcacatcaagccctggcacaaggccaaggagctgattgtgaaccacgagaaggagcactggctgctgatccaggatgccagcacccggctgcgggccctgatggacatgatgggcggcgtgctggaggtgaagaaggaggacatcctgaggatggtgatcccccagcctgccttcatggccaagccagatgctgtgtggacagaggaggagaggaagcagttcaaggactatgagaagaaggtgaaggagctgaatgaggagcgggacaagtacaggaagagcctggaggccgagctgaagaagctgcagaacagcatccaggagagcacccaggcctttgatgagcacctgaagaggctgtttgaaagaagagtgaaggccgagatggtgaccaaccaggaggagctgaagatcagcaacctggccttcagcctgctgctggatgaggagctgagcagccgggagaagttcctgaacaactacctgaccaggaagcagcacgagaaggtgatggacaggagcttcaagaaggagttcagcgagatccctggccaccaggtggacatcctgtacaagctgttcaagaggcggccccgcatcagcaagcagaagacccacagcgagaccacctctgtggtgccctttggagagctgcccggcagcggcaagctgaacaaggatgcctttgcccagctgatgaaggccatggatgagctggacaacatcagcaacatgcctgagggcctggaccccctggtgtggaaccacttctgcatgacccggcgggccaaggtggagaatgagcagaaggtgaagcagaaggctgctgacctgctggagatggccaccttcctgcagaagagggtggaggaggaggagaaggtgcagcaggagattgaaagagtcttccacgagctgatcctgctgcaggaggagaaggtgcgcttccagctgaacctgaccatccagatcctgctgaagcagggccaggtggagctggagaacttccagctggtgctggagtacagtgatgccatcctgatcaacaagaacatcatcgaggacctgaacagcgtcatccgcacccagggccagaagaaggtggcctccatgatggagagcaaggatgtgcacaagaggatcctgcagatcgagtgggagcacaagaagatggagatggagcgggaggacctgaaccagaaggcctgggacatccagatgctgttcttcagccgggaccggcagaagtacctgaatgagcccaactatgaggccctgatcagcatccagatcggcatcatggagcagaccatcgctgtgctggacaagatgcacaagaagaatgtggagaactgcaagaagctgctgaagaagctgggcaagttcagcaaccagaaggacatcgccaactatgccctgagctgcaacctgcgggaggagctggtggccgtgtctgagaggaaggacatctgcaatgccatgggcagcaagctgacctgtgagaagatcgtgaaggagagatatgagaacatgatgcagcagcagaagctgaccaacatcagcaagcagcaggccgagcagatcagcatcctgcagacagaggtggagcggctgaggatgaagaccttccctgccctggtgcagatgtag

SEQ ID NO: 43645 - DNA, 1545 bp, Artificial Sequence
  Description of Artificial Sequence: Synthetic coding sequence
tgatggacagaggaggagaggaagcagttcaaggactatgagaagaaggtgaaggagctgaatgaggagcgggacaagtacaggaagagcctggaggccgagctgaagaagctgcagaacagcatccaggagagcacccaggcctttgatgagcacctgaagaggctgtttgaaagaagagtgaaggccgagatggtgaccaaccaggaggagctgaagatcagcaacctggccttcagcctgctgctggatgaggagctgagcagccgggagaagttcctgaacaactacctgaccaggaagcagcacgagaagagccagaccagcgaggccgtgaggaagagccgggaggacctggatgtgtgcaaggagcactatgacaacctgctggccgaggacaaggtgatggaccgctccttcaagaaggagttcagcgagatccctggccaccaggtggacatcctgtacaagctgttcaagagaagaccccgcatcagcaagcagaagacccacagcgagaccacctctgtggtgccctttggagagctgcccggcagcggcaagctgaacaaggatgcctttgcccagctgatgaaggccatggatgagctggacaacatcagcaacatgcctgagggcctggaccccctggtgtggaaccacttctgcatgacccggcgggccaaggtggagaatgagcagaaggtgaagcagaaggctgctgacctgctggagatggccaccttcctgcagaagagggtggaggaggaggagaaggtgcagcaggagattgaaagagtcttccacgagctgatcctgctgcaggaggagaaggtgcgcttccagctgaacctgaccatccagatcctgctgaagcagggccaggtggagctggagaacttccagctggtgctggagtacagtgatgccatcctgatcaacaagaacatcatcgaggacctgaacagcgtcatccgcacccagggccagaagaaggtggcctccatgatggagagcaaggatgtgcacaagaggatcctgcagatcgagtgggagcacaagaagatggagatggagcgggaggacctgaaccagaaggcctgggacatccagatgctgttcttcagccgggaccggcagaagtacctgaatgagcccaactatgaggccctgatcagcatccagatcggcatcatggagcagaccatcgctgtgctggacaagatgcacaagaagaatgtggagaactgcaagaagctgctgaagaagctgggcaagttcagcaaccagaaggacatcgccaactatgccctgagctgcaacctgcgggaggagctggtggccgtgtctgagaggaaggacatctgcaatgccatgggcagcaagctgacctgtgagaagatcgtgaaggagagatatgagaacatgatgcagcagcagaagctgaccaacatcagcaagcagcaggccgagcagatcagcatcctgcagacagaggtggagcggctgaggatgaagaccttccctgccctggtgcagatgtag

SEQ ID NO: 43646 - DNA, 1965 bp, Artificial Sequence
  Description of Artificial Sequence: Synthetic coding sequence
atggcccccctggtgcccggcccccccctggaggccagccccaccaccctggatgctgctgtgcgctggggcctgcagaggcctgtgcggggccacatggcccctggccaggccggcggcagaggagatgccagcgccctgggcgcccagtacagctgggccagagatggccgctctgctgtgggcagcaagctgtcctgggtgggccctgctgcccctgagagcaaggccgcccagggccgggagatgggcagagatgtgggcaaggctgtggactgcctggacctgagcggcccagatggagccagctgcctgcagctgagcctgaggaagtctgagctgtttcctgctgcccggcggcccggccggcctgctgaccccggcctgagcccccgctgcctgcggcggccccccctgcggcccggccctgccagcacccccctgcggggccctggagctgcccggcccccacccctgcccccccacagccggggccgctctgctgtgtccttcctggccttcctgcccccccagaggagccccagcgccccccgggaggccgccggcagccggggcggcctgcgggccagcggcggccgctgtggcggccctgctggagctgctgctggcagcggcggcggcggagatgcccctggccctgctggccgggccatgcagaggagccgggccggggctgatgaagctgccctgctgctggccggcctggccctgcgggagctggagcccggctgcggcagccctggccggggccggcggggccccaggcctggccctggagatgaagctgccccagccctgggcagaagaggcaagggcagcggcggccctgaggccggggctgatggcctgagcagaggagagcggggcccccggcgggctgctgtgcctgagctgagcgcccagcctgctggcagcccccgggccagcctggccggcagtgatggcggcggcggcggcggcagcgcccggagcagcggcatcagcctgggctatgaccagagacatggcagccccaggagcggccgcagtgacccccggcccggccctggcccccccagcgtgggcagcgcccggagctctgtgagcagcctgggcagccggggcagcgctggggcctatgctgacttcctgcccccaggggcctgcccagccccagcccggagccctgagcctgctggccctgcccccttccccctgcctgccctgcccctgcccccaggccgggagggcggccccagcgctgctgagcggcggctggaggccctgacccgggagctggagcgggccctggaggccaggacagcccgggactacttcggcatctgcatcaagtgtggcctgggcatctatggagcccagcaggcctgccaggccatgggcagcctgtaccacacagactgcttcacctgtgacagctgtggccggcggctgcggggcaaggccttctacaacgtgggggagaaggtgtactgccaggaggacttcctgtacagcggcttccagcagacagctgacaagtgcagcgtgtgtggccacctgatcatggagatgatcctgcaggccctgggcaagagctaccaccctggctgcttccgctgcagcgtgtgcaatgaatgtctggatggagtgcccttcaccgtggatgtggagaacaacatctactgtgtgcgggactaccacacagtgtttgcccccaagtgtgccagctgtgcccggcccatcctgcctgcccagggctgtgagaccaccatccgggtggtgtccatggaccgggactaccacgtggcctgctaccactgtgaggactgtggcctgcagctgtctggagaggagggccgccgctgctaccccctggccggccacctgctgtgccgccgctgccacctgcggcggctgcagcccggccccctgcccagccccaccgtgcacgtgacagagctgtag

SEQ ID NO: 43647 - DNA, 5403 bp, Artificial Sequence
  Description of Artificial Sequence: Synthetic coding sequence
atggccacagattctggggaccctgccagcacagaggacagcgagaagccagatggcatcagctttgaaaatagagtgccccaggtggccgccaccctgactgtggaggcccggctgaaggagaagaacagcaccttcagcgccagcggggagaccgtggagaggaagcgcttcttcaggaagtctgtggagatgacagaagatgacaaggtggccgagagcagccccaaggatgagcgcatcaaggccgccatgaacatcccccgggtggacaagctgcccagcaatgtgctgcggggcggccaggaggtgaagtatgagcagtgcagcaagagcaccagcgagatcagcaaggactgcttcaaggagaagaatgagaaggagatggaggaggaggccgagatgaaggctgtggccaccagccccagcggccgcttcctgaagtttgatattgagctgggccgcggggccttcaagacagtgtacaagggcctggacacagagacctgggtggaggtggcctggtgtgagctgcaggacaggaagctgaccaaggccgagcagcagcgcttcaaggaggaggccgagatgctgaagggcctgcagcaccccaacatcgtgcgcttctatgacagctgggagagcatcctgaagggcaagaagtgcatcgtgctggtgacagagctgatgaccagcggcaccctgaagacctacctgaagcgcttcaaggtgatgaagcccaaggtgctgcgctcctggtgccggcagatcctgaagggcctgcagttcctgcacaccaggaccccacccatcatccaccgggacctgaagtgtgacaacatcttcatcaccggccccactggatctgtgaagatcggggacctgggcctggccaccctgatgaggaccagctttgccaagagcgtcatcggcaccccagagttcatggcccctgagatgtatgaggagcactatgatgagagcgtggatgtgtatgccttcggcatgtgcatgctggagatggccaccagcgagtacccctacagcgagtgccagaatgctgcccagatctacaggaaggtgaccagcggcatcaagccagccagcttcaacaaggtgacagatcctgaggtgaaggagatcatcgagggctgcatccggcagaacaagtctgagcggctgagcatccgggacctgctgaaccacgccttctttgctgaggacaccggcctgcgggtggagctggccgaggaggatgactgcagcaacagcagcctggccctgcggctgtgggtggaggaccccaagaagctgaagggcaagcacaaggacaatgaggccatcgagttctccttcaacctggagacagacaccccagaggaggtggcctatgagatggtgaagagcggcttcttccatgaaagtgacagcaaggctgtggccaagagcatccgggacagagtgacccccatcaagaagacccgggagaagaagccagctggctgcctggaggagcggcgggacagccagtgcaagtccatgggaaatgtgttcccccagccccagaacaccaccctgcccctggccccagcccagcagacaggagcagaatgtgaggagacagaggtggaccagcacgtgcggcagcagctgctgcagaggaagccccagcagcactgcagctctgtgactggagacaacctgtctgaggccggggccgccagcgtcatccacagcgacaccagcagccagcccagcgtggcctacagcagcaaccagaccatgggcagccagatggtgagcaacatcccccaggccgaggtgaatgtgcccggccagatctacagcagccagcagctggtgggccactaccagcaggtgtctggcctgcagaagcacagcaagctgacccagccccagatcctgcccctggtgcagggccagagcacagtgctgcctgtgcacgtgctgggccccaccgtggtgtcccagccccaggtgagccccctgactgtgcagaaggtgccccagatcaagcctgtgtcccagcctgtgggcgctgagcagcaggccgccctgctgaagccagacctggtgcgcagcctgaaccaggatgtggccaccaccaaggaaaatgtgagcagcccagacaaccccagcggaaatggcaagcaggaccgcatcaagcagaggcgggccagctgccccaggcctgagaagggcaccaagttccagctgactgtgctgcaggtgtccaccagcggggacaacatggtggagtgccagctggagacccacaacaacaagatggtgaccttcaagtttgatgtggatggagatgccccagaagatattgctgactacatggtggaggacaactttgtgctggagagcgagaaggagaagtttgtggaggagctgcgggccatcgtgggccaggcccaggagatcctgcacgtgcactttgccacagagcgggccaccggggtggacagcatcaccgtggacagcaacagcagccagacaggcagcagcgagcaggtgcagatcaacagcaccagcacccagaccagcaatgaaagtgccccccagagcagccctgtgggccgctggaggttctgcatcaaccagaccatccggaaccgggagacccagagcccccccagcctgcagcacagcatgtctgctgtgcccggccgccaccccctgcccagccccaagaacaccagcaacaaggagatcagccgggacaccctgctgaccatcgagaacaacccctgccaccgggccctcttcaccagcaagtctgagcacaaggatgtggtggatggcaagatcagtgaatgtgcctctgtggagaccaagcagcctgccatcctgtaccaggtggaggacaaccggcagatcatggcccctgtgaccaacagcagcagctacagcaccacctctgtgcgggctgtgcctgcagaatgtgagggcctgaccaagcaggccagcatcttcatccctgtgtacccctgccaccagacagccagccaggctgatgccctgatgagccaccctggagagagcacccagaccagcggcaacagcctgaccaccctggcctttgaccagaagccccagaccctgtctgtgcagcagcctgccatggatgctgagttcatcagccaggagggggagaccaccgtgaacacagaggccagcagccccaagacagtcatccccacccagaccccaggcctggagcccaccaccctgcagcccaccaccgtgctggagagtgatggagagcggccccccaagctggagtttgctgacaaccgcatcaagaccctggatgagaagctgaggaacctgctgtaccaggagcacagcatcagcagcatctacccagagagccagaaggacacccagagcattgacagccccttcagcagcagcgctgaggacaccctgagctgccctgtgacagaggtgattgccatcagccactgcggcatcaaggacagccctgtgcagagccccaacttccagcagacaggcagcaagctgctgagcaatgtggccgccagccagcctgccaacatcagcgtcttcaagagggacctgaatgtcatcacctctgtgcccagcgagctgtgcctgcacgagatgagcagtgatgccagcctgcccggggaccctgaggcctacccagctgctgtgagcagcggcggggccatccacctgcagacaggaggcggctacttcggcctgtccttcacctgccccagcctgaagaaccccatcagcaagaagtcctggaccaggaagctgaagtcctgggcctaccgcctgcggcagagcaccagcttcttcaagaggagcaaggtgcggcaggtggagacagaggagatgaggtctgccatcgccccagaccccatccccctgacccgggagagcacagctgacacccgggccctgaaccgctgcaaggccatgagcggcagcttccagaggggccgcttccaggtgatcaccatcccccagcagcagagcgccaagatgaccagctttggaattgagcacatctctgtgttcagcgagaccaaccacagcagcgaggaggccttcatcaagacagccaagagccagctggtggagattgaaccagccacccagaaccccaagaccagcttctcctatgagaagctgcaggccctgcaggagacctgcaaggagaacaagggcgtgcccaagcagggcgacaacttcctgtccttctctgctgcctgtgaaacagatgtgtcctctgtgaccccagagaaggagtttgaggagaccagcgccaccggcagctccatgcagagcggcagcgagctgctgctgaaggagcgggagatcctgacagctgggaagcagcccagcagtgacagcgagttcagcgccagcctggccggcagcggcaagtctgtggccaagacaggccctgagagcaaccagtgcctgccccaccacgaggagcaggcctatgcccagacccagagcagcctcttctacagccccagcagccccatgagcagtgatgatgagagcgagattgaagatgaggacctgaaggtggagctgcagaggctgcgggagaagcacatccaggaggtggtgaacctgcagacccagcagaacaaggagctgcaggagctgtatgagcggctgcggagcatcaaggacagcaagacccagagcacagagatccccctgcccccagccagcccccggcggcccaggagcttcaagagcaagctgcggagccggccccagagcctgacccacgtggacaatggcatcgtggccaccgggaagagctgcctgatcaatgagctggagaaccccctgtgtgtggagagcaatgctgccagctgccagcagagccctgccagcaagaagggcatgttcacagatgacctgcacaagctggtggatgactggaccaaggaggccgtgggcaacagcctcatcaagcccagcctgaaccagctgaagcagagccagcacaagctggagacagagaactggaacaaggtgtctgagaacacccccagcaccatgggctacaccagcacctggatcagcagcctgagccagatcagaggagctgtgcccaccagcctgccccagggcctgagcctgcccagcttccctggccccctgagcagctatggcatgccccacgtgtgccagtacaatgctgtggccggggccggctaccctgtgcagtgggtgggcatcagcggcaccacccagcagagcgtggtgatcccagcccagagcggcggccccttccagcccggcatgaacatgcaggccttccccaccagctctgtgcagaacccagccaccatccccccaggccccaagtag

SEQ ID NO: 43648 - DNA, 1065 bp, Artificial Sequence
  Description of Artificial Sequence: Synthetic coding sequence
atgcagggcctgctcttcagcaccctgctgctggccggcctggcccagttctgctgccgggtgcagggcaccggccccctggacaccaccccagagggccggcctggagaggtgtctgatgccccccagaggaagcagttctgccactggccctgcaagtgcccccagcagaagccccgctgccccccaggagtgtccctggtgagagatggctgcggctgctgcaagatctgtgccaagcagcccggggagatctgcaatgaagctgacctgtgtgacccccacaagggcctgtactgtgactacagcgtggaccggcccaggtatgaaacaggagtgtgtgcctacctggtggccgtgggctgtgagttcaaccaggtgcactaccacaacggccaggtgttccagcccaaccccctcttcagctgcctgtgtgtgtctggggccatcggctgcacccccctcttcatccccaagctggccggcagccactgcagcggggccaagggcggcaagaagagtgaccagagcaactgcagcctggagcccctgctgcagcagctgagcaccagctacaagaccatgcctgcctacagaaacctgcccctcatctggaagaagaagtgcctggtgcaggccaccaagtggaccccctgcagcaggacctgtggcatgggcatcagcaacagagtgaccaatgaaaacagcaactgtgagatgaggaaggagaagaggctgtgctacatccagccctgtgacagcaacatcctgaagaccatcaagatccccaagggcaagacctgccagcccaccttccagctgagcaaggccgagaagtttgtgttttctggctgcagcagcacccagagctacaagcccaccttctgtggcatctgcctggacaagcgctgctgcatccccaacaagagcaagatgatcaccatccagtttgactgccccaatgaaggcagcttcaagtggaagatgctgtggatcaccagctgtgtgtgccagaggaactgccgggagcccggggacatcttcagcgagctgaagatcctgtag

SEQ ID NO: 43649 - DNA, 2139 bp, Artificial Sequence
  Description of Artificial Sequence: Synthetic coding sequence
atgctgaaggactacctgtctgtggcccaggatgccctgcggacccagaaggagctgtaccacgtgaaggagcagaggctggccctggccctggatgaatatgtgcggctgaatgatgcctacaaggagaagagcagcagccacaccagcctcttcagcggcagcagcagcagcaccaagtatgaccctgacatcctgaaggccgagatcagcaccacccggctgcgggtgaagaagctgaagcgggagctgagccagatgaagcaggagctgctgtacaaggagcagggctttgagaccctgcagcagattgacaagaagatgtctgggggccagagcggctatgagctgtctgaggccaaggccatcctgacagagctgaagagcatcaggaaggccatcagcagcggggagaaggagaagcaggacctgatgcagagcctggccaagctgcaggagcgcttccacctggaccagaacatcggccgctctgagccagacctgcgctgcagccctgtgaacagccacctgtgcctgagccggcagaccctggatgctggcagccagaccagcatcagcggggacatcggcgtgcgcagccgcagcaacctggccgagaaggtgcggctgagcctgcagtatgaggaggccaagaggtccatggccaacctgaagattgagctgagcaagctggacagcgaggcctggccaggggccctggacatcgagaaggagaagctgatgctgatcaatgagaaggaggagctgctgaaggagctgcagtttgtgaccccccagaagaggacccaggatgagctggagcggctggaggccgagcggcagaggctggaggaggagctgctgtctgtgcggggcacccccagccgggccctggccgagcggctgcggctggaggagaggaggaaggagctgctgcagaagctggaggagaccaccaagctgaccacctacctgcacagccagctgaagagcctgagcgccagcaccctgtccatgagcagcggcagcagcctgggcagcctggccagcagccggggcagcctgaacaccagcagccggggcagcctgaacagcctgagcagcacagagctgtactacagcagccagagcgaccagattgatgtggactaccagtacaagctggacttcctgctgcaggagaagagcggctacatccccagcggccccatcaccaccatccatgaaaatgaggtggtgaagagccccagccagcccggccagagcggcctgtgtggggtggccgccgccgccaccggccacaccccacccctggccgaggcccccaagtctgtggccagcctgagcagccgcagcagcctgagcagcctgagccccccaggcagccccctggtgctggagggcaccttccccatgagcagcagccatgatgccagcctgcaccagttcaccgctgactttgaggactgtgagctgagcagccactttgctgacatcagcctgattgagaaccagatcctgctggacagcgacagcggcggggccagccagagcctgtctgaggacaaggacctgaatgaatgtgcccgggagcccctgtatgagggcacagcagatgtggagaagagcctgcccaagagaagagtcatccacctgctgggggagaagaccacctgtgtgtctgctgctgtgtctgatgagagcgtggccggggacagcggcgtgtatgaggcctttgtgaagcagcccagcgagatggaggatgtgacctacagcgaggaggatgtggccatcgtggagacagcccaggtgcagatcggcctgcgctacaatgccaagagcagcagcttcatggtgatcatcgcccagctgaggaacctgcacgccttcctgatcccccacaccagcaaggtgtacttccgggtggccgtgctgcccagcagcacagatgtgtcctgcctcttccgcaccaaggtgcaccccccaacagagagcatcctcttcaatgatgtgttccgggtggccatcagccagacagccctgcagcagaagaccctgaggaagaacttcacctttgtgacagccatcacccacggcgtgtgcctgcccctgcctgtgcccatgcccagctttgcctag

SEQ ID NO: 43650 - DNA, 3579 bp, Artificial Sequence
  Description of Artificial Sequence: Synthetic coding sequence
atgcccaggagagctggcagcggccagctgcccctgccccggggctgggaggaggcccgggactatgatggcaaggtgttctacatcgaccacaacaccaggaggacctcctggattgacccccgggaccggctgaccaagcccctgagctttgctgactgtgtgggagatgagctgccctggggctgggaggccggctttgacccccagattggagtgtactacatcgaccacatcaacaagaccacccagatcgaggaccccaggaagcagtggagaggagagcaggagaagatgctgaaggactacctgtctgtggcccaggatgccctgcggacccagaaggagctgtaccacgtgaaggagcagaggctggccctggccctggatgaatatgtgcggctgaatgatgcctacaaggagaagagcagcagccacaccagcctcttcagcggcagcagcagcagcaccaagtatgaccctgacatcctgaaggccgagatcagcaccacccggctgcgggtgaagaagctgaagcgggagctgagccagatgaagcaggagctgctgtacaaggagcagggctttgagaccctgcagcagattgacaagaagatgtctgggggccagagcggctatgagctgtctgaggccaaggccatcctgacagagctgaagagcatcaggaaggccatcagcagcggggagaaggagaagcaggacctgatgcagagcctggccaagctgcaggagcgcttccacctggaccagaacatcggccgctctgagccagacctgcgctgcagccctgtgaacagccacctgtgcctgagccggcagaccctggatgctggcagccagaccagcatcagcggggacatcggcgtgcgcagccgcagcaacctggccgagaaggtgcggctgagcctgcagtatgaggaggccaagaggtccatggccaacctgaagattgagctgagcaagctggacagcgaggcctggccaggggccctggacatcgagaaggagaagctgatgctgatcaatgagaaggaggagctgctgaaggagctgcagtttgtgaccccccagaagaggacccaggatgagctggagcggctggaggccgagcggcagaggctggaggaggagctgctgtctgtgcggggcacccccagccgggccctggccgagcggctgcggctggaggagaggaggaaggagctgctgcagaagctggaggagaccaccaagctgaccacctacctgcacagccagctgaagagcctgagcgccagcaccctgtccatgagcagcggcagcagcctgggcagcctggccagcagccggggcagcctgaacaccagcagccggggcagcctgaacagcctgagcagcacagagctgtactacagcagccagagcgaccagattgatgtggactaccagtacaagctggacttcctgctgcaggagaagagcggctacatccccagcggccccatcaccaccatccatgaaaatgaggtggtgaagagccccagccagcccggccagagcggcctgtgtggggtggccgccgccgccaccggccacaccccacccctggccgaggcccccaagtctgtggccagcctgagcagccgcagcagcctgagcagcctgagccccccaggcagccccctggtgctggagggcaccttccccatgagcagcagccatgatgccagcctgcaccagttcaccgctgactttgaggactgtgagctgagcagccactttgctgacatcagcctgattgagaaccagatcctgctggacagcgacagcggcggggccagccagagcctgtctgaggacaaggacctgaatgaatgtgcccgggagcccctgtatgagggcacagcagatgtggagaagagcctgcccaagagaagagtcatccacctgctgggggagaagaccacctgtgtgtctgctgctgtgtctgatgagagcgtggccggggacagcggcgtgtatgaggcctttgtgaagcagcccagcgagatggaggatgtgacctacagcgaggaggatgtggccatcgtggagacagcccaggtgcagatcggcctgcgctacaatgccaagagcagcagcttcatggtgatcatcgcccagctgaggaacctgcacgccttcctgatcccccacaccagcaaggtgtacttccgggtggccgtgctgcccagcagcacagatgtgtcctgcctcttccgcaccaaggtgcaccccccaacagagagcatcctcttcaatgatgtgttccgggtggccatcagccagacagccctgcagcagaagaccctgcgggtggacctgtgcagcgtgtccaagcacagaagagaggagtgcctggccggcacccagatcagcctggccgacctgcccttcagcagcgaggtgttcaccctgtggtacaacctgctgcccagcaagcagatgccctgcaagaagaatgaggagaatgaagacagcgtcttccagcccaaccagcccctggtggacagcattgacctggatgctgtgtctgccctgctggcccggaccagcgctgagctgctggccgtggagcaggagctggcccaggaggaggaggaggagagcggccaggaggagccccggggcccagatggagactggctgaccatgctgcgggaggccagtgatgagatcgtggccgagaaggaggccgaggtgaagctgcctgaggacagcagctgcacagaggacctgagcagctgcacctctgtgcctgagatgaatgaagatggcaacaggaaggagagcaactgtgccaaggacctgcggagccagccccccacccgcatccccaccctggtggacaaggagaccaacacagatgaagctgccaatgacaacatggctgtgcggcccaaggagaggagcagcctgagcagccggcagcacccctttgtgcgcagctctgtgattgtgcgcagccagaccttcagccctggagagaggaaccagtacatctgccgcctgaacagaagtgacagcgacagcagcaccctggccaagaagagcctgtttgtgaggaacagcacagagcggcgcagcctgcgggtgaagaggacagtgtgccagagcgtgctgcggaggaccacccaggagtgccctgtgaggaccagcctggacctggagctggacctgcaggccagcctgacccggcagagccggctgaatgatgagctgcaggccctgcgggacctgcggcagaagctggaggagctgaaggcccagggcgagacagacctgcccccaggagtgctggaggatgagcgcttccagaggctgctgaagcaggccgagaagcaggccgagcagagcaaggaggagcagaagcagggcctgaatgctgagaagctgatgaggcaggtgtccaaggatgtgtgccgcctgcgggagcagagccagaaggtgccccggcaggtgcagagcttccgggagaagatcgcctacttcacccgggccaagatcagcatccccagcctgcctgcagatgatgtgtag

SEQ ID NO: 43651 - DNA, 3651 bp, Artificial Sequence
  Description of Artificial Sequence: Synthetic coding sequence
atgcccaggagagctggcagcggccagctgcccctgccccggggctgggaggaggcccgggactatgatggcaaggtgttctacatcgaccacaacaccaggaggacctcctggattgacccccgggaccggctgaccaagcccctgagctttgctgactgtgtgggagatgagctgccctggggctgggaggccggctttgacccccagattggagtgtactacatcgaccacatcaacaagaccacccagatcgaggaccccaggaagcagtggagaggagagcaggagaagatgctgaaggactacctgtctgtggcccaggatgccctgcggacccagaaggagctgtaccacgtgaaggagcagaggctggccctggccctggatgaatatgtgcggctgaatgatgcctacaaggagaagagcagcagccacaccagcctcttcagcggcagcagcagcagcaccaagtatgaccctgacatcctgaaggccgagatcagcaccacccggctgcgggtgaagaagctgaagcgggagctgagccagatgaagcaggagctgctgtacaaggagcagggctttgagaccctgcagcagattgacaagaagatgtctgggggccagagcggctatgagctgtctgaggccaaggccatcctgacagagctgaagagcatcaggaaggccatcagcagcggggagaaggagaagcaggacctgatgcagagcctggccaagctgcaggagcgcttccacctggaccagaacatcggccgctctgagccagacctgcgctgcagccctgtgaacagccacctgtgcctgagccggcagaccctggatgctggcagccagaccagcatcagcggggacatcggcgtgcgcagccgcagcaacctggccgagaaggtgcggctgagcctgcagtatgaggaggccaagaggtccatggccaacctgaagattgagctgagcaagctggacagcgaggcctggccaggggccctggacatcgagaaggagaagctgatgctgatcaatgagaaggaggagctgctgaaggagctgcagtttgtgaccccccagaagaggacccaggatgagctggagcggctggaggccgagcggcagaggctggaggaggagctgctgtctgtgcggggcacccccagccgggccctggccgagcggctgcggctggaggagaggaggaaggagctgctgcagaagctggaggagaccaccaagctgaccacctacctgcacagccagctgaagagcctgagcgccagcaccctgtccatgagcagcggcagcagcctgggcagcctggccagcagccggggcagcctgaacaccagcagccggggcagcctgaacagcctgagcagcacagagctgtactacagcagccagagcgaccagattgatgtggactaccagtacaagctggacttcctgctgcaggagaagagcggctacatccccagcggccccatcaccaccatccatgaaaatgaggtggtgaagagccccagccagcccggccagagcggcctgtgtggggtggccgccgccgccaccggccacaccccacccctggccgaggcccccaagtctgtggccagcctgagcagccgcagcagcctgagcagcctgagccccccaggcagccccctggtgctggagggcaccttccccatgagcagcagccatgatgccagcctgcaccagttcaccgctgactttgaggactgtgagctgagcagccactttgctgacatcagcctgattgagaaccagatcctgctggacagcgacagcggcggggccagccagagcctgtctgaggacaaggacctgaatgaatgtgcccgggagcccctgtatgagggcacagcagatgtggagaagagcctgcccaagagaagagtcatccacctgctgggggagaagaccacctgtgtgtctgctgctgtgtctgatgagagcgtggccggggacagcggcgtgtatgaggcctttgtgaagcagcccagcgagatggaggatgtgacctacagcgaggaggatgtggccatcgtggagacagcccaggtgcagatcggcctgcgctacaatgccaagagcagcagcttcatggtgatcatcgcccagctgaggaacctgcacgccttcctgatcccccacaccagcaaggtgtacttccgggtggccgtgctgcccagcagcacagatgtgtcctgcctcttccgcaccaaggtgcaccccccaacagagagcatcctcttcaatgatgtgttccgggtggccatcagccagacagccctgcagcagaagaccctgcgggtggacctgtgcagcgtgtccaagcacagaagagaggagtgcctggccggcacccagatcagcctggccgacctgcccttcagcagcgaggtgttcaccctgtggtacaacctgctgcccagcaagcagatgccctgcaagaagaatgaggagaatgaagacagcgtcttccagcccaaccagcccctggtggacagcattgacctggatgctgtgtctgccctgctggcccggaccagcgctgagctgctggccgtggagcaggagctggcccaggaggaggaggaggagagcggccaggaggagccccggggcccagatggagactggctgaacacctacttcctgtgctgctgggagctgaaggatgatgtgttcacccggctgactgtgaagcccctgctgaccatgctgcgggaggccagtgatgagatcgtggccgagaaggaggccgaggtgaagctgcctgaggacagcagctgcacagaggacctgagcagctgcacctctgtgcctgagatgaatgaagatggcaacaggaaggagagcaactgtgccaaggacctgcggagccagccccccacccgcatccccaccctggtggacaaggagaccaacacagatgaagctgccaatgacaacatggctgtgcggcccaaggagaggagcagcctgagcagccggcagcacccctttgtgcgcagctctgtgattgtgcgcagccagaccttcagccctggagagaggaaccagtacatctgccgcctgaacagaagtgacagcgacagcagcaccctggccaagaagagcctgtttgtgaggaacagcacagagcggcgcagcctgcgggtgaagaggacagtgtgccagagcgtgctgcggaggaccacccaggagtgccctgtgaggaccagcctggacctggagctggacctgcaggccagcctgacccggcagagccggctgaatgatgagctgcaggccctgcgggacctgcggcagaagctggaggagctgaaggcccagggcgagacagacctgcccccaggagtgctggaggatgagcgcttccagaggctgctgaagcaggccgagaagcaggccgagcagagcaaggaggagcagaagcagggcctgaatgctgagaagctgatgaggcaggtgtccaaggatgtgtgccgcctgcgggagcagagccagaaggtgccccggcaggtgcagagcttccgggagaagatcgcctacttcacccgggccaagatcagcatccccagcctgcctgcagatgatgtgtag

SEQ ID NO: 43652 - DNA, 963 bp, Artificial Sequence
  Description of Artificial Sequence: Synthetic coding sequence
atgccccggctgcgggtgcatggagcctgcctgcccaccaagtctgtgctcttcctgttctaccaccggctgaccatgctgcgggaggccagtgatgagatcgtggccgagaaggaggccgaggtgaagctgcctgaggacagcagctgcacagaggacctgagcagctgcacctctgtgcctgagatgaatgaagatggcaacaggaaggagagcaactgtgccaaggacctgcggagccagccccccacccgcatccccaccctggtggacaaggagaccaacacagatgaagctgccaatgacaacatggctgtgcggcccaaggagaggagcagcctgagcagccggcagcacccctttgtgcgcagctctgtgattgtgcgcagccagaccttcagccctggagagaggaaccagtacatctgccgcctgaacagaagtgacagcgacagcagcaccctggccaagaagagcctgtttgtgaggaacagcacagagcggcgcagcctgcgggtgaagaggacagtgtgccagagcgtgctgcggaggaccacccaggagtgccctgtgaggaccagcctggacctggagctggacctgcaggccagcctgacccggcagagccggctgaatgatgagctgcaggccctgcgggacctgcggcagaagctggaggagctgaaggcccagggcgagacagacctgcccccaggagtgctggaggatgagcgcttccagaggctgctgaagcaggccgagaagcaggccgagcagagcaaggaggagcagaagcagggcctgaatgctgagaagctgatgaggcaggtgtccaaggatgtgtgccgcctgcgggagcagagccagaaggtgccccggcaggtgcagagcttccgggagaagatcgcctacttcacccgggccaagatcagcatccccagcctgcctgcagatgatgtgtag

SEQ ID NO: 43653 - DNA, 3432 bp, Artificial Sequence
  Description of Artificial Sequence: Synthetic coding sequence
atgcccaggagagctggcagcggccagctgcccctgccccggggctgggaggaggcccgggactatgatggcaaggtgttctacatcgaccacaacaccaggaggacctcctggattgacccccgggaccggctgaccaagcccctgagctttgctgactgtgtgggagatgagctgccctggggctgggaggccggctttgacccccagattggagtgtactacatcgaccacatcaacaagaccacccagatcgaggaccccaggaagcagtggagaggagagcaggagaagatgctgaaggactacctgtctgtggcccaggatgccctgcggacccagaaggagctgtaccacgtgaaggagcagaggctggccctggccctggatgaatatgtgcggctgaatgatgcctacaaggagaagagcagcagccacaccagcctcttcagcggcagcagcagcagcaccaagtatgaccctgacatcctgaaggccgagatcagcaccacccggctgcgggtgaagaagctgaagcgggagctgagccagatgaagcaggagctgctgtacaaggagcagggctttgagaccctgcagcagattgacaagaagatgtctgggggccagagcggctatgagctgtctgaggccaaggccatcctgacagagctgaagagcatcaggaaggccatcagcagcggggagaaggagaagcaggacctgatgcagagcctggccaagctgcaggagcgcttccacctggaccagaacatcggccgctctgagccagacctgcgctgcagccctgtgaacagccacctgtgcctgagccggcagaccctggatgctggcagccagaccagcatcagcggggacatcggcgtgcgcagccgcagcaacctggccgagaaggtgcggctgagcctgcagtatgaggaggccaagaggtccatggccaacctgaagattgagctgagcaagctggacagcgaggcctggccaggggccctggacatcgagaaggagaagctgatgctgatcaatgagaaggaggagctgctgaaggagctgcagtttgtgaccccccagaagaggacccaggatgagctggagcggctggaggccgagcggcagaggctggaggaggagctgctgtctgtgcggggcacccccagccgggccctggccgagcggctgcggctggaggagaggaggaaggagctgctgcagaagctggaggagaccaccaagctgaccacctacctgcacagccagctgaagagcctgagcgccagcaccctgtccatgagcagcggcagcagcctgggcagcctggccagcagccggggcagcctgaacaccagcagccggggcagcctgaacagcctgagcagcacagagctgtactacagcagccagagcgaccagattgatgtggactaccagtacaagctggacttcctgctgcaggagaagagcggctacatccccagcggccccatcaccaccatccatgaaaatgaggtggtgaagagccccagccagcccggccagagcggcctgtgtggggtggccgccgccgccaccggccacaccccacccctggccgaggcccccaagtctgtggccagcctgagcagccgcagcagcctgagcagcctgagccccccaggcagccccctggtgctggagggcaccttccccatgagcagcagccatgatgccagcctgcaccagttcaccgctgactttgaggactatgtggagaagagcctgcccaagagaagagtcatccacctgctgggggagaagaccacctgtgtgtctgctgctgtgtctgatgaatctgtggccggggacagcggcgtgtatgaggcctttgtgaagcagcccagcgagatggaggatgtgacctacagtgaagaagatgtggccatcgtggagacagcccaggtgcagatcggcctgcgctacaatgccaagagcagcagcttcatggtgatcatcgcccagctgaggaacctgcacgccttcctgatcccccacaccagcaaggtgtacttccgggtggccgtgctgcccagcagcacagatgtgtcctgcctcttccgcaccaaggtgcaccccccaacagagagcatcctcttcaatgatgtgttccgggtggccatcagccagacagccctgcagcagaagaccctgcgggtggacctgtgcagcgtgtccaagcaccggcgggaggagtgcctggccggcacccagatcagcctggccgacctgcccttcagcagcgaggtgttcaccctgtggtacaacctgctgcccagcaagcagatgccctgcaagaagaatgaagaaaatgaagattctgtgttccagcccaaccagcccctggtggacagcattgacctggatgctgtgtctgccctgctggcccggaccagcgctgagctgctggccgtggagcaggagctggcccaggaggaggaggaggagagcggccaggaggagccccggggcccagatggagactggctgaccatgctgcgggaggccagtgatgaaattgtggccgagaaggaggccgaggtgaagctgcctgaggacagcagctgcacagaggacctgagcagctgcacctctgtgcctgagatgaatgaagatggcaacaggaaggagagcaactgtgccaaggacctgcggagccagccccccacccgcatccccaccctggtggacaaggagaccaacacagatgaggccgccaatgacaacatggctgtgcggcccaaggagaggagcagcctgagcagccggcagcacccctttgtgcgcagcagcgtcatcgtgcgcagccagaccttcagccctggagagaggaaccagtacatctgccgcctgaacagaagtgacagcgacagcagcaccctggccaagaagagcctgtttgtgaggaacagcacagaaagaagaagcctgcgggtgaagaggacagtgtgccagagcgtgctgcggaggaccacccaggagtgccctgtgaggaccagcctggacctggagctggacctgcaggccagcctgacccggcagagccggctgaatgatgagctgcaggccctgcgggacctgcggcagaagctggaggagctgaaggcccagggcgagacagacctgcccccaggagtgctggaggatgagcgcttccagaggctgctgaagcaggccgagaagcaggccgagcagagcaaggaggagcagaagcagggcctgaatgctgagaagctgatgaggcaggtgtccaaggatgtgtgccgcctgcgggagcagagccagaaggtgccccggcaggtgcagagcttccgggagaagatcgcctacttcacccgggccaagatcagcatccccagcctgcctgcagatgatgtgtag

SEQ ID NO: 43654 - DNA, 315 bp, Artificial Sequence
  Description of Artificial Sequence: Synthetic coding sequence
atgaagagctgccagaagatggagggcaagccagaaaatgaaagtgagcccaagcatgaggaggagcccaagccagaggagaagccagaggaggaggagaagctggaggaggaggccaaggccaagggcaccttccgggagcggctcatccagagcctgcaggagttcaaggaggacatccacaacagacacctgagcaatgaagacatgttccgggaggtggatgaaattgatgagatcagaagagtgaggaacaagctgattgtgatgcgctggaaggtgaacagaaaccacccctacccctacctgatgtag

SEQ ID NO: 43655 - DNA, 315 bp, Artificial Sequence; identical to SEQ ID NO: 43654
  Description of Artificial Sequence: Synthetic coding sequence

SEQ ID NO: 43656 - DNA, 3279 bp, Artificial Sequence
  Description of Artificial Sequence: Synthetic coding sequence
atggaccacatcaacaagctgacccagatcgaggacccccgggagcagtggaggcgggagcaggagaggatgctgaaggagtacctgattgtggcccaggaggccctgaatgccaagaaggagatctaccagatcaagcagcagagatttgagctggcccaggaggagtaccagcagctgcacaagatgtgtgaagatgacagccgctcctatgccagcagcttcagcggctacagcaccaacaccaagtatgacccccaccagatcaaggccgagatcgccagccggcgggaccggctgagccggctgaagcgggagctgacccagatgaagcaggagctgcagtacaaggagaagggcgtggagaccctgcaggagattgacaggaagatgagcagcacccacaccagctacaagctggatgaggcccaggccatcatgtctgagctgcggaccatcaagaaggccatctgcacaggagagaaggagcggcgggacctgatgcacagcctggccaagctgacagacagcttcaagaacagctgcagcgtgacagacagcctggtggacttcccccaccacgtgggcgtgcctggagatgctggggtgccccagcagttctgtgatgctggcagccagacagacatcattggagaatttgtgtttgatgacaagacccggctggtggacagagtgcggctgaactggcagtatgaggaggccaggaagagggtggccaacatccagcagcagctggcccggctggacaatgaatcctggcccagcacagctgaggccgaccgggaccggctgcagctgatcaaggagaaggaggccctgctgcaggagctgcagctgatcatcgcccagaggagatctgctggagatgtggcccggctggaggaggagcgggagcggctggaggaggagctgcggcgggcccgggccaccagcgcccagggcgccacagagcgcatcctgctgcaggagaagaggaactgcctgctgatgcagctggaggaggccacccggctgaccagctacctgcagagccagctgaagagcctgtgtgccagcaccctgactgtgagcagcggcagcagccggggcagcctggccagcagccggggcagcctggccagcagccggggcagcctgagctctgtgtccttcacagacatctacggcctgccccagtatgagaagccagatgctgagggcagccagctgctgcgctttgacctgatcccctttgacagcctgggcagagatgcccccttcagcgagcccccaggccccagcggcttccacaagcagaggaggagcctggacaccccccagagcctggccagcctgagcagccgcagcagcctgagcagcctgagcccccccagcagccccctggacacccccttcctgcctgccagccgggacagccccctggcccagctggccgacagctgtgagggccctggcctgggcgccctggaccggctgcgggcccacgccagcgccatgggagatgaggacctgcccggcatggccgccctgcagccccacggcgtgcctggagatggagagggcccccatgagcggggccccccaccagccagcgcccctgtgggcggcaccgtgaccctgagagaagattctgccaagaggctggagcggcgggcccggcgcatcagcgcctgcctgagtgactacagcctggccagtgacagcggcgtgtttgagcccctgaccaagagaaatgaagatgctgaggagcccgcctatggagacacagccagcaatggagacccccagatccacgtgggcctgctgcgggacagcggctctgaatgtctgctggtgcacgtgctgcagctgaagaacccagctggcctggccgtgaaggaggactgcaaggtgcacatccgggtgtacctgccccccctggacagcggcacccccaacacctactgcagcaaggccctggagttccaggtgcccctggtgttcaatgaggtgttccgcatccctgtgcacagcagcgccctgaccctgaagagcctgcagctgtatgtgtgcagcgtgaccccccagctgcaggaggagctgctgggcatcgcccagatcaacctggccgactatgacagcctgtctgagatgcagctgcgctggcacagcgtgcaggtgttcaccagcagcgagcccagcaggacccgggaggccggctgtgccggggagagcagcgcccgggaccctgcccacaccatcagcatcagcggcaagacagatgctgtgacagtgctgctggcccggaccacagcccagctgcaggccgtggagcgggagctggccgaggagcgggccaagctggagtacacagaggaggaggtgctggagatggagaggaaggaggagcaggccgaggccatcagcgagaggtcctggcaggccgacagcgtggacagcggctgcagcaactgcacccagaccagccccccctacccagagccctgctgcatgggcatcgacagcatcctgggccacccctttgctgcccaggccggcccctacagccctgagaagttccagcccagccccctgaaggtggacaaggagaccaacacagaggacctcttcctggaggaggccgccagcctggtgaaggagcggcccagcagaagagcccggggcagcccctttgtgcgcagcggcaccatcgtgcgcagccagaccttcagccctggggcccggagccagtatgtgtgccgcctgtacagaagtgacagcgacagcagcaccctgcccaggaagagcccctttgtgaggaacaccctggagaggaggaccctgcgctacaagcagagctgccgcagcagcctggccgagctgatggcccggaccagcctggacctggagctggacctgcaggccagcaggacccggcagaggcagctgaatgaggagctgtgtgccctgcgggagctgcggcagaggctggaggatgcccagctgcggggccagacagacctgcccccctgggtgctgagagatgagcggctgcggggcctgctgcgggaggccgagcggcagacccggcagaccaagctggactacagacatgagcaggccgctgagaagatgctgaagaaggccagcaaggagatctaccagctgcggggccagagccacaaggagcccatccaggtgcagaccttccgggagaagatcgccttcttcacccggccccgcatcaacatcccccccctgcctgcagatgatgtgtag

SEQ ID NO: 43657 - DNA, 1749 bp, Artificial Sequence
  Description of Artificial Sequence: Synthetic coding sequence
ctgagccacatcagcgagctgacccagatcgaggacccccgggagcagtggaggcgggagcaggagaggatgctgaaggagtacctgattgtggcccaggaggccctgaatgccaagaaggagatctaccagatcaagcagcagagatttgagctggcccaggaggagtaccagcagctgcacaagatgtgtgaagatgacagccgctcctatgccagcagcttcagcggctacagcaccaacaccaagtatgacccccaccagatcaaggccgagatcgccagccggcgggaccggctgagccggctgaagcgggagctgacccagatgaagcaggagctgcagtacaaggagaagggcgtggagaccctgcaggagattgacaggaagatgagcagcacccacaccagctacaagctggatgaggcccaggccatcatgtctgagctgcggaccatcaagaaggccatctgcacaggagagaaggagcggcgggacctgatgcacagcctggccaagctgacagacagcttcaagaacagctgcagcgtgacagacagcctggtggacttcccccaccacgtgggcgtgcctggagatgctggggtgccccagcagttctgtgatgctggcagccagacagacatcattggagaatttgtgtttgatgacaagacccggctggtggacagagtgcggctgaactggcagtatgaggaggccaggaagagggtggccaacatccagcagcagctggcccggctggacaatgaatcctggcccagcacagctgaggccgaccgggaccggctgcagctgatcaaggagaaggaggccctgctgcaggagctgcagctgatcatcgcccagaggagatctgctggagatgtggcccggctggaggaggagcgggagcggctggaggaggagctgcggcgggcccgggccaccagcgcccagggcgccacagagcgcatcctgctgcaggagaagaggaactgcctgctgatgcagctggaggaggccacccggctgaccagctacctgcagagccagctgaagagcctgtgtgccagcaccctgactgtgagcagcggcagcagccggggcagcctggccagcagccggggcagcctggccagcagccggggcagcctgagctctgtgtccttcacagacatctacggcctgccccagtatgagaagccagatgctgagggcagccagctgctgcgctttgacctgatcccctttgacagcctgggcagagatgcccccttcagcgagcccccaggccccagcggcttccacaagcagaggaggagcctggacaccccccagagcctggccagcctgagcagccgcagcagcctgagcagcctgagcccccccagcagccccctggacacccccttcctgcctgccagccgggacagccccctggcccagctggccgacagctgtgagggccctggcctgggcgccctggaccggctgcgggcccacgccagcgccatgggagatgaggacctgcccggcatggccgccctgcagccccacggcgtgcctggagatggagagggcccccatgagcggggccccccaccagccagcgcccctgtgggcggcagcaaatgtggctgcagcgacagcagccggcggcagtgccaggaggtgggggaggagggcaccccccacctgaggatgtctgtgggcctgtttgccagccagaggcagtggggcgtgtag

SEQ ID NO: 43658 - DNA, 3279 bp, Artificial Sequence; identical to SEQ ID NO: 43656
  Description of Artificial Sequence: Synthetic coding sequence

SEQ ID NO: 43659 - DNA, 639 bp, Artificial Sequence
  Description of Artificial Sequence: Synthetic coding sequence
atgcagctggaggaggccacccggctgaccagctacctgcagagccagctgaagagcctgtgtgccagcaccctgactgtgagcagcggcagcagccggggcagcctggccagcagccggggcagcctggccagcagccggggcagcctgagctctgtgtccttcacagacatctacggcctgccccagtatgagaagccagatgctgagggcagccagctgctgcgctttgacctgatcccctttgacagcctgggcagagatgcccccttcagcgagcccccaggccccagcggcttccacaagcagaggaggagcctggacaccccccagagcctggccagcctgagcagccgcagcagcctgagcagcctgagcccccccagcagccccctggacacccccttcctgcctgccagccgggacagccccctggcccagctggccgacagctgtgagggccctggcctgggcgccctggaccggctgcgggcccacgccagcgccatgggagatgaggacctgcccggcatggccgccctgcagccccacggcgtgcctggagatggagagggcccccatgagcggggccccccaccagccagcgcccctgtgggcggcaagatcctgaccagctag

SEQ ID NO: 43660 - DNA, 1764 bp, Artificial Sequence
  Description of Artificial Sequence: Synthetic coding sequence
atgggagatgaggacctgcccggcatggccgccctgcagccccatggagtgcctggagatggagagggcccccatgagcggggccccccaccagccagcgcccctgtgggcggcaccgtgaccctgcgggaggacagcgccaagaggctggagcggcgggcccggcgcatcagcgcctgcctgagtgactacagcctggccagtgacagcggcgtgtttgagcccctgaccaagagaaatgaagatgctgaggagcccgcctacggggacacagccagcaatggagacccccagatccacgtgggcctgctgcgggacagcggcagcgagtgcctgctggtgcacgtgctgcagctgaagaacccagctggcctggccgtgaaggaggactgcaaggtgcacatccgggtgtacctgccccccctggacagcggcacccccaacacctactgcagcaaggccctggagttccaggtgcccctggtgttcaatgaggtgttccgcatccctgtgcacagcagcgccctgaccctgaagagcctgcagctgtatgtgtgcagcgtgaccccccagctgcaggaggagctgctgggcatcgcccagatcaacctggccgactatgacagcctgtctgagatgcagctgcgctggcacagcgtgcaggtgttcaccagcagcgagcccagcaggacccgggaggccggctgtgccggggagagcagcgcccgggaccctgcccacaccatcagcatcagcggcaagacagatgctgtgacagtgctgctggcccggaccacagcccagctgcaggccgtggagcgggagctggccgaggagcgggccaagctggagtacacagaggaggaggtgctggagatggagaggaaggaggagcaggccgaggccatcagcgagaggtcctggcaggccgacagcgtggacagcggctgcagcaactgcacccagaccagccccccctacccagagccctgctgcatgggcatcgacagcatcctgggccacccctttgctgcccaggccggcccctacagccctgagaagttccagcccagccccctgaaggtggacaaggagaccaacacagaagatctcttcctggaggaggccgccagcctggtgaaggagcggcccagccggcgggcccggggcagcccctttgtgcgcagcggcaccatcgtgcgcagccagaccttcagccctggggcccggagccagtatgtgtgccgcctgtacagaagtgacagcgacagcagcaccctgcccaggaagagcccctttgtgaggaacaccctggagaggaggaccctgcgctacaagcagagctgccgcagcagcctggccgagctgatggcccggaccagcctggacctggagctggacctgcaggccagcaggacccggcagaggcagctgaatgaggagctgtgtgccctgcgggagctgcggcagaggctggaggatgcccagctgcggggccagacagacctgcccccctgggtgctgagagatgagcggctgcggggcctgctgcgggaggccgagcggcagacccggcagaccaagctggactacagacatgagcaggccgctgagaagatgctgaagaaggccagcaaggagatctaccagctgcggggccagagccacaaggagcccatccaggtgcagaccttccgggagaagatcgccttcttcacccggccccgcatcaacatcccccccctgcctgcagatgatgtgtag

SEQ ID NO: 43661 - DNA, 210 bp, Artificial Sequence
  Description of Artificial Sequence: Synthetic coding sequence
atggagagccccaagaagaagaaccagcagctgaaggtgggcatcctgcacctgggcagccggcagaagaagatccgcatccagctgcggagccaggtgctgggccgggagatgagggacatggagggggacctgcaggagctgcaccagagcaacacaggagacaagagcggcttcggcttccggcggcagggcgaggacaacacctag

SEQ ID NO: 43662 - DNA, 441 bp, Artificial Sequence
  Description of Artificial Sequence: Synthetic coding sequence
atgctgctgtggtgccccccccagtgtgcctgcagcctgggcgtcttccccagcgcccccagccctgtgtggggcaccaggaggagctgtgagcccgccaccagggtgcctgaggtgtggatcctgagccccctgctgcggcacggcggccacacccagacccagaaccacacagccagccccaggagccctgtgatggagagccccaagaagaagaaccagcagctgaaggtgggcatcctgcacctgggcagccggcagaagaagatccgcatccagctgcggagccagtgtgccacctggaaggtgatctgcaagagctgcatcagccagaccccaggcatcaacctggacctgggcagcggcgtgaaggtgaagatcatccccaaggaggagcactgcaagatgcctgaggccggggaggagcagccccaggtgtag

SEQ ID NO: 43663 - DNA, 441 bp, Artificial Sequence; identical to SEQ ID NO: 43662
  Description of Artificial Sequence: Synthetic coding sequence

SEQ ID NO: 43664 - DNA, 210 bp, Artificial Sequence; identical to SEQ ID NO: 43661
  Description of Artificial Sequence: Synthetic coding sequence

SEQ ID NO: 43665 - DNA, 336 bp, Artificial Sequence
  Description of Artificial Sequence: Synthetic coding sequence
atgatctggaggggccgcagcacctaccggccccggccccggcgctctgtgcccccacctgagctgattggccccatgctggagcctggagatgaggagccccagcaggaggagcccccaacagagagccgggaccctgcccctggccaggagcgggaggaggaccagggcgctgctgagacccaggtgcctgacctggaggccgacctgcaggagctgagccagagcaagacaggaggagaatgtggaaatggaccagatgaccagggcaagatcctgcccaagtctgagcagttcaagatgcctgagggcggggaccggcagccccaggtgtag

SEQ ID NO: 43666 - DNA, 336 bp, Artificial Sequence; identical to SEQ ID NO: 43665
  Description of Artificial Sequence: Synthetic coding sequence

SEQ ID NO: 43667 - DNA, 327 bp, Artificial Sequence
  Description of Artificial Sequence: Synthetic coding sequence
atgtcctggaggggccgccgctaccggccccggcgctgcctgcggctggcccagctggtgggccccatgctggagcccagcgtgcctgagccccagcaggaggagcccccaacagagagccaggaccacaccccaggccagaagcgggaggatgaccagggcgctgctgagatccaggtgcccaacctggaggccgacctgcaggagctgagccagagcaagacaggagatgaatgtggggacagcccagatgtgcagggcaagatcctgcccaagtctgagcagttcaagatgcctgagggcggggagggcaagccccagctgtag

SEQ ID NO: 43668 - DNA, 246 bp, Artificial Sequence
  Description of Artificial Sequence: Synthetic coding sequence
atggagagccccaagaagaagaaccagcagctgaaggtgggcatcctgcacctgggcagccggcagaagaagatccgcatccagctgcggagccagtgtgccacctggaaggtgatctgcaagagctgcatcagccagaccccaggcatcaacctggacctgggcagcggcgtgaaggtgaagatcatccccaaggaggagcactgcaagatgcctgaggccggggaggagcagccccaggtgtag

SEQ ID NO: 43669 - DNA, 441 bp, Artificial Sequence; identical to SEQ ID NO: 43662
  Description of Artificial Sequence: Synthetic coding sequence

SEQ ID NO: 43670 - DNA, 210 bp, Artificial Sequence; identical to SEQ ID NO: 43661
  Description of Artificial Sequence: Synthetic coding sequence

SEQ ID NO: 43671 - DNA, 336 bp, Artificial Sequence
  Description of Artificial Sequence: Synthetic coding sequence
atgtcctggaggggccgcagcacctaccggccccggccccggcgcagcctgcagcccccagagctgattggagccatgctggagcccacagatgaggagcccaaggaggagaagccacccaccaagagcaggaaccccaccccagaccagaagagagaagatgaccagggcgctgctgagatccaggtgcctgacctggaggccgacctgcaggagctgtgccagaccaagacaggagatggctgtgagggcggcacagatgtgaagggcaagatcctgcccaaggccgagcacttcaagatgcctgaggccggggagggcaagagccaggtgtag

SEQ ID NO: 43672 - DNA, 336 bp, Artificial Sequence; identical to SEQ ID NO: 43671
  Description of Artificial Sequence: Synthetic coding sequence

SEQ ID NO: 43673 - DNA, 327 bp, Artificial Sequence; identical to SEQ ID NO: 43667
  Description of Artificial Sequence: Synthetic coding sequence

SEQ ID NO: 43674 - DNA, 327 bp, Artificial Sequence; identical to SEQ ID NO: 43667
  Description of Artificial Sequence: Synthetic coding sequence

SEQ ID NO: 43675 - DNA, 228 bp, Artificial Sequence
  Description of Artificial Sequence: Synthetic coding sequence
atgtcctggaggggccgccgctaccggccccggcgctgcctgcggctggcccagctggtgggccccatgctggagcccagcgtgcctgagccccagcaggaggagcccccaacagagagccaggaccacaccccaggccagaagcgggaggatgaccagggcgctgctgagatccagggcaccagcatcctggcccaggacaagacccagttcagcgagaccggctag

SEQ ID NO: 43676 - DNA, 327 bp, Artificial Sequence; identical to SEQ ID NO: 43667
  Description of Artificial Sequence: Synthetic coding sequence

SEQ ID NO: 43677 - DNA, 270 bp, Artificial Sequence
  Description of Artificial Sequence: Synthetic coding sequence
atgaagtacaccaagcagaacttcatgatgtctgtgctgggcatcatcatctacgtgacagacctgattgtggacatctgggtgtctgtgcgcttcttccacgagggccagtatgtgttttctgccctggccctgtccttcatgctgtttggcaccctggtggcccagtgcttctcctacagctggttcaaggctgacctgaagaaggccggccaggagagccagcactgcttcctgctgctgcactgcctgcagggcggcgtcttctag

SEQ ID NO: 43678 - DNA, 492 bp, Artificial Sequence
  Description of Artificial Sequence: Synthetic coding sequence
atgaggcggctgctgatccccctggccctgtggctgggcgctgtgggcgtgggcgtggccgagctgacagaggcccagaggcggggcctgcaggtggccctggaggagttccacaagcacccccctgtgcagtgggccttccaggagacctctgtggagagcgctgtggacacccccttccctgctggcatctttgtgcggctggagttcaagctgcagcagaccagctgcaggaagagggactggaagaagccagagtgcaaggtgcggcccaacggcaggaagaggaagtgcctggcctgcatcaagctgggcagcgaggacaaggtgctgggccgcctggtgcactgccccatcgagacccaggtgctgcgggaggccgaggagcaccaggagacccagtgcctgcgggtgcagagagctggggaggacccccacagcttctacttccctggccagtttgccttcagcaaggccctgcccaggagctag

SEQ ID NO: 43679 - DNA, 621 bp, Artificial Sequence
  Description of Artificial Sequence: Synthetic coding sequence
atgtcctgggtgcaggccgccagcctcatccagggccctggggacaagggagatgtgtttgatgaggaggctgatgagagcctgctggcccagcgggagtggcagagcaacatgcagaggagagtgaaggagggctacagagatggcattgatgctgggaaggctgtgaccctgcagcagggcttcaaccagggctacaagaagggagctgaggtgatcctgaactacggccgcctgcggggcaccctgaggaacagcacagactggagcctgctgggcctgcgggcccccctgcggagccctgaggtgggcacccagctgctgccccggcccctgcctgtgcccggccacatggccagcggggccacccccaagcagcccacagagctggaggccaccctgctgagcctggtgccccagagcggccgggccaccccccgcttccctgcccggctgcgggcccctggccctggcacccccagccacagaagacgcttccggaggaagccccaccgggaccctgctgctgcctgcccagcctggcccccagaggcccccagcaacagcgagacccacttcagcacctacaaccgcatcatcatccggggcggccacatctag

SEQ ID NO: 43680 - DNA, 972 bp, Artificial Sequence
  Description of Artificial Sequence: Synthetic coding sequence
atgagccggcccaggatgaggctggtggtgacagcagatgactttggctactgccccaggagagatgagggcatcgtggaggccttcctggccggggctgtgacctctgtgtccctgctggtgaatggagctgccacagagagcgctgctgagctggcccggcggcacagcatccccaccggcctgcacgccaacctgtctgagggccggcctgtgggccctgcccggcggggggccagcagcctgctgggccctgagggcttcttcctgggcaagatgggcttccgggaggccgtggccgctggagatgtggacctgccccaggtgcgggaggagctggaggcccagctgagctgcttccgggagctgctgggccgggcccccacccatgctgatggccaccagcacgtgcacgtgctgcccggggtgtgccaggtgtttgctgaggccctgcaggcctacggcgtgcgcttcacccggctgcccctggagcggggcgtgggcggctgcacctggctggaggccccagcccgggcctttgcctgtgctgtggagagagatgcccgggctgctgtgggccccttcagccgccacggcctgcgctggacagatgcctttgtgggcctgagcacctgtggccgccacatgtctgcccaccgggtgtctggggccctggcccgggtgctggagggcaccctggccggccacaccctgacagctgagctgatggcccaccctggctaccccagcgtgccccccaccggcggctgtggggagggcccagatgccttcagctgctcctgggagcggctgcacgagctgcgggtgctgacagcccccaccctgcgggcccagctggcccaggatggagtgcagctgtgtgccctggatgacctggacagcaagaggcctggagaggaggtgccctgtgagcccaccctggagcccttcctggagcccagcctgctgtag

SEQ ID NO: 43681 - DNA, 450 bp, Artificial Sequence
  Description of Artificial Sequence: Synthetic coding sequence
atgagccggcccaggatgaggctggtggtgacagcagatgactttggctactgccccaggagagatgagggcatcgtggaggccttcctggccggggctgtgacctctgtgtccctgctggtgaatggagctgccacagagagcgctgctgagctggcccggcggcacagcatccccaccggcctgcacgccaacctgtctgagggccggcctgtgggccctgcccggcggggggccagcagcctgctgggccctgagggcttcttcctgggcaagatgggcttccgggaggccgtggccgctggagatgtggacctgccccaggtgcgggaggagctggaggcccagctgagctgcttccgggagctgctgggccgggcccccacccatgctgatggccaccagcacgtgcacgtgctgcccggcggccagacccccagctgggcctag

SEQ ID NO: 43682 - DNA, 900 bp, Artificial Sequence
  Description of Artificial Sequence: Synthetic coding sequence
atgagcagcgctgctggccctgaccccagcgaggcccctgaggagcggcacttcctgcgggccctggagctgcagccccccctggccgacatgggccgggcagagctgagcagcaatgccaccaccagcctggtgcagaggaggaagcaggcctggggccggcagagctggctggagcagatctggaatgccggccctgtgtgccagagcacagctgaggccgccgccctggagcgggagctgctggaggactacagatttggccggcagcagctggtggagctgtgtggccacgccagcgctgtggccgtgaccaaggccttccccctgcctgccctgagcaggaagcagaggacagtgctggtggtgtgtggccctgagcagaatggagctgtgggcctggtgtgtgcccggcacctgcgggtgtttgaatatgagcccaccatcttctaccccaccaggagcctggacctgctgcaccgggacctgaccacccagtgtgagaagatggacatccccttcctgagctacctgcccacagaggtgcagctgatcaatgaggcctacggcctggtggtggatgctgtgctgggccctggggtggagcctggagaggtgggcggcccctgcacccgggccctggccaccctgaagctgctgagcatccccctggtgtccctggacatccccagcggctgggatgctgagactggaagtgacagtgaagatggcctgcggccagatgtgctggtgtccctggccgcccccaagagatgtgccggccgcttcagcggccgccaccactttgtggccggccgctttgtgcctgatgatgtgcggaggaagtttgccctgcggctgcccggctacacaggaacagactgtgtggccgccctgtag

SEQ ID NO: 43683 - DNA, 750 bp, Artificial Sequence
  Description of Artificial Sequence: Synthetic coding sequence
atgagcagcgctgctggccctgaccccagcgaggcccctgaggagcggcacttcctgagcacagctgaggccgccgccctggagcgggagctgctggaggactacagatttggccggcagcagctggtggagctgtgtggccacgccagcgctgtggccgtgaccaaggccttccccctgcctgccctgagcaggaagcagaggacagtgctggtggtgtgtggccctgagcagaatggagctgtgggcctggtgtgtgcccggcacctgcgggtgtttgaatatgagcccaccatcttctaccccaccaggagcctggacctgctgcaccgggacctgaccacccagtgtgagaagatggacatccccttcctgagctacctgcccacagaggtgcagctgatcaatgaggcctacggcctggtggtggatgctgtgctgggccctggggtggagcctggagaggtgggcggcccctgcacccgggccctggccaccctgaagctgctgagcatccccctggtgtccctggacatccccagcggctgggatgctgagactggaagtgacagtgaagatggcctgcggccagatgtgctggtgtccctggccgcccccaagagatgtgccggccgcttcagcggccgccaccactttgtggccggccgctttgtgcctgatgatgtgcggaggaagtttgccctgcggctgcccggctacacaggaacagactgtgtggccgccctgtag

SEQ ID NO: 43684 - DNA, 750 bp, Artificial Sequence; identical to SEQ ID NO: 43683
  Description of Artificial Sequence: Synthetic coding sequence

SEQ ID NO: 43685 - DNA, 900 bp, Artificial Sequence; identical to SEQ ID NO: 43682
  Description of Artificial Sequence: Synthetic coding sequence

SEQ ID NO: 43686 - DNA, 822 bp, Artificial Sequence
  Description of Artificial Sequence: Synthetic coding sequence
atggccgccagcaaggtgaagcaggacatgcctcctcctgggggctacggccccatcgactacaagaggaacctgccccggcggggcctgagcggctacagcatgctggccatcggcatcggcaccctcatctacggccactggagcatcatgaagtggaaccgggagcggcggcggctgcagattgaagattttgaggccagaattgccctgctgcccctgctgcaggccgagacagacaggaggaccctgcagatgctgcgggagaacctggaggaggaggccatcatcatgaaggatgtgcctgactggaaggccttccccctgcctgccctgagcaggaagcagaggacagtgctggtggtgtgtggccctgagcagaatggagctgtgggcctggtgtgtgcccggcacctgcgggtgtttgaatatgagcccaccatcttctaccccaccaggagcctggacctgctgcaccgggacctgaccacccagtgtgagaagatggacatccccttcctgagctacctgcccacagaggtgcagctgatcaatgaggcctacggcctggtggtggatgctgtgctgggccctggggtggagcccggggaggtgggcggcccctgcacccgggccctggccaccctgaagctgctgagcatccccctggtgtccctggacatccccagcggcatgcctggccggggcggccacatcggggcctggggcgcctgggtggaggcccctgtgccccagctgctggtggccccagcctgcctgaacctgaacctgcccagcctggatggccccaccctgggctag

SEQ ID NO: 43687 - DNA, 507 bp, Artificial Sequence
  Description of Artificial Sequence: Synthetic coding sequence
atggagtttgtgcctgggggcagcatcagcagcatcatcaaccgcttcggccccctgcctgagatggtgttctgcaagtacaccaagcagatcctgcagggcgtggcctacctgcacgagaactgtgtggtgcaccgggacatcaagggcaacaacgtgatgctgatgcccaccggcatcatcaagctgattgactttggctgtgcccggcggctggcctgggccggcctgaatggcacccacagcgacatgctgaagtccatgcacggcaccccctactggatggcccctgaggtgatcaatgaaagtggctacggcaggaagagtgacatctggagcatcggctgcaccgtgtttgagatggccaccgggaagccacccctggcctccatggacaggatggccgccatgttctacatcggggcccaccggggcctgatgccacccctgcctgaccacttctctgaaaatgctgctgactttgtgaggatgtgcctgaccaggtag

SEQ ID NO: 43688 - DNA, 3648 bp, Artificial Sequence
  Description of Artificial Sequence: Synthetic coding sequence
atgagctccatgcccaagccagagagacatgctgagagcctgctggacatctgccacgacaccaacagcagccccacagacctgatgacagtgaccaagaaccagaacatcatcctgcagagcatcagccgctctgaggagtttgaccaggatggagactgcagccacagcaccctggtgaatgaggaggaggaccccagcggcggccggcaggactggcagcccaggacagaggagttcagcaccagccacatgaagtacagcggccgcagcatcaagttcctgctgccccccctgagcctgctgcccaccaggtctggagtgctgaccatcccccagaaccacaagttccccaaggagaaggagaggaacatccccagcctgaccagctttgtgcccaagctgtctgtgtctgtgcggcagagtgatgagctgagccccagcaatgaacctcctggggccctggtgaagagcctgatggaccccaccctgcggagcagtgatggcttcatctggagcaggaacatgtgcagcttccccaagaccaaccaccaccggcagtgcctggagaaggaggagaactggaagagcaaggagattgaggagtgcaacaagattgagatcacccactttgagaagggccagagcctggtgtcctttgagaacctgaaggagggcaacatcccagctgtgcgggaggaggacatcgactgccacggcagcaagaccaggaagccagaggaggagaacagccagtacctgagcagcaggaagaatgaatcttctgtggccaagaactatgagcaggaccctgagatcgtgtgcaccatccccagcaagttccaggagacccagcacagcgagatcacccccagccaggatgaggagatgaggaacaacaaggccgccagcaagagggtgtccctgcacaagaatgaggccatggagcccaacaacatcctggaggagtgcaccgtgctgaagagcctgagctctgtggtgtttgatgaccccatcgacaagctgcctgagggctgcagctccatggagaccaacatcaagatcagcattgctgagcgggccaagccagagatgagcaggatggtgcccctcatccacatcaccttccctgtggatggcagccccaaggagcctgtgattgccaagcccagcctgcagaccaggaagggcaccatccacaacaaccacagcgtgaacatccctgtgcaccaggagaatgacaagcacaagatgaacagccacaggagcaagctggacagcaagaccaagaccagcaagaagaccccccagaactttgtgatcagcacagagggccccatcaagcccaccatgcacaagaccagcatcaagacccagatcttccctgccctgggcctggtggacccccggccctggcagctgccccgcttccagaagaagatgccccagatcgccaagaagcagagcacccacaggacccagaagcccaagaagcagagcttcccctgcatctgcaagaaccctggcacccagaagagctgtgtgcccctgtctgtgcagcccacagagccccggctgaactacctggacctgaagtacagcgacatgttcaaggagatcaacagcacagccaatggacctggcatctatgagatgtttggcacccctgtgtactgccacgtgcgggagacagaaagagatgagaacacctactaccgggagatctgcagcgcccccagcggccgccgcatcaccaacaagtgccgcagcagccacagcgagaggaagagcaacatccgcacccggctgagccagaagaagacccacatgaagtgccccaagaccagctttggcatcaagcaggagcacaaggtgctgatcagcaaggagaagagcagcaaggctgtgcacagcaacctgcatgacattgaaaatggagatggcatcagcgagccagactggcagatcaagagcagtggaaatgagttcctgagcagcaaggatgagatccaccccatgaacctggcccagaccccagagcagagcatgaagcagaatgagttcccccctgtgtctgacctgagcatcgtggaggaggtgtccatggaggagagcactggagaccgggacatcagcaacaaccagatcctgaccaccagcctgcgggacctgcaggagctggaggagctgcaccaccagatccccttcatccccagcgaggacagctgggccgtgcccagcgagaagaacagcaacaagtatgtgcagcaggagaagcagaacacagccagcctgagcaaggtgaatgccagccgcatcctgaccaatgacctggagtttgacagcgtgtctgaccacagcaagaccctgaccaacttctccttccaggccaagcaggagagcgccagcagccagacctaccagtactgggtgcactacctggaccatgacagcctggccaacaagagcatcacctaccagatgtttgggaagaccctgagcggcaccaacagcatcagccaggagatcatggacagcgtgaacaatgaggagctgacagatgagctgctgggctgcctggccgctgagctgctggccctggatgagaaggacaacaacagctgccagaagatggccaatgaaacagatcctgagaacctgaacctggtgctgcgctggaggggcagcacccccaaggagatgggccgggagaccaccaaggtgaagatccagaggcacagcagcggcctgcgcatctatgaccgggaggagaagttcctgatcagcaatgagaagaagatcttcagcgagaacagcctgaagtctgaggagcccatcctgtggaccaagggggagatcctgggcaagggggcctatggaacagtgtactgcggcctgaccagccagggccagctgattgctgtgaagcaggtggccctggacaccagcaacaagctggccgctgagaaggagtacaggaagctgcaggaggaggtggacctgctgaaggccctgaagcacgtgaacatcgtggcctacctgggcacctgcctgcaggagaacacagtgtccatcttcatggagtttgtgcctgggggcagcatcagcagcatcatcaaccgcttcggccccctgcctgagatggtgttctgcaagtacaccaagcagatcctgcagggcgtggcctacctgcacgagaactgtgtggtgcaccgggacatcaagggcaacaacgtgatgctgatgcccaccggcatcatcaagctgattgactttggctgtgcccggcggctggcctgggccggcctgaatggcacccacagcgacatgctgaagtccatgcacggcaccccctactggatggcccctgaggtgatcaatgaaagtggctacggcaggaagagtgacatctggagcatcggctgcaccgtgtttgagatggccaccgggaagccacccctggcctccatggacaggatggccgccatgttctacatcggggcccaccggggcctgatgccacccctgcctgaccacttctctgaaaatgctgctgactttgtgaggatgtgcctgacccgggaccagcacgagcggcccagcgccctgcagctgctgaagcacagcttcctggagaggagccactag

SEQ ID NO: 43689 - DNA, 1533 bp, Artificial Sequence
  Description of Artificial Sequence: Synthetic coding sequence
atgagctccatgcccaagccagagagacatgctgagagcctgctggacatctgccacgacaccaacagcagccccacagacctgatgacagtgaccaagaaccagaacatcatcctgcagagcatcagccgctctgaggagtttgaccaggatggagactgcagccacagcaccctggtgaatgaggaggaggaccccagcggcggccggcaggactggcagcccaggacagaaggagtggagatcaccgtgaccttccccagagatgtgagccccccccaggagatgagccaggaggacctgaaggagaagaacctgatcaacagcagcctgcaggagtgggcccaggcccatgctgtgagccaccccaatgaaattgagaccgtggagctgaggaagaagaagctgaccatgaggcccctggtgctgcagaaggaggagagcagccgggagctgtgcaatgtgaacctgggcttcctgctgcccaggagctgcctggagctgaacatcagcaagtctgtgaccagagaagatgccccccacttcctgaaggagcagcagaggaagtctgaggagttcagcaccagccacatgaagtacagcggccgcagcatcaagaggcacagcagcggcctgcgcatctatgaccgggaggagaagttcctgatcagcaatgagaagaagatcttcagcgagaacagcctgaagtctgaggagcccatcctgtggaccaagggggagatcctgggcaaaggagcctacggcaccgtgtactgcggcctgaccagccagggccagctgattgctgtgaagcaggtggccctggacaccagcaacaagctggccgctgagaaggagtacaggaagctgcaggaggaggtggacctgctgaaggccctgaagcacgtgaacatcgtggcctacctgggcacctgcctgcaggagaacacagtgtccatcttcatggagtttgtgcctgggggcagcatcagcagcatcatcaacagatttggccccctgcctgagatggtgttctgcaagtacaccaagcagatcctgcagggcgtggcctacctgcacgagaactgtgtggtgcaccgggacatcaagggcaacaacgtgatgctgatgcccaccggcatcatcaagctgattgactttggctgtgcccggcggctggcctgggccggcctgaatggcacccacagcgacatgctgaagtccatgcacggcaccccctactggatggcccctgaggtgatcaatgaaagtggctacggcaggaagagtgacatctggagcatcggctgcaccgtgtttgagatggccaccgggaagccacccctggcctccatggacaggatggccgccatgttctacatcggggcccaccggggcctgatgccacccctgcctgaccacttctctgaaaatgctgctgactttgtgaggatgtgcctgacccgggaccagcacgagcggcccagcgccctgcagctgctgaagcacagcttcctggagaggagccactag

SEQ ID NO: 43690 - DNA, 3987 bp, Artificial Sequence
  Description of Artificial Sequence: Synthetic coding sequence
atgagctccatgcccaagccagagagacatgctgagagcctgctggacatctgccacgacaccaacagcagccccacagacctgatgacagtgaccaagaaccagaacatcatcctgcagagcatcagccgctctgaggagtttgaccaggatggagactgcagccacagcaccctggtgaatgaggaggaggaccccagcggcggccggcaggactggcagcccaggacagaaggagtggagatcaccgtgaccttccccagagatgtgagccccccccaggagatgagccaggaggacctgaaggagaagaacctgatcaacagcagcctgcaggagtgggcccaggcccatgctgtgagccaccccaatgaaattgagaccgtggagctgaggaagaagaagctgaccatgaggcccctggtgctgcagaaggaggagagcagccgggagctgtgcaatgtgaacctgggcttcctgctgcccaggagctgcctggagctgaacatcagcaagtctgtgaccagagaagatgccccccacttcctgaaggagcagcagaggaagtctgaggagttcagcaccagccacatgaagtacagcggccgcagcatcaagttcctgctgccccccctgagcctgctgcccaccaggtctggagtgctgaccatcccccagaaccacaagttccccaaggagaaggagaggaacatccccagcctgaccagctttgtgcccaagctgtctgtgtctgtgcggcagagtgatgagctgagccccagcaatgagcccccaggggccctggtgaagagcctgatggaccccaccctgcggagcagtgatggcttcatctggagcaggaacatgtgcagcttccccaagaccaaccaccaccggcagtgcctggagaaggaggagaactggaagagcaaggagattgaggagtgcaacaagattgagatcacccactttgagaagggccagagcctggtgtcctttgagaacctgaaggagggcaacatcccagctgtgcgggaggaggacatcgactgccacggcagcaagaccaggaagccagaggaggagaacagccagtacctgagcagcaggaagaatgaatcttctgtggccaagaactatgagcaggaccctgagatcgtgtgcaccatccccagcaagttccaggagacccagcacagcgagatcacccccagccaggatgaggagatgaggaacaacaaggccgccagcaagagggtgtccctgcacaagaatgaggccatggagcccaacaacatcctggaggagtgcaccgtgctgaagagcctgagctctgtggtgtttgatgaccccatcgacaagctgcctgagggctgcagctccatggagaccaacatcaagatcagcattgctgagcgggccaagccagagatgagcaggatggtgcccctcatccacatcaccttccctgtggatggcagccccaaggagcccgtcatcgccaagcccagcctgcagaccaggaagggcaccatccacaacaaccacagcgtgaacatccctgtgcaccaggagaatgacaagcacaagatgaacagccacaggagcaagctggacagcaagaccaagaccagcaagaagaccccccagaacttcgtcatcagcacagagggccccatcaagcccaccatgcacaagaccagcatcaagacccagatcttccctgccctgggcctggtggacccccggccctggcagctgccccgcttccagaagaagatgccccagatcgccaagaagcagagcacccacaggacccagaagcccaagaagcagagcttcccctgcatctgcaagaaccctggcacccagaagagctgtgtgcccctgtctgtgcagcccacagagccccggctgaactacctggacctgaagtacagcgacatgttcaaggagatcaacagcacagccaacggccctggcatctatgagatgtttggcacccctgtgtactgccacgtgcgggagacagaaagagatgagaacacctactaccgggagatctgcagcgcccccagcggccgccgcatcaccaacaagtgccgcagcagccacagcgagaggaagagcaacatccgcacccggctgagccagaagaagacccacatgaagtgccccaagaccagctttggcatcaagcaggagcacaaggtgctgatcagcaaggagaagagcagcaaggctgtgcacagcaacctgcatgacattgaaaatggagatggcatcagcgagccagactggcagatcaagagcagtggaaatgagttcctgagcagcaaggatgagatccaccccatgaacctggcccagaccccagagcagagcatgaagcagaatgagttcccccctgtgtctgacctgagcatcgtggaggaggtgtccatggaggagagcactggagaccgggacatcagcaacaaccagatcctgaccaccagcctgcgggacctgcaggagctggaggagctgcaccaccagatccccttcatccccagtgaagattcctgggccgtgcccagcgagaagaacagcaacaagtatgtgcagcaggagaagcagaacacagccagcctgagcaaggtgaatgccagccgcatcctgaccaatgacctggagtttgattctgtgtctgaccacagcaagaccctgaccaacttctccttccaggccaagcaggagagcgccagcagccagacctaccagtactgggtgcactacctggaccatgacagcctggccaacaagagcatcacctaccagatgtttgggaagaccctgagcggcaccaacagcatcagccaggagatcatggattctgtgaacaatgaggagctgacagatgagctgctgggctgcctggccgctgagctgctggccctggatgagaaggacaacaacagctgccagaagatggccaatgaaacagatcctgagaacctgaacctggtgctgcgctggaggggcagcacccccaaggagatgggccgggagaccaccaaggtgaagatccagaggcacagcagcggcctgcgcatctatgaccgggaggagaagttcctgatcagcaatgagaagaagatcttcagcgagaacagcctgaagtctgaggagcccatcctgtggaccaagggggagatcctgggcaaaggagcctacggcaccgtgtactgcggcctgaccagccagggccagctgattgctgtgaagcaggtggccctggacaccagcaacaagctggccgctgagaaggagtacaggaagctgcaggaggaggtggacctgctgaaggccctgaagcacgtgaacatcgtggcctacctgggcacctgcctgcaggagaacacagtgtccatcttcatggagtttgtgcctgggggcagcatcagcagcatcatcaacagatttggccccctgcctgagatggtgttctgcaagtacaccaagcagatcctgcagggcgtggcctacctgcacgagaactgtgtggtgcaccgggacatcaagggcaacaacgtgatgctgatgcccaccggcatcatcaagctgattgactttggctgtgcccggcggctggcctgggccggcctgaatggcacccacagcgacatgctgaagtccatgcacggcaccccctactggatggcccctgaggtgatcaatgaaagtggctacggcaggaagagtgacatctggagcatcggctgcaccgtgtttgagatggccaccgggaagccacccctggcctccatggacaggatggccgccatgttctacatcggggcccaccggggcctgatgccacccctgcctgaccacttctctgaaaatgctgctgactttgtgaggatgtgcctgacccgggaccagcacgagcggcccagcgccctgcagctgctgaagcacagcttcctggagaggagccactag

SEQ ID NO: 43691 - DNA, 1383 bp, Artificial Sequence
  Description of Artificial Sequence: Synthetic coding sequence
atgagctccatgcccaagccagagagacatgctgagagcctgctggacatctgccacgacaccaacagcagccccacagacctgatgacagtgaccaagaaccagaacatcatcctgcagagcatcagccgctctgaggagtttgaccaggatggagactgcagccacagcaccctggtgaatgaggaggaggaccccagcggcggccggcaggactggcagcccaggacagaaggagtggagatcaccgtgaccttccccagagatgtgagccccccccaggagatgagccaggaggacctgaaggagaagaacctgatcaacagcagcctgcaggagtgggcccaggcccatgctgtgagccaccccaatgaaattgagaccgtggagctgaggaagaagaagctgaccatgaggcccctggtgctgcagaaggaggagagcagccgggagctgtgcaatgtgaacctgggcttcctgctgcccaggagctgcctggagctgaacatcagcaagtctgtgaccagagaagatgccccccacttcctgaaggagcagcagaggaagtctgaggagttcagcaccagccacatgaagtacagcggccgcagcatcaaggtgtactgcggcctgaccagccagggccagctgattgctgtgaagcaggtggccctggacaccagcaacaagctggccgctgagaaggagtacaggaagctgcaggaggaggtggacctgctgaaggccctgaagcacgtgaacatcgtggcctacctgggcacctgcctgcaggagaacacagtgtccatcttcatggagtttgtgcctgggggcagcatcagcagcatcatcaacagatttggccccctgcctgagatggtgttctgcaagtacaccaagcagatcctgcagggcgtggcctacctgcacgagaactgtgtggtgcaccgggacatcaagggcaacaacgtgatgctgatgcccaccggcatcatcaagctgattgactttggctgtgcccggcggctggcctgggccggcctgaatggcacccacagcgacatgctgaagtccatgcacggcaccccctactggatggcccctgaggtgatcaatgaaagtggctacggcaggaagagtgacatctggagcatcggctgcaccgtgtttgagatggccaccgggaagccacccctggcctccatggacaggatggccgccatgttctacatcggggcccaccggggcctgatgccacccctgcctgaccacttctctgaaaatgctgctgactttgtgaggatgtgcctgacccgggaccagcacgagcggcccagcgccctgcagctgctgaagcacagcttcctggagaggagccactag

SEQ ID NO: 43692 - DNA, 1389 bp, Artificial Sequence
  Description of Artificial Sequence: Synthetic coding sequence
atgagctccatgcccaagccagagagacatgctgagagcctgctggacatctgccacgacaccaacagcagccccacagacctgatgacagtgaccaagaaccagaacatcatcctgcagagcatcagccgctctgaggagtttgaccaggatggagactgcagccacagcaccctggtgaatgaggaggaggaccccagcggcggccggcaggactggcagcccaggacagaaggagtggagatcaccgtgaccttccccagagatgtgagccccccccaggagatgagccaggaggacctgaaggagaagaacctgatcaacagcagcctgcaggagtgggcccaggcccatgctgtgagccaccccaatgaaattgagaccgtggagctgaggaagaagaagctgaccatgaggcccctggtgctgcagaaggaggagagcagccgggagctgtgcaatgtgaacctgggcttcctgctgcccaggagctgcctggagctgaacatcagcaagtctgtgaccagagaagatgccccccacttcctgaaggagcagcagaggaagtctgaggagttcagcaccagccacatgaagtacagcggccgcagcatcaagaggcacagcagcggcctgcgcatctatgaccgggaggagaagttcctgatcagcaatgagaagaagatcttcagcgagaacagcctgaagtctgaggagcccatcctgtggaccaaggtggacctgctgaaggccctgaagcacgtgaacatcgtggcctacctgggcacctgcctgcaggagaacacagtgtccatcttcatggagtttgtgcctgggggcagcatcagcagcatcatcaacagatttggccccctgcctgagatggtgttctgcaagtacaccaagcagatcctgcagggcgtggcctacctgcacgagaactgtgtggtgcaccgggacatcaagggcaacaacgtgatgctgatgcccaccggcatcatcaagctgattgactttggctgtgcccggcggctggcctgggccggcctgaatggcacccacagcgacatgctgaagtccatgcacggcaccccctactggatggcccctgaggtgatcaatgaaagtggctacggcaggaagagtgacatctggagcatcggctgcaccgtgtttgagatggccaccgggaagccacccctggcctccatggacaggatggccgccatgttctacatcggggcccaccggggcctgatgccacccctgcctgaccacttctctgaaaatgctgctgactttgtgaggatgtgcctgacccgggaccagcacgagcggcccagcgccctgcagctgctgaagcacagcttcctggagaggagccactag

SEQ ID NO: 43693 - DNA, 2094 bp, Artificial Sequence
  Description of Artificial Sequence: Synthetic coding sequence
aagcagagcttcccctgcatctgcaagaaccctggcacccagaagagctgtgtgcccctgtctgtgcagcccacagagccccggctgaactacctggacctgaagtacagcgacatgttcaaggagatcaacagcacagccaacggccctggcatctatgagatgtttggcacccctgtgtactgccacgtgcgggagacagaaagagatgagaacacctactaccgggagatctgcagcgcccccagcggccgccgcatcaccaacaagtgccgcagcagccacagcgagaggaagagcaacatccgcacccggctgagccagaagaagacccacatgaagtgccccaagaccagctttggcatcaagcaggagcacaaggtgctgatcagcaaggagaagagcagcaaggctgtgcacagcaacctgcatgacattgaaaatggagatggcatcagcgagccagactggcagatcaagagcagtggaaatgagttcctgagcagcaaggatgagatccaccccatgaacctggcccagaccccagagcagagcatgaagcagaatgagttcccccctgtgtctgacctgagcatcgtggaggaggtgtccatggaggagagcactggagaccgggacatcagcaacaaccagatcctgaccaccagcctgcgggacctgcaggagctggaggagctgcaccaccagatccccttcatccccagtgaagattcctgggccgtgcccagcgagaagaacagcaacaagtatgtgcagcaggagaagcagaacacagccagcctgagcaaggtgaatgccagccgcatcctgaccaatgacctggagtttgattctgtgtctgaccacagcaagaccctgaccaacttctccttccaggccaagcaggagagcgccagcagccagacctaccagtactgggtgcactacctggaccatgacagcctggccaacaagagcatcacctaccagatgtttgggaagaccctgagcggcaccaacagcatcagccaggagatcatggattctgtgaacaatgaggagctgacagatgagctgctgggctgcctggccgctgagctgctggccctggatgagaaggacaacaacagctgccagaagatggccaatgaaacagatcctgagaacctgaacctggtgctgcgctggaggggcagcacccccaaggagatgggccgggagaccaccaaggtgaagatccagaggcacagcagcggcctgcgcatctatgaccgggaggagaagttcctgatcagcaatgagaagaagatcttcagcgagaacagcctgaagtctgaggagcccatcctgtggaccaagggggagatcctgggcaaaggagcctacggcaccgtgtactgcggcctgaccagccagggccagctgattgctgtgaagcaggtggccctggacaccagcaacaagctggccgctgagaaggagtacaggaagctgcaggaggaggtggacctgctgaaggccctgaagcacgtgaacatcgtggcctacctgggcacctgcctgcaggagaacacagtgtccatcttcatggagtttgtgcctgggggcagcatcagcagcatcatcaacagatttggccccctgcctgagatggtgttctgcaagtacaccaagcagatcctgcagggcgtggcctacctgcacgagaactgtgtggtgcaccgggacatcaagggcaacaacgtgatgctgatgcccaccggcatcatcaagctgattgactttggctgtgcccggcggctggcctgggccggcctgaatggcacccacagcgacatgctgaagtccatgcacggcaccccctactggatggcccctgaggtgatcaatgaaagtggctacggcaggaagagtgacatctggagcatcggctgcaccgtgtttgagatggccaccgggaagccacccctggcctccatggacaggatggccgccatgttctacatcggggcccaccggggcctgatgccacccctgcctgaccacttctctgaaaatgctgctgactttgtgaggatgtgcctgaccaggtag

SEQ ID NO: 43694 - DNA, 4293 bp, Artificial Sequence
  Description of Artificial Sequence: Synthetic coding sequence
atgagccggcccagctctgtgagcccccggcagcctgcccctgggggcggcggcggcggcggccccagcccctgtggccctgggggcggcggccgggccaagggcctgaaggacatcagaattgatgaggaggtgaagattgctgtgaacatcgccctggagcgcttccgctacggggaccagcgggagatggagttccccagcagcctgaccagcacagagcgggccttcatccaccggctgagccagagcctgggcctggtgtccaagagcaagggcaagggggccaaccgctacctgactgtgaagaagaaggatggcagcgagacagcccacgccatgatgacctgcaacctgacccacaacaccaagcatgctgtgcgcagcctcatccagcgcttccctgtgaccaacaaggagaggacagagctgctgcccaagacagaaagaggaaatgtgtttgctgtggaggctgaaaatcgggagatgagcaagaccagcggccgcctgaacaacggcatcccccagatccctgtgaagagaggagagagcgagtttgacagcttccggcagagcctgcctgtgtttgagaagcaggaggagatcgtgaagatcatcaaggagaacaaggtggtgctgattgtgggggagaccggcagcggcaagaccacccagatcccccagttcctgctggatgactgcttcaagaatggcatcccctgccgcatcttctgcacccagccccggcggctggccgccatcgctgtggccgagcgggtggccgctgagcggcgggagcgcatcggccagaccatcggctaccagatccggctggagagccgggtgagccccaagaccctgctgaccttctgcaccaatggagtgctgctgcggaccctgatggccggggacagcaccctgagcacagtgacccacgtgattgtggatgaggtgcatgagcgggaccgcttcagtgacttcctgctgaccaagctgcgggacctgctgcagaagcaccccaccctgaagctgatcctgagcagcgctgccctggatgtgaacctcttcatccgctacttcggcagctgccctgtgatctacatccagggccggccctttgaggtgaaggagatgttcctggaggacatcctgcggaccaccggctacaccaacaaggagatgctgaagtacaagaaggagaagcagcaggaggagaagcagcagaccaccctgacagagtggtacagcgcccaggagaacagcttcaagccagagagccagaggcagaggacagtgctgaatgtgacagatgaatatgacctgctggatgatggaggagatgctgtgttcagccagctgacagagaaggatgtgaactgcctggagccctggctgatcaaggagatggatgcctgcctgagtgacatctggctgcacaaggacattgatgcctttgcccaggtgttccacctgatcctgacagaaaatgtgtctgtggactaccgccacagcgagaccagcgccacagccctgatggtggccgccggccggggctttgccagccaggtggagcagctgatctccatgggcgccaacgtgcacagcaaggccagcaatggctggatggccctggactgggccaagcacttcggccagacagaaattgtggacctgctggagagctacagcgccaccctggagtttggaaacctggatgagagcagcctggtgcagaccaacggcagtgacctgtctgcagaagatcgggagctgctgaaggcctaccaccacagctttgatgatgagaaggtggacctggacctgatcatgcacctgctgtacaacatctgccacagctgtgatgctggagctgtgctgatcttcctgcccggctatgatgaaattgtgggcctgcgggaccgcatcctgtttgatgacaagagatttgctgacagcacccaccgctaccaggtgttcatgctgcacagcaacatgcagaccagtgaccagaagaaggtgctgaagaaccccccagctggggtgaggaagatcatcctgagcaccaacattgctgagaccagcatcaccgtgaatgatgtggtgtttgtgattgacagcggcaaggtgaaggagaagagctttgatgccctgaactttgtgaccatgctgaagatggtgtggatcagcaaggccagcgccatccagaggaagggccgggccggccgctgcaggcctggcatctgcttccgcctcttcagccggctgcgcttccagaacatgctggagttccagaccccagagctgctgaggatgcccctgcaggagctgtgcctgcacaccaagctgctggcccctgtgaactgccccatcgctgacttcctgatgaaggcccctgagcccccaccagccctgattgtgagaaatgctgtgcagatgctgaagaccattgatgccatggacacctgggaggacctgacagagctgggctaccacctggccgacctgcctgtggagccccacctgggcaagatggtgctgtgtgctgtggtgctgaagtgcctggaccccatcctgaccatcgcctgcaccctggcctacagagacccctttgtgctgcccacccaggccagccagaagagagctgccatgctgtgcaggaagcgcttcaccgctggggccttcagtgaccacatggccctgctgcgggccttccaggcctggcagaaggcccggagtgatggctgggagcgggccttctgtgagaagaacttcctgagccaggccaccatggagatcatcatcggcatgaggacccagctgctgggccagctgcgggccagcggctttgtgcgggcccggggcggcggggacatcagagatgtgaacaccaacagcgagaactgggccgtggtgaaggccgccctggtggccggcatgtaccccaacctggtgcacgtggaccgggagaacctggtgctgaccggccccaaggagaagaaggtgcgcttccacccagcctctgtgctgagccagccccagtacaagaagatccccccagccaacggccaggccgccgccatcaaggccctgcccacagactggctgatctatgatgagatgacccgggcccaccgcatcgccaacatccgctgctgcagcgctgtgacccctgtgaccatcctggtgttctgtggccctgcccggctggccagcaatgccctgcaggagcccagcagcttccgggtggatggcatccccaatgacagcagtgacagcgagatggaggacaagaccacagccaacctggccgccctgaagctggatgagtggctgcacttcaccctggagcctgaggccgccagcctgctgctgcagctgcggcagaagtggcacagcctcttcctgcggaggatgagggcccccagcaagccctggagccaggtggatgaggccaccatccgggccatcatcgctgtgctgagcacagaggagcagagcgctggcctgcagcagcccagcggcatcggccagaggccccggcccatgagcagcgaggagctgcccctggccagctcctggaggagcaacaacagcaggaagagcagcgctgacacagagttcagtgatgagtgcaccacagctgagcgggtgctgatgaagagccccagccctgccctgcaccccccccagaagtacaaggaccggggcatcctgcaccccaagaggggcacagaagatagaagtgaccagagcagcctgaagagcacagacagcagcagctaccccagcccctgtgccagccccagcccccccagcagcggcaagggcagcaagagccccagcccccggcccaacatgcctgtgcgctacttcatcatgaagagcagcaacctgaggaacctggagatcagccagcagaagggcatctggagcaccacccccagcaatgaaaggaagctgaacagagccttctgggagagcagcatcgtgtacctggtgttttctgtgcagggcagcggccacttccagggcttcagcaggatgagcagcgagatcggccgggagaagagccaggactggggcagcgctggcctgggcggcgtcttcaaggtggagtggatcaggaaggagagcctgcccttccagtttgcccaccacctgctgaacccctggaatgacaacaagaaggtgcagatcagcagagatggccaggagctggagcccctggtgggggagcagctgctgcagctgtgggagcggctgcccctgggggagaagaacaccacagactag

SEQ ID NO: 43695 - DNA, 4023 bp, Artificial Sequence
  Description of Artificial Sequence: Synthetic coding sequence
atgctgaggaagggggccaaccgctacctgactgtgaagaagaaggatggcagcgagacagcccacgccatgatgacctgcaacctgacccacaacaccaagcatgctgtgcgcagcctcatccagcgcttccctgtgaccaacaaggagaggacagagctgctgcccaagacagaaagaggaaatgtgtttgctgtggaggctgaaaatcgggagatgagcaagaccagcggccgcctgaacaacggcatcccccagatccctgtgaagagaggagagagcgagtttgacagcttccggcagagcctgcctgtgtttgagaagcaggaggagatcgtgaagatcatcaaggagaacaaggtggtgctgattgtgggggagaccggcagcggcaagaccacccagatcccccagttcctgctggatgactgcttcaagaatggcatcccctgccgcatcttctgcacccagccccggcggctggccgccatcgctgtggccgagcgggtggccgctgagcggcgggagcgcatcggccagaccatcggctaccagatccggctggagagccgggtgagccccaagaccctgctgaccttctgcaccaatggagtgctgctgcggaccctgatggccggggacagcaccctgagcacagtgacccacgtgattgtggatgaggtgcatgagcgggaccgcttcagtgacttcctgctgaccaagctgcgggacctgctgcagaagcaccccaccctgaagctgatcctgagcagcgctgccctggatgtgaacctcttcatccgctacttcggcagctgccctgtgatctacatccagggccggccctttgaggtgaaggagatgttcctggaggacatcctgcggaccaccggctacaccaacaaggagatgctgaagtacaagaaggagaagcagcaggaggagaagcagcagaccaccctgacagagtggtacagcgcccaggagaacagcttcaagccagagagccagaggcagaggacagtgctgaatgtgacagatgaatatgacctgctggatgatggaggagatgctgtgttcagccagctgacagagaaggatgtgaactgcctggagccctggctgatcaaggagatggatgcctgcctgagtgacatctggctgcacaaggacattgatgcctttgcccaggtgttccacctgatcctgacagaaaatgtgtctgtggactaccgccacagcgagaccagcgccacagccctgatggtggccgccggccggggctttgccagccaggtggagcagctgatctccatgggcgccaacgtgcacagcaaggccagcaatggctggatggccctggactgggccaagcacttcggccagacagaaattgtggacctgctggagagctacagcgccaccctggagtttggaaacctggatgagagcagcctggtgcagaccaacggcagtgacctgtctgcagaagatcgggagctgctgaaggcctaccaccacagctttgatgatgagaaggtggacctggacctgatcatgcacctgctgtacaacatctgccacagctgtgatgctggagctgtgctgatcttcctgcccggctatgatgaaattgtgggcctgcgggaccgcatcctgtttgatgacaagagatttgctgacagcacccaccgctaccaggtgttcatgctgcacagcaacatgcagaccagtgaccagaagaaggtgctgaagaaccccccagctggggtgaggaagatcatcctgagcaccaacattgctgagaccagcatcaccgtgaatgatgtggtgtttgtgattgacagcggcaaggtgaaggagaagagctttgatgccctgaactttgtgaccatgctgaagatggtgtggatcagcaaggccagcgccatccagaggaagggccgggccggccgctgcaggcctggcatctgcttccgcctcttcagccggctgcgcttccagaacatgctggagttccagaccccagagctgctgaggatgcccctgcaggagctgtgcctgcacaccaagctgctggcccctgtgaactgccccatcgctgacttcctgatgaaggcccctgagcccccaccagccctgattgtgagaaatgctgtgcagatgctgaagaccattgatgccatggacacctgggaggacctgacagagctgggctaccacctggccgacctgcctgtggagccccacctgggcaagatggtgctgtgtgctgtggtgctgaagtgcctggaccccatcctgaccatcgcctgcaccctggcctacagagacccctttgtgctgcccacccaggccagccagaagagagctgccatgctgtgcaggaagcgcttcaccgctggggccttcagtgaccacatggccctgctgcgggccttccaggcctggcagaaggcccggagtgatggctgggagcgggccttctgtgagaagaacttcctgagccaggccaccatggagatcatcatcggcatgaggacccagctgctgggccagctgcgggccagcggctttgtgcgggcccggggcggcggggacatcagagatgtgaacaccaacagcgagaactgggccgtggtgaaggccgccctggtggccggcatgtaccccaacctggtgcacgtggaccgggagaacctggtgctgaccggccccaaggagaagaaggtgcgcttccacccagcctctgtgctgagccagccccagtacaagaagatccccccagccaacggccaggccgccgccatcaaggccctgcccacagactggctgatctatgatgagatgacccgggcccaccgcatcgccaacatccgctgctgcagcgctgtgacccctgtgaccatcctggtgttctgtggccctgcccggctggccagcaatgccctgcaggagcccagcagcttccgggtggatggcatccccaatgacagcagtgacagcgagatggaggacaagaccacagccaacctggccgccctgaagctggatgagtggctgcacttcaccctggagcctgaggccgccagcctgctgctgcagctgcggcagaagtggcacagcctcttcctgcggaggatgagggcccccagcaagccctggagccaggtggatgaggccaccatccgggccatcatcgctgtgctgagcacagaggagcagagcgctggcctgcagcagcccagcggcatcggccagaggccccggcccatgagcagcgaggagctgcccctggccagctcctggaggagcaacaacagcaggaagagcagcgctgacacagagttcagtgatgagtgcaccacagctgagcgggtgctgatgaagagccccagccctgccctgcaccccccccagaagtacaaggaccggggcatcctgcaccccaagaggggcacagaagatagaagtgaccagagcagcctgaagagcacagacagcagcagctaccccagcccctgtgccagccccagcccccccagcagcggcaagggcagcaagagccccagcccccggcccaacatgcctgtgcgctacttcatcatgaagagcagcaacctgaggaacctggagatcagccagcagaagggcatctggagcaccacccccagcaatgaaaggaagctgaacagagccttctgggagagcagcatcgtgtacctggtgttttctgtgcagggcagcggccacttccagggcttcagcaggatgagcagcgagatcggccgggagaagagccaggactggggcagcgctggcctgggcggcgtcttcaaggtggagtggatcaggaaggagagcctgcccttccagtttgcccaccacctgctgaacccctggaatgacaacaagaaggtgcagatcagcagagatggccaggagctggagcccctggtgggggagcagctgctgcagctgtgggagcggctgcccctgggggagaagaacaccacagactag

SEQ ID NO: 43696 - DNA, 597 bp, Artificial Sequence
  Description of Artificial Sequence: Synthetic coding sequence
atgctgttcctgggcagcctgggcgcctggggcaccaccagcatcagcacaggcagcatcttcagcctgaagaccctgcggagccagcacggcggccaggtgggcctgaaggtgtcccggccccgggcccccaggatgggcgccgccacccccaccccccgggccccctgggtggcccgctggctgatgggcagccaggccttcaccgccaccccatctgcccggcccccacctccacccatcaagcacaacatggacatcggcacctgggacaacaagggccctgtgcccaaggcccctgtgccccagcaggcccccagcccccaggccgccccccagccccagcaggtggcccagcccctgcctgcccagcccccagccctggcccagccccagtaccagagcccccagcagcccccccagacccgctgggtggcccccaggaacagaaatgctgccttcggccagagcggcggggccggcagtgacagcaacagccctggaaatgtgcagcccaacagcgcccccagcgtggagagccaccctgtgctggagaagctgaaggccgcccacagctacaaccccaaggagttctag

SEQ ID NO: 43697 - DNA, 1530 bp, Artificial Sequence
  Description of Artificial Sequence: Synthetic coding sequence
atgtctgacccctacctgagcagctactacccacccagcatcggcttcccctacagcctgaatgaggccccctggagcacagctggggacccccccatcccctacctgaccacctacggccagctgagcaatggagaccaccacttcatgcatgatgctgtgtttggccagcccggcggcctgggcaacaacatctaccagcaccgcttcaacttcttcccagaaaatcctgccttcagcgcctggggcaccagcggcagccagggccagcagacccagagcagcgcctacggcagcagctacacctacccacccagcagcctgggcggcaccgtggtggatggccagcccggcttccacagcgacaccctgagcaaggcccctggcatgaacagcctggagcagggcatggtgggcctgaagattggagatgtgagcagcagcgctgtgaagacagtgggctctgtggtgtcctctgtggccctgactggagtgctgtctggaaatggaggcaccaacgtgaacatgcctgtgtccaagcccacctcctgggccgccatcgccagcaagccagccaagccccagcccaagatgaagaccaagagcggccctgtgatgggcggcggcctgcccccaccacccatcaagcacaacatggacatcggcacctgggacaacaagggccctgtgcccaaggcccctgtgccccagcaggcccccagcccccaggccgccccccagccccagcaggtggcccagcccctgcctgcccagcccccagccctggcccagccccagtaccagagcccccagcagcccccccagacccgctgggtggcccccaggaacagaaatgctgccttcggccagagcggcggggccggcagtgacagcaacagccctggaaatgtgcagcccaacagcgcccccagcgtggagagccaccctgtgctggagaagctgaaggccgcccacagctacaaccccaaggagtttgagtggaacctgaagagcggccgggtcttcatcatcaagagctacagtgaagatgacatccacaggagcatcaagtacagcatctggtgcagcacagagcacggcaacaagaggctggacagcgccttccgctgcatgagcagcaaaggacctgtgtacctgctcttctctgtgaatggaagtggccacttctgtggggtggccgagatgaagagccctgtggactatggcaccagcgctggggtgtggagccaggacaagtggaagggcaagtttgatgtgcagtggatctttgtgaaggatgtgcccaacaaccagctgcggcacatccggctggagaacaatgacaacaagcctgtgaccaacagccgggacacccaggaggtgcccctggagaaggccaagcaggtgctgaagatcatcagcagctacaagcacaccaccagcatctttgatgactttgcccactatgagaagaggcaggaggaggaggaggtggtgaggaaggagcggcagagcaggaacaagcagtag

SEQ ID NO: 43698 - DNA, 1680 bp, Artificial Sequence
  Description of Artificial Sequence: Synthetic coding sequence
atgtctgccacctctgtggacacccagaggaccaagggccaggacaacaaggtgcagaatggcagcctgcaccagaaggacacagtgcatgacaatgactttgagccctacctgaccggccagagcaaccagagcaacagctaccccagcatgtctgacccctacctgagcagctactacccacccagcatcggcttcccctacagcctgaatgaggccccctggagcacagctggggacccccccatcccctacctgaccacctacggccagctgagcaatggagaccaccacttcatgcatgatgctgtgtttggccagcccggcggcctgggcaacaacatctaccagcaccgcttcaacttcttcccagaaaatcctgccttcagcgcctggggcaccagcggcagccagggccagcagacccagagcagcgcctacggcagcagctacacctacccacccagcagcctgggcggcaccgtggtggatggccagcccggcttccacagcgacaccctgagcaaggcccctggcatgaacagcctggagcagggcatggtgggcctgaagattggagatgtgagcagcagcgctgtgaagacagtgggctctgtggtgtcctctgtggccctgactggagtgctgtctggaaatggaggcaccaacgtgaacatgcctgtgtccaagcccacctcctgggccgccatcgccagcaagccagccaagccccagcccaagatgaagaccaagagcggccctgtgatgggcggcggcctgcccccaccacccatcaagcacaacatggacatcggcacctgggacaacaagggccctgtgcccaaggcccctgtgccccagcaggcccccagcccccaggccgccccccagccccagcaggtggcccagcccctgcctgcccagcccccagccctggcccagccccagtaccagagcccccagcagcccccccagacccgctgggtggcccccaggaacagaaatgctgccttcggccagagcggcggggccggcagtgacagcaacagccctggaaatgtgcagcccaacagcgcccccagcgtggagagccaccctgtgctggagaagctgaaggccgcccacagctacaaccccaaggagtttgagtggaacctgaagagcggccgggtcttcatcatcaagagctacagtgaagatgacatccacaggagcatcaagtacagcatctggtgcagcacagagcacggcaacaagaggctggacagcgccttccgctgcatgagcagcaaaggacctgtgtacctgctcttctctgtgaatggaagtggccacttctgtggggtggccgagatgaagagccctgtggactatggcaccagcgctggggtgtggagccaggacaagtggaagggcaagtttgatgtgcagtggatctttgtgaaggatgtgcccaacaaccagctgcggcacatccggctggagaacaatgacaacaagcctgtgaccaacagccgggacacccaggaggtgcccctggagaaggccaagcaggtgctgaagatcatcagcagctacaagcacaccaccagcatctttgatgactttgcccactatgagaagaggcaggaggaggaggaggtggtgaggaaggagcggcagagcaggaacaagcagtag

SEQ ID NO: 43699 - DNA, 879 bp, Artificial Sequence
  Description of Artificial Sequence: Synthetic coding sequence
atgctgaggaagctgtggcagtggttctatgaggagacagagagcagtgatgatgtggaggtgctgaccctgaagaagttcaagggggacctggcctaccgccggcaggagtaccagaaggccctgcaggagtacagcagcatcagcgagaagctgagcagcaccaactttgccatgaagagagatgtgcaggagggccaggcccgctgcctggcccacctgggccgccacatggaggccctggagattgctgccaacctggagaacaaggccaccaacacagaccacctgaccaccgtgctgtacctgcagctggccatctgcagcagcctgcagaacctggagaagaccatcttctgcctgcagaagctgatcagcctgcaccccttcaacccctggaactggggcaagctggccgaggcctacctgaacctgggccctgccctgtctgctgccctggccagcagccagaagcagcacagcttcaccagcagtgacaagaccatcaagagcttcttcccccacagcggcaaggactgcctgctgtgcttccctgagaccctgcctgagagcagcctcttctctgtggaggccaacagcagcaacagccagaagaatgagaaggccctgaccaacatccagaactgcatggccgagaagcgggagaccgtgctgattgagacccagctgaaggcctgtgccagcttcatccgcacccggctgctgctgcagttcacccagccccagcagaccagctttgccctggagaggaacctgcggacccagcaggagattgaggacaagatgaagggcttctccttcaaggaggacaccctgctgctgattgctgaggtgtctgtgtccctgggcttcatgtag

SEQ ID NO: 43700 - DNA, 684 bp, Artificial Sequence
  Description of Artificial Sequence: Synthetic coding sequence
atggccgagctggacatcggccagcactgccaggtggagcactgccggcagagggacttcctgccctttgtgtgtgatgactgcagcggcatcttctgcctggagcacaggagccgggagagccacggctgcccagaggtgaccgtcatcaatgaaaggctgaagacagaccagcacaccagctacccctgcagcttcaaggactgtgccgagcgggagctggtggccgtcatctgcccctactgtgagaagaacttctgcctgcggcaccgccaccagagcgaccatgaatgtgagaagctggagatccccaagcccaggatggccgccacccagaagctggtgaaggacatcatcgacagcaagacaggagaaacagccagcaagcgctggaagggggccaagaacagcgagacagctgccaaggtggccctgatgaagctgaagatgcacgcagatggagacaagagcctgccccagacagagcgcatctacttccaggtgttcctgcccaagggcagcaaggagaagagcaagcccatgttcttctgccaccgctggagcatcggcaaggccatcgactttgctgccagcctggcccggctgaagaatgacaacaacaagttcaccgccaaggtgaccagccactacaacaacatcagcatcctgatcaaggtgctgtag

SEQ ID NO: 43701 - DNA, 786 bp, Artificial Sequence
  Description of Artificial Sequence: Synthetic coding sequence
atggccgagctggacatcggccagcactgccaggtggagcactgccggcagagggacttcctgccctttgtgtgtgatgactgcagcggcatcttctgcctggagcacaggagccgggagagccacggctgcccagaggtgaccgtcatcaatgaaaggctgaagacagaccagcacaccagctacccctgcagcttcaaggactgtgccgagcgggagctggtggccgtcatctgcccctactgtgagaagaacttctgcctgcggcaccgccaccagagcgaccatgaatgtgagaagctggagatccccaagcccaggatggccgccacccagaagctggtgaaggacatcatcgacagcaagacaggagaaacagccagcaagcgctggaagggggccaagaacagcgagacagctgccaaggtggccctgatgaagctgaagatgcacgcagatggagacaagagcctgccccaggtgttcctgcccaagggcagcaaggagaagagcaagcccatgttcttctgccaccgctggagcatcggcaaggccatcgactttgctgccagcctggcccggctgaagaatgacaacaacaagttcaccgccaagaagctgcggctgtgccacatcaccagcggggaggccctgcccctggaccacaccctggagacctggatcgccaaggaggactgccccctgtacaatggaggcaacatcatcctggagtacctgaatgatgaggagcagttctgcaagaatgtggagagctacctggagtag

SEQ ID NO: 43702 - DNA, 3696 bp, Artificial Sequence
  Description of Artificial Sequence: Synthetic coding sequence
atgtgcaagtgctgcaacctcttcagccccaaccagagcgagctgctgagccacgtgtctgagaagcacatggaggagggcgtgaatgtggatgagatcatcatccccctgcggcccctgagcaccccagagccccccaacagcagcaagacaggagatgagttcctggtgatgaagaggaagaggggccggcccaagggcagcaccaagaagagcagcacagaggaggagctggccgagaacatcgtgagccccacagaggacagccccctggcccctgaggagggcaacagcctgccccccagcagcctggagtgcagcaagtgctgcaggaagttcagcaacacccggcagctgaggaagcacatctgcatcatcgtgctgaacctgggggaggaggagggggaggccggaaatgaaagtgacctggagctggagaagaagtgcaaggaggatgaccgggagaaggccagcaagaggcccaggagccagaagacagagaaggtgcagaagatcagcggcaaggaggcccggcagctgagcggggccaagaagcccatcatctctgtggtgctgacagcccacgaggccatccctggggccaccaagatcgtgcctgtggaggccggccccccagagaccggggccaccaacagcgagaccaccagcgctgacctggtgccccggcggggctaccaggagtatgccatccagcagaccccctatgagcagcccatgaagagcagccggctgggccccacccagctgaagatcttcacctgtgagtactgcaacaaggtgttcaagttcaagcacagcctgcaggcccacctgcgcatccacaccaatgagaagccctacaagtgcccccagtgcagctatgccagcgccatcaaggccaacctgaatgtgcacctgaggaagcacactggagagaagtttgcctgtgactactgcagcttcacctgcctgagcaagggccacctgaaggtgcacatcgagcgggtgcacaagaagatcaagcagcactgccgcttctgcaagaagaagtacagtgatgtgaagaacctgatcaagcacatcagagatgcccatgacccccaggacaagaaggtgaaggaggccctggatgagctgtgcctgatgacccgggagggcaagaggcagctgctgtatgactgccacatctgtgagaggaagttcaagaatgagctggaccgggacagacacatgctggtgcacggggacaagtggccctttgcctgtgagctgtgtggccatggagccaccaagtaccaggccctggagctgcacgtgaggaagcacccctttgtgtatgtgtgtgctgtgtgcaggaagaagtttgtgagcagcatccggctgcggacccacatcaaggaggtgcatggagctgcccaggaggccctggtgttcaccagcagcatcaaccagagcttctgcctgctggagcctggaggagacatccagcaggaggccctgggggaccagctgcagctggtggaggaggagtttgccctgcagggcgtgaatgccctgaaggaggaggcctgccctggggacacccagctggaggagggcaggaaggagcctgaggcccctggagagatgcctgccccagctgtgcacctggccagcccccaggccgagagcacagccctgcccccctgtgagctggagaccaccgtggtgagcagcagtgacctgcacagccaggaggtggtgtctgatgacttcctgctgaagaatgacaccagcagcgctgaggcccacgccgcccctgagaagcccccagacatgcagcacaggagctctgtgcagacccagggcgaggtgatcaccctgctgctgagcaaggcccagagcgctggcagtgaccaggagagccacggggcccagagccccctgggggagggccagaacatggctgtgctgtctgctggggaccctgaccccagccgctgcctgcggagcaacccagctgaggccagtgacctgctgccccctgtggccggcggcggggacaccatcacccaccagcctgacagctgcaaggccgcccctgagcacaggagcggcatcacagccttcatgaaggtgctgaacagcctgcagaagaagcagatgaacaccagcctgtgtgagcgcatcaggaaggtgtatggagacctggagtgtgagtactgcggcaagctgttctggtaccaggtgcactttgacatgcacgtgaggacccacacccgggagcacctgtactactgcagccagtgccactacagcagcatcaccaagaactgcctgaagagacatgtgatccagaagcacagcaacatcctgctgaagtgccccacagatggctgtgactacagcaccccagacaagtacaagctgcaggcccacctgaaggtgcacacagccctggacaagaggagctacagctgccctgtgtgtgagaagagcttctctgaagatagactcatcaagagccacatcaagaccaaccaccctgaggtgtccatgagcaccatcagcgaggtgctgggcagaagagtgcagctgaagggcctgattggcaagagggccatgaagtgcccctactgtgacttctacttcatgaagaatggaagtgacctgcagaggcacatctgggcccatgaaggagtgaagcccttcaagtgcagcctgtgtgaatatgccaccaggagcaagagcaacctgaaggcccacatgaacagacacagcacagagaagacccacctgtgtgacatgtgtgggaagaagttcaagagcaagggcaccctgaagagccacaagctgctgcacacagcagatggcaagcagttcaagtgcaccgtgtgtgactacacagctgcccagaagccccagctgctgcggcacatggagcagcacgtgtccttcaagcccttccgctgtgcccactgccactacagctgcaacatcagcggcagcctgaagaggcactacaacaggaagcaccccaatgaggagtatgccaacgtgggcactggagagctggccgctgaggtgctgatccagcagggcggcctgaagtgccctgtgtgcagctttgtgtatggcaccaagtgggagttcaacagacacctgaagaacaagcacggcctgaaggtggtggagattgatggagaccccaagtgggagacagccacagaggcccctgaggagcccagcacccagtacctgcacatcacagaagcagaagaagatgtgcagggcacccaggccgctgtggccgccctgcaggacctgcgctacaccagcgagagcggggaccggctggaccccacagctgtgaacatcctgcagcagatcatcgagctgggcgctgagacccatgatgccacagccctggcctctgtggtggccatggcccctggcaccgtgacagtggtgaagcaggtgacagaggaggagcccagcagcaaccacacagtgatgatccaggagaccgtgcagcaggcctctgtggagctggccgagcagcaccacctggtggtgtccagtgatgatgtggagggcattgaaacagtgacagtgtacacccagggcggggaggccagcgagttcatcgtgtatgtgcaggaggccatgcagcctgtggaggagcaggccgtggagcagcctgcccaggagctgtag

SEQ ID NO: 43703 - DNA, 1905 bp, Artificial Sequence
  Description of Artificial Sequence: Synthetic coding sequence
atggagcccagccccctgagccccagcggggccgccctgcccctgcccctgagcctggcccccccacccctgcccctgcctgctgctgctgtggtgcacgtgtccttccctgaggtgaccagcgccctgctggagagcctgaaccagcagaggctgcagggccagctgtgtgatgtgtccatccgggtgcagggccgggagttccgggcccacagagctgtgctggccgccagcagcccctacttccatgaccaggtgctgctgaagggcatgaccagcatcagcctgcccagcgtgatggaccccggggcctttgaaacagtgctggccagcgcctacacaggccgcctgtccatggctgctgctgacatcgtgaacttcctgactgtgggctctgtgctgcagatgtggcacatcgtggacaagtgcacagagctgctgcgggagggccgggccagcgccaccaccaccatcaccacagctgctgccacctctgtgacagtgcctggagctggggtgcccagcggcagcggcggcaccgtggccccagccaccatgggcagcgcccggagccacgccagcagccgggccagcgagaaccagagccccagcagcagcaactacttcagcccccgggagagcacagacttcagcagcagcagccaggaggcctttgctgccagcgctgtgggcagcggggagaggagaggaggcggccctgtgtttcctgcccctgtggtgggcagcggcggggccaccagcggcaagctgctgctggaggctgatgagctgtgtgatgatggaggagatggccgcggggctgtggtgcctggagctggcctgcggcggcccacctacaccccacccagcatcatgccccagaagcactgggtgtatgtgaagagaggaggcaactgcccagccccagcccccctggtgccccaggaccctgacctggaggaggaggaggaggaggaggacctggtgctgacctgtgaagatgatgaagatgaggagctgggcggcagcagccgggtgcctgtgggcggcggccctgaggccaccctgagcatcagtgatgtgaggaccctgtctgagcccccagacaagggggaggagcaggtgaacttctgtgagagcagcaatgactttggcccctatgaaggaggcggccctgtggccggcctggatgattctgggggccccacccccagcagctatgcccccagccaccccccccggcccctgctgcccctggacatgcagggcaaccagatcctggtgttccccagcagcagcagcagcagcagcagccaggcccctggccagcccccaggcaaccaggccgagcacggggctgtgacagtgggcggcacctctgtgggcagcctgggcgtgcccggctctgtgggcggcgtgcctgggggcactggaagtggagatggcaacaagatcttcctgtgccactgtgggaaggccttcagccacaagtccatgagggacagacatgtgaacatgcacctgaacctgcggccctttgactgccctgtgtgcaacaagaagttcaagatgaagcaccacctgacagagcacatgaagacccacacaggcctgaagccctatgaatgtggggtgtgtgccaagaagttcatgtggagggacagcttcatgaggcaccggggccactgtgaaagaagacaccggctgggcggcgtgggcgctgtgcccggccctggcacccccaccggccccagcctgcccagcaagcgggagagccctggggtgggcggcggcagcggagatgaggccagcgctgccaccccacccagcagccggcgggtgtggagccccccccgggtgcacaaggtggagatgggctttggaggcggcggcggggccaactag

SEQ ID NO: 43704 - DNA, 1905 bp, Artificial Sequence; identical to SEQ ID NO: 43703
  Description of Artificial Sequence: Synthetic coding sequence

SEQ ID NO: 43705 - DNA, 1905 bp, Artificial Sequence; identical to SEQ ID NO: 43703
  Description of Artificial Sequence: Synthetic coding sequence

SEQ ID NO: 43706 - DNA, 450 bp, Artificial Sequence
  Description of Artificial Sequence: Synthetic coding sequence
atggagcccagccccctgagccccagcggggccgccctgcccctgcccctgagcctggcccccccacccctgcccctgcctgctgctgctgtggtgcacgtgtccttccctgaggtgaccagcgccctgctggagagcctgaaccagcagaggctgcagggccagctgtgtgatgtgtccatccgggtgcagggccgggagttccgggcccacagagctgtgctggccgccagcagcccctacttccatgaccaggtgctgctgaagggcatgaccagcatcagcctgcccagcgtgatggaccccggggcctttgaaacagtgctggccagcgcctacacaggccgcctgtccatggctgctgctgacatcgtgaacttcctgactgtgggctctgtgctgcagatgtggcacatcgtggacaagtgcacagagctgctgcgggagtag

SEQ ID NO: 43707 - DNA, 450 bp, Artificial Sequence; identical to SEQ ID NO: 43706
  Description of Artificial Sequence: Synthetic coding sequence

SEQ ID NO: 43708 - DNA, 450 bp, Artificial Sequence; identical to SEQ ID NO: 43706
  Description of Artificial Sequence: Synthetic coding sequence

SEQ ID NO: 43709 - DNA, 1905 bp, Artificial Sequence; identical to SEQ ID NO: 43703
  Description of Artificial Sequence: Synthetic coding sequence

SEQ ID NO: 43710 - DNA, 1905 bp, Artificial Sequence; identical to SEQ ID NO: 43703
  Description of Artificial Sequence: Synthetic coding sequence

SEQ ID NO: 43711 - DNA, 1905 bp, Artificial Sequence; identical to SEQ ID NO: 43703
  Description of Artificial Sequence: Synthetic coding sequence

SEQ ID NO: 43712 - DNA, 2019 bp, Artificial Sequence
  Description of Artificial Sequence: Synthetic coding sequence
atggagagcaggaagctgatcagcgccacagacatccagtacagcggcagcctgctgaacagcctgaatgagcagaggggccacggcctcttctgtgatgtgacagtgattgtggaggacaggaagttccgggcccacaagaacatcctgagcgccagcagcacctacttccaccagctgttctctgtggccggccaggtggtggagctgtccttcatccgggcagagatctttgctgagatcctgaactacatctacagcagcaagatcgtgcgggtgcggagtgacctgctggatgagctgatcaagagcggccagctgctgggcgtgaagttcatcgccgagctgggcgtgcccctgagccaggtgaagagcatctctggaacagcccaggacggcaacacagagcccctgcccccagacagcggggacaagaacctggtgatccagaagagcaaggatgaggcccaggacaatggagccaccatcatgcccatcatcacagagagcttcagcctgtctgctgaggactatgagatgaagaagatcatcgtgacagacagtgatgatgatgatgatgatgtgatcttctgcagcgagatcctgcccaccaaggagaccctgcccagcaacaacacagtggcccaggtgcagagcaaccctggccctgtggccatcagtgatgtggcccccagcgccagcaacaacagcccccccctgaccaacatcacccccacccagaagctgcccacccctgtgaaccaggccaccctgagccagacccagggcagcgagaagctgctggtgtcctctgcccccacccacctgacccccaacatcatcctgctgaaccagacccccctgagcaccccaccaaatgtgagcagcagcctgcccaaccacatgcccagcagcatcaacctgctggtgcagaaccagcagacccccaacagcgccatcctgaccggcaacaaggccaatgaggaggaggaggaggagatcattgatgatgatgatgacaccatcagcagcagcccagacagcgctgtgagcaacaccagcctggtgccccaggccgacaccagccagaacaccagctttgatggcagcctcatccagaagatgcagatccccaccctgctgcaggagcccctgagcaacagcctgaagatcagtgacatcatcaccaggaacaccaatgaccccggggtgggcagcaagcacctgatggagggccagaagatcatcaccctggacacagccacagaaattgagggcctgagcacaggctgcaaggtgtatgccaacattggagaggacacctatgacatcgtcatccctgtgaaggatgatcctgatgaaggagaggcccggctggagaatgagatccccaagaccagcggcagcgagatggccaacaagaggatgaaggtgaagcatgatgaccactatgagctgattgtggatggccgggtgtactacatctgcatcgtgtgcaagaggagctatgtgtgcctgaccagcctgcggcggcacttcaacatccacagctgggagaagaagtacccctgccgctactgtgagaaggtgttccccctggccgagtaccgcaccaagcatgagatccaccacactggagagcggcgctaccagtgcctggcctgtgggaagagcttcatcaactaccagttcatgagcagccacatcaagtctgtgcacagccaggaccccagcggggacagcaagctgtaccgcctgcacccctgccgcagcctgcagatccggcagtatgcctacctgagtgacaggagcagcaccatcccagccatgaaggatgatggcatcggctacaaggtggacaccgggaaggagccccctgtgggcaccaccaccagcacccagaacaagcccatgacctgggaggacatcttcatccagcaggagaatgacagcatcttcaagcagaatgtgacagatggcagcacagaatttgagttcatcatccctgagagctactag

SEQ ID NO: 43713 - DNA, 609 bp, Artificial Sequence
  Description of Artificial Sequence: Synthetic coding sequence
atgctgacagccaccctgagcatcaacacagagaacatcattgatgtgctggccgccgccagctacatgcagatgttttctgtggccagcacctgcagcgagttcatgaagagcagcatcctgtggaacacccccaacagccagcctgagaagggcctggatgctggccaggagaacaacagcaactgcaacttcaccagcagagatggcagcatcagccctgtgtcctctgagtgcagcgtggtggagaggaccatccctgtgtgccgggagagcaggaggaagaggaagagctacatcgtgatgagccctgagagccctgtgaagtgtggcacccagaccagcagcccccaggtgctgaacagcagcgccagctacagcgagaacagaaaccagcctgtggacagcagcctggccttcccctggaccttccccttcggcatcgaccggcgcatccagcctgagaaggtgaagcaggccgagaacaccaggaccctggagctgcccggccccagcgagaccggccgcaggatggctgactatgtgacctgtgagagcaccaagaccaccctgcccctgggcacagaagaagatgtgcgcagcaagtag

SEQ ID NO: 43714 - DNA, 1713 bp, Artificial Sequence
  Description of Artificial Sequence: Synthetic coding sequence
atgggcgtgaagaccttcacccacagcagcagcagccacagccaggagatgctgggcaagctgaacatgctgagaaatgatggccacttctgtgacatcaccatccgggtgcaggacaagatcttccgggcccacaaggtggtgctggccgcctgcagcgacttcttccgcaccaagctggtgggccaggctgaagatgagaacaagaatgtgctggacctgcaccacgtgacagtgacaggcttcatccccctgctggagtatgcctacacagccaccctgagcatcaacacagagaacatcattgatgtgctggccgccgccagctacatgcagatgttttctgtggccagcacctgcagcgagttcatgaagagcagcatcctgtggaacacccccaacagccagcctgagaagggcctggatgctggccaggagaacaacagcaactgcaacttcaccagcagagatggcagcatcagccctgtgtcctctgagtgcagcgtggtggagaggaccatccctgtgtgccgggagagcaggaggaagaggaagagctacatcgtgatgagccctgagagccctgtgaagtgtggcacccagaccagcagcccccaggtgctgaacagcagcgccagctacagcgagaacagaaaccagcctgtggacagcagcctggccttcccctggaccttccccttcggcatcgaccggcgcatccagcctgagaaggtgaagcaggccgagaacaccaggaccctggagctgcccggccccagcgagaccggccgcaggatggctgactatgtgacctgtgagagcaccaagaccaccctgcccctgggcacagaagaagatgtgcgggtgaaggtggagcggctgagtgatgaggaggtgcatgaggaggtgtcccagcctgtgtctgccagccagagcagcctgagtgaccagcagacagtgcccggcagcgagcaggtgcaggaggacctgctgatcagcccccagagcagcagcatcggctctgtggatgaaggagtgtctgagggcctgcccaccctgcagagcaccagcagcaccaatgcccccccagatgatgatgaccggctggagaatgtgcagtacccctaccagctgtacatcgcccccagcaccagcagcacagagcggcccagccccaatggaccagaccggcccttccagtgccccacctgtggggtgcgcttcacccgcatccagaacctgaagcagcacatgctgatccacagcggcatcaagcccttccagtgtgacagatgtgggaagaagttcacccgggcctacagcctgaagatgcaccggctgaagcatgagggcaagcgctgcttccgctgccagatctgcagcgccaccttcaccagctttggagagtacaagcaccacatgagggtgagccgccacatcatcaggaagccccgcatctatgagtgcaagacctgtggggccatgttcaccaacagcggcaacctgattgtgcacctgcggagcctgaaccacgaggccagcgagctggccaactacttccagagcagtgacttcctggtgcctgactacctgaaccaggagcaggaggagaccctggtgcagtatgacctgggggagcacggctttgagagcaacagctctgtgcagatgcctgtgatcagccagtaccacagcaagggcaaggagccctag

SEQ ID NO: 43715 - DNA, 1713 bp, Artificial Sequence; identical to SEQ ID NO: 43714
  Description of Artificial Sequence: Synthetic coding sequence

SEQ ID NO: 43716 - DNA, 1404 bp, Artificial Sequence
  Description of Artificial Sequence: Synthetic coding sequence
atgggcgtgaagaccttcacccacagcagcagcagccacagccaggagatgctgggcaagctgaacatgctgagaaatgatggccacttctgtgacatcaccatccgggtgcaggacaagatcttccgggcccacaaggtggtgctggccgcctgcagcgacttcttccgcaccaagctggtgggccaggctgaagatgagaacaagaatgtgctggacctgcaccacgtgacagtgacaggcttcatccccctgctggagtatgcctacacagccaccctgagcatcaacacagagaacatcattgatgtgctggccgccgccagctacatgcagatgttttctgtggccagcacctgcagcgagttcatgaagagcagcatcctgtggaacacccccaacagccagcctgagaagggcctggatgctggccaggagaacaacagcaactgcaacttcaccagcagagatggcagcatcagccctgtgtcctctgagtgcagcgtggtggagaggaccatccctgtgtgccgggagagcaggaggaagaggaagagctacatcgtgatgagccctgagagccctgtgaagtgtggcacccagaccagcagcccccaggtgctgaacagcagcgccagctacagcgagaacagaaaccagcctgtggacagcagcctggccttcccctggaccttccccttcggcatcgaccggcgcatccagcctgagaaggtgaagcaggccgagaacaccaggaccctggagctgcccggccccagcgagaccggccgcaggatggctgactatgtgacctgtgagagcaccaagaccaccctgcccctgggcacagaagaagatgtgcgggtgaaggtggagcggctgagtgatgaggaggtgcatgaggaggtgtcccagcctgtgtctgccagccagagcagcctgagtgaccagcagacagtgcccggcagcgagcaggtgcaggaggacctgctgatcagcccccagagcagcagcatcggctctgtggatgaaggagtgtctgagggcctgcccaccctgcagagcaccagcagcaccaatgcccccccagatgatgatgaccggctggagaatgtgcagtacccctaccagctgtacatcgcccccagcaccagcagcacagagcggcccagccccaatggaccagaccggcccttccagtgccccacctgtggggtgcgcttcacccgcatccagaacctgaagcagcacatgctgatccacagcggcatcaagcccttccagtgtgacagatgtgggaagaagttcacccgggcctacagcctgaagatgcaccggctgaagcatgagggccaccccaggaagagcgccagccgcagcagcagcgccaccaactgctgctag

SEQ ID NO: 43717 - DNA, 1362 bp, Artificial Sequence
  Description of Artificial Sequence: Synthetic coding sequence
atgggcgtgaagaccttcacccacagcagcagcagccacagccaggagatgctgggcaagctgaacatgctgagaaatgatggccacttctgtgacatcaccatccgggtgcaggacaagatcttccgggcccacaaggtggtgctggccgcctgcagcgacttcttccgcaccaagctggtgggccaggctgaagatgagaacaagaatgtgctggacctgcaccacgtgacagtgacaggcttcatccccctgctggagtatgcctacacagccaccctgagcatcaacacagagaacatcattgatgtgctggccgccgccagctacatgcagatgttttctgtggccagcacctgcagcgagttcatgaagagcagcatcctgtggaacacccccaacagccagcctgagaagggcctggatgctggccaggagaacaacagcaactgcaacttcaccagcagagatggcagcatcagccctgtgtcctctgagtgcagcgtggtggagaggaccatccctgtgtgccgggagagcaggaggaagaggaagagctacatcgtgatgagccctgagagccctgtgaagtgtggcacccagaccagcagcccccaggtgctgaacagcagcgccagctacagcgagaacagaaaccagcctgtggacagcagcctggccttcccctggaccttccccttcggcatcgaccggcgcatccagcctgagaaggtgaagcaggccgagaacaccaggaccctggagctgcccggccccagcgagaccggccgcaggatggctgactatgtgacctgtgagagcaccaagaccaccctgcccctgggcacagaagaagatgtgcgggtgaaggtggagcggctgagtgatgaggaggtgcatgaggaggtgtcccagcctgtgtctgccagccagagcagcctgagtgaccagcagacagtgcccggcagcgagcaggtgcaggaggacctgctgatcagcccccagagcagcagcatcggctctgtggatgaaggagtgtctgagggcctgcccaccctgcagagcaccagcagcaccaatgcccccccagatgatgatgaccggctggagaatgtgcagtacccctaccagctgtacatcgcccccagcaccagcagcacagagcggcccagccccaatggaccagaccggcccttccagtgccccacctgtggggtgcgcttcacccgcatccagaacctgaagcagcacatgctgatccacagcggcatcaagcccttccagtgtgacagatgtgggaagaagttcacccgggcctacagcctgaagatgcaccggctgaagcatgaagtcatctcctag

SEQ ID NO: 43718 - DNA, 1425 bp, Artificial Sequence
  Description of Artificial Sequence: Synthetic coding sequence
atgggcgtgaagaccttcacccacagcagcagcagccacagccaggagatgctgggcaagctgaacatgctgagaaatgatggccacttctgtgacatcaccatccgggtgcaggacaagatcttccgggcccacaaggtggtgctggccgcctgcagcgacttcttccgcaccaagctggtgggccaggctgaagatgagaacaagaatgtgctggacctgcaccacgtgacagtgacaggcttcatccccctgctggagtatgcctacacagccaccctgagcatcaacacagagaacatcattgatgtgctggccgccgccagctacatgcagatgttttctgtggccagcacctgcagcgagttcatgaagagcagcatcctgtggaacacccccaacagccagcctgagaagggcctggatgctggccaggagaacaacagcaactgcaacttcaccagcagagatggcagcatcagccctgtgtcctctgagtgcagcgtggtggagaggaccatccctgtgtgccgggagagcaggaggaagaggaagagctacatcgtgatgagccctgagagccctgtgaagtgtggcacccagaccagcagcccccaggtgctgaacagcagcgccagctacagcgagaacagaaaccagcctgtggacagcagcctggccttcccctggaccttccccttcggcatcgaccggcgcatccagcctgagaaggtgaagcaggccgagaacaccaggaccctggagctgcccggccccagcgagaccggccgcaggatggctgactatgtgacctgtgagagcaccaagaccaccctgcccctgggcacagaagaagatgtgcgggtgaaggtggagcggctgagtgatgaggaggtgcatgaggaggtgtcccagcctgtgtctgccagccagagcagcctgagtgaccagcagacagtgcccggcagcgagcaggtgcaggaggacctgctgatcagcccccagagcagcagcatcggctctgtggatgaaggagtgtctgagggcctgcccaccctgcagagcaccagcagcaccaatgcccccccagatgatgatgaccggctggagaatgtgcagtacccctaccagctgtacatcgcccccagcaccagcagcacagagcggcccagccccaatggaccagaccggcccttccagtgccccacctgtggggtgcgcttcacccgcatccagaacctgaagcagcacatgctgatccacagcggcatcaagcccttccagtgtgacagatgtgggaagaagttcacccgggcctacagcctgaagatgcaccggctgaagcatgaggtgcccctgcagaggcagggcaccatgattgacaacagccaggccgtggatgagatgaccagaaatggagagtag

SEQ ID NO: 43719 - DNA, 231 bp, Artificial Sequence
  Description of Artificial Sequence: Synthetic coding sequence
atgaagggcggcagccgggtgagcaacccagctgtgatggcccaggaggaggaggatgtgcgggactacaacctgacagaggagcagaaggccatcaaggccaagtacccacctgtgaacagaaaatatgagtaccaccagacccacctgctgcagagcccccaccgcatctacagccacctgcacagcagcgccatctggaacccctacctgcacctgatgggcacctag

SEQ ID NO: 43720 - DNA, 411 bp, Artificial Sequence
  Description of Artificial Sequence: Synthetic coding sequence
atggcccaggaggaggaggatgtgcgggactacaacctgacagaggagcagaaggccatcaaggccaagtacccacctgtgaacagaaaatatgagtacctggaccacacagcagatgtgcagctgcacgcctggggagacaccctggaggaggcctttgagcagtgtgccatggccatgtttggctacatgacagacacaggaacagtggagcccctgcagacagtggaggtggagacccagggagatgacctgcagagcctgctcttccacttcctggatgagtggctgtacaagttcagcgcagatgagttcttcatcccccgggtgggccgccgcatcttcatcgtgcaggcccccagcggcaacagaagccagagcaacaacatcttcagcaatgccggcctgtag

SEQ ID NO: 43721 - DNA, 444 bp, Artificial Sequence
  Description of Artificial Sequence: Synthetic coding sequence
tgaggaggcagccgggtgagcaacccagctgtgatggcccaggaggaggaggatgtgcgggactacaacctgacagaggagcagaaggccatcaaggccaagtacccacctgtgaacagaaaatatgagtacctggaccacacagcagatgtgcagctgcacgcctggggagacaccctggaggaggcctttgagcagtgtgccatggccatgtttggctacatgacagacaccggcaccgtggagcccctgcagacagtggaggtggagacccagggagatgacctgcagagcctgctcttccacttcctggatgagtggctgtacaagttcagcgcagatgagttcttcatcccccgggtgggccgccgcatcttcatcgtgcaggcccccagcggcaacagaagccagagcaacaacatcttcagcaatgccggcctgtag

SEQ ID NO: 43722 - DNA, 540 bp, Artificial Sequence
  Description of Artificial Sequence: Synthetic coding sequence
atgaagggcggcagccgggtgagcaacccagctgtgatggcccaggaggaggaggatgtgcgggactacaacctgacagaggagcagaaggccatcaaggccaagtacccacctgtgaacagaaaatatgagtacctggaccacacagcagatgtgcagctgcacgcctggggagacaccctggaggaggcctttgagcagtgtgccatggccatgtttggctacatgacagacacaggaacagtggagcccctgcagacagtggaggtggagacccagggagatgacctgcagagcctgctcttccacttcctggatgagtggctgtacaagttcagcgcagatgagttcttcatcccccgggaggtgaaggtgctgagcattgaccagaggaacttcaagctgcggagcatcggctggggcgaggagttcagcctgagcaagcacccccagggcacagaggtgaaggccatcacctacagcgccatgcaggtgtacaatgaagaaaatcctgaggtgtttgtgatcatcgacatctag

SEQ ID NO: 43723 - DNA, 1488 bp, Artificial Sequence
  Description of Artificial Sequence: Synthetic coding sequence
atggccgccaactggaccctgtcctggggccagggcggcccctgcaacagccctggcagtgacacccccaggtctgtggccagccctgagacccagctgggcaaccacgacaggaaccctgagacctggcacatgaacttcaggatgttcagctgcccagaggagagtgaccccatccaggccctgaggaagctgacagagctgtgccacctgtggctgcggccagacctgcacaccaaggagcagatcctggacatgctggtgatggagcagttcatgatctccatgccccaggagctgcaggtgctggtgaaggtgaatggagtgcagagctgcaaggacctggaggacctgctgaggaacaacagaagacccaagaagtggagcatcgtgaacctgctgggcaaggagtacctgatgctgaacagtgatgtggagatggccgaggccccagcctctgtgagagatgaccccagagatgtgagcagccagtgggccagctctgtgaaccagatgcaccctggcaccggccaggcccggcgggagcagcagatcctgccccgggtggccgccctgagccggcggcagggcgaggacttcctgctgcacaagagcattgatgtgactggagaccccaacagcccccggcccaagcagaccctggagaaggacctgaaggaaaatcgggaggagaaccctggcctgagcagccctgagccccagctgcccaagagccccaacctggtgcgggccaaggagggcaaggagccccagaagagggcctctgtggagaatgtggatgctgacacccccagcgcctgtgtggtggagcgggaggccctgacccacagcggcaacagaggagatgccctgaacctgagcagccccaagaggagcaagccagatgccagcagcatcagccaggaggagccccagggcgaggccacccctgtgggcaaccgggagagccctggccaggccgagatcaaccctgtgcacagccctggccctgctggccctgtgagccacccagatggccaggaggccaaggccctgcccccatttgcctgtgatgtgtgcaacaagagcttcaagtacttcagccagctgagcatccaccggcgcagccacactggagaccggcccttccagtgtgacctgtgcaggaagcgcttcctgcagcccagcgacctgcgggtgcaccagagggtgcacactggagagcggccctacatgtgtgatgtgtgccagaagagatttgcccacgagagcaccctgcagggccacaagaggatccacactggagagcggcccttcaagtgcaagtactgcagcaaggtgttcagccacaagggcaacctgaatgtgcaccagaggacccacagcggggagaagccctacaagtgccccacctgccagaaggccttccggcagctgggcaccttcaagaggcacctgaagacccaccgggagaccaccagccagtag

SEQ ID NO: 43724 - DNA, 1491 bp, Artificial Sequence
  Description of Artificial Sequence: Synthetic coding sequence
atggccgccaactgcaccagctcctggagcctgggggagagctgcaacagccctggcagcgagcccccccagagcatgcccagccctgccacccagctgggcaaccacgacagcgaccctgagacctgccacgtgaacttcaggatgttcagctgccccaaggagagtgaccccatccaggccctgaggaagctgacagagctgtgccacctgtggctgcggccagacctgcacaccaaggagcagatcctggacatgctggtgatggagcagttcatgatctccatgccccaggagctgcaggtgctggtgatgatgaatggagtgcagagctgcaaggacctggaggacctgctgaggaacaacagaagacccaagaagtggagcgtggtgtccttcctgggcaaggagtacctgatgcaggagagtgatgtggagatggccgaggccccagcctctgtgagagatgaccccaggcatgtgagcagccagaggaccagctctgtgaaccagatgtgcccagaggagggccaggccagccaggagctgcagaccctgccccgggtgcctgccctcttccggcggcaggaggaggacttcctgctgcctgagaccaccgtgatgaagggggaccccaaggccctgcggcccaagcccaccctggagaaggacctggaggaggaccgggaggagaaccctggcctgaccagccctgagccccagctgcccaacagccccactggagtggtgggcgccaaggagggcaaggagccccagaagagggcctctgtggagaatgtggatgctgacaccccatctgcctgtgtggtggagcgggaggccagcacccacagcggcagcagaggagatgccctgaacctgcggggcctgaagaggagcaagccagatgccaccagcatcagccaggaggagccccagggcgaggccacccctgtgggcaaccgggagagccctggccaggccgagatcaaccctgtgcacagccctggccctgctggccctgtgagccaccccagcggccaggaggtgaaggagctgctgccctttgcctgtgaggtgtgtgggaagcgcttcaagtaccggggcaagctggccgtgcacaccaggagccacactggagagcggctcttccagtgcaacctgtgtgggaagcgcttcatgcagagaattggcctgcagttccaccagaggacccacactggagagcggccctacacctgtgacatctgccagaagcagttcacccagaagagctacctgaagtgccacaagaggagccacactggagagaagccctttgagtgcaaggactgcaagaaggtgttcacctacaaggccaacctgaaggagcaccagaggatccacagcggggagaagccccacaagtgcagcaagtgcccccgggccttcggccggcctgccaccctgcggcggcaccagaagacccaccgggaggccaccagccagtag

SEQ ID NO: 43725 - DNA, 1491 bp, Artificial Sequence; identical to SEQ ID NO: 43724
  Description of Artificial Sequence: Synthetic coding sequence

SEQ ID NO: 43726 - DNA, 2316 bp, Artificial Sequence
  Description of Artificial Sequence: Synthetic coding sequence
atggagaaggtgcagctggagtttgagaaccaggagatggagaagaagctgcaggagttccgcagcaccaggaacaaggagaaggaggaccgggagagcagcgagtactactggaagagcggcaaggtgggcaagctggtgaaccagagctacatgatgagccagaacaagggaaatgtggtgaagttctctgctgggaaggtgaagctgaagctgctgaaggagcagatccaggagcctgtgaagcccaccgtgaactacaagatggccaacagcagtgaatgtgagaagcccaagatcaatggcaaggtgtgtggccagtgtgagaacaaggccgccctgctggtgtgcctggagtgtggggaggactactgcagcggctgctttgccaaggtgcaccagaagggggccctgaagctgcacaggaccaccctgctgcaggccaagagccagatcctcttcaacgtgctggatgtggcccaccagttcatcaaggatgtgaacccagatgagcccaaggaggagaacaacagcaccaaggagaccagcaagatccagcacaagcccaagtctgtgctgctgcagaggagcagcagcgaggtggagatcaccaccatgaagagggcccagaggaccaagcccaggaagagcctgctgtgtgagggcagctttgatgaggaggccagcgcccagagcttccaggaggtgctgagccagtggaggacaggcaaccatgatgacaacaagaagcagaacctgcatgctgctgtgaaggacagcctggaggagtgtgaggtgcagaccaacctgaagatctggagggagcccctgaacatcgagctgaaggaggacatcctgagctacatggagaagctgtggctgaagaagcacaggaggaccccccaggagcagctgttcaagatgctgcctgacaccttcccccacccccatgagaccactggagatgcccagtgcagccagaatgaaaatgatgaggacagtgatggagaggagaccaaggtgcagcacacagccctgctgctgcctgtggagaccctgaacatcgagaggcctgagcccagcctgaagatcgtggagctggatgacacctatgaggaggagtttgaggaggctgaaaatattgtgccctacaaggtgaagctggctgatgctgacagccagaggagctgtgccttccatgactgccagaagaacagcttcccctatgaaaatggcatccaccagcaccacgtgtttgataaaggcaagagggacttcctgaacctgtgcctgaggaacagcagcacctactacaaggacaacagcaaggccgagaccagcaacacagactttgacaacatcgtggaccctgatgtgtacagcagtgacatcgagaagattgaggagagcaccagctttgaaagaaacctgaaggagaagaacatcggcctggagagcaaccagaagagtgatgacagctgtgtgtccctggagagcaaggacaccctgctgggccgggacctggagaaggcccccatcgaggagaagctgagccaggacatcaaggagagcctggagctgagcaacctgtacaagaggcccagctttgaggagagcaagaccaccaagagcagcctgctgctgcaggagatcgcctgccgcagcaagcccatcaccaagcagtaccagggcctggagcgcttcttcatctttgacaccaatgaaaggctgaacctgctgcccagccaccggctggagtgcaacaacagcagcacccgcatcaccctggccggccagaagagccagaggcccagcacagccaacttccccctgagcaacagcgtgaaggagagcagcagctgcctgagcagcagccaccccaggagccgctctgctgctgcccagagcagcagccgggccgccagcgagatcagcgagattgagtacatcgacatcacagaccagaatgagctgagcctggatgacaccacagaccagcacaccctggacaacctggagaaggagctgcaggtgctgcggagcctggccgacaccagcgagaagctgtacagcctgaccagcgaggagttcccagacttcagcagccagagcctgaacatcagccagatcagcacagacttcctgaagaccagccacgtgcggggcccctgtggggtggaggagctgagctgcagcggccgggacaccaagatccagagcctgctgagcctgtctgagagcagcacagatgaggaggaggaggacttcctgaacaagcagcacgtgatcaccctgccctggagcaagagcacctag

SEQ ID NO: 43727 - DNA, 2082 bp, Artificial Sequence
  Description of Artificial Sequence: Synthetic coding sequence
atgattgcccccctgctgtgcatcctgagctacaacttcaacacctttgccatcctgaatgtgtacagcaagctgaccatgttctgcaccaccaacagcctgcccatggacctgctgctgaagcagggcagcctgaagcaggaggtggagagcttctgctaccagatcgtgtctgagagcaatgaccagaaggtgggcatcctgcagagcgaggacaagcagctgcagcccagcgtgtccaagaagtctgagggggagctgagccgggtgaagttcatcagcaacagcaacaagatcaccttcagcaagaagcccaagaggaggaaatatgatgagagctacctgagctttggcttcacctacttcggcaacagagatgcccctcatgcccagtgtgtgctgtgcaagaagatcctgagcaacagcagcctggcccccagcaagctgcggcggcacctggagaccaagcacgccgcctacaaggacaaggacatctccttcttcaagcagcacctggacagccctgagaacaacaagccacccacccccaagatcgtgaacacagacaatgaaagtgccacagaggccagctacaacgtgtcctaccacatcgccctgtctggagaggcccacaccatcggggagctgctgatcaagccctgtgccaaggatgtggtgatgaggatgtttgatgagcagtacagcaagaagattgatgctgtgcagctgagcaacagcacagtggcccggcgcatcaaggacctggccgctgacatcgaggaggagctggtgtgccgcctgaagatctgtgatggcttcagcctgcagctggatgagagcgcagatgtgtctggcctggccgtgctgctggtgtttgtgcgctaccgcttcaacaagagcattgaggaggacctgctgctgtgtgagagcctgcagagcaatgccaccggggaggagatcttcaactgcatcaacagcttcatgcagaagcatgaaattgagtgggagaagtgtgtggatgtgtgcagtgatgccagcagagctgtggatggcaagattgctgaggccgtgaccctcatcaagtatgtggcccctgagagcaccagcagccactgcctgctgtacagacatgccctggccgtgaagatcatgcccaccagcctgaagaatgtgctggaccaggccgtgcagatcatcaactacatcaaggcccggccccaccagagccggctgctgaagatcctgtgtgaggagatgggcgcccagcacacagccctgctgctgaacacagaggtgcgctggctgagccggggcaaggtgctggtgcggctgtttgagctgcggcgggagctgctggtgttcatggattctgccttccggctgagtgactgcctgaccaacagctcctggctgctgcggctggcctacctggccgacatcttcaccaagctgaatgaggtgaacctgtccatgcagggcaagaatgtgacagtgttcaccgtgtttgacaagatgagcagcctgctgaggaagctggagttctgggccagctctgtggaggaggagaactttgactgcttccccaccctgagtgacttcctgacagagatcaacagcacagtggacaaggacatctgcagcgccatcgtgcagcacctgcggggcctgcgggccaccctgctgaagtacttccctgtgaccaatgacaacaatgcctgggtgaggaaccccttcaccgtgacagtgaagccagccagcctggtggcccgggactatgagagcctgattgacctgaccagtgacagccaggtgaagcagaacttcagcgagctgagcctgaatgacttctggagcagcctcatccaggagtaccccagcatcgccaggagagctgtgcgggtgctgctgccctttgccaccatgcacctgtgtgagaccggcttctcctactatgctgccaccaagaccaagtacaggaagaggctggatgctgccccccacatgaggatccggctgagcaacatcacccccaacatcaagaggatctgtgacaagaagacccagaagcactgcagccactag

SEQ ID NO: 43728 - DNA, 2082 bp, Artificial Sequence; identical to SEQ ID NO: 43727
  Description of Artificial Sequence: Synthetic coding sequence

SEQ ID NO: 43729 - DNA, 1305 bp, Artificial Sequence
  Description of Artificial Sequence: Synthetic coding sequence
atgccagaccgggacagctatgccaatggaacaggcagcagcggcggcggccctgggggcggcggcagcgaggaggccagcggggccggcgtgggcagcggcggggccagcagtgatgccatctgccgggacttcctgagaaatgtgtgcaagaggggcaagcgctgccgctaccgccacccagacatgtctgaggtgagcaacctgggcgtgtccaagaatgagttcatcttctgccacgacttccagaacaaggagtgcagccggcccaactgccgcttcatccacggcagcaaggaggatgaagatggctacaagaagacaggagagctgcccccccggctgcggcagaaggtggccgccggcctgggcctgagccctgctgacctgcccaacgggaaggaggaggtgcccatctgccgggacttcctgaagggggactgccagagaggagccaagtgcaagttccgccacctgcagagggactttgaatttgatgcccggggcggcggcggcactggaggcggcagcacaggctctgtgctgcctggaagaagacatgacctgtatgacatctatgacctgcctgaccggggctttgaagatcatgagcccggccccaagagaagaagaggaggctgctgccccccagatggcccccactttgagagctatgagtacagcctggccccaccccggggcgtggagtgccgcctgctggaggaggagaatgccatgctgaggaagagggtggaggagctgaagaagcaggtgagcaacctgctggccaccaatgaggtgctgctggagcagaatgcccagttcaggaaccaggccaaggtgatcaccctgagcagcacagccccagccacagagcagaccctggcccccaccgtgggcaccgtggccaccttcaaccacggcatcgcccagacccacaccaccctgagcagccaggccctgcagcccaggcctgtgtcccagcaggagctggtggccccagctggggccccagctgccccacccaccaatgctgcccctcctgctgcccctcctcctcctccaccccacctgaccccagagatcacccccctgtctgctgccctggcccagaccatcgcccagggcatggcccctcctcctgtgtccatggcccctgtggccgtgtctgtggcccctgtggcccctgtggccgtgtccatggcccagcccctggccggcatcaccatgagccacaccaccacccccatggtgacctaccccatcgccagccagagcatgaggatcacagccatgccccactag

SEQ ID NO: 43730 - DNA, 270 bp, Artificial Sequence
  Description of Artificial Sequence: Synthetic coding sequence
atgccagaccgggacagctatgccaatggaacaggcagcagcggcggcggccctgggggcggcggcagcgaggaggccagcggggccggcgtgggcagcggcggggccagcagtgatgccatctgccgggacttcctgagaaatgtgtgcaagaggggcaagcgctgccgctaccgccacccagacatgtctgaggtgagcaacctgggcgtgtccaagaatgagttcatcttctgccacgacttccagaacaaggagtgcagcaggtag

SEQ ID NO: 43731 - DNA, 138 bp, Artificial Sequence
  Description of Artificial Sequence: Synthetic coding sequence
atgccagaccgggacagctatgccaatggaacaggcagcagcggcggcggccctgggggcggcggcagcgaggaggccagcggggccggcgtgggcagcggcggggccagcagtgatgccatctgccgggacttctag

SEQ ID NO: 43732 - DNA, 240 bp, Artificial Sequence
  Description of Artificial Sequence: Synthetic coding sequence
atgccagaccgggacagctatgccaatggaacaggcagcagcggcggcggccctgggggcggcggcagcgaggaggccagcggggccggcgtgggcagcggcggggccagcagtgatgccatctgccgggacttcctgagaaatgtgtgcaagaggggcaagcgctgccgctaccgccacccagacatgtctgaggtgagcaacctgggcgtgtccaagaatgagttcatcttctgctag

SEQ ID NO: 43733 - DNA, 5136 bp, Artificial Sequence
  Description of Artificial Sequence: Synthetic coding sequence
atgatcagcacagcccccctgtacagcggcgtgcacaactggaccagcagtgaccgcatccgcatgtgtggcatcaatgaggagcggcgggcccccctgagtgatgaggagagcaccaccggggactgccagcacttcggcagccaggagttctgtgtgagcagcagcttcagcaaggtggagctgacagctgtgggcagcggcagcaatgcccggggagctgaccctgatggcagcgccacagagaagctgggccacaagtctgaggacaagccagatgacccccagcccaagatggactatgctggaaatgtggccgaggccgagggcttcctggtgcccctgagcagccctggagatggcctgaagctgcctgccagtgacagcgctgaggccagcaacagcagagctgactgctcctggacccccctgaacacccagatgagcaagcaggtggactgcagccctgctggggtgaaggccctggacagccggcagggcgtgggggagaagaacaccttcatcctggccaccctgggcactggagtgcctgtggagggcaccctgcccctggtgaccaccaacttcagccccctgcctgcccccatctgccccccagcccctggcagcgcctctgtgccccacagcgtgcctgatgccttccaggtgcccctgtctgtgcctgcccctgtgccccacagcggcctggtgcctgtgcaggtggccacctctgtgcctgcccccagcccccccctggcccctgtgcctgccctggccccagccccacccagcgtgcccaccctcatcagtgacagcaaccccctgtctgtgtctgcctctgtgctggtgcctgtgcctgccagcgccccacccagcggccctgtgcccctgagcgccccagccccagcccccctgtctgtgcctgtgtctgccccacccctggccctgatccaggcccctgtgccccccagcgcccccaccctggtgctggcccctgtgcccacccctgtgctggcccccatgcctgccagcaccccacctgctgccccagccccacccagcgtgcccatgcccacccccacccccagcagcggcccccccagcacccccaccctcatcccagcctttgcccccacccctgtgcctgcccccaccccagcccccatcttcaccccagcccccacccccatgcctgctgccaccccagctgccatccccaccagcgcccccatcccagccagcttcagcctgagccgggtgtgcttccctgctgcccaggccccagccatgcagaaggtgcccctgtccttccagcccggcaccgtgctgacccccagccagcccctggtgtacatccccccacccagctgtggccagcccctgtctgtggccaccctgcccaccaccctgggcgtgagcagcaccctgaccctgcctgtgctgcccagctacctgcaggaccgctgcctgcccggggtgctggccagccctgagctgcggagctacccctatgccttctctgtggcccggcccctgaccagtgacagcaagctggtgtccctggaggtgaaccggctgccctgcaccagccccagcggcagcaccaccacccagcctgccccagatggagtgcccggccccctggccgacaccagcctggtgacagccagcgccaaggtgctgcccaccccccagcccctgctgcctgcccccagcggcagcagcgccccaccccacccagccaagatgcccagcggcacagagcagcagacagagggcacctctgtgaccttcagccccctgaagagccccccccagctggagcgggagatggccagccccccagagtgcagcgagatgcccctggacctgagcagcaagagcaaccggcagaagctgcccctgcccaaccagaggaagaccccacccatgcctgtgctgacccctgtgcacaccagcagcaaggccctgctgagcacagtgctgagccgcagccagaggaccacccaggccgccggcggcaatgtgaccagctgcctgggcagcaccagcagcccctttgtgatcttccctgagatcgtgagaaatggagaccccagcacctgggtgaagaacagcacagccctgatcagcaccatccctggcacctacgtgggcgtggccaaccctgtgcctgccagcctgctgctgaacaaggaccccaacctgggcctgaacagagaccccaggcacctgcccaagcaggagcccatcagcatcatcgaccagggcgagcccaagggcaccggggccacctgtgggaagaagggcagccaggccggggctgagggccagcccagcacagtgaagcgctacaccccagcccgcatcgcccctggcctgcccggctgccagaccaaggagctgagcctgtggaagcccaccggccctgccaacatctacccccgctgcagcgtgaatggcaagcccaccagcacccaggtgctgcctgtgggctggagcccctaccaccaggccagcctgctgagcatcggcatcagcagcgctggccagctgacccccagccagggcgcccccatccggcccacctctgtggtgtctgagttcagcggcgtgcccagcctgagcagcagcgaggccgtgcacggcctgcctgagggccagcccaggcctgggggcagctttgtgcctgagcaggaccctgtgaccaagaacaagacctgcagaattgctgccaagccctatgaggagcaggtgaaccctgtgctgctgaccctgagcccccagacaggcaccctggccctgtctgtgcagcccagcggcggggacatccgcatgaaccagggccctgaggagagcgagagccacctgtgcagcgacagcacccccaagatggagggcccccagggcgcctgtggcctgaagctggccggggacaccaagcccaagaaccaggtgctggccacctacatgagccatgagctggtgctggccaccccccagaacctgcccaagatgcctgagctgcccctgctgccccatgacagccaccccaaggagctgatcctggatgtggtgcccagcagccggcggggcagcagcacagagcggccccagctgggcagccaggtggacctgggccgggtgaagatggagaaggtggatggagatgtggtgttcaacctggccacctgcttccgggcagatggcctgcctgtggccccccagaggggccaggccgaggtgcgggccaaggccggccaggcccgggtgaagcaggagagcgtgggcgtgtttgcctgcaagaacaagtggcagccagatgatgtgacagagagcctgccccccaagaagatgaagtgtgggaaggagaaggacagcgaggagcagcagctgcagccccaggccaaggctgtggtgcgcagcagccaccggcccaagtgcaggaagctgcccagcgacccccaggagagcaccaagaagagccccaggggggccagtgacagcggcaaggagcacaacggggtgcggggcaagcacaagcacaggaagcccaccaagccagagagccagagccctgggaagagagctgacagccatgaggagggcagcctggagaagaaggccaagagcagcttccgggacttcatccctgtggtgctgagcaccaggaccaggagccagagcggcagcatctgcagcagctttgctggcatggctgacagcgacatgggcagccaggaggtgttccccacagaggaggaggaggaggtgacccccaccccagccaagaggaggaaggtgaggaagacccagagggacacccagtaccgcagccaccacgcccaggacaagagcctgctgagccagggccgccgccacctgtggagggcccgggagatgccctggaggacagaagctgcccggcagatgtgggacaccaatgaggaggaggaggaggaggaggaggagggcctgctgaagaggaagaagagaagacggcagaagagcaggaagtaccagacaggagagtacctgacagagcaggaggatgagcagaggaggaagggccgggctgacctgaaggccaggaagcagaagaccagcagcagccagagcctggagcaccggctgaggaacagaaacctgctgctgcccaacaaggtgcagggcatcagtgacagccccaacggcttcctgcccaacaacctggaggagcccgcctgcctggagaacagcgagaagcccagcggcaagaggaagtgcaagaccaagcacatggccaccgtgtctgaggaggccaaggatgtggtgctgtactgcctgcagaaggacagtgaagatgtgaaccaccgggacaatgccggctacacagccctgcacgaggcctgcagccggggctggacagacatcctgaacatcctgctggagcacggggccaacgtgaactgcagcgcccaggacggcaccaggcctgtgcatgatgctgtggtgaatgacaacctggagaccatctggctgctgctgtcctatggagctgaccccaccctggccacctacagcggccagacagccatgaagctggccagcagtgacaccatgaagcgcttcctgagtgaccacctgagtgacctgcagggccgggcagagggggaccccggggtgtcctgggacttctacagcagctctgtgctggaggagaaggatggctttgcctgtgacctgctgcacaaccccccaggcagcagtgaccaggagggagatgaccccatggaggaggatgacttcatgtttgagctgagtgacaagcccctgctgccctgctacaacctgcaggtgtctgtgtcccggggcccctgcaactggttcctgttcagtgatgtgctgaagaggctgaagctgagcagccgcatcttccaggcccgcttcccccactttgagatcaccaccatgcccaaggccgagttctaccggcaggtggccagcagccagctgctgaccccagctgagaggcctgggggcctggatgacaggagccccccaggcagcagcgagaccgtggagctggtgcgctatgagccagacctgctgcggctgctgggcagcgaggtggagttccagagctgcaacagctag

SEQ ID NO: 43734 - DNA, 2511 bp, Artificial Sequence
  Description of Artificial Sequence: Synthetic coding sequence
atgacagccacagctgaggtggagacccccaagatggagaagagcgccagcaaggaggagaagcagcagcccaagcaggacagcacagagcagggcaatgctgacagcgaggagtggatgagcagcgagagtgaccctgagcagatcagcctgaagagcagtgacaacagcaagagctgccagcccagagatggccagctgaagaagaaggagatgcacagcaagccccaccggcagctgtgccgcagcccctgcctggaccggcccagcttcagccagagcagcatcctgcaggacggcaagctggacctggagaaggagtaccaggccaagatggagtttgccctgaagctgggctatgcagaggagcagatccagagcgtgctgaacaagctgggccctgagagcctcatcaatgatgtgctggccgagctggtgcggctgggcaacaagggggacagcgagggccagatcaacctgagcctgctggtgccccggggccccagcagccgggagatcgccagccctgagctgagcctggaggatgaaattgacaacagcgacaacctgcggcctgtggtgattgatggcagcaatgtggccatgagccacggcaacaaggaggagttcagctgccggggcatccagctggccgtggactggttcctggacaagggccacaaggacatcaccgtgtttgtgcctgcctggaggaaggagcagagcaggccagatgcccccatcacagaccaggacatcctgaggaagctggagaaggagaagatcctggtgttcacccccagcagaagagtgcagggccggcgggtggtgtgctatgatgaccgcttcatcgtgaagctggcctttgacagtgatggcatcatcgtgtccaatgacaactacagagacctgcaggtggagaagccagagtggaagaagttcatcgaggagcggctgctgatgtacagctttgtgaatgacaagttcatgcccccagatgaccccctgggcagacatggccccagcctggagaacttcctgaggaagaggcccatcgtgcctgagcacaagaagcagccctgcccctacggcaagaagtgcacctacggccacaagtgcaagtactaccaccctgagcgggccaaccagccccagaggtctgtggctgatgagctgcgcatcagcgccaagctgagcacagtgaagaccatgtctgagggcaccctggccaagtgtggcaccggcatgagcagcgccaagggggagatcaccagcgaggtgaagagggtggcccccaagaggcagagcgaccccagcatccgctctgtggccatggagcctgaggagtggctgagcatcgccaggaagccagaggccagctctgtgcccagcctggtgacagccctgtctgtgcccaccatccccccacccaagagccatgctgtgggcgccctgaacaccaggtctgccagcagccctgtgcccggcagcagccacttcccccaccagaaggccagcctggagcacatggcctccatgcagtacccacccatcctggtgaccaacagccacggcacccccatctcctatgcagagcagtaccccaagtttgagagcatgggagaccacggctactacagcatgctgggggacttcagcaagctgaacatcaacagcatgcacaaccgggagtactacatggccgaggtggacagaggagtgtatgccaggaaccccaacctgtgcagcgacagccgggtgagccacaccagaaatgacaactacagcagctacaacaacgtgtacctggccgtggccgacacccaccctgagggcaacctgaagctgcacaggtctgccagccagaaccggctgcagcccttcccccacggctaccacgaggccctgaccagggtgcagagctatggccctgaggacagcaagcagggcccccacaagcagagcgtgccccacctggccctgcacgcccagcaccccagcacaggcaccaggagcagctgcccagctgactaccccatgccacccaacatccaccctggggccaccccccagcccggccgggccctggtgatgaccaggatggacagcatcagtgacagccggctgtatgagagcaaccctgtgcggcagaggcggccccccctgtgccgggagcagcacgcctcctgggaccccctgccctgcaccacagacagctatggctaccacagctaccccctgagcaacagcctgatgcagccctgctatgagcctgtgatggtgcgctctgtgcctgagaagatggagcagctgtggaggaacccctgggtgggcatgtgcaatgacagccgggagcacatgatccctgagcaccagtaccagacctacaagaacctgtgcaacatcttccccagcaacatcgtgctggccgtgatggagaagaacccccacacagcagatgcccagcagctggccgccctgattgtggccaagctgcgggccgccaggtag

SEQ ID NO: 43735 - DNA, 2478 bp, Artificial Sequence
  Description of Artificial Sequence: Synthetic coding sequence
atggagaagagcgccagcaaggaggagaagcagcagcccaagcaggacagcacagagcagggcaatgctgacagcgaggagtggatgagcagcgagagtgaccctgagcagatcagcctgaagagcagtgacaacagcaagagctgccagcccagagatggccagctgaagaagaaggagatgcacagcaagccccaccggcagctgtgccgcagcccctgcctggaccggcccagcttcagccagagcagcatcctgcaggacggcaagctggacctggagaaggagtaccaggccaagatggagtttgccctgaagctgggctacgccgaggagcagatccagagcgtgctgaacaagctgggccctgagagcctcatcaatgatgtgctggccgagctggtgcggctgggcaacaagggggacagcgagggccagatcaacctgagcctgctggtgccccggggccccagcagccgggagatcgccagccctgagctgagcctggaggatgaaattgacaacagcgacaacctgcggcctgtggtgattgatggcagcaatgtggccatgagccacggcaacaaggaggagttcagctgccggggcatccagctggccgtggactggttcctggacaagggccacaaggacatcaccgtgtttgtgcctgcctggaggaaggagcagagcaggccagatgcccccatcacagaccaggacatcctgaggaagctggagaaggagaagatcctggtgttcacccccagccggcgggtgcagggcagaagagtggtgtgctatgatgaccgcttcatcgtgaagctggcctttgacagtgatggcatcatcgtgtccaatgacaactacagagacctgcaggtggagaagccagagtggaagaagttcatcgaggagcggctgctgatgtacagctttgtgaatgacaagttcatgcccccagatgaccccctgggccgccacggccccagcctggagaacttcctgaggaagaggcccatcgtgcctgagcacaagaagcagccctgcccctacggcaagaagtgcacctacggccacaagtgcaagtactaccaccctgagcgggccaaccagccccagaggtctgtggctgatgagctgcgcatcagcgccaagctgagcacagtgaagaccatgtctgagggcaccctggccaagtgtggcaccggcatgagcagcgccaagggggagatcaccagcgaggtgaagagggtggcccccaagaggcagagcgaccccagcatccgctctgtggccatggagcctgaggagtggctgagcatcgccaggaagccagaggccagctctgtgcccagcctggtgacagccctgtctgtgcccaccatccccccacccaagagccatgctgtgggcgccctgaacaccaggtctgccagcagccctgtgcccggcagcagccacttcccccaccagaaggccagcctggagcacatggcctccatgcagtacccacccatcctggtgaccaacagccacggcacccccatctcctatgcagagcagtaccccaagtttgagagcatgggagaccacggctactacagcatgctgggggacttcagcaagctgaacatcaacagcatgcacaaccgggagtactacatggccgaggtggaccggggcgtgtatgccaggaaccccaacctgtgcagcgacagccgggtgagccacaccagaaatgacaactacagcagctacaacaacgtgtacctggccgtggccgacacccaccctgagggcaacctgaagctgcacaggtctgccagccagaaccggctgcagcccttcccccacggctaccacgaggccctgaccagggtgcagagctatggccctgaggacagcaagcagggcccccacaagcagagcgtgccccacctggccctgcacgcccagcaccccagcacaggcaccaggagcagctgcccagctgactaccccatgccacccaacatccaccctggggccaccccccagcccggccgggccctggtgatgaccaggatggacagcatcagtgacagccggctgtatgagagcaaccctgtgcggcagaggaggcctcccctgtgccgggagcagcacgcctcctgggaccccctgccctgcaccacagacagctatggctaccacagctaccccctgagcaacagcctgatgcagccctgctatgagcctgtgatggtgcgctctgtgcctgagaagatggagcagctgtggaggaacccctgggtgggcatgtgcaatgacagccgggagcacatgatccctgagcaccagtaccagacctacaagaacctgtgcaacatcttccccagcaacatcgtgctggccgtgatggagaagaacccccacacagcagatgcccagcagctggccgccctgattgtggccaagctgcgggccgccaggtag

SEQ ID NO: 43736 - DNA, 2652 bp, Artificial Sequence
  Description of Artificial Sequence: Synthetic coding sequence
atgcctgggggcggcagccaggagtatggagtgctgtgcatccaggagtacaggaagaacagcaaggtggagagcagcaccaggaacaacttcatgggcctgaaggaccacctgggccatgacctgggccacctgtatgtggagagcacagacccccagctgagccctgctgtgccctggagcacagtggagaaccccagcatggacacagtgaatgtgggcaaggatgagaaggaggcctctgaagaaaatgccagcagcggggacagcgaggagaacaccaacagcgaccacgagagcgagcagctgggcagcatctctgtggagcccggcctcatcaccaagacccaccggcagctgtgccgcagcccctgcctggagccccacatcctgaagagaaatgagatcctgcaggacttcaagccagaggagagccagaccaccagcaaggaggccaagaagcccccagatgtggtgcgggagtaccagaccaagctggagtttgccctgaagctgggctacagcgaggagcaggtgcagctggtgctgaacaagctgggcacagatgccctgatcaatgacatcctgggggagctggtgaagctgggcaacaagtctgaggccgaccagacagtgtccaccatcaacaccatcacccgggagaccagcagcctggagagccagaggtctgagagccccatgcaggagatcgtgacagatgatggagagaacctgcggcccatcgtgattgatggcagcaatgtggccatgagccacggcaacaaggaggtgttcagctgccggggcatcaagctggccgtggactggttcctggagcggggccacaaggacatcaccgtgtttgtgcctgcctggaggaaggagcagagcaggccagatgccctgatcacagaccaggagatcctgaggaagctggagaaggagaagatcctggtgttcacccccagccggcgggtgcagggcagaagagtggtgtgctatgatgaccgcttcatcgtgaagctggcctttgaaagtgatggcatcatcgtgtccaatgacaactacagagacctggccaatgagaagccagagtggaagaagttcattgatgagcggctgctgatgtacagctttgtgaatgacaagttcatgcccccagatgaccccctgggccgccacggccccagcctggacaacttcctgaggaagaagcccatcgtgcctgagcacaagaagcagccctgcccctacggcaagaagtgcacctacggccacaagtgcaagtactaccaccctgagcggggcagccagccccagaggtctgtggctgatgagctgcgggccatgagcaggaacacagctgccaagacagccaatgaaggaggcctggtgaagagcaacagcgtgccctgcagcaccaaggctgacagcaccagtgatgtgaagagaggagcccccaagaggcagagcgaccccagcatccgcacccaggtgtaccaggacctggaggagaagctgcccaccaagaacaagctggagaccaggtctgtgcccagcctggtgtccatcccagccaccagcacagccaagccccagagcaccaccagcctgagcaatggcctgcccagcggcgtgcacttccccccccaggaccagaggccccagggccagtaccccagcatgatgatggccaccaagaaccacggcacccccatgccctatgagcagtaccccaagtgtgacagccctgtggacatcggctactacagcatgctgaatgcctacagcaacctgagcctgagcggccccaggagccctgagcggcgcttcagcctggacacagactaccgcatcagctctgtggccagtgactgcagcagcgagggctccatgagctgtggcagcagtgacagctatgtgggctacaatgacaggagctatgtgagcagcccagacccccagctggaggagaacctgaagtgccagcacatgcacccccacagccggctgaacccccagcccttcctgcagaacttccatgaccccctgacccggggccagagctacagccatgaggagcccaagttccaccacaagccacccctgccccacctggccctgcacctgccccacagcgctgtgggcgcccggagcagctgccctggggactaccccagcccccccagcagcgcccacagcaaggccccccacctgggccgcagcctggtggccaccagaattgacagcatcagtgacagccggctgtatgacagcagccccagccggcagaggaagccctacagccggcaggagggcctgggctcctgggagcggcccggctacggcattgatgcctacggctaccggcagacctacagcctgcctgacaacagcacccagccctgctatgagcagttcaccttccagagcctgcctgagcagcaggagcccgcctggaggatcccctactgcggcatgccccaggaccccccacgctaccaggacaaccgggagaagatctacatcaacctgtgcaacatcttccccccagacctggtgcgcatcgtgatgaagaggaacccccacatgacagatgcccagcagctggccgccgccatcctggtggagaagagccagctgggctactag

SEQ ID NO: 43737 - DNA, 5007 bp, Artificial Sequence
  Description of Artificial Sequence: Synthetic coding sequence
atgagcaagatccggaggaaggtgacagtggagaacaccaagaccatcagtgacagcaccagccggcggcccagcgtgtttgagcggctgggccccagcacaggcagcacagctgagacccagtgcaggaactggctgaagacaggcaactgcctgtatggcaacacctgccgctttgtgcacggccccagcccccggggcaagggctacagcagcaactacagaagaagccctgagcggcccaccggggacctgcgggagaggatgaagaacaagaggcaggatgtggacacagagccccagaagaggaacacagaggagagcagcagccctgtgaggaaggagagcagccggggccgccaccgggagaaggaggacatcaagatcaccaaggagaggaccccagagagcgaggaggagaatgtggagtgggagaccaacagagatgacagcgacaatggagacatcaactatgactatgtgcatgagctgagcctggagatgaagaggcagaagatccagcgggagctgatgaagctggagcaggagaacatggagaagcgggaggagatcatcatcaagaaggaggtgtccccagaggtggtgcgcagcaagctgagccccagccccagcctgaggaagagcagcaagagccccaagaggaagagcagccccaagagcagcagcgccagcaagaaggacaggaagaccagcgctgtgagcagccccctgctggaccagcagaggaacagcaagaccaaccagagcaagaagaagggccccaggacccccagccccccaccacccatccctgaggacatcgccctgggcaagaagtacaaggagaagtacaaggtgaaggaccgcatcgaggagaagaccagagatggcaaggaccggggccgggactttgagcggcagcgggagaagagggacaagcccaggagcaccagccctgctggccagcaccacagccccatcagcagccgccaccacagcagcagcagccagagcggcagcagcatccagaggcacagccccagccccaggaggaagaggacccccagccccagctaccagaggaccctgaccccacccctgcggcgcagcgccagcccctaccccagccacagcctgagcagcccccagaggaagcagagcccccccaggcacaggagccccatgagggagaagggcagacatgaccacgagaggaccagccagagccatgacagaagacatgagcggcgggaggacacccggggcaagagggaccgggagaaggacagccgggaggagcgggagtatgagcaggaccagagcagcagccgggaccacagagatgaccgggagcccagagatggccgggacagaagagatgcccgggacacccgggacagaagagagctgcgggacagccgggacatgagggacagccgggagatgagggactacagccgggacaccaaggagagccgggacccccgggacagccgcagcaccagagatgcccatgactacagagaccgggagggccgggacacccacaggaaagaagacacctacccagaggagagccgctcctatggaagaaaccacctgcgggaggagagcagcaggacagagatcagaaatgaaagcagaaatgaaagccgctctgagatcagaaatgacaggatgggccgcagccggggccgggtgcctgagctgcctgagaagggcagccggggcagccggggcagccagattgacagccacagcagcaacagcaactaccatgacagctgggagaccaggagcagctacccagagcgggaccgctacccagagcgggacaacagagaccaggcccgggacagcagctttgagcggcggcacggggagcgggacagaagagacaaccgggagcgggaccagaggcccagcagccccatccgccaccagggcagaaatgatgagctggagagagatgaaagaagagaggagaggagagtggacagagtggatgacagaagagatgagcgggcccgggagcgggaccgggagcgggagcgggaccgggagcgggagcgggagcgggagcgggagcgggaccgggagcgggagaaggagcgggagctggagcgggagcgggcccgggagcgggagcgggagcgggagaaggagcgggaccgggagcgggaccgggaccgggaccatgaccgggagcgggagcgggagcgggagcgggaccgggagaaggagcgggagcgggagcgggaggagcgggagcgggagcgggagcgggagcgggagcgggagcgggagcgggagcgggagcgggagcgggcccgggagcgggacaaggagcgggagcggcagagggactgggaggacaaggacaagggcagagatgaccggcgggagaagcgggaggagatcagagaagatagaaaccccagagatggccatgatgagaggaagagcaagaagcgctacagaaatgaaggcagccccagcccccggcagagccccaagagaagaagagagcacagcccagacagtgatgcctacaacagcggagatgacaagaatgagaagcaccggctgctgagccaggtggtgcggccccaggagagccgcagcctgagccccagccacctgacagaagatcggcagggccgctggaaggaggaggacaggaagccagagaggaaggagagcagcagaagatatgaggagcaggagctgaaggagaaggtgtcctctgtggacaagcagcgggagcagacagagatcctggagagcagcaggatgagggcccaggacatcatcggccaccaccagagcgaggaccgggagaccagtgaccgggcccatgatgagaacaagaagaaggccaagatccagaagaagcccatcaagaagaagaaggaggatgatgtgggcatcgagcggggcaacatcgagaccaccagtgaagatggccaggtgttcagccccaagaagggccagaagaagaagagcattgagaagaagaggaagaagagcaaaggagacagcgacatcagtgatgaggaggccgcccagcagagcaagaagaagaggggccccaggaccccacccatcaccaccaaggaggagctggtggagatgtgcaatggcaagaatggcatcctggaggacagccagaagaaggaggacacagccttcagtgactggagcgatgaagatgtgcctgacagaacagaggtgacagaagctgagcacacagccacagccaccaccccaggcagcacccccagccccctgagcagcctgctgcccccacctcctcctgtggccacagccacagccaccaccgtgcctgccaccctggccgccaccacagctgctgctgccaccagcttcagcaccagcgccatcaccatcagcaccagcgccacccccaccaacaccaccaacaacacctttgccaatgaagacagccacaggaagtgccacaggaccagggtggagaaggtggagaccccccacgtgaccattgaagatgcccagcacaggaagcccatggaccagaagaggagcagcagcctgggcagcaacagaagcaacagaagccacaccagcggccgcctgcggagccccagcaatgattctgcccacaggtctggagatgaccagagcggcaggaagagggtgctgcacagcggcagccgggaccgggagaagaccaagagcctggagatcaccggggagaggaagagcagaattgaccagctgaagagaggagagcccagccgcagcaccagcagtgaccggcaggacagccgcagccacagcagccgccgcagcagccctgagagtgaccggcaggtgcacagccgcagcggcagctttgacagccgggaccggctgcaggagcgggacagatatgaacatgaccgggagcgggagcgggagcggcgggacacccggcagcgggagtgggacagagatgctgacaaggactggcccaggaacagagaccgggaccggctgcgggagcgggagcgggagcgggagcgggacaagaggcgggacctggaccgggagcgggagcggctcatcagtgacagcgtggagcgggaccgggaccgggaccgggacaggacctttgagagcagccagatcgagagcgtgaagagatgtgaggccaagctggagggggagcacgagcgggacctggagagcaccagccgggacagcctggccctggacaaggagaggatggacaaggacctgggctctgtgcagggctttgaggagaccaacaagtctgagaggacagagagcctggagggagatgatgagagcaagctggatgatgcccacagcctgggcagcggggccggggagggctatgagcccatcagtgatgatgagctggatgagatcctggccggagatgctgagaagcgggaggaccagcaggatgaggagaagatgccagaccccctggatgtgattgatgtggactggagcggcctgatgcccaagcaccccaaggagccccgggagcccggggccgccctgctgaagttcaccccaggagctgtgatgctgcgggtgggcatcagcaagaagctggccggcagcgagctgtttgccaaggtgaaggagacctgccagaggctgctggagaagcccaaggatgctgacaacctgtttgaacatgagctgggcgccctgaacatggccgccctgctgaggaaggaggagcgggccagcctgctgagcaacctgggcccctgctgcaaggccctgtgcttccggcgggacagcgccatcaggaagcagctggtgaagaatgagaagggcaccatcaagcaggcctacaccagcgcccccatggtggacaatgagctgctgcggctgagcctgcggctcttcaagaggaagaccacctgccacgcccctggccacgagaagacagaggacaacaagctgagccagagcagcatccagcaggagctgtgtgtgtcctag

SEQ ID NO: 43738 - DNA, 4695 bp, Artificial Sequence
  Description of Artificial Sequence: Synthetic coding sequence
atgagcaagatccggaggaaggtgacagtggagaacaccaagaccatcagtgacagcaccagccggcggcccagcgtgtttgagcggctgggccccagcacaggcagcacagctgagacccagtgcaggaactggctgaagacaggcaactgcctgtatggcaacacctgccgctttgtgcacggccccagcccccggggcaagggctacagcagcaactacagaagaagccctgagcggcccaccggggacctgcgggagaggatgaagaacaagaggcaggatgtggacacagagccccagaagaggaacacagaggagagcagcagccctgtgaggaaggagagcagccggggccgccaccgggagaaggaggacatcaagatcaccaaggagaggaccccagagagcgaggaggagaatgtggagtgggagaccaacagagatgacagcgacaatggagacatcaactatgactatgtgcatgagctgagcctggagatgaagaggcagaagatccagcgggagctgatgaagctggagcaggagaacatggagaagcgggaggagatcatcatcaagaaggaggtgtccccagaggtggtgcgcagcaagctgagccccagccccagcctgaggaagagcagcaagagccccaagaggaagagcagccccaagagcagcagcgccagcaagaaggacaggaagaccagcgctgtgagcagccccctgctggaccagcagaggaacagcaagaccaaccagagcaagaagaagggccccaggacccccagccccccaccacccatccctgaggacatcgccctgggcaagaagtacaaggagaagtacaaggtgaaggaccgcatcgaggagaagaccagagatggcaaggaccggggccgggactttgagcggcagcgggagaagagggacaagcccaggagcaccagccctgctggccagcaccacagccccatcagcagccgccaccacagcagcagcagccagagcggcagcagcatccagaggcacagccccagccccaggaggaagaggacccccagccccagctaccagaggaccctgaccccacccctgcggcgcagcgccagcccctaccccagccacagcctgagcagcccccagaggaagcagagcccccccaggcacaggagccccatgagggagaagggcagacatgaccacgagaggaccagccagagccatgacagaagacatgagcggcgggaggacacccggggcaagagggaccgggagaaggacagccgggaggagcgggagtatgagcaggaccagagcagcagccgggaccacagagatgaccgggagcccagagatggccgggacagaagagatgcccgggacacccgggacagaagagagctgcgggacagccgggacatgagggacagccgggagatgagggactacagccgggacaccaaggagagccgggacccccgggacagccgcagcaccagagatgcccatgactacagagaccgggagggccgggacacccacaggaaagaagacacctacccagaggagagccgctcctatggaagaaaccacctgcgggaggagagcagcaggacagagatcagaaatgaaagcagaaatgaaagccgctctgagatcagaaatgacaggatgggccgcagccggggccgggtgcctgagctgcctgagaagggcagccggggcagccggggcagccagattgacagccacagcagcaacagcaactaccatgacagctgggagaccaggagcagctacccagagcgggaccgctacccagagcgggacaacagagaccaggcccgggacagcagctttgagcggcggcacggggagcgggacagaagagacaaccgggagcgggaccagaggcccagcagccccatccgccaccagggcagaaatgatgagctggagagagatgaaagaagagaggagaggagagtggacagagtggatgacagaagagatgagcgggcccgggagcgggaccgggagcgggagcgggaccgggagcgggagcgggagcgggagcgggagcgggaccgggagcgggagaaggagcgggagctggagcgggagcgggcccgggagcgggagcgggagcgggagaaggagcgggaccgggagcgggaccgggaccgggaccatgaccgggagcgggagcgggagcgggagcgggaccgggagaaggagcgggagcgggagcgggaggagcgggagcgggagcgggagcgggagcgggagcgggagcgggagcgggagcgggagcgggagcgggcccgggagcgggacaaggagcgggagcggcagagggactgggaggacaaggacaagggcagagatgaccggcgggagaagcgggaggagatcagagaagatagaaaccccagagatggccatgatgagaggaagagcaagaagcgctacagaaatgaaggcagccccagcccccggcagagccccaagagaagaagagagcacagcccagacagtgatgcctacaacagcggagatgacaagaatgagaagcaccggctgctgagccaggtggtgcggccccaggagagccgcagcctgagccccagccacctgacagaagatcggcagggccgctggaaggaggaggacaggaagccagagaggaaggagagcagcagaagatatgaggagcaggagctgaaggagaaggtgtcctctgtggacaagcagcgggagcagacagagatcctggagagcagcaggatgagggcccaggacatcatcggccaccaccagagcgaggaccgggagaccagtgaccgggcccatgatgagaacaagaagaaggccaagatccagaagaagcccatcaagaagaagaaggaggatgatgtgggcatcgagcggggcaacatcgagaccaccagtgaagatggccaggtgttcagccccaagaagggccagaagaagaagagcattgagaagaagaggaagaagagcaaaggagacagcgacatcagtgatgaggaggccgcccagcagagcaagaagaagaggggccccaggaccccacccatcaccaccaaggaggagctggtggagatgtgcaatggcaagaatggcatcctggaggacagccagaagaaggaggacacagccttcagtgactggagcgatgaagatgtgcctgacagaacagaggtgacagaagctgagcacacagccacagccaccaccccaggcagcacccccagccccctgagcagcctgctgcccccacctcctcctgtggccacagccacagccaccaccgtgcctgccaccctggccgccaccacagctgctgctgccaccagcttcagcaccagcgccatcaccatcagcaccagcgccacccccaccaacaccaccaacaacacctttgccaatgaagacagccacaggaagtgccacaggaccagggtggagaaggtggagaccccccacgtgaccattgaagatgcccagcacaggaagcccatggaccagaagaggagcagcagcctgggcagcaacagaagcaacagaagccacaccagcggccgcctgcggagccccagcaatgattctgcccacaggtctggagatgaccagagcggcaggaagagggtgctgcacagcggcagccgggaccgggagaagaccaagagcctggagatcaccggggagaggaagagcagaattgaccagctgaagagaggagagcccagccgcagcaccagcagtgaccggcaggacagccgcagccacagcagccgccgcagcagccctgagagtgaccggcaggtgcacagccgcagcggcagctttgacagccgggaccggctgcaggagcgggacagatatgaacatgaccgggagcgggagcgggagcggcgggacacccggcagcgggagtgggacagagatgctgacaaggactggcccaggaacagagaccgggaccggctgcgggagcgggagcgggagcgggagcgggacaagaggcgggacctggaccgggagcgggagcggctcatcagtgacagcgtggagcgggaccgggaccgggaccgggacaggacctttgagagcagccagatcgagagcgtgaagagatgtgaggccaagctggagggggagcacgagcgggacctggagagcaccagccgggacagcctggccctggacaaggagaggatggacaaggacctgggctctgtgcagggctttgaggagaccaacaagtctgagaggacagagagcctggaggccggagatgatgagagcaagctggatgatgcccacagcctgggcagcggggccggggagggctatgagcccatcagtgatgatgagctggatgagatcctggccggagatgctgagaagcgggaggaccagcaggatgaggagaagatgccagaccccctggatgtgattgatgtggactggagcggcctgatgcccaagcaccccaaggagccccgggagcctggagctgccctgctgaagttcaccccaggagctgtgatgctgcgggtgggcatcagcaagaagctggccggcagcgagctgtttgccaaggtgaaggagacctgccagaggctgctggagaagcccaagggcagcttcatcctgctgtag

SEQ ID NO: 43739 - DNA, 1875 bp, Artificial Sequence
  Description of Artificial Sequence: Synthetic coding sequence
atgtgcaatggcaagaatggcatcctggaggacagccagaagaaggaggacacagccttcagtgactggagcgatgaagatgtgcctgacagaacagaggtgacagaagctgagcacacagccacagccaccaccccaggcagcacccccagccccctgagcagcctgctgcccccacctcctcctgtggccacagccacagccaccaccgtgcctgccaccctggccgccaccacagctgctgctgccaccagcttcagcaccagcgccatcaccatcagcaccagcgccacccccaccaacaccaccaacaacacctttgccaatgaagacagccacaggaagtgccacaggaccagggtggagaaggtggagaccccccacgtgaccattgaagatgcccagcacaggaagcccatggaccagaagaggagcagcagcctgggcagcaacagaagcaacagaagccacaccagcggccgcctgcggagccccagcaatgattctgcccacaggtctggagatgaccagagcggcaggaagagggtgctgcacagcggcagccgggaccgggagaagaccaagagcctggagatcaccggggagaggaagagcagaattgaccagctgaagagaggagagcccagccgcagcaccagcagtgaccggcaggacagccgcagccacagcagccgccgcagcagccctgagagtgaccggcaggtgcacagccgcagcggcagctttgacagccgggaccggctgcaggagcgggacagatatgaacatgaccgggagcgggagcgggagcggcgggacacccggcagcgggagtgggacagagatgctgacaaggactggcccaggaacagagaccgggaccggctgcgggagcgggagcgggagcgggagcgggacaagaggcgggacctggaccgggagcgggagcggctcatcagtgacagcgtggagcgggaccgggaccgggaccgggacaggacctttgagagcagccagatcgagagcgtgaagagatgtgaggccaagctggagggggagcacgagcgggacctggagagcaccagccgggacagcctggccctggacaaggagaggatggacaaggacctgggctctgtgcagggctttgaggagaccaacaagtctgagaggacagagagcctggagggagatgatgagagcaagctggatgatgcccacagcctgggcagcggggccggggagggctatgagcccatcagtgatgatgagctggatgagatcctggccggagatgctgagaagcgggaggaccagcaggatgaggagaagatgccagaccccctggatgtgattgatgtggactggagcggcctgatgcccaagcaccccaaggagccccgggagcccggggccgccctgctgaagttcaccccaggagctgtgatgctgcgggtgggcatcagcaagaagctggccggcagcgagctgtttgccaaggtgaaggagacctgccagaggctgctggagaagcccaaggatgctgacaacctgtttgaacatgagctgggcgccctgaacatggccgccctgctgaggaaggaggagcgggccagcctgctgagcaacctgggcccctgctgcaaggccctgtgcttccggcgggacagcgccatcaggaagcagctggtgaagaatgagaagggcaccatcaagcaggcctacaccagcgcccccatggtggacaatgagctgctgcggctgagcctgcggctcttcaagaggaagaccacctgccacgcccctggccacgagaagacagaggacaacaagctgagccagagcagcatccagcaggagctgtgtgtgtcctag

SEQ ID NO: 43740 - DNA, 348 bp, Artificial Sequence
  Description of Artificial Sequence: Synthetic coding sequence
atgagcaagatccggaggaaggtgacagtggagaacaccaagaccatcagtgacagcaccagccggcggcccagcgtgtttgagcggctgggccccagcacaggcagcacagctgagacccagtgcaggaactggctgaagacaggcaactgcctgtatggcaacacctgccgctttgtgcacggccccagcccccggggcaagggctacagcagcaactacagaagaagccctgagcggcccaccggggacctgcgggagaggatgaagaacaagaggcaggatgtggacacagagccccagaagaggaacacagaggagagcagcagccctgtgcgggtgggctag

SEQ ID NO: 43741 - DNA, 1455 bp, Artificial Sequence
  Description of Artificial Sequence: Synthetic coding sequence
atggagaagcgggaggagatcatcatcaagaaggaggtgtccccagaggtggtgcgcagcaagctgagccccagccccagcctgaggaagagcagcaagagccccaagaggaagagcagccccaagagcagcagcgccagcaagaaggacaggaagaccagcgctgtgagcagccccctgctggaccagcagaggaacagcaagaccaaccagagcaagaagaagggccccaggacccccagccccccaccacccatccctgaggacatcgccctgggcaagaagtacaaggagaagtacaaggtgaaggaccgcatcgaggagaagaccagagatggcaaggaccggggccgggactttgagcggcagcgggagaagagggacaagcccaggagcaccagccctgctggccagcaccacagccccatcagcagccgccaccacagcagcagcagccagagcggcagcagcatccagaggcacagccccagccccaggaggaagaggacccccagccccagctaccagaggaccctgaccccacccctgcggcgcagcgccagcccctaccccagccacagcctgagcagcccccagaggaagcagagcccccccaggcacaggagccccatgagggagaagggcagacatgaccacgagaggaccagccagagccatgacagaagacatgagcggcgggaggacacccggggcaagagggaccgggagaaggacagccgggaggagcgggagtatgagcaggaccagagcagcagccgggaccacagagatgaccgggagcccagagatggccgggacagaagagatgcccgggacacccgggacagaagagagctgcgggacagccgggacatgagggacagccgggagatgagggactacagccgggacaccaaggagagccgggacccccgggacagccgcagcaccagagatgcccatgactacagagaccgggagggccgggacacccacaggaaagaagacacctacccagaggagagccgctcctatggaagaaaccacctgcgggaggagagcagcaggacagagatcagaaatgaaagcagaaatgaaagccgctctgagatcagaaatgacaggatgggccgcagccggggccgggtgcctgagctgcctgagaagggcagccggggcagccggggcagccagattgacagccacagcagcaacagcaactaccatgacagctgggagaccaggagcagctacccagagcgggaccgctacccagagcgggacaacagagaccaggcccgggacagcagctttgagcggcggcacggggagcgggacagaagagacaaccgggagcgggaccagaggcccagcagccccatccgccaccagggcagaaatgatgagctggagagagatgaaagaagagaggagaggaggaaggagaagaagtag

SEQ ID NO: 43742 - DNA, 3912 bp, Artificial Sequence
  Description of Artificial Sequence: Synthetic coding sequence
atggaggccgcccctggcaccccacctcctcctccttctgagagccccccaccacccagccccccaccacccagcacccccagccccccaccctgcagcccagatgcccggcctgccaccccccacctgctgcaccaccggctgcccctgcctgatgacagagaagatggagagctggaggagggggagctggaggatgatggagctgaggagacccaggacaccagcggcggccctgagaggagcaggaaggagaagggggagaagcaccacagcgacagtgatgaggagaagagccaccggcggctgaagaggaagaggaagaaggagcgggagaaggagaagaggaggagcaagaagaggaggaagagcaagcacaagagacatgccagcagcagtgatgacttcagtgacttcagtgatgacagcgacttcagccccagcgagaagggccacaggaagtaccgggagtacagccccccctatgcccccagccaccagcagtacccacccagccacgccacccccctgcccaagaaggcctacagcaagatggacagcaagagctatggcatgtatgaggactatgaaaatgagcagtatggagaatatgaaggagatgaggaggaggacatgggcaaggaggactatgatgacttcaccaaggagctgaaccagtaccgccgggccaaggagggcagcagccggggccggggcagccggggccggggccggggctaccggggccggggcagccggggcggcagccggggccggggcatgggccggggcagccggggccggggccggggctccatgggcggggaccacccagaagatgaggaggacttctatgaggaggagatggactatggagagagcgaggagcccatgggagatgatgattatgatgagtacagcaaggagctgaaccagtaccgccgcagcaaggacagccggggccggggcctgagccggggccggggccggggcagccggggccggggcaagggcatgggccggggccggggccggggcggcagccggggcggcatgaacaagggcggcatgaatgatgatgaggacttctatgatgaggacatgggagatggcggcggcggcagctaccgcagccgggaccatgacaagccccaccagcagagcgacaagaagggcaaggtgatctgcaagtactttgtggagggccgctgcacctggggagaccactgcaacttcagccatgacatcgagctgcccaagaagcgggagctgtgcaagttctacatcaccggcttctgtgcccgggcagagaactgcccctacatgcatggagacttcccctgcaagctgtaccacaccaccggcaactgcatcaatggagatgactgcatgttcagccatgaccccctgacagaggagacccgggagctgctggacaagatgctggctgatgatgctgaggccggggctgaagatgagaaggaggtggaggagctgaagaagcagggcatcaaccccctgcccaagcccccacctggggtgggcctgctgcccaccccacccaggcctcctggcccccaggcccccaccagccccaacggccggcccatgcagggcggccccccacctcctcctcctcctcctcctcctcctcctggccccccccagatgcccatgcctgtgcatgagcccctgagcccccagcagctgcagcagcaggacatgtacaacaagaagatccccagcctgtttgagatcgtggtgcggcccaccggccagctggccgagaagctgggcgtgcgcttccctggccctgggggccccccaggccccatgggccctggccccaacatgggccccccaggccccatgggcggccccatgcacccagacatgcacccagacatgcacccagacatgcacccagacatgcacgccgacatgcacgccgacatgcccatgggccctggcatgaaccctggcccccccatgggccctgggggcccccccatgatgccctacggccctggggacagcccccacagcggcatgatgccacccatccccccagcccagaacttctatgagaacttctaccagcagcaggagggcatggagatggagcccggcctgctgggagatgctgaggactatggccactatgaggagctgcctggagagcccggggagcacctgtttcctgagcaccccctggagccagacagcttcagcgagggcggccccccaggccggcccaagccaggggccggcgtgcctgacttcctgcccagcgcccagagggccctgtacctgcgcatccagcagaagcagcaggaggaggaggagcgggcccggcggctggccgagagcagcaagcaggaccgggagaatgaggagggggacaccggcaactggtacagcagtgatgaagatgaaggaggcagctctgtgaccagcatcctgaagaccctgcggcagcagaccagcagccggcccccagcctctgtgggggagctgagcagcagcggcctgggggacccccggctgcagaagggccaccccaccggcagccggctggccgacccccggctgagccgggacccccggctgaccaggcatgtggaggccagcggcggcagcggccctggggacagcggccccagcgacccccggctggcccgggccctgcccaccagcaagccagagggcagcctgcacagcagccctgtgggccccagcagcagcaagggcagcggccccccacccacagaggaggaggagggggagcgggccctgcgggagaaggctgtgaacatccccctggaccccctgcccggccaccccctgcgggaccccaggagccagctgcagcagttcagccacatcaagaaggatgtgaccctgagcaagcccagctttgccaggacagtgctgtggaaccctgaggacctgatccccctgcccatccccaagcaggatgctgtgccccctgtgcctgctgccctgcagagcatgcccaccctggacccccggctgcacagagctgccacagctggccccccaaatgcccggcagaggcctggggccagcacagacagcagcacccagggcgccaacctgcctgactttgagctgctgagccgcatcctgaagacagtgaatgccaccggcagcagcgctgcccctggcagcagtgacaagcccagcgacccccgggtgaggaaggcccccacagacccccggctgcagaagcccacagacagcacagccagcagccgggccgccaagccaggccctgctgaggcccccagccccacagccagccccagcggagatgccagccccccagccacagccccctatgacccccgggtgctggccgccggcggcctgggccagggcggcggcggcggccagagctctgtgctgagcggcatcagcctgtatgaccccaggaccccaaatgctgggggcaaggccacagagcctgctgctgacacaggagcccagcccaagggagctgagggcaatggcaagagcagcgccagcaaggccaaggagcccccatttgtgaggaagagcgccctggagcagcctgagaccgggaaggccggggctgatggcggcacccccacagaccgctacaacagctacaaccggccccggcccaaggctgctgctgccccagctgccaccacagccaccccacctcctgagggcgccccaccccagcccggggtgcacaacctgcctgtgcccaccctgtttggcaccgtgaagcagacccccaagacaggcagcggcagcccctttgctggcaacagccctgcccgggagggggagcaggatgctgccagcctgaaggatgtgttcaagggctttgaccccacagccagccccttctgccagtag

SEQ ID NO: 43743 - DNA, 3570 bp, Artificial Sequence
  Description of Artificial Sequence: Synthetic coding sequence
atgacagacagcgagcacgccggccatgaccgggaggatggagagctggaggatggagaaattgatgatgctggctttgaggagatccaggagaaggaggccaaggaaaatgagaagcagaagtctgagaaggcctacaggaagagcaggaagaagcacaagaaggagcgggagaagaagaagagcaagaggaggaagcgggagaagcacaagcacaacagccccagcagtgatgacagcagtgactacagcctggacagtgatgtggagcacacagagagcagccacaagaagaggacaggcttctacagagattatgacatccccttcacccagaggggccacatcagcggcagctacatcaccagcaagaagggccagcacaacaagaagttcaagagcaaggagtatgatgagtacagcacctacagtgatgacaactttggaaactacagtgatgacaactttggaaattatggccaggagacagaagaagattttgccaaccagctgaagcagtaccggcaggccaaggagaccagcaacatcgccctgggcagcagcttcagcaaggagagcggcaagaagcagaggatgaagggcgtgcagcagggcatcgagcagagggtgaagagcttcaacgtgggccggggccggggcctgcccaagaagatcaagaggaaggagcggggcggccgcaccaacaagggccccaacgtgttttctgtgtctgatgacttccaggagtacaacaagccaggcaagaagtggaaggtgatgacccaggagttcatcaaccagcacacagtggagcacaagggcaagcagatctgcaagtacttcctggagggccgctgcatcaagggggaccagtgcaagtttgaccatgatgctgagctggagaagaggaaggagatctgcaagttctacctgcagggctactgcaccaagggggagaactgcatctacatgcacaatgagttcccctgcaagttctaccacagcggggccaagtgctaccagggcgacaactgcaagttcagccatgatgacctgaccaaggagaccaagaagctgctggacaaggtgctgaacacagatgaggagctgatcaatgaagatgagcgggagctggaggagctgaggaagaggggcatcacccccctgcccaagcccccacctggggtgggcctgctgcccaccccacctgagcacttccccttcagtgaccctgaagatgacttccagacagacttcagtgatgacttcaggaagatccccagcctgtttgagatcgtggtgaagcccaccgtggacctggcccacaagattggaaggaagcccccagccttctacaccagcgccagccccccaggcccccagttccagggcagcagcccccacccccagcacatctacagcagcggcagcagccctggccctggccccaacatgagccagggccacagcagccctgtgatgcaccctggcagccctggccaccacccctgtgccggccccccaggcctgcctgtgccccagagcccccccctgcccccaggccccccagaaattgtgggcccccagaaccaggccggcgtgctggtgcagcctgacaccagcctgaccccacccagcatgggcggggcctaccacagccctggcttccctggccacgtgatgaaggtgccccgggagaaccactgcagccctggcagcagctaccagcagagccctggagagatgcagctgaacaccaactatgagagcctgcagaacccagctgagttctatgacaactactatgcccagcacagcatccacaacttccagccccccaacaacagcggagatggcatgtggcacggggagtttgcccagcagcagccccctgtggtgcaggacagccccaaccacggcagcggcagtgatggcagcagcaccaggacaggccacggccccctgcctgtgcccggcctgctgcctgctgtgcagagggccctgtttgtgcggctgacccagcgctaccaggaggatgaggagcagaccagcacccagccccaccgggcccccagcaaggaggaggatgacacagtgaactggtacagcagcagcgaggaggaggagggcagctctgtgaagagcatcctgaagaccctgcagaagcagacagagaccctgaggaaccagcagcagcccagcacagagctgagcacccccacagacccccggctggccaaggagaagagcaaaggaaaccaggtggtggacccccggctgcggaccatcccccggcaggacatcaggaagcccagcgagagcgcccccctggacctgcggctggcctgggaccccaggaagctgcggggaaatggaagtggccacatcggcagctctgtgggcggggccaagtttgacctgcaccacgccaatgccggcaccaacgtgaagcacaagagaggagatgatgatgatgaggacacagagcgggagctgcgggagaaggccttcctgatccccctggatgccagccctggcatcatgctgcaggaccccaggagccagctgcggcagttcagccacatcaagatggacatcaccctgaccaagcccaactttgccaagcacatcgtgtgggcccctgaggacctgctgcctgtgcccctgcccaagccagaccctgtgagcagcatcaacctgcccctgccccccctgattgctgaccagaggctgaaccggctgtggaacaccaagagtgacctgcaccagaacacagtgtccattgaccccaagctggccgccaaggccaagatcaacaccaccaaccgggagggctacctggagcagtttggagacagccacggcagcggggccaagctgggggacccccggctgcagaagaactttgacccccggctgcaccggctgcccaacacagagagccaccaggtggtgatgaaggacagccacgccagcaaaggagccccccacctgcccaggagcaaccctggcagcagccagcccagcggggccggcaccagcaacagcggcagcggggccctgcccccctatgcccccaagctgagcagcagcgctggcctgcccctgggcaccagcacctctgtgctgagcggcatcagcctgtatgacccccgggaccacggcagcagcagcaccagcgagctggccacagccagcagtggagagaacagcaagaaccagaagaagagcggcggcctgaagagcagtgacaagacagagcccagccctggagaggccatcctgccccagaagcccagccccaacgtgggcgtgaccctggagggccctgctgacccccaggctgatgtgcccaggagcagcggcaaggtgcaggtgcctgctgtgcacagcctgcctgtgcaggccctgaccggcctcatccggccccagtacagcgacccccggcaggcccggcagcccggccagggcagccccaccccagacaatgaccccggccgggagacagatgacaagagcctgaaggaggtgttcaagacctttgaccccacagccagccccttctgctag

SEQ ID NO: 43744 - DNA, 3570 bp, Artificial Sequence; identical to SEQ ID NO: 43743
  Description of Artificial Sequence: Synthetic coding sequence

SEQ ID NO: 43745 - DNA, 2679 bp, Artificial Sequence
  Description of Artificial Sequence: Synthetic coding sequence
atgcaggacctgaagaagtacaagaagaagaagcagaagaggatgaagagcaggaaggtgaggaagcccacagagaaccaggagaagaacatcaggaagcgggagaggaagaagagcaagaggaggaagcgggagaagcacaagcacaacagccccagcagtgatgacagcagtgactacagcctggacagtgatgtggagcacacagagagcagccacaagaagaggacaggcttctacagagattatgacatccccttcacccagaggggccacatcagcggcagctacatcaccagcaagaagggccagcacaacaagaagttcaagagcaaggagtatgatgagtacagcacctacagtgatgacaactttggaaactacagtgatgacaactttggaaactacggccaggagacagaggaggactttgccaaccagctgaagcagtaccggcaggccaaggagaccagcaacatcgccctgggcagcagcttcagcaaggagagcggcaagaagcagaggatgaagggcgtgcagcagggcatcgagcagagggtgaagagcttcaacgtgggccggggccggggcctgcccaagaagatcaagaggaaggagcggggcggccgcaccaacaagggccccaacgtgttttctgtgtctgatgacttccaggagtacaacaagccaggcaagaagtggaaggtgatgacccaggagttcatcaaccagcacacagtggagcacaagggcaagcagatctgcaagtacttcctggagggccgctgcatcaagggggaccagtgcaagtttgaccatgatgctgagctggagaagaggaaggagatctgcaagttctacctgcagggctactgcaccaagggggagaactgcatctacatgcacaatgagttcccctgcaagttctaccacagcggggccaagtgctaccagggcgacaactgcaagttcagccatgatgacctgaccaaggagaccaagaagctgctggacaaggtgctgaacacagatgaggagctgatcaatgaagatgagcgggagctggaggagctgaggaagaggggcatcacccccctgcccaagcccccacctggggtgggcctgctgcccaccccacctgagcacttccccttcagtgaccctgaagatgacttccagacagacttcagtgatgacttcaggaagatccccagcctgtttgaaattgtggtgaagcccaccgtggacctggcccacaagattggaaggaagcccccagccttctacaccagcgccagccccccaggcccccagttccagggcagcagcccccacccccagcacatctacagcagcggcagcagccctggccctggccccaacatgagccagggccacagcagccctgtgatgcaccctggcagccctggccaccacccctgtgccggccccccaggcctgcctgtgccccagagcccccccctgcccccaggccccccagagatcgtgggcccccagaaccaggccggcgtgctggtgcagcctgacaccagcctgaccccacccagcatgggcggggcctaccacagccctggcttccctggccacgtgatgaaggtgccccgggagaaccactgcagccctggcagcagctaccagcagagccctggagagatgcagctgaacaccaactatgagagcctgcagaacccagctgagttctatgacaactactatgcccagcacagcatccacaacttccagccccccaacaacagcggagatggcatgtggcatggagaatttgcccagcagcagccccctgtggtgcaggacagccccaaccacggcagcggcagtgatggcagcagcaccaggactggacatggccccctgcctgtgcccggcctgctgcctgctgtgcagagggccctgtttgtgcggctgacccagcgctaccaggaggatgaggagcagaccagcacccagccccaccgggcccccagcaaggaggaggatgacacagtgaactggtacagcagcagcgaggaggaggagggcagctctgtgaagagcatcctgaagaccctgcagaagcagacagagaccctgaggaaccagcagcagcccagcacagagctgagcacccccacagacccccggctggccaaggagaagagcaagggcaaccaggtggtggacccccggctgcggaccatcccccggcaggacatcaggaagcccagcgagagcgcccccctggacctgcggctggcctgggaccccaggaagctgcggggaaatggcagcggccacatcggcagctctgtgggcggggccaagtttgacctgcaccacgccaatgccggcaccaacgtgaagcacaagagaggagatgatgatgatgaggacacagagcgggagctgcgggagaaggccttcctgatccccctggatgccagccctggcatcatgctgcaggaccccaggagccagctgcggcagttcagccacatcaagatggacatcaccctgaccaagcccaactttgccaagcacatcgtgtgggcccctgaggacctgctgcctgtgcccctgcccaagccagaccctgtgagcagcatcaacctgcccctgccccccctgattgctgaccagaggctgaaccggctgtggtag

SEQ ID NO: 43746 - DNA, 903 bp, Artificial Sequence
  Description of Artificial Sequence: Synthetic coding sequence
atggccgagcccaccgtgtgcagcttcctgaccaaggtgctgtgtgcccatggaggccgcatgttcctgaaggacctgcggggccacgtggagctgtctgaggcccggctgagagatgtgctgcagagagctggccctgagcgcttcctgctgcaggaggtggagacccaggagggcctgggagatgctgaggccgaggccgctgctggagctgtgggcggcggcggcaccagcgcctggagggtggtggccgtgtcctctgtgcggctgtgtgcccgctaccagagaggagagtgccaggcctgtgaccagctgcacttctgcagaagacacatgctgggcaaatgtcccaacagagactgctggagcacctgcaccctgagccatgacatccacacccctgtgaacatgcaggtgctgaagagccacggcctgtttggcctgaatgaaaaccagctgcgcatcctgctgctgcagaatgacccctgcctgctgcctgaggtgtgcctgctgtacaacaagggggaggccctgtatggctactgcaacctgaaggacaagtgcaacaagttccacgtgtgcaagagctttgtgaagggggagtgcaagctgcagacctgcaagaggagccaccagctgattcatgctgccagcctgaagctgctgcaggaccagggcctgaacatccccagcgtggtgaacttccagatcatcagcacctacaagcacatgaagctgcacaagatgctggagaacacagacaacagcagccccagcacagagcacagccagggcctggagaagcagggcgtgcatgctgctggagctgctgaggccggccccctggcctctgtgcctgcccagagcgccaagaagccctgccctgtgtcctgtgagaagtag

SEQ ID NO: 43747 - DNA, 309 bp, Artificial Sequence
  Description of Artificial Sequence: Synthetic coding sequence
atggccgagcccaccgtgtgcagcttcctgaccaaggtgctgtgtgcccatggaggccgcatgttcctgaaggacctgcggggccacgtggagctgtctgaggcccggctgagagatgtgctgcagagagctggccctgagcgcttcctgctgcaggaggtggagacccaggagggcctgggagatgctgaggccgaggccgctgctggagctgtgggcggcggcggcaccagcgcctggagggtggtggccgtgtctggcaccatcggggcctgccaccacacccagctgatcttcctgggcttctag

SEQ ID NO: 43748 - DNA, 1575 bp, Artificial Sequence
  Description of Artificial Sequence: Synthetic coding sequence
atgatgaccaccctgcagaacaaggaggagtgtgggaagggccccaagaggatctttgcccccccagcccagaagagctacagcctgctgccctgcagccccaacagccccaaggaggagaccccaggcatcagcagccctgagacagaggcccgcatcagcctgcccaaggccagcctgaagaagaaggaggagaaggccaccatgaagaatgtgcccagccgggagcaggagaagaagaggaaggcccagatcaacaagcaggccgagaagaaggagaaggagaagagcagcctgaccaatgctgagtttgaggagatcgtgcagatcgtgctgcagaagagcctgcaggagtgcctgggcatgggcagcggcctggactttgctgagaccagctgtgcccagcctgtggtgtccacccagagcgacaaggagcccggcatcacagccagcgccacagacacagacaatgccaatggagaggaggtgccccacacccaggagatctctgtgtcctgggagggggaggccgcccctgagatccgcaccagcaagctgggccagcctgaccctgcccccagcaagaagaagagcaaccggctgaccctgagcaagaggaagaaggaggcccaggatgagaaggtggagaagacccagggcggccacgagcaccggcaggaggaccggctgaagaagacagtgcaggaccacagccagatccgggaccagcagaagggggagatcagcggcttcggccagtgcctggtgtgggtgcagtgcagcttccccaactgtgggaagtggaggcggctgtgtggcaacatcgaccccagcgtgctgcctgacaactggagctgtgaccagaacacagatgtgcagtacaacagatgtgacatccctgaggagacctggacaggcctggagagtgatgtggcctatgccagctacatccctggcagcatcatctgggccaagcagtatggctacccctggtggccaggcatgattgaaagtgaccctgacctgggggagtacttcctgttcaccagccacctggacagcctgcccagcaagtaccacgtgaccttcttcggggagaccgtgtcccgggcctggatccctgtgaacatgctgaagaacttccaggagctgagcctggagctgtctgtgatgaagaagagaagaaatgactgcagccagaagctgggcgtggccctgatgatggcccaggaggccgagcagatcagcatccaggagcgggtgaacctgtttggcttctggagccgcttcaacggcagcaacagcaatggagagaggaaggacctgcagctgagcggcctgaacagccctggcagctgcctggagaagaaggagaaggaggaggagctggagaaggaggagggggagaagacagccctgaggaagaacctgaagctgccccgggcccggccctggcagcctgccttccagcgggagaagaagctggagcagtgccagaggacctgggcctaccagagggtgcggggccctgccccccacctgaggaagaagagcccagacaccggcaacccctag

SEQ ID NO: 43749 - DNA, 330 bp, Artificial Sequence
  Description of Artificial Sequence: Synthetic coding sequence
cccatggtgggcctgctggtgcacacagctgccaccttcaactacagcttcaggaagatccggggcctgctgtgcccccagcacaagcagaggggcgtgcaggccaaccagacccctgtgctcttcctgcacatcagctgtgtgtactacagcctgtacctgttcttcctgttctgctgcctcttcctgatccccctggagcagaagatgaccaccagccccctgccctacccctgtgacaacatccacgtgacagtgtggcccctgggggaggtgctgatggagaccaggatgtgggagagcaagattggcctggagatgaggctgtag

SEQ ID NO: 43750 - DNA, 399 bp, Artificial Sequence
  Description of Artificial Sequence: Synthetic coding sequence
atgaggaacatgatcccccaggacaatgaaaaccccccccagcagggcgaggccaaccagaatgactttgccctggtggcccaggccggcgtgcagtggctggacctgggcccccagctgcccctgctgcccggcttcaagcagttcttctgcctgagcctgctgagcagctgtggctacagctggagcctggccctgagcccccggctggagtgcagcggggccatcagcgcctacggcaagctgcggctgcccggcagctgccacagccctgccagcgccagccgggtggcccggaccactggagcccggcaccacaccaggctcatctttgtgttcctggtggagacccgcttccaccgggtgtcccaggacggcctggacctgctgaccagctag

SEQ ID NO: 43751 - DNA, 891 bp, Artificial Sequence
  Description of Artificial Sequence: Synthetic coding sequence
atgattgctgagcggctggcccggctgcggcaggagaacaagcccaagctggtgcccagccaggccgagattgaggcccggctggccgccctgaaggatgagcggcagggcagcatccccagcacccaggagatggaggcccggctggccgccctgcagggccgggtgctgcccagccagaccccccagcctgcccaccacaccccagacaccaggacccaggcccagcagacccaggacctgctgacccagctggccgctgaggtggccattgatgagagctggaagggcggcggccctgctgccagcctgcagaatgacctgaaccagggcggccctggcagcaccaacagcaagaggcaggccaactggagcctggaggaggagaagagccggctgctggccgaggccgccctggagctgcgggaggagaacacccggcaggagcgcatcctggccctggccaagaggctggccatgctgcggggccaggaccctgagcgggtgaccctgcaggactaccgcctgcctgacagtgatgatgatgaagatgaggagacagccatccagagggtgctgcagcagctgacagaggaggccagcctggatgaggccagcggcttcaacatcccagctgagcaggccagccggccctggacccagcccagaggagctgagcctgaggcccaggatgtggaccccaggcctgaggccgaggaggaggagctgccctggtgctgcatctgcaatgaagatgccaccctgcgctgtgccggctgtgatggagacctcttctgtgcccgctgcttccgggagggccatgatgcctttgagctgaaggagcaccagaccagcgcctacagccccccccgggccggccaggagcactag

SEQ ID NO: 43752 - DNA, 1584 bp, Artificial Sequence
  Description of Artificial Sequence: Synthetic coding sequence
atgtaccagccagaagatgacaacaacagtgatgtgaccagtgatgatgacatgaccaggaacagaagagagagcagccccccccacagcgtgcacagcttcagcggggaccgggactgggaccggcggggccgcagccgggacatggagccccgggaccgctggagccacaccaggaaccccaggagcaggatgccaccccgggacctgagcctgcctgtggtggccaagaccagctttgagatggacagagaagatgaccgggacagccgggcctatgagagccgcagccaggatgctgagagctaccagaatgtggtggacctggccgaggacaggaagccccacaacaccatccaggacaacatggagaactacaggaagctgctgagcctgggcttcctggcccaggacagcgtgcctgctgagaagaggaacacagagatgctggacaacctgcccagcgctggcagccagttcccagacttcaagcacctgggcaccttcctggtgtttgaggagctggtgacctttgaagatgtgctggtggacttcagccctgaggagctgagcagcctgtctgctgcccagaggaacctgtaccgggaggtgatgctggagaactacagaaacctggtgtccctgggccaccagttcagcaagccagacatcatcagccggctggaggaggaggagagctatgccatggagacagacagccgccacacagtcatctgccagggcgagagccatgatgaccccctggagccccaccagggcaaccaggagaagctgctgacccccatcaccatgaatgaccccaagaccctgaccccagagaggagctatggcagtgatgaatttgagaggagcagcaacctgagcaagcagagcaaggaccccctgggcaaggacccccaggagggcacagcccctggcatctgcaccagcccccagagcgccagccaggagaacaagcacaacagatgtgagttctgcaagaggaccttcagcacccaggtggccctgcggagacatgagcgcatccacacaggcaagaagccctatgagtgcaagcagtgtgccgaggccttctacctgatgccccacctgaacagacaccagaagacccacagcggcaggaagaccagcggctgcaatgaaggaaggaagcccagcgtgcagtgtgccaacctgtgtgagcgggtgcgcatccacagccaggaggactactttgagtgcttccagtgtgggaaggccttcctgcagaatgtgcacctgctgcagcacctgaaggcccacgaggccgcccgggtgctgcccccaggcctgagccacagcaagacctacctgatccgctaccagaggaagcatgactatgtgggggagcgggcctgccagtgctgtgactgtggccgggtcttcagcagaaattcctacctgatccagcactaccgcacccacacccaggagcggccctaccagtgccagctgtgtgggaaatgttttggccggcccagctacctgacccagcactaccagctgcacagccaggagaagacagtggagtgtgaccactgctag

SEQ ID NO: 43753 - DNA, 1809 bp, Artificial Sequence
  Description of Artificial Sequence: Synthetic coding sequence
atggcccggctgaccaagaggcggcaggccgacaccaaggccatccagcacctgtgggccgccatcgagatcatccggaaccagaagcagatcgccaacatcgaccgcatcaccaagtacatgagccgggtgcacggcatgcaccccaaggagaccacccggcagctgagcctggccgtgaaggatggcctgattgtggagaccctgactgtgggctgcaagggcagcaaggccggcatcgagcaggagggctactggctgcctggagatgaaattgactgggagacagaaaatcatgactggtactgctttgagtgccacctgcctggagaggtgctgatctgtgacctgtgcttccgggtgtaccacagcaagtgcctgagtgatgagttccggctgcgggacagcagcagcccctggcagtgccctgtgtgccgcagcatcaagaagaagaacaccaacaagcaggagatgggcacctacctgcgcttcatcgtgtccaggatgaaggagcgggccatcgacctgaacaagaagggcaaggacaacaagcaccccatgtacagaaggctggtgcacagcgctgtggatgtgcccaccatccaggagaaggtgaatgaaggcaagtaccgctcctatgaggagttcaaggcagatgcccagctgctgctgcacaacacagtcatcttctatggagctgacagcgagcaggccgacatcgccaggatgctgtacaaggacacctgccacgagctggatgagctgcagctgtgcaagaactgcttctacctgagcaatgcccggccagacaactggttctgctacccctgcatccccaaccacgagctggtgtgggccaagatgaagggcttcggcttctggccagccaaggtgatgcagaaggaggacaaccaggtggatgtgcgcttcttcggccaccaccaccagagggcctggatccccagcgagaacatccaggacatcaccgtgaacatccaccggctgcacgtgaagaggtccatgggctggaagaaggcctgtgatgagctggagctgcaccagcgcttcctgcgggagggccgcttctggaagagcaagaatgaagatagaggagaggaggaggccgagagcagcatcagcagcaccagcaatgagcagctgaaggtgacccaggagccccgggccaagaagggcagaagaaaccagagcgtggagcccaagaaggaggagcctgagcctgagacagaagctgtgagcagcagccaggagatccccaccatgccccagcccatcgagaaggtgtctgtgtccacccagaccaagaagctgagcgccagcagccccaggatgctgcacaggagcacccagaccaccaatgatggagtgtgccagagcatgtgccacgacaagtacaccaagatcttcaatgacttcaaggacaggatgaagagtgaccacaagcgggagacagagcgggtggtgcgggaggccctggagaagctgcggtctgagatggaggaggagaagaggcaggccgtgaacaaggctgtggccaacatgcagggcgagatggacaggaagtgcaagcaggtgaaggagaagtgcaaggaggagtttgtggaggagatcaagaagctggccacccagcacaagcagctgatcagccagaccaagaagaagcagtggtgctacaactgtgaggaggaggccatgtaccactgctgctggaacaccagctactgcagcatcaagtgccagcaggagcactggcacgccgagcacaagaggacctgcaggaggaagaggtag

SEQ ID NO: 43754 - DNA, 1920 bp, Artificial Sequence
  Description of Artificial Sequence: Synthetic coding sequence
atgaccccagccagcgccagcggagaagattctggcagcttctacagctggcagaaggccaagcgggagcagggcctggtgacctttgaagatgtggccgtggacttcacccaggaggagtggcagtacctgaaccccccccagaggaccctgtacagagatgtgatgctggagacctacagcaacctggtgtttgtgggccagcaggtgaccaagcccaacctgatcctgaagctggaggtggaggagtgcccagctgagggcaagatccccttctggaacttccctgaggtgtgccaggtggatgagcagatcgagcggcagcaccaggatgaccaggacaagtgcctgctgatgcaggtgggcttcagtgacaagaagaccatcatcaccaagagcgcccgggactgccacgagtttggaaacatcctgcacctgagcaccaacctggtggccagcatccagaggccagacaagcatgagagctttggaaacaacatggtggacaacctggacctcttcagccgcagcagcgctgagaacaagtatgacaatggctgtgccaagctgttcttccacacagaatatgagaagaccaaccctggcatgaagccctacggctacaaggaatgtgggaagggcctgcggaggaagaagggcctgagcctgcaccagaggatcaagaatggagagaagccctttgaatgtacagcctgcaggaagaccttcagcaagaagagccacctgattgtgcactggaggacccacactggagagaagcccttcggctgcacagaatgtgggaaggccttcagccagaagagccagctgatcatccacctgcggacccacactggagagcggccctttgaatgtccagaatgtgggaaggccttccgggagaagagcaccgtcatcatccactaccgcacccacactggagagaagccctatgaatgtaatgaatgtgggaaggccttcacccagaagagcaacctgattgtgcaccagaagacccacactggagagaagacctatgaatgtaccaagtgtggggagagcttcatccagaagctggacctgatcatccaccacagcacccacacaggcaagaagccccatgaatgtaatgaatgcaagaagaccttcagtgacaagagcaccctcatcatccaccagaggacccacactggagagaagccccacaagtgcacagaatgtgggaagagcttcaatgagaagagcaccctcatcgtgcaccagaggacccacactggagagaagccctatgaatgtgatgtgtgtgggaagaccttcacccagaagagcaacctgggcgtgcaccagaggacccacagcggggagaagccctttgaatgtaatgaatgtgagaaggccttcagccagaagagctacctgatgctgcaccagaggggccacactggagagaagccctatgaatgtaatgaatgtgagaaggccttcagccagaagagctacctgatcatccaccagaggacccacacagaggagaagccctacaagtgcaatgaatgtgggaaggccttccgggagaagagcaagctgatcatccaccagaggatccacactggagagaagccctatgaatgtcctgtgtgctggaaggccttcagccagaagagccagctgatcatccaccagaggacccacactggagagaagccctatgcctgcacagaatgtgggaaggccttccgggagaagagcaccttcaccgtgcaccagaggacccacactggagagaagccctacaagtgcacagaatgtgggaaggccttcacccagaagagcaacctgattgtgcaccagaggacccatgctgggaagaaggcccacggccggggccacaccaggaagagcaagttcatggcccactag

SEQ ID NO: 43755 - DNA, 993 bp, Artificial Sequence
  Description of Artificial Sequence: Synthetic coding sequence
tgaagtgagatggccgccagagatgagctgggcctgggcggggacagcctggaggccatgcctgtgcctgctgcccggggccggccccgcatcaccaatggacctgaggagctggccgcccccagccctgctgccctggccgactatgagggcaaggatgtggccaccagggtgggggaggcctggcaggagaggcctggggccccccggggcggccagggcgaccctgctgtgcctgcccagcagcctgctgaccccagcaccccagagcggcagagcagccccagcggcagcgagcagctggtgagaagagagagctgtggcagctctgtgctgacagactttgagggcaaggatgtggccaccaaggtgggggaggcctggcaggacaggcctggggccccccggggcggccagggcgaccctgctgtgcccacccagcagcctgctgaccccagcaccccagagcagcagaacagccccagcggcagcgagcagtttgtgagaagagagagctgcaccagccgggtgcgcagccccagcagctgcatggtgacagtgacagtgacagccaccagcgagcagccccacatctacatcccagccccagccagcgagctggacagcagcagcaccaccaagggcatcctgtttgtgaaggagtatgtgaatgccagcgaggtgagcagcggcaagcctgtgtctgcccgctacagcaatgtgagcagcattgaagattcttttgccatggagaagaagccaccctgtggcagcaccccctacagcgagaggaccaccggcggcatctgcacctactgcaaccgggagatccgggactgccccaagatcaccctggagcacctgggcatctgctgccacgagtactgcttcaagtgtggcatctgcagcaagcccatgggagacctgctggaccagatcttcatccaccgggacaccatccactgtgggaagtgctatgagaagctgttctag

SEQ ID NO: 43756 - DNA, 1167 bp, Artificial Sequence
  Description of Artificial Sequence: Synthetic coding sequence
atggctgctgtgagccccaccacccgctgccaggagagcgtgacctttgaagatgtggccgtggtgttcacagatgaggagtggagccggctggtgcccatccagagggacctgtacaaggaggtgatgctggagaactacaacagcatcgtgtccctggactgggagaccaagccagagatccatgatgccagtgacaagaagtctgagggcagcctgagagaatgtctgggccggcagagccccctgtgccccaagtttgaggtgcacaccccaaatggaaggatgggcacagagaagcagagccccagcggggagaccaggaagaagagcctgagccgggacaagggcctgcggaggagaagaagtgccctgagccgggagatcctgaccaaggagcggcaccaggagtgcagcgactgtgggaagaccttctttgaccacagcagcctgaccaggcaccagaggacccacactggagagaagccctatgactgccgggagtgtgggaaggccttcagccacaggagcagcctgagccgccacctgatgagccacactggagagagcccctatgaatgttctgtgtgcagcaaggccttctttgacaggagcagcctgactgtgcaccagaggatccacactggagagaagcccttccagtgcaatgaatgtgggaaggccttctttgacaggagcagcctgaccaggcaccagaggatccacactggagagagcccctatgagtgccaccagtgtgggaaggccttcagccagaagagcatcctgaccaggcaccagctgatccacactggaaggaagccctatgaatgtaatgaatgtgggaaggccttctacggcgtgagcagcctgaacagacaccagaaggcccatgctggggacccccgctaccagtgcaatgaatgtgggaaggccttctttgacaggagcagcctgacccagcaccagaagatccacactggagacaagccctatgaatgttctgaatgtgggaaggccttcagccagcgctgccgcctgaccaggcaccagagggtgcacactggagagaagccctttgaatgtactgtgtgtgggaaggtgttcagcagcaagagcagcgtcatccagcaccagaggagatatgccaagcagggcattgattag

SEQ ID NO: 43757 - DNA, 2049 bp, Artificial Sequence
  Description of Artificial Sequence: Synthetic coding sequence
atgatccccaagcaggacatcagcgaggagctggagagccagagggccaagtcagaagatcatgtgaggaacatcttcaaggagacagaggagatgagcaagacagagggcaagctggagaactgctggaggaaatatgctgtggagggcgtgaagaacagcttcagccagaagagcaacttccgggagatcaccatgagatatgtgaagaccctgagcagagaaaatggccagaagttcaatgctgtgggggagaactgcatcacagacagcaacccagccaagcacctgcggggcagccgggaggagagcctgcaccccagcgtgtcctctgtggagaacctgcagcagcatgaagatctcatcaacctgcagagcttccagctgggggagcgggcctaccagacagatgtgctggtgaaggtgccccggcagagctctgtgctgtctgagaaccagaggatgaacaaccctgagcgctggtttgagagcacaggctgcggcaagacctacaaccagaacagagccttcaaccagcaccagcgcttccacagcggggagaagacctatgagcacaatgaatgtgggaaggccttctcctggcccagcatcctgagcaagcaccagaggatccacacaggcaagaagctgtacacctgtgaggactgtgggaagagcttctctgtgcacagctacttcatccagcactgcaagatccacacccgggagaagccctatgagtgcatcaagtgtgggaaggccttcagcacccacagcagctatgtgcagcacctgaagatccacactggagagaagcaccacgagtgcaaccagtgtgggaaggccttcagccacagcagcaacctgatccaccaccagaggatccacagcggggagaagccctacaagtgcaaggaatgtgggaaggccttcaaccggcagagcaacctgatccagcaccagaggatccacagcggggagaagccctatgactgcaaggaatgtgggaaggccttcagcacccagctgttcctgatccagcaccagaggatccacactggagagaagccctatgaatgtaatgaatgtgccaagagcttcagcctgaacagaaccctgactgtgcaccagaggatccacactggagagaagccctaccgctgcaatgaatgtgggaagagcttcagccagtgcagccaggtgatccagcacaagaggatccacactggagagaagccctacatctgcaatgaatgtgggaagagctttggagcccggctgagcctcatccagcaccagaggatccacactggagagaagccctacggctgccgggagaagccctatgagtgcagtgaatgtgggaaggccttcagccagagcttcaacctgatccaccaccagaggacccacaacggggagaagagctatgagtgcaatgaatgtgacaaggccttcagcctgctgagcagcctggtgcagcaccagaggatccacaacggggacaagccctatgagtgccacaagtgtgggaaggccttcagccagggcagccacctgatccagcaccagaggagccacatcggggagaagccctatgagtgcaatgaatgtgggaagaccttcggccagatcagcaccctcatcaagcatgagaggacccacaacggggagaagccctatgagtgcagcgactgtgggaaggccttcagccagagcgcccacctgatccaccaccagaggatccacactggagagaacccctatgagtgcagtgaatgtgggaaggccttcaacgtgtgcagcagcctcatccagcaccaccgcatccacactggagagaagccctatgagtgcagcgactgtgggaaggccttcagccagcacagccagttcatccagcaccagaggatccacactggagagaagccctacatgtgcaatgaatgtgagaagagcttcagcgcctgcctgagcctcatccagcacaagaggatccacactggagagaagccctacgtgtgtgccaagtgtgggaagagcttctag

SEQ ID NO: 43758 - DNA, 1419 bp, Artificial Sequence
  Description of Artificial Sequence: Synthetic coding sequence
atgatgggcacctacggcaacctgctgagcctgggctgtgacagcagaattgagaaggaggagatgatccccaagcaggacatcagcgaggagctggagagccagagggccaagtctgaggaccacgtgaggaacatcttcaaggagacagaggagatgagcaagacagagggcaagctggagaactgctggaggaaatatgctgtggagggcgtgaagaacagcttcagccagaagagcaacttccgggagatcaccatgagatatgtgaagaccctgagccgggagaatggccagaagttcaatgctgtgggggagaactgcatcacagacagcaacccagccaagcacctgcggggcagccgggaggagagcctgcaccccagcgtgtcctctgtggagaacctgcagcagcacgaggacctgatcaacctgcagagcttccagctgggggagcgggcctaccagacagatgtgctggtgaaggtgccccggcagagctctgtgctgtctgagaaccagaggatgaacaaccctgagcgctggtttgagagcacaggctgtgggaagacctacaaccagaacagagccttcaaccagcaccagcgcttccacagcggggagaagacctatgagcacaatgaatgtgggaaggccttctcctggcccagcatcctgagcaagcaccagaggatccacacaggcaagaagctgtacacctgtgaggactgtgggaagagcttctctgtgcacagctacttcatccagcactgcaagatccacacccgggagaagccctatgagtgcatcaagtgtgggaaggccttcagcacccacagcagctatgtgcagcacctgaagatccacactggagagaagcaccacgagtgcaaccagtgtgggaaggccttcagccacagcagcaacctgatccaccaccagaggatccacagcggggagaagccctacaagtgcaaggaatgtgggaagaccttcggccagatcagcaccctcatcaagcatgagaggacccacaacggggagaagccctatgagtgcagcgactgtgggaaggccttcagccagagcgcccacctgatccaccaccagaggatccacactggagagaacccctatgagtgcagtgaatgtgggaaggccttcaacgtgtgcagcagcctcatccagcaccaccgcatccacactggagagaagccctatgagtgcagcgactgtgggaaggccttcagccagcacagccagttcatccagcaccagaggatccacactggagagaagccctacatgtgcaatgaatgtgagaagagcttcagcgcctgcctgagcctcatccagcacaagaggatccacactggagagaagccctacgtgtgtgccaagtgtgggaagagcttctag

SEQ ID NO: 43759 - DNA, 1200 bp, Artificial Sequence
  Description of Artificial Sequence: Synthetic coding sequence
atgagccaggtgaccttcagtgatgtggccatcgacttcagccatgaggagtgggcctgcctggacagcgcccagagggacctgtacaaggatgtgatggtgcagaactatgagaacctggtgtctgtgggcctgtctgtgaccaagccctacgtgatcatgctgctggaggatggcaaggagccctggatgatggagaagaagctgagcaaggactgggagagccgctgggagaacaaggagctgagcaccaagaaggacatctatgatgaggacagcccccagcctgtgaccatggagaaggtggtgaagcagagctatgagttcagcaacagcaacaagaacctggagtacacagaatgtgacaccttccgcagcaccttccacagcaagagcaccctgtctgagccccagaacaacagcgctgagggcaacagccacaagtatgacatcctgaagaagaacctgagcaagaagagcgtcatcaagtctgagcgcatcaatggaggcaagaagctgctgaacagcaacaagtctggagctgccttcaaccagagcaagagcctgaccctgccccagacctgcaaccgggagaagatctacacctgcagtgaatgtgggaaggccttcggcaagcagagcatcctgagccgccactggaggatccacactggagagaagccctatgagtgcagagaatgtgggaagaccttcagccacggcagcagcctgaccaggcaccagatcagccacagcggggagaagccctacaagtgcattgaatgtgggaaggccttcagccacggcagcagcctgaccaaccaccagagcacccacactggagagaagccctatgagtgcatgaactgtgggaagagcttcagccgggtgtccctgctgatccagcacctgcgcatccacacccaggagaagagatatgagtgccgcatctgtgggaaggccttcatccacagcagcagcctcatccaccaccagaagagccacactggagagaagccctatgagtgcagagaatgtgggaaggccttctgctgcagcagccacctgacccagcaccagaggatccacagcatgaagaagaagtatgagtgcaacaagtgcctgaaggtgttcagcagcttctccttcctggtgcagcaccagagcatccacacagaggagaagccctttgaggtgtag

SEQ ID NO: 43760 - DNA, 1332 bp, Artificial Sequence
  Description of Artificial Sequence: Synthetic coding sequence
atgagccagaggcagtacccagagtgctacctggcccccaacggctgcctggtgagcaactgtggggtgaacaagatgagcaatgaggagctggtgggccagaaccacggcatggagggggaggcctgcacaggaggagatgtgaccttcagtgatgtggccatcgacttcagccatgaggagtgggcctgcctggacagcgcccagagggacctgtacaaggatgtgatggtgcagaactatgagaacctggtgtctgtgggcctgtctgtgaccaagccctacgtgatcatgctgctggaggatggcaaggagccctggatgatggagaagaagctgagcaaggactgggagagccgctgggagaacaaggagctgagcaccaagaaggacatctatgatgaggacagcccccagcctgtgaccatggagaaggtggtgaagcagagctatgagttcagcaacagcaacaagaacctggagtacacagaatgtgacaccttccgcagcaccttccacagcaagagcaccctgtctgagccccagaacaacagcgctgagggcaacagccacaagtatgacatcctgaagaagaacctgagcaagaagagcgtcatcaagtctgagcgcatcaatggaggcaagaagctgctgaacagcaacaagtctggagctgccttcaaccagagcaagagcctgaccctgccccagacctgcaaccgggagaagatctacacctgcagtgaatgtgggaaggccttcggcaagcagagcatcctgagccgccactggaggatccacactggagagaagccctatgagtgcagagaatgtgggaagaccttcagccacggcagcagcctgaccaggcaccagatcagccacagcggggagaagccctacaagtgcattgaatgtgggaaggccttcagccacggcagcagcctgaccaaccaccagagcacccacactggagagaagccctatgagtgcatgaactgtgggaagagcttcagccgggtgtccctgctgatccagcacctgcgcatccacacccaggagaagagatatgagtgccgcatctgtgggaaggccttcatccacagcagcagcctcatccaccaccagaagagccacactggagagaagccctatgagtgcagagaatgtgggaaggccttctgctgcagcagccacctgacccagcaccagaggatccacagcatgaagaagaagtatgagtgcaacaagtgcctgaaggtgttcagcagcttctccttcctggtgcagcaccagagcatccacacagaggagaagccctttgaggtgtag

SEQ ID NO: 43761 - DNA, 1200 bp, Artificial Sequence; identical to SEQ ID NO: 43759
  Description of Artificial Sequence: Synthetic coding sequence

SEQ ID NO: 43762 - DNA, 429 bp, Artificial Sequence
  Description of Artificial Sequence: Synthetic coding sequence
atgagccaggtgaccttcagtgatgtggccatcgacttcagccatgaggagtgggcctgcctggacagcgcccagagggacctgtacaaggatgtgatggtgcagaactatgagaacctggtgtctgtgggcctgtctgtgaccaagccctacgtgatcatgctgctggaggatggcaaggagccctggatgatggagaagaagctgagcaaggactgggagagccgctgggagaacaaggagctgagcaccaagaaggacatctatgatgaggacagcccccagcctgtgaccatggagaaggtggtgaagcagagctatgagttcagcaacagcaacaagaacctggagtacacagaatgtgacaccttccgcagcaccttccacagcaagagcaccctgtctgagccccagaacaacagcgcctag

SEQ ID NO: 43763 - DNA, 1200 bp, Artificial Sequence; identical to SEQ ID NO: 43759
  Description of Artificial Sequence: Synthetic coding sequence

SEQ ID NO: 43764 - DNA, 399 bp, Artificial Sequence
  Description of Artificial Sequence: Synthetic coding sequence
atgagccaggtgaccttcagtgatgtggccatcgacttcagccatgaggagtgggcctgcctggacagcgcccagagggacctgtacaaggatgtgatggtgcagaactatgagaacctggtgtctgtggccggcctgtctgtgaccaagccctacgtgatcatgctgctggaggatggcaaggagccctggatgatggagaagaagctgagcaaggcctaccccttccccctgagccacagcgtgcctgcctctgtgaactttggcttcagcgccctgtttgagcactgcagcgaggtgacagagatctttgagctgtctgagctgtgtgtgttctgggtgctgcacttcctgagcaacagccccaacagcacagtggaggccttcttcaagaagtag

SEQ ID NO: 43765 - DNA, 399 bp, Artificial Sequence; identical to SEQ ID NO: 43764
  Description of Artificial Sequence: Synthetic coding sequence

SEQ ID NO: 43766 - DNA, 2001 bp, Artificial Sequence
  Description of Artificial Sequence: Synthetic coding sequence
atgcaggaggtggtgctgctggatgagagcagcggcccccccagccagctgctgtggacccggcaggacacccagctgccccaggagagcgccctgctgcctgccccctacccagccttcaccaaggatggcagccagggcaacctgccccaggccgacatcaccctgatgagccaggcccaggagagcgtgacctttgaagatgtggccgtgaacttcaccaaccgggagtggcagtgcctgacctacgcccagaggcacctgtacaaggatgtgatgctggagaactacggcaacatggtgtccctgggcttccccttccccaagccacccctcatcagccacctggagcgggaggtggacccctgtgtgcaggacccccaggaccgggagagcctgagctgcagctaccctgtgtctgctgacaagatgtggccagaaaatgagaaggccagcagccagcaggagatctttgaaaatggagaggcctactggatgaagttcaacagcctgctgaaggtggacagccgggaccccaaggtgcgggaggtgtgtgtgcaggatgtgaagctggagaaccagtgggagaccagcatccgggagaagctgcgggaggagaaggagggcagcgaggaggtgacctgcaagaagggcaagaaccagaaggtgctgagcaagaacctgaaccccaacagcaagcacagccagtgcaacaaggtgctgattgcccagaagctgcatgaatgtgcccgctgtgggaagaacttctcctggcacagcgacctgatcctgcacgagcagatccacagcggggagaagccccacgtgtgcaatgaatgtgggaaggccttcaagaccaggaaccagctgtccatgcaccgcatcatccacactggagagaagcccttcaactgcacccagtgtgggaaggccttcaacagccgcagcgccctgtgccgccacaagaagacccacagcggggagaagccccatgagtgccgggactgtgggaaggccttcaagaccaggaaccggctgtgcatgcaccagctgatccacactggagagaagccctacaagtgcaactgctgcggcaaggccttccagttcaagcacagcctgaccatccacggccgcatccacactggagagaagccctatgaatgtgaagaatgtgggaaggccttcagcggcagcagtgacctgaccaagcacatccgcatccacactggagagcggccctatgagtgcagcaaatgtggccgggccttcagccgcagcagtgacctgagcaagcacaagaggatccacacccgggagaagcactacggctgcccccagtgtgggaaggacttcagcatcaaggccgagctgaccaagcaccggcgcatccacacagaggagaagcgctaccgctgtgaagaatgtgggaaggccttccgccacaactgcaagaggcgggcccacgagcgggagcacactggagagaagccctaccagtgccgggactgtgggaagaccttccaggaccagcactgcctgaccatccaccagaggatccacactggagagaagccctacaagtgcctggagtgtgggaaggccttcagcggcaagagcaacctgaccaaccaccggcgcatccacactggagagaagccccacaagtgtgaggtgtgtggcatggccttccaccacagctctgtgctgcggcagcacaagaggatccacactggagagaagccctacacctgcagtgaatgtggcaccagcttccggcagggcagcgccctgattggccacaagagggtgcacactggagagaagccctatgaatgtgaagaatgtgggaaggccttccgggtgagcagcaacctgaccggccacaagaagaggaagcaccaggtgtggagcacccatgagctggatggcagcaggaagagcctgagccctgtgacagtgtcccagacctctgtggtgtccatcctgaccagcgcctag

SEQ ID NO: 43767 - DNA, 1725 bp, Artificial Sequence
  Description of Artificial Sequence: Synthetic coding sequence
atgctggagaactacggcaacatggtgtccctgggcttccccttccccaagccacccctcatcagccacctggagcgggaggtggacccctgtgtgcaggacccccaggaccgggagagcctgagctgcagctaccctgtgtctgctgacaagatgtggccagaaaatgagaaggccagcagccagcaggagatctttgaaaatggagaggcctactggatgaagttcaacagcctgctgaaggtggacagccgggaccccaaggtgcgggaggtgtgtgtgcaggatgtgaagctggagaaccagtgggagaccagcatccgggagaagctgcgggaggagaaggagggcagcgaggaggtgacctgcaagaagggcaagaaccagaaggtgctgagcaagaacctgaaccccaacagcaagcacagccagtgcaacaaggtgctgattgcccagaagctgcatgaatgtgcccgctgtgggaagaacttctcctggcacagcgacctgatcctgcacgagcagatccacagcggggagaagccccacgtgtgcaatgaatgtgggaaggccttcaagaccaggaaccagctgtccatgcaccgcatcatccacactggagagaagcccttcaactgcacccagtgtgggaaggccttcaacagccgcagcgccctgtgccgccacaagaagacccacagcggggagaagccccatgagtgccgggactgtgggaaggccttcaagaccaggaaccggctgtgcatgcaccagctgatccacactggagagaagccctacaagtgcaactgctgcggcaaggccttccagttcaagcacagcctgaccatccacggccgcatccacactggagagaagccctatgaatgtgaagaatgtgggaaggccttcagcggcagcagtgacctgaccaagcacatccgcatccacactggagagcggccctatgagtgcagcaaatgtggccgggccttcagccgcagcagtgacctgagcaagcacaagaggatccacacccgggagaagcactacggctgcccccagtgtgggaaggacttcagcatcaaggccgagctgaccaagcaccggcgcatccacacagaggagaagcgctaccgctgtgaagaatgtgggaaggccttccgccacaactgcaagaggcgggcccacgagcgggagcacactggagagaagccctaccagtgccgggactgtgggaagaccttccaggaccagcactgcctgaccatccaccagaggatccacactggagagaagccctacaagtgcctggagtgtgggaaggccttcagcggcaagagcaacctgaccaaccaccggcgcatccacactggagagaagccccacaagtgtgaggtgtgtggcatggccttccaccacagctctgtgctgcggcagcacaagaggatccacactggagagaagccctacacctgcagtgaatgtggcaccagcttccggcagggcagcgccctgattggccacaagagggtgcacactggagagaagccctatgaatgtgaagaatgtgggaaggccttccgggtgagcagcaacctgaccggccacaagaagaggaagcaccaggtgtggagcacccatgagctggatggcagcaggaagagcctgagccctgtgacagtgtcccagacctctgtggtgtccatcctgaccagcgcctag

SEQ ID NO: 43768 - DNA, 702 bp, Artificial Sequence
  Description of Artificial Sequence: Synthetic coding sequence
atgctgcgggaggaggccaccaagaagagcaaggagaaggagcccggcatggccctgccccagggccgcctgaccttcagagatgtggccatcgagttcagcctggaggagtggaagtgcctgaacccagcccagagggccctgtacagagctgtgatgctggagaactacagaaacctggagtttgtggacatcagcagcaagtgcatgatgaaggagttcagcagcacagcccagggcaacacagaggtgatccacacaggcaccctgcagagacatgagagccaccacatccgggacttctgcttccaggagattgagaaggacatccacaactttgagttccagtggcaggaggaggagagaaatggacatgaggcccccatgacagagatcaaggagctgaccggcagcacagacagacatgaccagagacatgctggcaacaagcccatcaaggaccagctgggcagcagcttccacagccacctgcctgagctgcacatcttccagcctgagtggaagattggcaaccaggtggagaagagcatcatcaatgccagcctcatcctgaccagccagaggatcagctgcagccccaagacccgcatcagcaacaactacggcaacaacagcctgcacagcagcctgcccatccagaagctgggcagcacccatgagaggaagatcttccccatgtag

SEQ ID NO: 43769 - DNA, 1209 bp, Artificial Sequence
  Description of Artificial Sequence: Synthetic coding sequence
atgtacaccagcgaggagaagtgcaaccagaggacccagaagaggaagatctacaacgtgtgccccaggaagggcaagaagatcttcatccacatgcatgagatcatccagattgatggccacatctaccagtgcctggagtgcaagcagaacttctgtgagaacctggccctgatcatgtgtgagaggacccacactggagagaagccctacaagtgtgacatgtgtgagaagacctttgtgcagagcagtgacctgaccagccaccagaggatccacaactatgagaagccctacaagtgcagcaaatgtgagaagagcttctggcaccacctggccctgagcggccaccagaggacccacgccggcaagaagttctacacctgtgacatctgtgggaagaactttggccagagcagtgacctgctggtgcaccagaggagccacactggagagaagccctacctgtgcagtgaatgtgacaagtgcttcagccgcagcaccaacctgatccgccacaggaggacccacactggagagaagcccttcaagtgcctggagtgtgagaaggccttcagcggcaagagtgacctgatcagccaccagaggacccacactggagagcggccctacaagtgcaacaagtgtgagaagagctaccgccacaggtctgccttcatcgtgcacaagagggtgcacactggagagaagccctacaagtgtggggcctgtgagaagtgcttcggccagaagagtgacctgattgtgcaccagagggtgcacactggagagaagccctacaagtgcctggagtgcatgaggagcttcaccaggtctgccaacctgatccgccaccaggccacccacacccacaccttcaagtgcctggagtatgagaagagcttcaactgcagcagtgacctgattgtgcaccagaggatccacatggaggagaagccccaccagtggagcgcctgtgagagcggcttcctgctgggcatggactttgtggcccagcagaagatgaggacccagacagaggagctgcactacaagtacacagtgtgtgacaagagcttccaccagagcagcgccctgctgcagcaccagacagtgcacatcggggagaagccctttgtgtgcaatgtgtctgagaagggcctggagctgagccccccccacgccagcgaggccagccagatgtcctag

SEQ ID NO: 43770 - DNA, 744 bp, Artificial Sequence
  Description of Artificial Sequence: Synthetic coding sequence
atggtgacccagctgcgctatgagagcttctgcctgcaccagttccaggagcaggatggagagagcatccctgagaaccaggagctggccagcaagcaggagatcctgaaggagatggagcacctgggggacagcaagctgcagagagatgtgtccctggacagcaagtaccgggagacctgcaagagggacagcaaggccgagaagcagcaggcccacagcactggagagcggcggcaccgctgcaatgaatgtgggaagagcttcaccaagagctctgtgctgattgagcaccagaggatccacactggagagaagccctatgaatgtgaggagtgtgggaaggccttcagcagaagaagcagcctgaatgagcacagaagaagccacactggagagaagccctaccagtgcaaggaatgtgggaaggccttcagcgccagcaatggcctgaccaggcaccggcgcatccacactggagagaagccctatgagtgcaaggtgtgtgggaaggccttcctgctgagcagctgcctggtgcagcaccagaggatccacactggagagaagcgctaccagtgccgggagtgtgggaaggccttcatccagaatgccggcctcttccagcacctgcgggtgcacactggagagaagccctaccagtgcagccagtgcagcaagctgttcagcaagaggaccctgctgaagaagcaccagaagatccacactggagagcggccctag

SEQ ID NO: 43771 - DNA, 1653 bp, Artificial Sequence
  Description of Artificial Sequence: Synthetic coding sequence
caggtgcccctgaccttcagtgatgtggccatcgacttcagccaggaggagtgggagtacctgaacagcgaccagagggacctgtacagagatgtgatgctggagaactacaccaacctggtgtccctggacttcaacttcaccacagagagcaacaagctgagcagcgagaagagaaattatgaggtgaatgcctaccaccaggagacctggaagaggaacaagaccttcaacctgatgaggttcatcttcagaacagacccccagtacaccatcgagtttggccggcagcagaggcccaaggtgggctgcttcagccagatgatcttcaagaagcacaagagcctgcccctgcacaagaggaacaacacccgggagaagagctatgagtgcaaggagtacaagaagggcttcaggaagtacctgcacctgacagagcacctgcgggaccacactggagtcatcccctatgagtgcaatgaatgtgggaaggcctttgtggtgttccagcacttcatccgccacaggaagatccacacagacctgaagccctatgagtgcaatggctgtgagaaggccttccgcttctacagccagctgatccagcaccagatcatccacacaggcatgaagccctatgagtgcaagcagtgtgggaaggccttcagaagacacagccacctgacagagcaccagaagatccacgtgggcctgaagccctttgagtgcaaggaatgtggggagaccttccggctgtaccgccacatgtgcctgcaccagaagatccaccacggcgtgaagccctacaagtgcaaggaatgtgggaaggccttcggccacaggagcagcctgtaccagcacaagaagatccacagcggggagaagccctacaagtgtgagcagtgtgagaaggcctttgtgcgcagctacctgctggtggagcaccagaggagccacactggagagaagccccatgagtgcatggagtgtgggaaggccttcggcaagggcagcagcctgctgaagcacaagaggatccacagcagcgagaagctgtatgactgcaaggactgtgggaaggccttctgccggggcagccagctgacccagcaccagaggatccacactggagagaagccccatgagtgcaaggaatgtgggaagaccttcaagctgcacagctacctgatccagcaccagatcatccacacagacctgaagccctatgagtgcaagcagtgtgggaaggccttcagccgggtgggggacctgaagacccaccagagcatccacgccggggagaagccctatgagtgcaaggaatgtgggaagaccttccggctgaacagccagctgatctaccaccagaccatccacacaggcctgaagccctacgtgtgcaaggagtgcaagaaggccttccgcagcatcagcggcctgagccagcacaagaggatccacactggagagaagccctatgagtgcaaggaatgtgacaaggccttcaacagaagtgaccggctgacccagcacgagaccatccacactggagtgaagccccagaagtgcaaggaatgtgggaaggccttcagccactgctaccagctgagccagcaccagcgcttccaccacggggagcggctgctgatgtag

SEQ ID NO: 43772 - DNA, 1668 bp, Artificial Sequence
  Description of Artificial Sequence: Synthetic coding sequence
atggccttcacccagctgaccttcagagatgtggccatcgagttcagccaggatgagtggaagtgcctgaacagcacccagaggaccctgtacagagatgtgatgctggagaactacagaaacctggtgtccctggacctgagcaggaactgtgtgatcaaggagctggccccccagcaggagggcaaccctggagaggtgttccacacagtgaccctggagcagcacgagaagcatgacatcgaggagttctgcttccgggagatcaagaagaagatccatgactttgactgccagtggagagatgatgaaagaaactgcaacaaggtgaccacagcccccaaggagaacctgacctgcagaagagaccagagggacagaagaggcatcggcaacaagagcatcaagcaccagctgggcctgtccttcctgccccacccccatgagctgcagcagttccaggccgagggcaagatctatgagtgcaaccacgtggagaagtctgtgaaccacggcagctctgtgtccccaccccagatcatcagcagcaccatcaagacccacgtgagcaacaagtatggaacagacttcatctgcagcagcctgctgacccaggagcagaagagctgcatccgggagaagccctaccgctacattgaatgtgacaaggccctgaaccacggcagccacatgacagtgcggcaggtgagccacagcggggagaagggctacaagtgtgacctgtgtgggaaggtgttcagccagaagagcaacctggcccggcactggagggtgcacactggagagaagccctacaagtgcaatgaatgtgacaggagcttcagcaggaacagctgcctggccctgcacagaagagtgcacactggagagaagccctacaagtgctatgaatgtgacaaggtgttcagcaggaacagctgcctggccctgcaccagaagacccacatcggggagaagccctacacctgcaaggaatgtgggaaggccttctctgtgcgcagcaccctgaccaaccaccaggtgatccacagcggcaagaagccctacaagtgcaatgaatgtgggaaggtgttcagccagaccagcagcctggccacccaccagaggatccacactggagagaagccctacaagtgcaatgaatgtgggaaggtgttcagccagaccagcagcctggcccggcactggaggatccacactggagagaagccctacaagtgcaatgaatgtgggaaggtgttctcctacaacagccacctggccagccacagaagagtgcacactggagagaagccctacaagtgcaatgaatgtgggaaggccttctctgtgcacagcaacctgaccacccaccaggtgatccacactggagagaagccctacaagtgcaaccagtgtgggaagggcttctctgtgcacagcagcctgaccacccaccaggtgatccacactggagagaagccctacaagtgcaatgaatgtgggaagagcttctctgtgcggcccaacctgaccaggcaccagatcatccacacaggcaagaagccctacaagtgcagcgactgtgggaagagcttctctgtgcggcccaacctcttccgccaccagatcatccacaccaaggagaagccctacaagaggaactag

SEQ ID NO: 43773 - DNA, 1704 bp, Artificial Sequence
  Description of Artificial Sequence: Synthetic coding sequence
atgcctgagctgtacacagaggacttcatccagggctgtgatgtgggggagctgcaggagcccggcctgcccggcctggagtgcaatggagccatcagcgcccactgcaacctgcggctgcctgacagcaatgacagccctgccagcgccagccgggtggccggcatcacagacctgagcaggaactgtgtgatcaaggagctggccccccagcaggagggcaaccctggagaggtgttccacacagtgaccctggagcagcacgagaagcatgacatcgaggagttctgcttccgggagatcaagaagaagatccatgactttgactgccagtggagagatgatgaaagaaactgcaacaaggtgaccacagcccccaaggagaacctgacctgcagaagagaccagagggacagaagaggcatcggcaacaagagcatcaagcaccagctgggcctgtccttcctgccccacccccatgagctgcagcagttccaggccgagggcaagatctatgagtgcaaccacgtggagaagtctgtgaaccacggcagctctgtgtccccaccccagatcatcagcagcaccatcaagacccacgtgagcaacaagtatggaacagacttcatctgcagcagcctgctgacccaggagcagaagagctgcatccgggagaagccctaccgctacattgaatgtgacaaggccctgaaccacggcagccacatgacagtgcggcaggtgagccacagcggggagaagggctacaagtgtgacctgtgtgggaaggtgttcagccagaagagcaacctggcccggcactggagggtgcacactggagagaagccctacaagtgcaatgaatgtgacaggagcttcagcaggaacagctgcctggccctgcacagaagagtgcacactggagagaagccctacaagtgctatgaatgtgacaaggtgttcagcaggaacagctgcctggccctgcaccagaagacccacatcggggagaagccctacacctgcaaggaatgtgggaaggccttctctgtgcgcagcaccctgaccaaccaccaggtgatccacagcggcaagaagccctacaagtgcaatgaatgtgggaaggtgttcagccagaccagcagcctggccacccaccagaggatccacactggagagaagccctacaagtgcaatgaatgtgggaaggtgttcagccagaccagcagcctggcccggcactggaggatccacactggagagaagccctacaagtgcaatgaatgtgggaaggtgttctcctacaacagccacctggccagccacagaagagtgcacactggagagaagccctacaagtgcaatgaatgtgggaaggccttctctgtgcacagcaacctgaccacccaccaggtgatccacactggagagaagccctacaagtgcaaccagtgtgggaagggcttctctgtgcacagcagcctgaccacccaccaggtgatccacactggagagaagccctacaagtgcaatgaatgtgggaagagcttctctgtgcggcccaacctgaccaggcaccagatcatccacacaggcaagaagccctacaagtgcagcgactgtgggaagagcttctctgtgcggcccaacctcttccgccaccagatcatccacaccaaggagaagccctacaagaggaactag

SEQ ID NO: 43774 - DNA, 1629 bp, Artificial Sequence
  Description of Artificial Sequence: Synthetic coding sequence
atgtgggagcacaggaaggagccctggaccatcgagagccaggtgcgggtggccaggaagcccaagggctgggagtggatcaagggcgtgaagacagacctgagcaggaactgtgtgatcaaggagctggccccccagcaggagggcaaccctggagaggtgttccacacagtgaccctggagcagcacgagaagcatgacatcgaggagttctgcttccgggagatcaagaagaagatccatgactttgactgccagtggagagatgatgagaggaactgcaacaaggtgaccacagcccccaaggagaacctgacctgccggcgggaccagagggaccggcggggcatcggcaacaagagcatcaagcaccagctgggcctgtccttcctgccccacccccatgagctgcagcagttccaggccgagggcaagatctatgagtgcaaccacgtggagaagtctgtgaaccacggcagctctgtgagccccccccagatcatcagcagcaccatcaagacccacgtgagcaacaagtatggaacagacttcatctgcagcagcctgctgacccaggagcagaagagctgcatccgggagaagccctaccgctacattgaatgtgacaaggccctgaaccacggcagccacatgacagtgcggcaggtgagccacagcggggagaagggctacaagtgtgacctgtgtgggaaggtgttcagccagaagagcaacctggcccggcactggagggtgcacactggagagaagccctacaagtgcaatgaatgtgaccgctccttcagcaggaacagctgcctggccctgcaccggcgggtgcacactggagagaagccctacaagtgctatgaatgtgacaaggtgttcagcaggaacagctgcctggccctgcaccagaagacccacatcggggagaagccctacacctgcaaggaatgtgggaaggccttctctgtgcgcagcaccctgaccaaccaccaggtgatccacagcggcaagaagccctacaagtgcaatgaatgtgggaaggtgttcagccagaccagcagcctggccacccaccagaggatccacactggagagaagccctacaagtgcaatgaatgtgggaaggtgttcagccagaccagcagcctggcccggcactggaggatccacactggagagaagccctacaagtgcaatgaatgtgggaaggtgttctcctacaacagccacctggccagccaccggcgggtgcacactggagagaagccctacaagtgcaatgaatgtgggaaggccttctctgtgcacagcaacctgaccacccaccaggtgatccacactggagagaagccctacaagtgcaaccagtgtgggaagggcttctctgtgcacagcagcctgaccacccaccaggtgatccacactggagagaagccctacaagtgcaatgaatgtgggaagagcttctctgtgcggcccaacctgaccaggcaccagatcatccacacaggcaagaagccctacaagtgcagcgactgtgggaagagcttctctgtgcggcccaacctcttccgccaccagatcatccacaccaaggagaagccctacaagagaaattag

SEQ ID NO: 43775 - DNA, 1812 bp, Artificial Sequence
  Description of Artificial Sequence: Synthetic coding sequence
atgcctgagctgtacacagaggacttcatccagggctgtgatgtgggggagctgcaggagcccggcctgcccggggtgctgtcctatgtgggcgcccaggagcgggccctggaccacaggaagcccagcaccagcagcaagaagaccaagagggtgggcatggaccagagatgtgaaaatcggctggagtgcaatggagccatcagcgcccactgcaacctgcggctgcctgacagcaatgacagccctgccagcgccagccgggtggccggcatcacagacctgagcaggaactgtgtgatcaaggagctggccccccagcaggagggcaaccctggagaggtgttccacacagtgaccctggagcagcacgagaagcatgacatcgaggagttctgcttccgggagatcaagaagaagatccatgactttgactgccagtggagagatgatgaaagaaactgcaacaaggtgaccacagcccccaaggagaacctgacctgcagaagagaccagagggacagaagaggcatcggcaacaagagcatcaagcaccagctgggcctgtccttcctgccccacccccatgagctgcagcagttccaggccgagggcaagatctatgagtgcaaccacgtggagaagtctgtgaaccacggcagctctgtgtccccaccccagatcatcagcagcaccatcaagacccacgtgagcaacaagtatggaacagacttcatctgcagcagcctgctgacccaggagcagaagagctgcatccgggagaagccctaccgctacattgaatgtgacaaggccctgaaccacggcagccacatgacagtgcggcaggtgagccacagcggggagaagggctacaagtgtgacctgtgtgggaaggtgttcagccagaagagcaacctggcccggcactggagggtgcacactggagagaagccctacaagtgcaatgaatgtgacaggagcttcagcaggaacagctgcctggccctgcacagaagagtgcacactggagagaagccctacaagtgctatgaatgtgacaaggtgttcagcaggaacagctgcctggccctgcaccagaagacccacatcggggagaagccctacacctgcaaggaatgtgggaaggccttctctgtgcgcagcaccctgaccaaccaccaggtgatccacagcggcaagaagccctacaagtgcaatgaatgtgggaaggtgttcagccagaccagcagcctggccacccaccagaggatccacactggagagaagccctacaagtgcaatgaatgtgggaaggtgttcagccagaccagcagcctggcccggcactggaggatccacactggagagaagccctacaagtgcaatgaatgtgggaaggtgttctcctacaacagccacctggccagccacagaagagtgcacactggagagaagccctacaagtgcaatgaatgtgggaaggccttctctgtgcacagcaacctgaccacccaccaggtgatccacactggagagaagccctacaagtgcaaccagtgtgggaagggcttctctgtgcacagcagcctgaccacccaccaggtgatccacactggagagaagccctacaagtgcaatgaatgtgggaagagcttctctgtgcggcccaacctgaccaggcaccagatcatccacacaggcaagaagccctacaagtgcagcgactgtgggaagagcttctctgtgcggcccaacctcttccgccaccagatcatccacaccaaggagaagccctacaagaggaactag

SEQ ID NO: 43776 - DNA, 1812 bp, Artificial Sequence; identical to SEQ ID NO: 43775
  Description of Artificial Sequence: Synthetic coding sequence

SEQ ID NO: 43777 - DNA, 1668 bp, Artificial Sequence
  Description of Artificial Sequence: Synthetic coding sequence
atggatggagatggcctgaccttcagagatgtggccatcgagttcagccaggatgagtggaagtgcctgaacagcacccagaggaccctgtacagagatgtgatgctggagaactacagaaacctggtgtccctggacctgagcaggaactgtgtgatcaaggagctggccccccagcaggagggcaaccctggagaggtgttccacacagtgaccctggagcagcacgagaagcatgacatcgaggagttctgcttccgggagatcaagaagaagatccatgactttgactgccagtggagagatgatgaaagaaactgcaacaaggtgaccacagcccccaaggagaacctgacctgcagaagagaccagagggacagaagaggcatcggcaacaagagcatcaagcaccagctgggcctgtccttcctgccccacccccatgagctgcagcagttccaggccgagggcaagatctatgagtgcaaccacgtggagaagtctgtgaaccacggcagctctgtgtccccaccccagatcatcagcagcaccatcaagacccacgtgagcaacaagtatggaacagacttcatctgcagcagcctgctgacccaggagcagaagagctgcatccgggagaagccctaccgctacattgaatgtgacaaggccctgaaccacggcagccacatgacagtgcggcaggtgagccacagcggggagaagggctacaagtgtgacctgtgtgggaaggtgttcagccagaagagcaacctggcccggcactggagggtgcacactggagagaagccctacaagtgcaatgaatgtgacaggagcttcagcaggaacagctgcctggccctgcacagaagagtgcacactggagagaagccctacaagtgctatgaatgtgacaaggtgttcagcaggaacagctgcctggccctgcaccagaagacccacatcggggagaagccctacacctgcaaggaatgtgggaaggccttctctgtgcgcagcaccctgaccaaccaccaggtgatccacagcggcaagaagccctacaagtgcaatgaatgtgggaaggtgttcagccagaccagcagcctggccacccaccagaggatccacactggagagaagccctacaagtgcaatgaatgtgggaaggtgttcagccagaccagcagcctggcccggcactggaggatccacactggagagaagccctacaagtgcaatgaatgtgggaaggtgttctcctacaacagccacctggccagccacagaagagtgcacactggagagaagccctacaagtgcaatgaatgtgggaaggccttctctgtgcacagcaacctgaccacccaccaggtgatccacactggagagaagccctacaagtgcaaccagtgtgggaagggcttctctgtgcacagcagcctgaccacccaccaggtgatccacactggagagaagccctacaagtgcaatgaatgtgggaagagcttctctgtgcggcccaacctgaccaggcaccagatcatccacacaggcaagaagccctacaagtgcagcgactgtgggaagagcttctctgtgcggcccaacctcttccgccaccagatcatccacaccaaggagaagccctacaagaggaactag

SEQ ID NO: 43778 - DNA, 567 bp, Artificial Sequence
  Description of Artificial Sequence: Synthetic coding sequence
atgacagagacccgggagcctgctgagaccggcggctacgccagcctggaggaggatgatgaggacctgagccctggccctgagcacagcagtgacagcgagtacaccctgtctgagccagacagcgaggaggaggaggatgaggaggaggaggaggaggagaccacagatgatcctgaatatgaccccggctacaaggtgaagcagaggctgggcggcggccggggcggccccagccggcgggcccccagggctgcccagcccccagcccagccctgccagctgtgtggccgcagccccctgggggaggcccctcctggcaccccaccctgccgcctgtgctgcccagccacagccccccaggaggccccagcccctgagggccgggccctgggggaggaggaggaggagccccccagggctggggagggccggcctgctggccgggaggaggaggaggaggaggaggaggagggcacctaccactgcacagaatgtgaagattcttttgacaacctgggggagctgcacggccacttcatgctgcacgcccggggggaggtgtag

SEQ ID NO: 43779 - DNA, 375 bp, Artificial Sequence
  Description of Artificial Sequence: Synthetic coding sequence
atgacagagacccgggagcctgctgagaccggcggctacgccagcctggaggaggatgatgaggacctgagccctggccctgagcacagcagtgacagcgagtacaccctgtctgagccagacagcgaggaggaggaggatgaggaggaggaggaggaggagaccacagatgatcctgaatatgaccccggctacaaggtgaagcagaggctgggcggcggccggggcggccccagccggcgggcccccagggctgcccagcccccagcccagccctgccagctgtgtggccgcagccccctgggggaggcccctcctggcaccccaccctatggagagctgggccggcggggcggcgtgggcggcggcggctag

SEQ ID NO: 43780 - DNA, 2412 bp, Artificial Sequence
  Description of Artificial Sequence: Synthetic coding sequence
atggatgtggccatcgagttctgcctggaggagtggcagtgcctggacatcgcccagcagaacctgtacagaaatgtgatgctggagaactacagaaacctggtgttcctgggcattgctgtgtccaagccagacctgatcacctgcctggagcaggagaaggagccctgggagcccatgagaagacatgagatggtggccaagccccctgtgatgtgcagccacttcacccaggacttctggccagagcagcacatcaaggaccccttccagaaggccaccctgcggcgctacaagaactgtgagcacaagaatgtgcacctgaagaaggaccacaagtctgtggatgagtgcaaggtgcacagaggaggctacaacggcttcaaccagtgcctgcctgccacccagagcaagatcttcctgtttgacaagtgtgtgaaggccttccacaagttcagcaacagcaacagacacaagatcagccacacagagaagaagctgttcaagtgcaaggaatgtgggaagagcttctgcatgctgccccacctggcccagcacaagatcatccacaccagggtgaacttctgcaagtgtgagaagtgtgggaaggccttcaactgccccagcatcatcaccaagcacaagaggatcaacacaggagagaagccctacacctgtgaggagtgtgggaaggtgttcaactggagcagccggctgaccacccacaagaagaactacacccgctacaagctgtacaagtgtgaggagtgtgggaaggccttcaacaagagcagcatcctgaccacccacaagatcatcagaactggagagaagttctacaagtgcaaggaatgtgccaaggccttcaaccagagcagcaacctgacagagcacaagaagatccaccctggagagaagccctacaagtgtgaggagtgtgggaaggccttcaactggcccagcaccctgaccaagcacaagaggatccacactggagagaagccctacacctgtgaggagtgtgggaaggccttcaaccagttcagcaacctgaccacccacaagaggatccacacagctgagaagttctacaagtgcacagaatgtggggaggccttcagccgcagcagcaacctgaccaagcacaagaagatccacacagagaagaagccctacaagtgtgaggagtgtgggaaggccttcaagtggagcagcaagctgacagagcacaagctgacccacactggagagaagccctacaagtgtgaggagtgtgggaaggccttcaactggcccagcaccctgaccaagcacaaccgcatccacactggagagaagccctacaagtgtgaggtgtgtgggaaggccttcaaccagttcagcaacctgaccacccacaagaggatccacacagctgagaagccctacaagtgtgaggagtgtgggaaggccttcagccgcagcagcaacctgaccaagcacaagaagatccacatcgagaagaagccctacaagtgtgaggagtgtgggaaggccttcaagtggagcagcaagctgacagagcacaagatcacccacactggagagaagccctacaagtgtgaggagtgtgggaaggccttcaaccacttcagcatcctgaccaagcacaagaggatccacactggagagaagccctacaagtgtgaggagtgtgggaaggccttcacccagagcagcaacctgaccacccacaagaagatccacactggagagaagttctacaagtgtgaggagtgtgggaaggccttcacccagagcagcaacctgaccacccacaagaagatccacactggaggcaagccctacaagtgtgaggagtgtgggaaggccttcaaccagttcagcaccctgaccaagcacaagatcatccacacagaggagaagccctacaagtgtgaggagtgtgggaaggccttcaagtggagcagcaccctgaccaagcacaagatcatccacactggagagaagccctacaagtgtgaggagtgtgggaaggccttcaagctgagcagcaccctgagcacccacaagatcatccacactggagagaagccctacaagtgtgagaagtgtgggaaggccttcaacagaagcagcaacctgattgagcacaagaagatccacactggagagcagccctacaagtgtgaggagtgtgggaaggccttcaactacagcagccacctgaacacccacaagaggatccacaccaaggagcagccctacaagtgcaaggaatgtgggaaggccttcaaccagtacagcaacctgaccacccacaacaagatccacactggagagaagctgtacaagccagaagatgtgaccgtcatcctgaccaccccccagaccttcagcaacatcaagtag

SEQ ID NO: 43781 - DNA, 1095 bp, Artificial Sequence
  Description of Artificial Sequence: Synthetic coding sequence
atggagcggggcaagaagaagaggatcagcaacaagctgcagcagaccttccaccacagcaaggagcccaccttcctgatcaaccaggccggcctgctgagcagtgacagctacagcagcctgagccctgagacagaatctgtgaaccctggagagaacatcaagacagacacccagaagaagaggcctggcaccgtcatcctgagcaagctgagcagccgccgcatcatcagcgagagccagctgagcccccctgtgatcccagcccggcggcccggcttccgggtgtgctacatctgtggccgggagtttggcagccagagcatcgccatccacgagccccagtgcctgcagaagtggcacatcgagaacagcaagctgcccaagcacctgcggcggcctgagcccagcaagccccagagcctgagcagcagcggcagctacagcctgcaggccaccaatgaggccgccttccagagcgcccaggcccagctgctgccctgtgagagctgtggccgcaccttcctgcctgaccacctgctggtgcaccacaggagctgcaagcccaagggggagggcccccgggccccccacagcaacagcagtgaccacctgaccggcctgaagaaggcctgcagcggcaccccagcccggcccaggacagtcatctgctacatctgtgggaaggagtttggcaccctgagcctgcccatccacgagcccaagtgcctggagaagtggaagatggagaatgaccggctgcctgtggagctgcaccagcccctgccccagaagccccagcccctgcccaatgcccagagcagccaggccggccccaaccaggcccagctggtgttctgcccccactgcagccgcatcttcaccagtgaccggctgctggtgcaccagaggagctgcaagacccacccctacggccccaagtaccagaacctgaacctgggcagcaaaggaggcctgaaggagtacaccaacagcaagcagcagaggaacagagctgcccccagcgtgacagacaaggtgattcatgccacccaggatgccctgggggagcccggcggggccctgtgcctgtag

SEQ ID NO: 43782 - DNA, 192 bp, Artificial Sequence
  Description of Artificial Sequence: Synthetic coding sequence
atggagcggggcaagaagaagaggatcagcaacaagctgcagcagaccttccaccacagcaaggagcccaccttcctgatcaaccaggccggcctgctgagcagtgacagctacagcagcctgagccctgagacagaatctgtgaaccctggagagaacatcaagacagacacccagaagaagaggccctag

SEQ ID NO: 43783 - DNA, 111 bp, Artificial Sequence
  Description of Artificial Sequence: Synthetic coding sequence
atggagcggggcaagaagaagaggatcagcaacaagctgcagcagaccttccaccacagcaaggagcccaccttcctgatcaaccaggccggcctgctgagcagtgactag

SEQ ID NO: 43784 - DNA, 4452 bp, Artificial Sequence
  Description of Artificial Sequence: Synthetic coding sequence
atgcccagcgagcagaagcagctgttctgtgatgagaagcagaccaccctgaagaaggactatgatgtgaagaatgaaattgtggacagaagtgcccccaagcccaagatcagcggcagcatccactacgccctgaagaatgtgaagattgacctgcccaagatcaacatccccaatgaggtgctgctgaagcatgaggtggacaagtacaggaagctgttccagagcaagcagcagacagccaggaagagcatcagcatcaagacagtgtcctgtgtggaggagtgcaccctgctgcacaagtcagaaagagctgaggaggagggcgtgaagatgtctgccaagatcctgaacttcagctgcctgaagtgccgggacaacacccgctacagccccaatgacctgcagaagcacttccagatgtggcaccacggggagctgcccagctacccctgtgagatgtgcaacttcagcgccaatgacttccaggtgttcaagcagcacaggaggacccacaggagcaccctggtgaagtgtgacatctgcaacaatgaatctgtgtacaccctgctgaacctgaccaagcacttcaccagcacccactgtgtgaatggaaacttccagtgtgagaagtgcaagttcagcacccaggatgtgggcacctttgtgcagcacatccaccgccacaatgagatccactacaagtgtgggaagtgccaccacgtgtgcttcaccaagggggagctgcagaagcacctgcacatccacagcggcaccttccccttcacctgccagtactgcagctatggagccacccggcgggagcacctggtgcgccacgtgatcaccctgcacaaggagcacctgtatgccaaggagaagctggagaaggacaagtatgagaagaggatggccaagaccagcgctggcctgaagctgatcctgaagcgctacaagatcggggccagcaggaagaccttctggaagaggaagaagatcaacagcggcagtgacaggagcattgagaagaacacccaggtgctgaagaagatgaacaagacccagaccaagtctgaggaccagagccacgtggtgcaggagcacctgtctgaggagaaggatgagcggctgcactgtgagaacaatgacaaggcccctgagagcgagagcgagaagcccacccccctgagcacaggccagggcaacagagctgaggagggccccaatgccagcagcggcttcatgaagacagctgtgctgggccccaccctgaagaatgtgatgatgaagaacaacaagctggccgtgagccccaactacaatgccaccttcatgggcttcaagatgatggatggcaagcagcacatcgtgctgaagctggtgcccatcaagcagaatgtgtgcagccctggcagccagagcggggccgccaaggatggaacagccaacctgcagccccagaccctggacaccaacggcttcctgactggagtgaccacagagctgaatgacacagtgtacatgaaggccgccacccccttcagctgcagcagcagcatcctgagcggcaaggccagcagcgagaaggagatgaccctcatcagccagaggaacaacatgctgcagaccatggactatgagaagtctgtgagcagcctgagcgccaccagcgagctggtgacagcctctgtgaacctgaccaccaagtttgagacccgggacaacgtggacttctggggcaaccacctgacccagagccaccctgaggtgctgggcaccaccatcaagagcccagacaaggtgaactgtgtggccaagcccaatgcctacaacagcggggacatgcacaactactgcatcaactacggcaactgtgagctgcctgtggagagcagcaaccagggcagcctgcccttccacaactacagcaaggtgaacaacagcaacaagagaagacgcttctctggaacagctgtgtatgagaacccccagcgggagagcagcagcagcaagacagtggtgcagcagcccatcagcgagagcttcctgagcctggtgcggcaggagagcagcaagccagacagcctgctggccagcatcagcctgctgaatgacaaggatggcaccctgaaggccaagtcagaaattgaggagcagtatgtgctggagaagggccagaacattgatggccagaacctgtacagcaatgaaaaccagaacctggagtgtgccacagagaagagcaagtgggaggacttcagcaatgtggacagccccatgatgccccgcatcaccagcgtcttcagcctgcagagccagcaggccagcgagttcctgcccccagaggtgaaccagctgctgcaggatgtgctgaagatcaagccagatgtgaagcaggacagcagcaacacccccaacaagggcctgcccctgcactgtgaccagagcttccagaagcatgagcgggagggcaagatcgtggagagcagcaaggacttcaaggtgcagggcatcttccctgtgcccccaggctctgtgggcatcaacgtgcccaccaatgacctgaacctgaagtttgggaaggagaagcaggtgagcagcatcccccaggatgtgcgggacagcgagaagatgccccgcatcagcggcttcggcaccctgctgaagacccagagtgatgccatcatcacccagcagctggtgaaggacaagctgcgggccaccacccagaacctgggcagcttctacatgcagagccccctgctgaacagcgagcagaagaagaccatcatcgtgcagaccagcaagggcttcctgatccccctgaacatcaccaacaagccaggcctgcctgtgattcctggaaatgccctgcccctggtgaacagccagggcatcccagccagcctgtttgtgaacaagaagccaggcatggtgctgaccctgaacaacgggaagctggagggcgtgtctgctgtgaagacagaaggagccccagcccggggcaccgtgaccaaggagccctgcaagacccccatcctgaaggtggagcccaacaacaactgcctgaccccaggcctgtgcagcagcatcggcagctgcctgtccatgaagagcagcagcgagaacaccctgcccctgaagggcccctacatcctgaagcccaccagctctgtgaaggctgtgctgatccccaacatgctgtctgagcagcagagcaccaagctgaacatcagtgacagcgtgaagcagcagaatgagatcttccccaagccacccctgtacaccttcctgcctgatggcaagcaggccgtgttcctgaagtgtgtgatgcccaacaagacagagctgctgaagcccaagctggtgcagaacagcacctaccagaacatccagcccaagaagccagagggcaccccccagaggatcctgctgaagatcttcaaccctgtgctgaatgtgacagctgccaacaacctgtctgtgagcaacagcgccagcagcctgcagaaggacaacgtgcccagcaaccagatcatcggcggggagcagaaggagcctgagagcagagatgccctgcccttcctgctggatgacctgatgcctgccaatgagatcgtcatcaccagcacagccacctgcccagagagcagcgaggagcccatctgtgtgtctgactgcagcgagagccgggtgctgcgctgcaagaccaactgcagaattgaaagaaacttcaacaggaagaagaccagcaagaagatcttcagcaagaccaagacccacggcagcaaggacagcgagacagcctttgtgtccaggaacagaaactgcaagaggaagtgccgggacagctaccaggagccccccaggaggaaggccaccctgcacaggaagtgcaaggagaaggccaagccagaagatgtgcgggagaccttcggcttcagccggccccggctgagcaaggacagcatccgcaccctgcggctcttccccttcagcagcaagcagctggtgaagtgccccaggaggaaccagcctgtggtggtgctgaaccacccagatgctgatgcccctgaggtggtgtctgtgatgaagaccatcgccaagttcaatggacatgtgctgaaggtgtccctgagcaagaggaccatcaatgccctgctgaagcctgtgtgctacaacccccccaagaccacctatgatgacttcagcaagaggcacaagaccttcaagcctgtgtcctctgtgaaggagagatttgtgctgaagctgaccctgaagaagaccagcaagaacaactaccagatcgtgaagaccaccagcgagaacatcctgaaggccaagttcaactgctggttctgtggccgggtgtttgacaaccaggacacctgggccggccacggccagaggcacctgatggaggccacccgggactggaacatgctggagtag

SEQ ID NO: 43785 - DNA, 1734 bp, Artificial Sequence
  Description of Artificial Sequence: Synthetic coding sequence
atggctgtgggcctgtgcaaggccatgagccagggcctggtgaccttcagagatgtggccctggacttcagccaggaggagtgggagtggctgaagcccagccagaaggacctgtacagagatgtgatgctggagaactacagaaacctggtgtggctggactgggagagctggtgtgaaattgaggagctgagccccaagtggttcattgatgaagatgagatcagccaggagatggtgatggagcggctggccagccacggcctggagtgcagcagcttccgggaggcctggaagtacaagggggagtttgagctgcaccagggcaatgctgagcggcacttcatgcaggtgacagctgtgaaggagatcagcacaggcaagagggacaatgagttcagcaacagcggccgcagcatccccctgaagagcgtcttcctgacccagcagaaggtgcccaccatccagcaggtgcacaagtttgacatctatgacaagctgttcccccagaacagcgtcatcatcgagtacaagaggctgcacgccgagaaggagagcctgattggaaatgaatgtgaggagttcaaccagagcacctacctgagcaaggacatcggcatccccccaggagagaagccctatgagagccatgacttcagcaagctgctgtccttccacagcctcttcacccagcaccagaccacccactttgggaagctgccccacggctatgatgaatgtggagatgccttcagctgctacagcttcttcacccagccccagaggatccacagcggggagaagccctatgcctgcaatgactgtgggaaggccttcagccatgacttcttcctgtctgagcaccagaggacccacatcggggagaagccctatgagtgcaaggagtgcaacaaggccttccggcagagcgcccacctggcccagcaccagaggatccacactggagagaagccctttgcctgcaatgaatgtgggaaggccttcagccgctatgccttcctggtggagcaccagaggatccacactggagagaagccctatgagtgcaaggagtgcaacaaggccttccggcagagcgcccacctgaaccagcaccagaggatccacactggagagaagccctatgagtgcaaccagtgtgggaaggccttcagcagaagaattgccctgaccctgcaccagaggatccacactggagagaagcccttcaagtgcagtgaatgtgggaagaccttcggctaccgcagccacctgaaccagcaccagaggatccacactggagagaagccctatgagtgcatcaagtgtgggaagttcttcagaacagacagccagctgaacagacaccaccgcatccacactggagagcggccctttgaatgttccaaatgtgggaaggccttcagtgatgccctggtgctgatccaccacaagaggagccatgctggggagaagccctatgagtgcaacaagtgtgggaaggccttcagctgtggcagctacctgaaccagcaccagaggatccacactggagagaagccctatgaatgttctgaatgtgggaaggccttccaccagatcctgagcctgcggctgcaccagagaattcatgctggggagaagccctacaagtgcaatgaatgtggcaacaacttcagctgtgtgtctgccctgcggcggcaccagaggatccacaaccgggagaccctgtag

SEQ ID NO: 43786 - DNA, 1830 bp, Artificial Sequence
  Description of Artificial Sequence: Synthetic coding sequence
atggctgtgggcctgtgcaaggccatgagccagggcctggtgaccttcagagatgtggccctggacttcagccaggaggagtgggagtggctgaagcccagccagaaggacctgtacagagatgtgatgctggagaactacagaaacctggtgtggctgggcctgagcatcagcaagcccaacatgatcagcctgctggagcagggcaaggagccctggatggtggagaggaagatgagccagggccactgtgccgactgggagagctggtgtgaaattgaggagctgagccccaagtggttcattgatgaagatgagatcagccaggagatggtgatggagcggctggccagccacggcctggagtgcagcagcttccgggaggcctggaagtacaagggggagtttgagctgcaccagggcaatgctgagcggcacttcatgcaggtgacagctgtgaaggagatcagcacaggcaagagggacaatgagttcagcaacagcggccgcagcatccccctgaagagcgtcttcctgacccagcagaaggtgcccaccatccagcaggtgcacaagtttgacatctatgacaagctgttcccccagaacagcgtcatcatcgagtacaagaggctgcacgccgagaaggagagcctgattggaaatgaatgtgaggagttcaaccagagcacctacctgagcaaggacatcggcatccccccaggagagaagccctatgagagccatgacttcagcaagctgctgtccttccacagcctcttcacccagcaccagaccacccactttgggaagctgccccacggctatgatgaatgtggagatgccttcagctgctacagcttcttcacccagccccagaggatccacagcggggagaagccctatgcctgcaatgactgtgggaaggccttcagccatgacttcttcctgtctgagcaccagaggacccacatcggggagaagccctatgagtgcaaggagtgcaacaaggccttccggcagagcgcccacctggcccagcaccagaggatccacactggagagaagccctttgcctgcaatgaatgtgggaaggccttcagccgctatgccttcctggtggagcaccagaggatccacactggagagaagccctatgagtgcaaggagtgcaacaaggccttccggcagagcgcccacctgaaccagcaccagaggatccacactggagagaagccctatgagtgcaaccagtgtgggaaggccttcagcagaagaattgccctgaccctgcaccagaggatccacactggagagaagcccttcaagtgcagtgaatgtgggaagaccttcggctaccgcagccacctgaaccagcaccagaggatccacactggagagaagccctatgagtgcatcaagtgtgggaagttcttcagaacagacagccagctgaacagacaccaccgcatccacactggagagcggccctttgaatgttccaaatgtgggaaggccttcagtgatgccctggtgctgatccaccacaagaggagccatgctggggagaagccctatgagtgcaacaagtgtgggaaggccttcagctgtggcagctacctgaaccagcaccagaggatccacactggagagaagccctatgaatgttctgaatgtgggaaggccttccaccagatcctgagcctgcggctgcaccagagaattcatgctggggagaagccctacaagtgcaatgaatgtggcaacaacttcagctgtgtgtctgccctgcggcggcaccagaggatccacaaccgggagaccctgtag

SEQ ID NO: 43787 - DNA, 1674 bp, Artificial Sequence
  Description of Artificial Sequence: Synthetic coding sequence
actggcctgagcatcagcaagcccaacatgatcagcctgctggagcagggcaaggagccctggatggtggagaggaagatgagccagggccactgtgccgactgggagagctggtgtgaaattgaggagctgagccccaagtggttcattgatgaagatgagatcagccaggagatggtgatggagcggctggccagccacggcctggagtgcagcagcttccgggaggcctggaagtacaagggggagtttgagctgcaccagggcaatgctgagcggcacttcatgcaggtgacagctgtgaaggagatcagcacaggcaagagggacaatgagttcagcaacagcggccgcagcatccccctgaagagcgtcttcctgacccagcagaaggtgcccaccatccagcaggtgcacaagtttgacatctatgacaagctgttcccccagaacagcgtcatcatcgagtacaagaggctgcacgccgagaaggagagcctgattggaaatgaatgtgaggagttcaaccagagcacctacctgagcaaggacatcggcatccccccaggagagaagccctatgagagccatgacttcagcaagctgctgtccttccacagcctcttcacccagcaccagaccacccactttgggaagctgccccacggctatgatgaatgtggagatgccttcagctgctacagcttcttcacccagccccagaggatccacagcggggagaagccctatgcctgcaatgactgtgggaaggccttcagccatgacttcttcctgtctgagcaccagaggacccacatcggggagaagccctatgagtgcaaggagtgcaacaaggccttccggcagagcgcccacctggcccagcaccagaggatccacactggagagaagccctttgcctgcaatgaatgtgggaaggccttcagccgctatgccttcctggtggagcaccagaggatccacactggagagaagccctatgagtgcaaggagtgcaacaaggccttccggcagagcgcccacctgaaccagcaccagaggatccacactggagagaagccctatgagtgcaaccagtgtgggaaggccttcagcagaagaattgccctgaccctgcaccagaggatccacactggagagaagcccttcaagtgcagtgaatgtgggaagaccttcggctaccgcagccacctgaaccagcaccagaggatccacactggagagaagccctatgagtgcatcaagtgtgggaagttcttcagaacagacagccagctgaacagacaccaccgcatccacactggagagcggccctttgaatgttccaaatgtgggaaggccttcagtgatgccctggtgctgatccaccacaagaggagccatgctggggagaagccctatgagtgcaacaagtgtgggaaggccttcagctgtggcagctacctgaaccagcaccagaggatccacactggagagaagccctatgaatgttctgaatgtgggaaggccttccaccagatcctgagcctgcggctgcaccagagaattcatgctggggagaagccctacaagtgcaatgaatgtggcaacaacttcagctgtgtgtctgccctgcggcggcaccagaggatccacaaccgggagaccctgtag

SEQ ID NO: 43788 - DNA, 1692 bp, Artificial Sequence
  Description of Artificial Sequence: Synthetic coding sequence
atggccaacagcagcttcatcggggaccacgtgcacggggcccctcatgctgtgatgcctgaggtggagttcccagaccagttcttcaccgtgctgaccatggaccacgagctggtgaccctgagagatgtggtgatcaacttcagccaggaggagtgggagtacctggacagcgcccagaggaacctgtactgggatgtgatgatggagaactacagcaacctgctgagcctggacctggagagcagaaatgagaccaagcacctgtctgtgggcaaggacatcatccagaacacaggcagccagtgggaggtgatggagagcagcaagctgtgtggcctggagggcagcatcttcagaaatgactggcagagcaagagcaagattgacctgcagggccctgaggtgggctacttcagccagatgaagatcatcagtgaaaatgtgcccagctacaagacccatgagagcctgaccctgcccaggaggacccatgattctgagaagccctatgagtacaaggagtatgagaaggtgttcagctgtgacctggagtttgatgagtaccagaagatccacactggaggcaagaactatgagtgcaaccagtgctggaagaccttcggcatcgacaacagctccatgctgcagctgaacatccacactggagtgaagccctgcaagtacatggagtatggcaacacctgcagcttctacaaggacttcaacgtgtaccagaagatccacaatgagaagttctacaagtgcaaggagtacagaaggacctttgagcgggtgggcaaggtgacccccctgcagagggtgcatgatggagagaagcactttgaatgttccttctgtgggaagagcttccgggtgcacgcccagctgaccaggcaccagaagatccacacagatgagaagacctacaagtgcatggagtgtgggaaggacttccgcttccacagccagctgacagagcaccagaggatccacactggagagaagccctacaagtgcatgcactgtgagaaggtgttccgcatcagcagccagctgattgagcaccagaggatccacactggagagaagccctatgcctgcaaggaatgtgggaaggcctttggagtgtgccgggagctggcccggcaccagaggatccacacaggcaagaagccctatgagtgcaaggcctgtgggaaggtgttcaggaacagcagcagcctgaccaggcaccagaggatccacactggagagaagccctacaagtgcaaggaatgtgagaaggcctttggagtgggcagcgagctgaccaggcatgagcgcatccacagcggccagaagccctatgagtgcaaggaatgtgggaagttcttccggctgaccagcgccctgatccagcaccagaggatccacagcggggagaagccctatgagtgcaaggtgtgtgggaaggccttccgccacagcagcgccctgacagagcaccagaggatccacactggagagaagccctatgagtgcaaggcctgtgggaaggccttccgccacagcagcagcttcaccaagcaccagaggatccacacagatgacaagccctatgagtgcaaggaatgtggcaacagcttctctgtggtgggccacctgacctgccagcccaagatctacacaggagagaagagctttgattag

SEQ ID NO: 43789 - DNA, 1692 bp, Artificial Sequence; identical to SEQ ID NO: 43788
  Description of Artificial Sequence: Synthetic coding sequence

SEQ ID NO: 43790 - DNA, 1209 bp, Artificial Sequence
  Description of Artificial Sequence: Synthetic coding sequence
atggctgctgtgatcctgcccagcacagctgcccccagcagcctcttccctgccagccagcagaagggccacacccagggcggggagctggtgaatgagctgctgacctcctggctgcggggcctggtgacctttgaagatgtggccgtggagttcacccaggaggagtgggccctgctggaccctgcccagaggaccctgtacagagatgtgatgctggagaactgcaggaacctggccagcctgggctgccgggtgaacaagcccagcctcatcagccagctggagcaggacaagaaggtggtgacagaggagcggggcatcctgcccagcacctgcccagacctggagaccctgctgaaggccaagtggctgacccccaagaagaatgtgttcaggaaggagcagagcaagggcgtgaagacagagaggagccaccggggcgtgaagctgaatgaatgcaaccagtgcttcaaggtgttcagcaccaagagcaacctgacccagcacaagaggatccacactggagagaagccctatgactgcagccagtgtgggaagagcttcagcagccgcagctacctgaccatccacaagaggatccacaatggagagaagccctatgagtgcaaccactgcggcaaggccttcagtgaccccagcagcctgcggctgcacctgcgcatccacactggagagaagccctatgagtgcaaccagtgcttccacgtgttccgcaccagctgcaacctgaagagccacaagaggatccacactggagagaaccaccacgagtgcaaccagtgtgggaaggccttcagcaccaggagcagcctgaccggccacaacagcatccacactggagagaagccctatgaatgtcatgactgtgggaagaccttcaggaagagcagctacctgacccagcacgtgaggacccacactggagagaagccctatgaatgtaatgaatgtgggaagagcttcagcagcagcttcagcctgactgtgcacaagaggatccacactggagagaagccctatgaatgtagtgactgtgggaaggccttcaacaacctgtctgctgtgaagaagcacctgcggacccacactggagagaagccctatgagtgcaaccactgcggcaagagcttcaccagcaacagctacctgtctgtgcacaagaggatccacaaccgctggatctag

SEQ ID NO: 43791 - DNA, 1098 bp, Artificial Sequence
  Description of Artificial Sequence: Synthetic coding sequence
atgagggagaagagcttccagtgcaatgaaacaggagaggccttcaactgcagcagctttgtgaggaagcaccagatcatccacctgggggagaagcagtacaagtttgacatctgtgggaaggtgttcaatgagaagcgctacctggcccggcaccggcgctgccacaccagcgagaagccctacaagtgcaatgaatgtgggaagagcttctcctacaagagcagcctgacctgccaccggcgctgccacactggagagaagccctacaagtgcaatgaatgtgggaagagcttctcctacaagagcagcctgacctgccaccaccgctgccacactggagagaagccctacaagtgcaatgaatgtgggaagagcttctcctacaagagcagcctgcgctgccaccggcggctgcacacaggcatcaagccctacaagtgcaatgaatgtgggaagatgtttggccagaacagcaccctggtgatccacaaggccatccacactggagagaagccctacaagtgcaatgaatgtgggaaggccttcaaccagcagagccacctgagccgccaccaccggctgcacactggagagaagccctacaagtgcaatgactgtgggaaggccttcatccaccagagcagcctggcccggcaccaccggctgcacactggagagaagagctacaagtgtgaggagtgtgacagagtcttcagccagaagagcaacctggagcggcacaagatcatccacactggagagaagccctacaagtgcaatgaatgccacaagaccttcagccacaggagcagcctgccctgccaccggcggctgcacagcggggagaagccctacaagtgcaatgaatgtgggaagaccttcaacgtgcagagccacctgagccgccaccaccggctgcacactggagagaagccctacaagtgcaaggtgtgtgacaaggccttcatgtgccacagctacctggccaaccacacccgcatccacagcggggagaagccctacaagtgcaatgaatgtgggaaggcccacaaccacctgattgacagcagcatcaagccctgcatgagcagctag

SEQ ID NO: 43792 - DNA, 1773 bp, Artificial Sequence
  Description of Artificial Sequence: Synthetic coding sequence
atgctgcacgaggaggccgcccagaagaggaagggcaaggagcccggcatggccctgccccagggccgcctgaccttcagagatgtggccatcgagttcagcctggccgagtggaagttcctgaacccagcccagagggccctgtaccgggaggtgatgctggagaactacagaaacctggaggccgtggacatcagcagcaagaggatgatgaaggaggtgctgagcacaggccagggcaacacagaggtgatccacacaggcatgctgcagagacatgagagctaccacactggagacttctgcttccaggagattgagaaggacatccatgactttgagttccagagccagaaggatgaaagaaatggacatgaggcctccatgcccaagatcaaggagctgatgggcagcacagacagacatgaccagagacatgctggcaacaagcccatcaaggaccagctgggcctgtccttccacctgcacctgcctgagctgcacatcttccagcctgaggagaagatcgccaaccaggtggagaagtctgtgaatgatgccagcagcatcagcaccagccagaggatcagctgcaggcctgagacccacacccccaacaactacggcaacaacttcttccacagcagcctgctgacccagaagcaggaggtgcacatgagggagaagagcttccagtgcaatgagaccggggaggccttcaactgcagcagctttgtgaggaagcaccagatcatccacctgggggagaagcagtacaagtttgacatctgtgggaaggtgttcaatgagaagcgctacctggcccggcaccggcgctgccacaccagcgagaagccctacaagtgcaatgaatgtgggaagagcttctcctacaagagcagcctgacctgccaccggcgctgccacactggagagaagccctacaagtgcaatgaatgtgggaagagcttctcctacaagagcagcctgacctgccaccaccgctgccacactggagagaagccctacaagtgcaatgaatgtgggaagagcttctcctacaagagcagcctgcgctgccaccggcggctgcacacaggcatcaagccctacaagtgcaatgaatgtgggaagatgtttggccagaacagcaccctggtgatccacaaggccatccacactggagagaagccctacaagtgcaatgaatgtgggaaggccttcaaccagcagagccacctgagccgccaccaccggctgcacactggagagaagccctacaagtgcaatgactgtgggaaggccttcatccaccagagcagcctggcccggcaccaccggctgcacactggagagaagagctacaagtgtgaagaatgtgacagagtcttcagccagaagagcaacctggagcggcacaagatcatccacactggagagaagccctacaagtgcaatgaatgccacaagaccttcagccacaggagcagcctgccctgccaccggcggctgcacagcggggagaagccctacaagtgcaatgaatgtgggaagaccttcaacgtgcagagccacctgagccgccaccaccggctgcacactggagagaagccctacaagtgcaaggtgtgtgacaaggccttcatgtgccacagctacctggccaaccacacccgcatccacagcggggagaagccctacaagtgcaatgaatgtgggaaggcccacaaccacctgattgacagcagcatcaagccctgcatgagcagctag

SEQ ID NO: 43793 - DNA, 1773 bp, Artificial Sequence; identical to SEQ ID NO: 43792
  Description of Artificial Sequence: Synthetic coding sequence

SEQ ID NO: 43794 - DNA, 279 bp, Artificial Sequence
  Description of Artificial Sequence: Synthetic coding sequence
atggagctggtgaccttcagagatgtggccatcgagttcagccctgaggagtggaagtgcctggaccctgcccagcagaacctgtacagagatgtgatgctggagaactacagaaacctggtgtccctgggctttgtgatcagcaacccagacctggtgacctgcctggagcagatcaaggagccctgcaacctgaagatccacgagacagctgccaagcccccaggcagtgacctgcaggtgtacaaggagagccagtgccccctgtaccgcctgtag

SEQ ID NO: 43795 - DNA, 2715 bp, Artificial Sequence
  Description of Artificial Sequence: Synthetic coding sequence
atggctgctgctgggggcgctgagggccggcgggctgacatggaggccgaggccgccgccgcccctgagcgggagggcggcagctgtgtgctgtgctgcggggacctggaggccacagccctgggccgctgtgaccaccctgtgtgctaccgctgcagcaccaagatgagggtgctgtgtgagcagcgctactgtgctgtgtgccgggaggagctgcggcaggtggtgtttgggaagaagctgcctgcctttgccaccatccccatccaccagctgcagcacgagaagaagtatgacatctactttgctgatggcaaggtgtatgccctgtaccggcagctgctgcagcacgagtgcccccgctgcccagagctgccccccttcagcctgtttggagacctggagcagcacatgaggcggcagcacgagctgttctgctgccgcctgtgcctgcagcacctgcagatcttcacctatgaaaggaagtggtacagcaggaaggacctggcccggcacaggatgcagggcgaccctgatgacaccagccaccggggccaccccctgtgcaagttctgtgatgagcgctacctggacaatgatgagctgctgaagcacctgcggcgggaccactacttctgccacttctgtgacagtgatggagcccaggactactacagcgactatgcctacctgcgggagcacttccgggagaagcacttcctgtgtgaggagggccgctgcagcacagagcagttcacccacgccttcagaacagaaattgacctgaaggcccacaggacagcctgccacagccgcagcagagctgaggcccggcagaacagacacatcgacctgcagttctcctatgcccccaggcacagcagaagaaatgaaggagtggtgggcggggaggactatgaggaggtggaccgctacagccggcagggccgggtggcccgggccggcaccaggggggcccagcagagccggcggggctcctggagatacaagcgggaggaggaggaccgggaggtggccgctgctgtgcgggcctctgtggccgcccagcagcaggaggaggcccggcgctctgaggaccaggaggagggcggccggcccaagaaggaggaggccgccgcccggggccctgaggacccccggggcccccggcgcagccccaggacccagggcgagggccctggccccaaggagaccagcaccaacggccctgtgtcccaggaggccttctctgtgactggacctgctgcccctggctgtgtgggcgtgcctggggccctgcccccacccagccccaagctgaaggatgaggacttccccagcctgagcgccagcaccagcagcagctgcagcacagctgccaccccaggccctgtgggcctggccctgccctatgccatcccagcccggggccgcagcgccttccaggaggaggacttccctgccctggtgtcctctgtgcccaagccaggcacagcccccaccagcctggtgtctgcctggaacagcagcagcagcagcaagaaggtggcccagccccccctgagcgcccaggccaccggcagcggccagcccaccaggaaggccggcaagggcagcagaggaggcaggaagggcggcccccccttcacccaggaggaggaggaggatggcggccctgccctgcaggagctgctgagcacccggcccaccggctctgtgagcagcaccctgggcctggccagcatccagcccagcaaggtgggcaagaagaagaaggtgggcagcgagaagccaggcaccaccctgccccagcccccaccagccacctgccccccaggggccctgcaggcccctgaggccccagccagcagagctgagggccctgtggccgtggtggtgaatggccacatggagggccctgccccagcccggagcgcccccaaggagcccccaggcctgccccggcccctgggcagcttcccctgccccaccccccaggaggacttccctgccctgggcggcccctgcccccccaggatgcctcctcctcctggcttctctgctgtggtgctgctgaagggcaccccacctcctcctcctcctggcctggtgccccccatcagcaagcccccacctggcttcagcggcctgctgcccagcccccacccagcctgtgtgcccagccctgccaccaccaccaccaccaaggccccccggctgctgcctgccccccgggcctacctggtgcctgagaacttccgggagaggaacctgcagctgatccagagcatccgggacttcctgcagagtgatgaggcccgcttcagcgagttcaagagccacagcggggagttccggcagggcctcatctctgctgcccagtactacaagagctgccgggacctgctgggggagaacttccagaaggtgttcaatgagctgctggtgctgctgcctgacacagccaagcagcaggagctgctgagcgcccacacagacttctgcaaccgggagaagcccctgagcaccaagagcaagaagaacaagaagagcgcctggcaggccaccacccagcaggccggcctggactgccgggtgtgccccacctgccagcaggtgctggcccatggagatgccagcagccaccaggccctgcatgctgccagagatgatgacttccccagcctgcaggccatcgcccgcatcatcacctag

SEQ ID NO: 43796 - DNA, 2550 bp, Artificial Sequence
  Description of Artificial Sequence: Synthetic coding sequence
atgagggtgctgtgtgagcagcgctactgtgctgtgtgccgggaggagctgcggcaggtggtgtttgggaagaagctgcctgcctttgccaccatccccatccaccagctgcagcacgagaagaagtatgacatctactttgctgatggcaaggtgtatgccctgtaccggcagctgctgcagcatgaatgtccccgctgcccagagctgccccccttcagcctgtttggagacctggagcagcacatgaggcggcagcacgagctgttctgctgccgcctgtgcctgcagcacctgcagatcttcacctatgaaaggaagtggtacagcaggaaggacctggcccggcacaggatgcagggcgaccctgatgacaccagccaccggggccaccccctgtgcaagttctgtgatgagcgctacctggacaatgatgagctgctgaagcacctgcggcgggaccactacttctgccacttctgtgacagtgatggagcccaggactactacagcgactatgcctacctgcgggagcacttccgggagaagcacttcctgtgtgaggagggccgctgcagcacagagcagttcacccacgccttcagaacagaaattgacctgaaggcccacaggacagcctgccacagccgcagcagagctgaggcccggcagaacagacacatcgacctgcagttctcctatgcccccaggcacagcagaagaaatgaaggagtggtgggcggagaagattatgaggaggtggaccgctacagccggcagggccgggtggcccgggccggcaccaggggggcccagcagagcagaagaggctcctggagatacaagcgggaggaggaggaccgggaggtggccgctgctgtgcgggcctctgtggccgcccagcagcaggaggaggccaggagaagtgaggaccaggaggagggcggccggcccaagaaggaggaggccgccgcccggggccctgaggacccccggggccccaggaggagccccaggacccagggcgagggccctggccccaaggagaccagcaccaatggacctgtgtcccaggaggccttctctgtgacaggccctgctgcccctggctgtgtgggcgtgcctggggccctgcccccacccagccccaagctgaaggatgaggacttccccagcctgagcgccagcaccagcagcagctgcagcacagctgccaccccaggccctgtgggcctggccctgccctatgccatcccagcccggggccgcagcgccttccaggaggaggacttccctgccctggtgtcctctgtgcccaagccaggcacagcccccaccagcctggtgtctgcctggaacagcagcagcagcagcaagaaggtggcccagccccccctgagcgcccaggccactggaagtggccagcccaccaggaaggccggcaagggcagccggggcggcaggaaaggaggcccccccttcacccaggaggaggaggaggatggcggccctgccctgcaggagctgctgagcacccggcccactggatctgtgagcagcaccctgggcctggccagcatccagcccagcaaggtgggcaagaagaagaaggtgggcagcgagaagccaggcaccaccctgccccagcccccaccagccacctgccccccaggggccctgcaggcccctgaggccccagccagcagagctgagggccctgtggccgtggtggtgaatggccacatggagggccctgccccagcccggagcgcccccaaggagcccccaggcctgccccggcccctgggcagcttcccctgccccaccccccaggaggacttccctgccctgggcggcccctgcccccccaggatgcctcctcctcctggcttctctgctgtggtgctgctgaagggcaccccacctcctcctcctcctggcctggtgccccccatcagcaagcccccacctggcttcagcggcctgctgcccagcccccacccagcctgtgtgcccagccctgccaccaccaccaccaccaaggccccccggctgctgcctgccccccgggcctacctggtgcctgagaacttccgggagaggaacctgcagctgatccagagcatccgggacttcctgcagagtgatgaggcccgcttcagcgagttcaagagccacagcggggagttccggcagggcctcatctctgctgcccagtactacaagagctgccgggacctgctgggggagaacttccagaaggtgttcaatgagctgctggtgctgctgcctgacacagccaagcagcaggagctgctgagcgcccacacagacttctgcaaccgggagaagcccctgagcaccaagagcaagaagaacaagaagagcgcctggcaggccaccacccagcaggccggcctggactgccgggtgtgccccacctgccagcaggtgctggcccatggagatgccagcagccaccaggccctgcacgccgccagagatgatgacttccccagcctgcaggccatcgcccgcatcatcacctag

SEQ ID NO: 43797 - DNA, 4539 bp, Artificial Sequence
  Description of Artificial Sequence: Synthetic coding sequence
atgtctgtgaacatcagcacagctgggaagggcgtggaccccaacacagtggacacctatgacagcggagatgactgggagattggagtgggcaacctgatcatcgacctggatgctgacctggagaaggaccggcagaagtttgagatgaacaacagcaccaccaccaccagcagcagcaacagcaaggactgtggcggccctgccagcagtggagctggggccacagctgccctggctgatggcctgaagtttgcctctgtgcaggccagcgccccccagggcaacagccacaaggagaccagcaagagcaaggtgaagaggagcaagaccagcaaggatgccaacaagagcctgcccagcgctgccctgtatggcatccctgagatcagcagcacaggcaagaggcaggaggtgcagggccggcctggagaggccaccggcatgaacagcgccctgggccagagcgtgtcctctgggggcagcggcaaccccaacagcaacagcaccagcaccagcaccagcgctgccacagctggagctggcagctgtgggaagagcaaggaggagaagccaggcaagagccagagcagcagaggagccaagagggacaaggatgctgggaagagcaggaaggacaagcatgacctgctgcagggccaccagaatggaagtggcagccaggcccccagcggcggccacctgtatggctttggagccaagagcaatggaggaggagccagccccttccactgcggcggcactggaagtggctctgtggccgctgctggggaggtgtccaagagcgccccagattctggcctgatgggcaacagcatgctggtgaagaaggaggaggaggaggaggagagccaccggcgcatcaagaagctgaagacagagaaggtggaccccctcttcaccgtgcctgcccctcctccacccatcagcagcagcctgaccccccagatcctgcccagctacttcagccccagcagcagcaacattgctgcccctgtggagcagctgctggtgaggaccaggtctgtgggcgtgaacacctgtgaggtgggcgtggtgacagagcctgagtgcctgggcccctgtgagcccggcacctctgtgaacctggagggcatcgtgtggcatgaaacagaggagggcgtgctggtggtgaatgtgacctggaggaacaagacctacgtgggcaccctgctggactgcaccaagcatgactgggccccaccccgcttctgtgagagccccaccagtgacctggagatgaggggcggccggggccggggcaagagggcccggtctgctgctgctgcccctggcagcgaggccagcttcacagagagccggggcctgcagaacaagaacagaggaggagccaacgggaagggccggcggggcagcctgaatgccagcggccgccgcaccccacccaactgtgccgctgaggacatcaaggccagccccagcagcaccaacaagaggaagaacaagccacccatggagctggacctgaacagcagcagcgaggacaacaagccaggcaagagggtgaggaccaacagccgcagcacccccaccaccccccagggcaagccagagaccaccttcctggaccagggctgcagcagccctgtgctgattgactgcccccaccccaactgcaacaagaagtacaagcacatcaatggcctgcgctaccaccaggcccacgcccacctggaccctgagaacaagctggagtttgagccagattctgaggacaagatcagtgactgtgaggagggcctgagcaatgtggccctggagtgcagcgagcccagcacctctgtgtctgcctatgaccagctgaaggccccagccagccctggggccggcaaccccccaggcacccccaagggcaagcgggagctgatgagcaatggacctggcagcatcatcggggccaaggccggcaagaacagcggcaagaagaagggcctgaacaatgagctgaacaacctgcccgtcatcagcaacatgacagctgccctggacagctgcagcgctgctgatggcagcctggccgctgagatgcccaagctggaggccgagggcctgattgacaagaagaacctgggggacaaggagaagggcaagaaggccaccaactgcaagacagacaagaacctgagcaagctgaagagcgcccggcccatcgccccagccccagcccccaccccaccccagctgattgccatccccacagccaccttcaccaccaccaccaccggcaccatccctggcctgcccagcctgaccaccaccgtggtgcaggccacccccaagagcccccccctgaagcccatccagcccaagcccaccatcatgggagagcccatcaccgtgaacccagccctggtgtccctgaaggacaagaagaagaaggagaagaggaagctgaaggacaaggagggcaaggagaccggcagccccaagatggatgccaagctgggcaagctggaggacagcaaaggagccagcaaggacctgcccggccacttcctgaaggaccacctgaacaagaatgaaggcctggccaacggcctgtctgagagccaggagagcaggatggccagcatcaaggccgaggccgacaaggtgtacaccttcacagacaatgcccccagccccagcatcggcagcgccagccggctggagtgcagcaccctggtgaatggccaggcccccatggcccccctgcacgtgctgacccagaatggagctgagagcagcgctgccaagaccagcagccctgcctacagcgacatcagtgatgctgctgatgatggcggcagtgacagccgctctgagggcatgaggagcaaggccagcagccccagcgacatcatcagcagcaaggacagcgtggtgaagggccacagcagcaccacagcccagagcagccagctgaaggagagccacagcccctactaccacagctatgacccctactacagccccagctacatgcaccctggccaggtgggcgccccagctgctggcaacagcggcagcacccagggcatgaagatcaagaaggagagcgaggaggatgctgagaagaaggacaaggccgagcagctggacagcaagaaggtggaccacaacagcgccagcctgcagccccagcaccagagcgtcatcacccagaggcacccagccctggcccagagcctgtactacggccagtatgcctacggcctgtacatggaccagaagagcctgatggccaccagccctgcctaccggcagcagtatgagaagtactatgaggaccagaggctggccgagcagaagatggcccagacaggccgcggggactgtgagaggaagtctgagctgcccctgaaggagctgggcaaggaggagaccaagcagaagaacatgcccagcgccaccatcagcaaggcccccagcaccccagagcccaacaagaaccacagcaagctgggccccagcgtgcccaacaagacagaggagaccgggaagagccagctgctgagcaaccaccagcagcagctgcaggccgacagcttcaaggccaagcagatggagaaccaccagctgatcaaggaggccgtggagatgaagtctgtgatggacagcatgaagcagacaggagtggaccccaccagccgcttcaagcaggaccctgacagcaggacctggcaccactacgtgtaccagcccaagtacctggaccagcagaagtctgaggagctggaccgggagaagaagctgaaggaggacagccccaggaagacccccaacaaggagagcggcgtgcccagcctgcctgtgtccctgaccagcatcaaggaggagcccaaggaggccaagcacccagacagccagagcatggaggagagcaagctgaagaatgatgacaggaagacccctgtgaactggaaggacagccggggcaccagggtggccgtgagcagccccatgagccagcaccagagctacatccagtacctgcacgcctacccctacccccagatgtatgaccccagccacccagcctacagagctgtgtcccctgtgctgatgcacagctacccaggggcctacctgagccctggcttccactaccctgtgtatggcaagatgagcggccgggaggagacagagaaggtgaacaccagccccagcgtgaacaccaagaccaccacagagagcaaggccctggacctgctgcagcagcacgccaaccagtaccgcagcaagagccctgcccctgtggagaaggccacagctgagcgggagcgggaggccgagcgggagcgggacagacacagccccttcggccagaggcacctgcacacccaccaccacacccacgtgggcatgggctaccccctcatccctggccagtatgaccccttccagggcctgaccagcgctgccctggtggccagccagcaggtggccgcccaggccagcgccagcggcatgtttcctggccagaggcgggagtag

SEQ ID NO: 43798 - DNA, 3258 bp, Artificial Sequence
  Description of Artificial Sequence: Synthetic coding sequence
atgagaggaggccggggccggggcaagagggcccggtctgctgctgctgcccctggcagcgaggccagcttcacagagagccggggcctgcagaacaagaacagaggaggagccaatggaaaaggaagaagaggcagcctgaatgccagcggccgccgcaccccacccaactgtgccgctgaggacatcaaggccagccccagcagcaccaacaagaggaagaacaagccacccatggagctggacctgaacagcagcagcgaggacaacaagccaggcaagagggtgaggaccaacagccgcagcacccccaccaccccccagggcaagccagagaccaccttcctggaccagggctgcagcagccctgtgctgattgactgcccccaccccaactgcaacaagaagtacaagcacatcaatggcctgcgctaccaccaggcccacgcccacctggaccctgagaacaagctggagtttgagccagacagcgaggacaagatcagtgactgtgaggagggcctgagcaatgtggccctggagtgcagcgagcccagcacctctgtgtctgcctatgaccagctgaaggccccagccagccctggagctggcaaccccccaggcacccccaagggcaagcgggagctgatgagcaatggacctggcagcatcattggagccaaggccggcaagaacagcggcaagaagaagggcctgaacaatgagctgaacaacctgcctgtgatcagcaacatgacagctgccctggacagctgcagcgctgctgatggcagcctggccgctgagatgcccaagctggaggccgagggcctgattgacaagaagaacctgggggacaaggagaagggcaagaaggccaccaactgcaagacagacaagaacctgagcaagctgaagagcgcccggcccatcgccccagccccagcccccaccccaccccagctgattgccatccccacagccaccttcaccaccaccaccaccggcaccatccctggcctgcccagcctgaccaccaccgtggtgcaggccacccccaagagcccccccctgaagcccatccagcccaagcccaccatcatgggagagcccatcaccgtgaacccagccctggtgtccctgaaggacaagaagaagaaggagaagaggaagctgaaggacaaggagggcaaggagaccggcagccccaagatggatgccaagctgggcaagctggaggacagcaagggggccagcaaggacctgcccggccacttcctgaaggaccacctgaacaagaatgaaggcctggccaacggcctgtctgagagccaggagagcaggatggccagcatcaaggccgaggccgacaaggtgtacaccttcacagacaatgcccccagccccagcatcggcagcgccagccggctggagtgcagcaccctggtgaatggccaggcccccatggcccccctgcacgtgctgacccagaatggagctgagagcagcgctgccaagaccagcagccctgcctacagcgacatcagtgatgctgctgatgatggcggcagtgacagccgctctgagggcatgaggagcaaggccagcagccccagcgacatcatcagcagcaaggacagcgtggtgaagggccacagcagcaccacagcccagagcagccagctgaaggagagccacagcccctactaccacagctatgacccctactacagccccagctacatgcaccctggccaggtgggcgccccagctgctggcaacagcggcagcacccagggcatgaagatcaagaaggagagtgaagaagatgctgagaagaaggacaaggccgagcagctggacagcaagaaggtggaccacaacagcgccagcctgcagccccagcaccagagcgtcatcacccagaggcacccagccctggcccagagcctgtactacggccagtatgcctacggcctgtacatggaccagaagagcctgatggccaccagccctgcctaccggcagcagtatgagaagtactatgaggaccagaggctggccgagcagaagatggcccagacaggccgcggggactgtgagaggaagtctgagctgcccctgaaggagctgggcaaggaggagaccaagcagaagaacatgcccagcgccaccatcagcaaggcccccagcaccccagagcccaacaagaaccacagcaagctgggccccagcgtgcccaacaagacagaggagaccgggaagagccagctgctgagcaaccaccagcagcagctgcaggccgacagcttcaaggccaagcagatggagaaccaccagctgatcaaggaggccgtggagatgaagtctgtgatggacagcatgaagcagacaggagtggaccccaccagccgcttcaagcaggaccctgacagcaggacctggcaccactacgtgtaccagcccaagtacctggaccagcagaagtctgaggagctggaccgggagaagaagctgaaggaggacagccccaggaagacccccaacaaggagagcggcgtgcccagcctgcctgtgtccctgaccagcatcaaggaggagcccaaggaggccaagcacccagacagccagagcatggaggagagcaagctgaagaatgatgacaggaagacccctgtgaactggaaggacagccggggcaccagggtggccgtgagcagccccatgagccagcaccagagctacatccagtacctgcacgcctacccctacccccagatgtatgaccccagccacccagcctacagagctgtgtcccctgtgctgatgcacagctacccaggggcctacctgagccctggcttccactaccctgtgtatggcaagatgagcggccgggaggagacagagaaggtgaacaccagccccagcgtgaacaccaagaccaccacagagagcaaggccctggacctgctgcagcagcacgccaaccagtaccgcagcaagagccctgcccctgtggagaaggccacagctgagcgggagcgggaggccgagcgggagcgggacagacacagccccttcggccagaggcacctgcacacccaccaccacacccacgtgggcatgggctaccccctcatccctggccagtatgaccccttccagggcctgaccagcgctgccctggtggccagccagcaggtggccgcccaggccagcgccagcggcatgtttcctggccagaggcgggagtag

SEQ ID NO: 43799 - DNA, 2148 bp, Artificial Sequence
  Description of Artificial Sequence: Synthetic coding sequence
atgtctgtgaacatcagcacagctgggaagggcgtggaccccaacacagtggacacctatgacagcggagatgactgggagattggagtgggcaacctgatcatcgacctggatgctgacctggagaaggaccggcagaagtttgagatgaacaacagcaccaccaccaccagcagcagcaacagcaaggactgtggcggccctgccagcagtggagctggggccacagctgccctggctgatggcctgaagtttgcctctgtgcaggccagcgccccccagggcaacagccacaaggagaccagcaagagcaaggtgaagaggagcaagaccagcaaggatgccaacaagagcctgcccagcgctgccctgtatggcatccctgagatcagcagcacaggcaagaggcaggaggtgcagggccggcctggagaggccaccggcatgaacagcgccctgggccagagcgtgtcctctgggggcagcggcaaccccaacagcaacagcaccagcaccagcaccagcgctgccacagctggagctggcagctgtgggaagagcaaggaggagaagccaggcaagagccagagcagcagaggagccaagagggacaaggatgctgggaagagcaggaaggacaagcatgacctgctgcagggccaccagaatggaagtggcagccaggcccccagcggcggccacctgtatggctttggagccaagagcaatggaggaggagccagccccttccactgcggcggcactggaagtggctctgtggccgctgctggggaggtgtccaagagcgccccagattctggcctgatgggcaacagcatgctggtgaagaaggaggaggaggaggaggagagccaccggcgcatcaagaagctgaagacagagaaggtggaccccctcttcaccgtgcctgcccctcctccacccatcagcagcagcctgaccccccagatcctgcccagctacttcagccccagcagcagcaacattgctgcccctgtggagcagctgctggtgaggaccaggtctgtgggcgtgaacacctgtgaggtgggcgtggtgacagagcctgagtgcctgggcccctgtgagcccggcacctctgtgaacctggagggcatcgtgtggcatgaaacagaggagggcgtgctggtggtgaatgtgacctggaggaacaagacctacgtgggcaccctgctggactgcaccaagcatgactgggccccaccccgcttctgtgagagccccaccagtgacctggagatgaggggcggccggggccggggcaagagggcccggtctgctgctgctgcccctggcagcgaggccagcttcacagagagccggggcctgcagaacaagaacagaggaggagccaacgggaagggccggcggggcagcctgaatgccagcggccgccgcaccccacccaactgtgccgctgaggacatcaaggccagccccagcagcaccaacaagaggaagaacaagccacccatggagctggacctgaacagcagcagcgaggacaacaagccaggcaagagggtgaggaccaacagccgcagcacccccaccaccccccagggcaagccagagaccaccttcctggaccagggctgcagcagccctgtgctgattgactgcccccaccccaactgcaacaagaagtacaagcacatcaatggcctgcgctaccaccaggcccacgcccacctggaccctgagaacaagctggagtttgagccagattctgaggacaagatcagtgactgtgaggagggcctgagcaatgtggccctggagtgcagcgagcccagcacctctgtgtctgcctatgaccagctgaaggccccagccagccctggggccggcaaccccccaggcacccccaagggcaagcgggagctgatgagcaatggacctggcagcatcatcggggccaaggccggcaagaacagcggcaagaagaagggcctgaacaatgagctgaacaacctgcccgtcatcagcaacatgacagctgccctggacagctgcagcgctgctgatggcagcctggccgctgagatgcccaagctggaggccgagggcctgattgacaagaagaacctgggggacaaggagtag

SEQ ID NO: 43800 - DNA, 2124 bp, Artificial Sequence
  Description of Artificial Sequence: Synthetic coding sequence
atgtctgtgaacatcagcacagctgggaagggcgtggaccccaacacagtggacacctatgacagcggagatgactgggagattggagtgggcaacctgatcatcgacctggatgctgacctggagaaggaccggcagaagtttgagatgaacaacagcaccaccaccaccagcagcagcaacagcaaggactgtggcggccctgccagcagtggagctggggccacagctgccctggctgatggcctgaagtttgcctctgtgcaggccagcgccccccagggcaacagccacaaggagaccagcaagagcaaggtgaagaggagcaagaccagcaaggatgccaacaagagcctgcccagcgctgccctgtatggcatccctgagatcagcagcacaggcaagaggcaggaggtgcagggccggcctggagaggccaccggcatgaacagcgccctgggccagagcgtgtcctctgggggcagcggcaaccccaacagcaacagcaccagcaccagcaccagcgctgccacagctggagctggcagctgtgggaagagcaaggaggagaagccaggcaagagccagagcagcagaggagccaagagggacaaggatgctgggaagagcaggaaggacaagcatgacctgctgcagggccaccagaatggaagtggcagccaggcccccagcggcggccacctgtatggctttggagccaagagcaatggaggaggagccagccccttccactgcggcggcactggaagtggctctgtggccgctgctggggaggtgtccaagagcgccccagattctggcctgatgggcaacagcatgctggtgaagaaggaggaggaggaggaggagagccaccggcgcatcaagaagctgaagacagagaaggtggaccccctcttcaccgtgcctgcccctcctccacccatcagcagcagcctgaccccccagatcctgcccagctacttcagccccagcagcagcaacattgctgcccctgtggagcagctgctggtgaggaccaggtctgtgggcgtgaacacctgtgaggtgggcgtggtgacagagcctgagtgcctgggcccctgtgagcccggcacctctgtgaacctggagggcatcgtgtggcatgaaacagaggagggcgtgctggtggtgaatgtgacctggaggaacaagacctacgtgggcaccctgctggactgcaccaagcatgactgggccccaccccgcttctgtgagagccccaccagtgacctggagatgaggggcggccggggccggggcaagagggcccggtctgctgctgctgcccctggcagcgaggccagcttcacagagagccggggcctgcagaacaagaacagaggaggagccaacgggaagggccggcggggcagcctgaatgccagcggccgccgcaccccacccaactgtgccgctgaggacatcaaggccagccccagcagcaccaacaagaggaagaacaagccacccatggagctggacctgaacagcagcagcgaggacaacaagccaggcaagagggtgaggaccaacagccgcagcacccccaccaccccccagggcaagccagagaccaccttcctggaccagggctgcagcagccctgtgctgattgactgcccccaccccaactgcaacaagaagtacaagcacatcaatggcctgcgctaccaccaggcccacgcccacctggaccctgagaacaagctggagtttgagccagattctgaggacaagatcagtgactgtgaggagggcctgagcaatgtggccctggagtgcagcgagcccagcacctctgtgtctgcctatgaccagctgaaggccccagccagccctggggccggcaaccccccaggcacccccaagggcaagcgggagctgatgagcaatggacctggcagcatcatcggggccaaggccggcaagaacagcggcaagaagaagggcctgaacaatgagctgaacaacctgcccgtcatcagcaacatgacagctgccctggacagctgcagcgctgctgatggcagcctggccgctgagatgcccaagctggaggccgagggcctgattgattag

SEQ ID NO: 43801 - DNA, 1503 bp, Artificial Sequence
  Description of Artificial Sequence: Synthetic coding sequence
ctcttcctgttcctggccgtggtgtgcagctactttgcccaggacttctggcccaagcagggcatcaagaactgcttccagaaggtgatcctgaagcgctacaagaagtgtggccacgagaacctgcagctgggcaagtactgcaagtccatggatgagtgcaaggtgcatgaggagtgctacaacggcctgaaccagtgcctgcggaccacccagagcaagatcctgcagtgtgacaagtatgtgaaggtgttccacaagttcagcaacagcaaccgctacaagatccgccacacaggcaagaagcccttcaagtgcaaggaatgtgagaagagcttctgcatgctgagccacctggcccagcacaagaggatccacacccgggagaagccctacaagtgcaaggaatgtgggaaggcctacaatgaggccagcaacctgagcacccacaagaggatccacacaggcaagaagccctacaagtgtgagcagtgtgggaaggccttcaaccggctgagccacctgaccacccacaagatcatccacacaggcaagaagccctacatctgtgaggactgtgggaaggccttcaaccagagcgccaacctgaccacccacaagaggatccacactggagagaagccctacaagtgtgaggagagcggcaaggccttcagccagagcagcaccctgaccacccacaagatcatccatgctggggagaagccctacaagtatgaggagtgtgggaagagcttcaaccagagcagcaccctgaccaccaggaagatcatccacactggagagaagttctgcaagtgtgaggagtggggcaaggccttcagccggctgagccacctgaccacccacaagaggatccacagcggggagaagccctacaagtgtgaggagtgtgggaaggccttcaagcagagcagcaccctgaccacccacaagaggatccacagcggggagaagttctacaagtgtgaggtgtgcagcaaggccttcagccgcttcagccacctgaccacccacaagaggatccacagcggggagaagccctacaagtgtgaggagtgtgggaaggccttcaacctgagcagccacctgaccacccacaagatcatccacactggagagaagccctacaagtgtgaggagtgtgggaaggccttcaacctgagcagccacctgaccacccacaagatcatccacactggagagaagccctacaagtgtgaggagtgtgggaaggccttcaaccagagcagcaccctgagcaagcacaaggtgatccacactggagagaagccctacaagtgtggggagtgtgggaaggccttcaaccagagcagccacctgaccacccacaagatcatccacactggagagaagccctacaagtgtgaggagtgtgggaaggccttcaacaacagcagcatcctgaacagacacaagatgatccacactggagagaagttctacaagccagagagctag

SEQ ID NO: 43802 - DNA, 1239 bp, Artificial Sequence
  Description of Artificial Sequence: Synthetic coding sequence
atgaccttcaccttccagagcgaggacctgaagagggactgtgggaagaagatgagccaccagcacgtgttcagcctggccatggaggaggatgtgaagacagctgacaccaagaaggccagccgcatcctggaccacgagaaggagaacaccaggagcatctgcctgctggagcagaagaggaaggtggtgagcagcaacattgatgtgcccccagccaggaagagcagcgaggagctggacatggacaaggtgacagctgccatggtgctgaccagcctgagcaccagccccctggtgcgcagcccccctgtgcggcccaatgaaagcctgagcggctcctggaaggagggcggctgtgtgcccagcagcaccagcagcagcggctactggagctggagcgcccccagcgaccagagcaaccccagcacccccagcccccccctgtctgctgacagcttcaagcccttccgcagccctgcccagccagatgatggcattgatgaggccgaggccagcaacctgctgtttgatgagcccatccccaggaagaggaagaacagcatgaaggtgatgttcaagtgcctgtggaagaactgtgggaaggtgctgagcacagctgctggcatccagaagcacatccgcaccatccacctgggccgggtgggggacagcgactacagtgatggagaggaggacttctactacacagagatcaagctgaacacagattctgtggctgatggcctgagcagcctggcccctgtgagccccagccagagcctggccagcccccccaccttccccatcccagacagcagcaggacagagaccccctgtgccaagacagagaccaagctgatgacccccctgagccgcagcgcccccaccaccctgtacctggtgcacacagaccacgcctaccaggccaccccacctgtgaccatccctggcagcgccaagttcaccccaaatggcagcagcttcagcatctcctggcagagcccccctgtgaccttcaccggcatccctgtgagccccacccaccaccctgtgggcaccggggagcagaggcagcacgcccacacagtgctgagcagccccccccggggcaccgtgtccctgaggaagcccagaggagagggcaagaagtgcaggaaggtgtatggcatggagaacagagacatgtggtgcacagcctgccgctggaagaaggcctgccagcgcttcctggactag

SEQ ID NO: 43803 - DNA, 570 bp, Artificial Sequence
  Description of Artificial Sequence: Synthetic coding sequence
atgaccttcaccttccagagcgaggacctgaagagggactgtgggaagaagatgagccaccagcacgtgttcagcctggccatggaggaggatgtgaagacagctgacaccaagaaggccagccgcatcctggaccacgagaaggagaacaccaggagcatctgcctgctggagcagaagaggaaggtggtgagcagcaacattgatgtgcccccagccaggaagagcagcgaggagctggacatggacaaggtgacagctgccatggtgctgaccagcctgagcaccagccccctggtgcgcagcccccctgtgcggcccaatgaaagcctgagcggctcctggaaggagggcggctgtgtgcccagcagcaccagcagcagcggctactggagctggagcgcccccagcgaccagagcaaccccagcacccccagcccccccctgtctgctgacagcttcaagcccttccgcagccctgcccagccagatgatggcattgatgaggccgaggccagcaacctgctgtttgatgagcccatccccaggaagaggaagaacagcatgtag

SEQ ID NO: 43804 - DNA, 903 bp, Artificial Sequence
  Description of Artificial Sequence: Synthetic coding sequence
atgcacagcctggagaaggtgacctttgaagatgtggccatcgacttcacccaggaggagtgggacatgatggacaccagcaagaggaagctgtacagagatgtgatgctggagaacatcagccacctggtgtccctgggctaccagatcagcaagagctacatcatcctgcagctggagcagggcaaggagctgtggtgggagggccgggtcttcctgcaggaccagaacccagaccgggagagcgccctgaagaagaagcacatgatctccatgcaccccatcatcaggaaggacaccagcacctccatgaccatggagaacagcctcatcctggaggacccctttgagtacaatgattctggagaggactgcacccacagcagcaccatcacccagtgcctgctgacccacagcggcaagaagccctgtgtgtccaagcagtgtgggaagagcctgaggaacctgctgagccccaagcccaggaagcagatccacaccaagggcaagagctaccagtgcaacctgtgtgagaaggcctacaccaactgcttctacctgcggcggcacaagatgacccacactggagagcggccctatgcctgccacctgtgtgggaaggccttcacccagtgcagccacctgcggagacatgagaagacccacactggagagcggccctacaagtgccaccagtgtgggaaggccttcatccagagcttcaacctgcggagacatgagaggacccacctgggccagaagtgctatgaatgtgacaagagcggcaaggccttcagccagagcagcggcttccggggcaacaagatcatccacatcggggagaagcccccagcctgcctgctgtgtgggaaggccttcagcctgagcagtgacctgaggtag

SEQ ID NO: 43805 - DNA, 903 bp, Artificial Sequence; identical to SEQ ID NO: 43804
  Description of Artificial Sequence: Synthetic coding sequence

SEQ ID NO: 43806 - DNA, 903 bp, Artificial Sequence
  Description of Artificial Sequence: Synthetic coding sequence
atgcacagcctgaagaagctgacctttgaagatgtggccatcgacttcacccaggaggagtgggccatgatggacaccagcaagaggaagctgtacagagatgtgatgctggagaacatcagccacctggtgtccctgggctaccagatcagcaagagctacatcatcctgcagctggagcagggcaaggagctgtggagggagggccgggtcttcctgcaggaccagaaccccaaccgggagagcgccctgaagaagacccacatgatctccatgcaccccatcaccaggaaggatgccagcacctccatgaccatggagaacagcctcatcctggaggacccctttgaatgtaatgattctggagaggactgcaccaggagcagcaccatcacccagtgcctgctgacccacagcggcaagaagccctacgtgtccaagcagtgtgggaagagcctgaggaacctgctgagcacagagccccacaagcagatccacaccaagggcaagagctaccagtgcaacctgtgtgagaaggcctacaccaactgcttccacctgcggcggcacaagatgacccacactggagagcggccctatgcctgccacctgtgcaggaaggccttcacccagtgcagccacctgcggagacatgagaagacccacacaggccagaggccctacaagtgccaccagtatggcaaggtgttcatccagagcttcaacctgcagagacatgagaggacccacctgggcaagaagtgctatgaatgtgacaagagcggcaaggccttcagccagagcagcggcttccggggcaacaagatcatccacactggagagaagccccacgcctgcctgctgtgtgggaaggccttcagcctgagcagcaacctgaggtag

SEQ ID NO: 43807 - DNA, 903 bp, Artificial Sequence; identical to SEQ ID NO: 43806
  Description of Artificial Sequence: Synthetic coding sequence

SEQ ID NO: 43808 - DNA, 231 bp, Artificial Sequence
  Description of Artificial Sequence: Synthetic coding sequence
atggcccggggccagcagaagatccagagccagcagaagaatgccaagaagcaggccggccagaagaagaagcagggccatgaccagaaggccgccgccaaggccgccctgatctacacctgcaccgtgtgcaggacccagatgccagaccccaagaccttcaagcagcactttgagagcaagcaccccaagacccccctgcccccagagctggctgatgtgcaggcctag

SEQ ID NO: 43809 - DNA, 231 bp, Artificial Sequence; identical to SEQ ID NO: 43808
  Description of Artificial Sequence: Synthetic coding sequence

SEQ ID NO: 43810 - DNA, 231 bp, Artificial Sequence; identical to SEQ ID NO: 43808
  Description of Artificial Sequence: Synthetic coding sequence

SEQ ID NO: 43811 - DNA, 231 bp, Artificial Sequence; identical to SEQ ID NO: 43808
  Description of Artificial Sequence: Synthetic coding sequence

SEQ ID NO: 43812 - DNA, 231 bp, Artificial Sequence; identical to SEQ ID NO: 43808
  Description of Artificial Sequence: Synthetic coding sequence

SEQ ID NO: 43813 - DNA, 27 bp, Artificial Sequence
  Description of Artificial Sequence: Synthetic coding sequence
atggcccggggccagcagaagatctag

SEQ ID NO: 43814 - DNA, 231 bp, Artificial Sequence; identical to SEQ ID NO: 43808
  Description of Artificial Sequence: Synthetic coding sequence

SEQ ID NO: 43815 - DNA, 231 bp, Artificial Sequence; identical to SEQ ID NO: 43808
  Description of Artificial Sequence: Synthetic coding sequence

SEQ ID NO: 43816 - DNA, 129 bp, Artificial Sequence
  Description of Artificial Sequence: Synthetic coding sequence
atggcccggggccagcagaagatccagagccagcagaagaatgccaagaagcaggccggccagaagaagaagcagggccatgaccagaaggccgccgccaaggccgccctgatctacacctgcacctag

SEQ ID NO: 43817 - DNA, 1116 bp, Artificial Sequence
  Description of Artificial Sequence: Synthetic coding sequence
atggacatggcccaggagcctgtgaccttcagagatgtggccatctacttcagccgggaggagtgggcctgcctggagcccagccagagggccctgtacagagatgtgatgctggacaacttcagctctgtggccgccctgggcttctgcagccccaggccagacctggtgtcccggctggagcagtgggaggagccctgggtggaggaccgggagaggcctgagttccaggccgtgcagaggggccccaggcctggggccaggaagtctgctgaccccaagaggccctgtgaccacccagcctgggcccacaagaagacccacgtgcggcgggagcgggcccgggagggcagcagcttcaggaagggcttccggctggacacagatgatggccagctgccccgggccgcccctgagaggacagatgccaagcccacagccttcccctgccaggtgctgacccagagatgtggcagaagacctggaagaagagagaggaggaagcagagagctgtggagctgtccttcatctgtggcacctgtgggaaggccctgagctgccacagccggctgctggcccaccagacagtgcacacaggcaccaaggcctttgaatgtccagaatgtggccagaccttccgctgggccagcaacctgcagaggcaccagaagaaccacacccgggagaagcccttctgctgtgaggcctgtggccaggccttcagcctgaaggaccggctggcccagcacaggaaggtgcacacagagcaccggccctacagctgtggggactgtgggaaggccttcaagcagaagagcaacctgctgcggcaccagctggtgcacactggagagcggcccttctactgtgccgactgtgggaaggccttccgcaccaaggagaacctgagccaccaccagagggtgcacagcggggagaagccctacacctgtgccgagtgtgggaagagcttccgctggcccaagggcttcagcatccaccggcggctgcacctgaccaagcgcttctatgaatgtggccactgtgggaagggcttccgccacctgggcttcttcaccaggcaccagaggacccaccgccacggggaggtgtag

SEQ ID NO: 43818 - DNA, 1116 bp, Artificial Sequence; identical to SEQ ID NO: 43817
  Description of Artificial Sequence: Synthetic coding sequence

SEQ ID NO: 43819 - DNA, 1665 bp, Artificial Sequence
  Description of Artificial Sequence: Synthetic coding sequence
atgaatgtgatgctggagaactacaagaacctggtgttcctggccggcattgctgtgtccaagcaggaccccatcaccagcctggagcaggagaaggagccctggaacatgaagatctgtgagatggtggatgagagccctgccatgtgcagcagcttcacccgggacctgtggccagagcaggacatcaaggacagcttccagcaggtgatcctgcggagacatggaaaatgtgaacatgagaacctgcagctgaggaaaggaagtgccaacgtggtggagtgcaaggtgtacaagaagggctatgagctgaaccagtgcctgaccaccacccagagcaagatcttcccctgtgacaagtacatcaaggtgttccacaagatcttcaacagcaacagacacaagaccaggcacactggagagaagcccttcaagtgcaagaagtgtgatgagagcttctgcatgctgctgcacctgcaccagcacaagaggatccacatcagagaaaattcctaccagtgtgaggagtgtgacaaggtgttcaagcgcttcagcaccctgaccaggcacaagagggtgcacactggagagaagcccttcaagtgtgaggagtgtgggaaggccttcaagcacagcagcaccctgaccacccacaagatgatccacactggagagaagccctaccgctgtgaggagtgtgggaaggccttctaccacagcagccacctgaccacccacaaggtgatccacactggagagaagcccttcaagtgtgaggagtgtgggaaggccttcaaccaccccagcgccctgaccacccacaagttcatccacgtgaaggagaagccctacaagtgtgaggagtgtgacaaggccttcaaccgcttctcctacctgaccaagcacaagatcatccacagcggggagaagagctacaagtgtgagcagtgtgggaagggcttcaactggagcagcaccctgaccaagcacaagaggatccacactggagagaagccctacaagtgtgaggagtgtgggaaggccttcaacgtgagcagccacctgaccacccacaagatgatccacactggagagaagccctacaagtgtgaggagtgtgggaaggccttcaaccacagcagcaagctgaccatccacaagatcatccacactggagagaagccctacaagtgtgaggagtgtgggaaggccttcaaccagagcagcaacctgaccaagcacaagatcatccacactggagagaagctgtacaagtgtgaggagtgtgggaaggccttcaacagaagcagcaacctgaccacccacaagaggatccacactggagagaagccctacaagtgtgaggagtgtgggaaggccttcaacagaagcagcaacctgaccaagcacaacatcatccacactggagagaagagctacaagtgtgaggagtgtgggaaggccttcaaccagagcagcaccctgaccaagcacaggaagatccagcagggcatggtggcccacgcctgcaaccccaacaccctgcggggcctgggggagcagatcgcccggtctggagtgcaggaccagcccggccagcacggcaagacccccagcctgctgaagatccagaagtttgctggctgcggcggccggcggctgtag

SEQ ID NO: 43820 - DNA, 1572 bp, Artificial Sequence
  Description of Artificial Sequence: Synthetic coding sequence
atgaatgtgatgctggagaactacaagaacctggtgttcctggccggcattgctgtgtccaagcaggaccccatcaccagcctggagcaggagaaggagccctggaacatgaagatctgtgagatggtggatgagagccctgccatgtgcagcagcttcacccgggacctgtggccagagcaggacatcaaggacagcttccagcaggtgatcctgcggagacatggaaaatgtgaacatgagaacctgcagctgaggaaaggaagtgccaacgtggtggagtgcaaggtgtacaagaagggctatgagctgaaccagtgcctgaccaccacccagagcaagatcttcccctgtgacaagtacatcaaggtgttccacaagatcttcaacagcaacagacacaagaccaggcacactggagagaagcccttcaagtgcaagaagtgtgatgagagcttctgcatgctgctgcacctgcaccagcacaagaggatccacatcagagaaaattcctaccagtgtgaggagtgtgacaaggtgttcaagcgcttcagcaccctgaccaggcacaagagggtgcacactggagagaagcccttcaagtgtgaggagtgtgggaaggccttcaagcacagcagcaccctgaccacccacaagatgatccacactggagagaagccctaccgctgtgaggagtgtgggaaggccttctaccacagcagccacctgaccacccacaaggtgatccacactggagagaagcccttcaagtgtgaggagtgtgggaaggccttcaaccaccccagcgccctgaccacccacaagttcatccacgtgaaggagaagccctacaagtgtgaggagtgtgacaaggccttcaaccgcttctcctacctgaccaagcacaagatcatccacagcggggagaagagctacaagtgtgagcagtgtgggaagggcttcaactggagcagcaccctgaccaagcacaagaggatccacactggagagaagccctacaagtgtgaggagtgtgggaaggccttcaacgtgagcagccacctgaccacccacaagatgatccacactggagagaagccctacaagtgtgaggagtgtgggaaggccttcaaccacagcagcaagctgaccatccacaagatcatccacactggagagaagccctacaagtgtgaggagtgtgggaaggccttcaaccagagcagcaacctgaccaagcacaagatcatccacactggagagaagctgtacaagtgtgaggagtgtgggaaggccttcaacagaagcagcaacctgaccacccacaagaggatccacactggagagaagccctacaagtgtgaggagtgtgggaaggccttcaacagaagcagcaacctgaccaagcacaacatcatccacactggagagaagagctacaagtgtgaggagtgtgggaaggccttcaaccagagcagcaccctgaccaagcacaggaagatccagcagggcatggtggcccacgcctgcaaccccaacaccctgcggggccagggccgctggatcatgtag

SEQ ID NO: 43821 - DNA, 1665 bp, Artificial Sequence; identical to SEQ ID NO: 43819
  Description of Artificial Sequence: Synthetic coding sequence

SEQ ID NO: 43822 - DNA, 1452 bp, Artificial Sequence
  Description of Artificial Sequence: Synthetic coding sequence
atgggcctgctgaccttccgggacatcgccatcgagttcagcctggccgagtggcagtgcctggaccacgcccagcagaacctgtacagagatgtgatgctggagaactacagaaacctggtgtccctgggcattgctgtgtccaagccagacctgatcacctgcctggagcagaacaaggagccccagaacatcaagagaaatgagatggtggccaagcaccctgtgacctgcagccacttcacccaggacctgcagagcgagcagggcatcaaggacagcctgcagaaggtgatcctgcggcgctatggaaaatgtggccaggaggacctgcaggtgaagaagtgctgcaagtctgtgggggagtgtgaggtgcacaagggcggctacaactacgtgaaccagtgcctgagcgccacccagaacaagaccttccagacccacaagtgtgtgaaggtgtttgggaagttcagcaacagcaacagacacaagaccaggcacacaggcaagaagcacttcaagtgcaagaatgatggcaagagcttctgcatgctgagccggctgaaccagcaccagatcatccacacccgggagaagagctacaagtgtgaagaatgtgggaagagcttcaactgcagcagcaccctgaccaggcacaagaggatccacactggagagaagccctaccgctgtgaagaatgtgggaaggccttctcctggagcgccagcctgaccaagcacaagaggatccacactggagagaagccctacacctgtgaggagcggggcaaggtgttcagccgcagcaccctgaccaactacaagaggatccacactggagagaagccctacacctgtgaggagtgtgggaaggccttcagccgcagcagcaccctgaccaaccacaagaggatccacactggagagcggccctacaagtgtgaggagtgtgggaaggccttcagcctgagcagcaccctgaagaagcacaagatcgtgcacactggagagaagctgtacacctgtgaggagtgtgggaaggccttcaccttcagcagcaccctgaacacccacaagaggatccacactggagagaagccctacacctgtgaggagtgtgggaaggccttcagcctgcccagcaccttcacctaccacaagaggacccacactggagagaagccctacaagtgtgaggagtgtgggaaggccttcaactgcagcagcaccctgaagaagcacaagatcatccacactggagagaagctgtacaagtgcaaggaatgtgggaaggccttcaccttcagcagcaccctgaacacccacaagaggatccacactggagagaagccctacaagtgtgaggagtgtgaccagaccttcaagtggcacagcagcctggccaaccacaagaacatgcacactggagagaagccctacaagtatgaatag

SEQ ID NO: 43823 - DNA, 1488 bp, Artificial Sequence
  Description of Artificial Sequence: Synthetic coding sequence
atggccaagaggcctggccccccaggcagccgggagatgggcctgctgaccttccgggacatcgccatcgagttcagcctggccgagtggcagtgcctggaccacgcccagcagaacctgtacagagatgtgatgctggagaactacagaaacctggtgtccctgggcattgctgtgtccaagccagacctgatcacctgcctggagcagaacaaggagccccagaacatcaagagaaatgagatggtggccaagcaccctgtgacctgcagccacttcacccaggacctgcagagcgagcagggcatcaaggacagcctgcagaaggtgatcctgcggcgctatggaaaatgtggccaggaggacctgcaggtgaagaagtgctgcaagtctgtgggggagtgtgaggtgcacaagggcggctacaactacgtgaaccagtgcctgagcgccacccagaacaagaccttccagacccacaagtgtgtgaaggtgtttgggaagttcagcaacagcaacagacacaagaccaggcacacaggcaagaagcacttcaagtgcaagaatgatggcaagagcttctgcatgctgagccggctgaaccagcaccagatcatccacacccgggagaagagctacaagtgtgaagaatgtgggaagagcttcaactgcagcagcaccctgaccaggcacaagaggatccacactggagagaagccctaccgctgtgaagaatgtgggaaggccttctcctggagcgccagcctgaccaagcacaagaggatccacactggagagaagccctacacctgtgaggagcggggcaaggtgttcagccgcagcaccctgaccaactacaagaggatccacactggagagaagccctacacctgtgaggagtgtgggaaggccttcagccgcagcagcaccctgaccaaccacaagaggatccacactggagagcggccctacaagtgtgaggagtgtgggaaggccttcagcctgagcagcaccctgaagaagcacaagatcgtgcacactggagagaagctgtacacctgtgaggagtgtgggaaggccttcaccttcagcagcaccctgaacacccacaagaggatccacactggagagaagccctacacctgtgaggagtgtgggaaggccttcagcctgcccagcaccttcacctaccacaagaggacccacactggagagaagccctacaagtgtgaggagtgtgggaaggccttcaactgcagcagcaccctgaagaagcacaagatcatccacactggagagaagctgtacaagtgcaaggaatgtgggaaggccttcaccttcagcagcaccctgaacacccacaagaggatccacactggagagaagccctacaagtgtgaggagtgtgaccagaccttcaagtggcacagcagcctggccaaccacaagaacatgcacactggagagaagccctacaagtatgaatag

SEQ ID NO: 43824 - DNA, 2724 bp, Artificial Sequence
  Description of Artificial Sequence: Synthetic coding sequence
atgctggagacctacaacagcctggtgtccctgcaggagctggtgtcctttgaggaggtggccgtgcacttcacctgggaggagtggcaggacctggatgatgcccagaggaccctgtacagagatgtgatgctggagacctacagcagcctggtgtccctgggccactacatcaccaagccagagatgatcttcaagctggagcagggcgctgagccctggatcgtggaggagacccccaacctgcggctgtctgctgtgcagatcattgatgacctgattgaaagaagccatgagagccatgaccgcttcttctggcagatcgtcatcaccaacagcaacaccagcacccaggagcgggtggagctgggcaagaccttcaacctgaacagcaaccacgtgctgaacctgatcatcaacaatggaaacagcagcggcatgaagccaggccagttcaatgactgccagaacatgctgttccccatcaagccaggagagacccagagcggggagaagccccacgtgtgtgacatcacccggcgcagccaccgccaccacgagcacctgacccagcaccacaagatccagaccctgctgcagaccttccagtgcaatgagcagggcaagaccttcaacacagaggccatgttcttcatccacaagagggtgcacatcgtgcagaccttcggcaagtacaatgaatatgagaaggcctgcaacaacagcgctgtgattgtgcaggtgatcacccaggtgggccagcccacctgctgcaggaagagtgacttcaccaagcaccagcagacccacactggagagaagccctatgaatgtgtggagtgtgagaagcccagcatcagcaagagtgacctgatgctgcagtgcaagatgcccacagaggagaagccctatgcctgcaactggtgtgagaagctgttctcctacaagagcagcctcatcatccaccagaggatccacactggagagaagccctacggctgcaatgaatgtgggaagaccttccggaggaagagcttcctgaccctgcacgagaggacccacactggagacaagccctacaagtgcattgaatgtgggaagaccttccactgcaagagcctgctgaccctgcaccacaggacccacagcggggagaagccctaccagtgcagtgaatgtgggaagaccttcagccagaagagctacctgaccatccaccacaggacccacactggagagaagccctatgcctgtgaccactgtgaggaggccttcagccacaagagccggctgactgtgcaccagaggacccacactggagagaagccctatgaatgtaatgaatgtgggaagcccttcatcaacaagagcaacctgcggctgcaccagaggacccacactggagagaagccctatgaatgtaatgaatgtgggaagaccttccacaggaagagcttcctgaccatccaccagtggacccacactggagagaagccctatgaatgtaatgaatgtgggaagaccttccgctgcaagagcttcctgactgtgcaccagaggacccatgctggggagaagccctatgcctgcaatgaatgtgggaagacctacagccacaagagctacctgactgtgcaccacaggacccacactggagagaagccctatgaatgtaatgaatgtgggaagagcttccactgcaagagcttcctgaccatccaccagaggacccatgctgggaagaagccctatgaatgtaatgaatgtgagaagaccttcatcaacaagctgaacctgggcatccacaagaggacccacactggagagcggccctatgaatgtaatgaatgtgggaagaccttccggcagaagagcaacctgagcacccaccagggcacccacactggagagaagccctacgtgtgcaatgaatgtgggaagaccttccacaggaagagcttcctgaccatccaccagaggacccacacaggcaagaacaggatggatgtgatgaatgtggagaagctgtttgtgaggaaccacaccctgctgtacatccgggagctgaccccaggcaagagccccatgaatgtgatgaatgtggagaaccccttcatccggcggcagatcttccgcagcatcaaggtgttcacccggggcaggaaccccatgaatgtggccaacgtggagaagccctgccagaagtctgtgctgactgtgcaccacaggacccacactggagagaagccctatgagtgcaatgaatgtgggaagaccttctgccacaagagcaacctgagcacccaccagggcacccacagcggggagaagccctatgaatgtgatgaatgtaggaagaccttctatgacaagacagtgctgaccatccaccagaggacccacactggagagaagccctttgagtgcaaggaatgtaggaagaccttcagccagaagagcaagctgtttgtgcaccacaggacccacactggagagaagcccttccgctgcaatgaatgtaggaagaccttcagccagaagagcggcctgagcatccaccagaggacccacactggagagaagccctatgagtgcaaggaatgtgggaagaccttctgccagaagagccacctgagccgccaccagcagacccacatcggggagaagagtgatgtggccgaggccggctacgtgttcccccagaaccacagcttcttcccctag

SEQ ID NO: 43825 - DNA, 2745 bp, Artificial Sequence
  Description of Artificial Sequence: Synthetic coding sequence
atgtttcctgtgttcagcggctgcttccaggagctgcaggagaagaacaagagcctggagctggtgtcctttgaggaggtggccgtgcacttcacctgggaggagtggcaggacctggatgatgcccagaggaccctgtacagagatgtgatgctggagacctacagcagcctggtgtccctgggccactacatcaccaagccagagatgatcttcaagctggagcagggcgctgagccctggatcgtggaggagacccccaacctgcggctgtctgctgtgcagatcattgatgacctgattgaaagaagccatgagagccatgaccgcttcttctggcagatcgtcatcaccaacagcaacaccagcacccaggagcgggtggagctgggcaagaccttcaacctgaacagcaaccacgtgctgaacctgatcatcaacaacggcaacagcagcggcatgaagccaggccagttcaatgactgccagaacatgctgttccccatcaagccaggagagacccagagcggggagaagccccacgtgtgtgacatcaccaggaggagccaccgccaccacgagcacctgacccagcaccacaagatccagaccctgctgcagaccttccagtgcaatgagcagggcaagaccttcaacacagaggccatgttcttcatccacaagagggtgcacatcgtgcagaccttcggcaagtacaatgaatatgagaaggcctgcaacaacagcgctgtgattgtgcaggtgatcacccaggtgggccagcccacctgctgcaggaagagtgacttcaccaagcaccagcagacccacactggagagaagccctatgaatgtgtggagtgtgagaagcccagcatcagcaagagtgacctgatgctgcagtgcaagatgcccacagaggagaagccctatgcctgcaactggtgtgagaagctgttctcctacaagagcagcctcatcatccaccagaggatccacactggagagaagccctacggctgcaatgaatgtgggaagaccttccggaggaagagcttcctgaccctgcacgagaggacccacactggagacaagccctacaagtgcattgaatgtgggaagaccttccactgcaagagcctgctgaccctgcaccacaggacccacagcggggagaagccctaccagtgcagtgaatgtgggaagaccttcagccagaagagctacctgaccatccaccacaggacccacactggagagaagccctatgcctgtgaccactgtgaggaggccttcagccacaagagccggctgactgtgcaccagaggacccacactggagagaagccctatgagtgcaatgaatgtgggaagcccttcatcaacaagagcaacctgcggctgcaccagaggacccacactggagagaagccctatgagtgcaatgaatgtgggaagaccttccacaggaagagcttcctgaccatccaccagtggacccacactggagagaagccctatgagtgcaatgaatgtgggaagaccttccgctgcaagagcttcctgactgtgcaccagaggacccacgccggggagaagccctatgcctgcaatgaatgtgggaagacctacagccacaagagctacctgactgtgcaccacaggacccacactggagagaagccctatgagtgcaatgaatgtgggaagagcttccactgcaagagcttcctgaccatccaccagaggacccacgccggcaagaagccctatgagtgcaatgaatgtgagaagaccttcatcaacaagctgaacctgggcatccacaagaggacccacactggagagcggccctatgagtgcaatgaatgtgggaagaccttccggcagaagagcaacctgagcacccaccagggcacccacactggagagaagccctacgtgtgcaatgaatgtgggaagaccttccacaggaagagcttcctgaccatccaccagaggacccacacaggcaagaacaggatggatgtgatgaatgtggagaagctgtttgtgaggaaccacaccctgctgtacatccgggagctgacccctgggaagagccccatgaatgtgatgaatgtggagaaccccttcatccggcggcagatcttccgcagcatcaaggtgttcacccggggcaggaaccccatgaatgtggccaacgtggagaagccctgccagaagtctgtgctgactgtgcaccacaggacccacactggagagaagccctatgaatgtaatgaatgtgggaagaccttctgccacaagagcaacctgagcacccaccagggcacccacagcggggagaagccctatgaatgtgatgagtgcaggaagaccttctatgacaagacagtgctgaccatccaccagaggacccacactggagagaagccctttgagtgcaaggagtgcaggaagaccttcagccagaagagcaagctgtttgtgcaccacaggacccacactggagagaagcccttccgctgcaatgaatgtaggaagaccttcagccagaagagcggcctgagcatccaccagaggacccacactggagagaagccctatgagtgcaaggaatgtgggaagaccttctgccagaagagccacctgagccgccaccagcagacccacatcggggagaagagtgatgtggccgaggccggctacgtgttcccccagaaccacagcttcttcccctag

SEQ ID NO: 43826 - DNA, 381 bp, Artificial Sequence
  Description of Artificial Sequence: Synthetic coding sequence
atgggcctgctgaccttcagagatgtggccatcgagttcagccgggaggagtgggagcacctggacagcgaccagaagctgctgtatggagatgtgatgctggagaactacggcaacctggtgtccctgggcctggccgtgtccaagccagacctgatcaccttcctggagcagaggaaggagccctggaatgtgaagtctgctgagaccgtggccatccagcctgacatcttcagccatgacacccagggcctgctgaggaagaagctgattgaggccagcttccagaaggtgatcctggatggctacggcagctgtggcccccagaacctgaacctgaggaaggagtgggagagcgagggcaagatcatcctgtggtag

SEQ ID NO: 43827 - DNA, 537 bp, Artificial Sequence
  Description of Artificial Sequence: Synthetic coding sequence
atggtgaatgtgcctgacatcttcagccatgacacccagggcctgctgaggaagaagctgattgaggccagcttccagaaggtgatcctggatggctacggcagctgtggcccccagaacctgaacctgaggaaggagtgggagagcgagggcaaatgtgagggccacaacggctactatgatggccacaccaagtgcaagaccaccacctacaacaagaacctgactgtgactggaggccagaagcatgagaagacccagttcatgtctgtggccttcagcaagccctgtgtgtctgtgtccaagtgccagcaccagttcctgaagctgaccttctccttcaagggcaacctggacaaccccaacagcgacctggtgcacgtgagcaacaaccacctgaaccagctgaagtacagaactggagtgaatgtgcagagcaacatcagcgagaaggagcgcttcaagaatgaggaggtgatcagcaaatatgaccagtttgatggcagcctgctgaaggtgtgcttcaccaacaagtag

SEQ ID NO: 43828 - DNA, 1428 bp, Artificial Sequence
  Description of Artificial Sequence: Synthetic coding sequence
atgagcctggccaccgtggacaccctgtacatcttcagccatgacacccagggcctgctgaggaagaagctgattgaggccagcttccagaaggtgatcctggatggctacggcagctgtggcccccagaacctgaacctgaggaaggagtgggagagcgaggagaagaaccagtacaacaagagtgacaccaccctgagccagggcatcagccccaggaggcaccagaagacccacttcctgcacaaccactgcaagaggaagaagtgtgagaaggccttccacgagtgcaccaaccacgtgcaccagagcatcttcatccaggagaagagcgccaagtgcaacaagtgcatcgagaccttcatccagagcagcaagcacacccagccccagaggatccacatcggggagaagagccaccgctgcaacaacggggagaagatcctgagcaagctgagcagcctgaggaagcacaagatcatccacaatgaggagaagccctacaagtgcaaggaatgtgacaaggccttcaaccacaggagccacctgacccagcaccagatcatccacactggagagaagccctacaagtgcaaggaatgtgggaaggccttcaacagcagcagctacttcaccaggcaccagaggatccacactggagagaagctgtacaagtgcaaggcctgcagcaagtgcttcacccacagcagcaacctgctggtgcaccagaggatccacactggagagaagccctacaagtgcaaggaatgtgggaagagcttcaaggtgtcctctgccctgacccagcacgagcgcatccacactggagagaagccctacaagtgcaaggagtgcagcaaggccttcaactgccgcagctacctgaccaagcaccagaggatccacactggagagaagctgtacaagtgcaagagctgcagcaagagcttcagccgcagcagcagcctcatcgtgcaccagaggatccacactggagagaagccctacaagtgcaaggaatgtgggaaggccttcaactgcagcagccggctgacccagcaccagaggatccacactggagagaagccctacatctgcaaggaatgtgggaaggccttcaactgcagcagcagcctgaccaagcaccagaggatccacactggagtgaagctgtacaagtgcaaggcctgcagcaagagcttcagccacagcagctgcctgtctgtgcaccagatcacccacacaggcatgaagccctacatctgcaaggactgtggcatctccttcaacagaagcagcaacctgcggcggcaccagatgatccacactggagagaagccctacaagtgcaaggaatgtgggaagctgttcaaccgctgcagcaccctgaccaggcacaagagcatccacacccgggagttcctgtag

SEQ ID NO: 43829 - DNA, 1860 bp, Artificial Sequence
  Description of Artificial Sequence: Synthetic coding sequence
atgggccccctgaccttcatggatgtggccatcgagttctctgtggaggagtggcagtgcctggacacagcccagcagaacctgtacagaaatgtgatgctggagaactacagaaacctggtgttcctgggcattgctgtgtccaagccagacctgatcacctgcctggagcagggcaaggagccctggaacatggagagacatgagatggtggccaagcccccaggcatgtgctgctactttgcccaggacctgcggcctgagcagagcatcaaggccagcctgcagaggatcatcctgaggaaatatgaaaaatgtggccaccacaacctgcagctgaagaagggctacaagtctgtggatgagtacaaggtgcacaagggcagctacaacggcttcaaccagtgcctgaccaccacccagagcaagatcttccagtgtgacaagtatgtgaaggacttccacaagttcagcaacagcaacagacacaagacagagaagaaccccttcaagtgcaaggaatgtgggaagagcttctgtgtgctgagccacctgacccagcacaagaggatccacaccaccgtgaacagctacaagctggaggagtgtgggaaggccttcaacgtgagcagcaccctgagccagcacaagaggatccacacaggccagaagcactacaagtgtgaggagtgtggcatcgccttcaacaagagcagccacctgaacacccacaagatcatccacactggagagaagagctacaagcgggaggagtgtgggaaggccttcaacatcagcagccacctgaccacccacaagatcatccacactggagaaaatgcctacaagtgcaaggaatgtgggaaggccttcaaccagagcagcaccctgaccaggcacaagatcatccatgctggggagaagccctacatctgtgagcactgcggccgggccttcaaccagagcagcaacctgaccaagcacaagaggatccacactggagacaagccctacaagtgtgaggagtgtgggaaggccttcaacgtgagcagcaccctgacccagcacaagaggatccacactggagagaagccctacaagtgtgaggagtgtgggaaggccttcaacgtgagcagcaccctgacccagcacaagaggatccacactggagagaagccctacaagtgtgaggagtgtgggaaggccttcaacaccagcagccacctgaccacccacaagaggatccacactggagagaagccctacaagtgtgaggagtgtgggaaggccttcaaccagttcagccagctgaccacccacaagatcatccacactggagagaagccctacaagtgcaaggaatgtgggaaggccttcaagaggagcagcaacctgacagagcaccgcatcatccacactggagagaagccctacaagtgtgaggagtgtgggaaggccttcaacctgagcagccacctgaccacccacaagaagatccacactggagagaagccctacaagtgcaaggaatgtgggaaggccttcaaccagagcagcaccctggcccggcacaagatcatccatgctggggagaagccctacaagtgtgaggagtgtgggaaggccttctaccagtacagcaacctgacccagcacaagatcatccacactggagagaagccctacaagtgtgaggagtgtgggaaggccttcaactggagcagcaccctgaccaagcacaaggtgatccacactggagagaagccctacaagtgcaaggaatgtgggaaggccttcaaccagtgcagcaacctgaccacccacaagaagatccatgctgtggagaagagtgacaagtag

SEQ ID NO: 43830 - DNA, 1500 bp, Artificial Sequence
  Description of Artificial Sequence: Synthetic coding sequence
atgagggtgctgaccttcagagatgtggccgtggagttcagccctgaggagtgggagtgcctggacagcgcccagcagaggctgtacagagatgtgatgctggagaactacggcaacctcttcagcctgggcctggccatcttcaagccagacctgatcacctacctggagcagaggaaggagccctggaatgcccggcggcagaagacagtggccaagcaccctgctggcagcctgcacttcaccgctgagatcctgctggagcatgacatcaatgacagcttccagaaggtgatcctgaggaagagcggcagctgtgacctgaacaccctgcggctgaagaaggactaccagagggtgggcaactgcaagggccagaagagcagctacaacggcatccaccagtgcctgagcgccaccaggagcaagacctgccagtacaacaagtgtgggaaggccttcggcctgtgcagcatcttcacagagcacaagaagatcttcagccgggagaagtgctacaagtgtgaagaatgtgggaaggactgccgcctgagtgacttcaccatccagaagaggatccacacagctgacaggagctacaagtgtgaggagtgtgggaaggcctgcaagaagttcagcaacctgacagagcacaacagagtgcacacaggcaagaagccctacaagtgtgaggagtgtgggaagaccttcacctgcagcagcgccctgaccaagcacaagaggaaccacactggagaccggccctacaagtgtgaggagtgccacaaggccttccgctgctgcagcgacctgaccaagcacaagaggatccacactggagagaagccctacaagtgcaaggagtgccacaaggccttccgctgctgcagcgacctgaccaagcacaagaggatccacactggagagaagccctacaagtgcaatgaatgtgggaaggccttcatgtggatcagcgccctgagccagcacaaccgcatccacactggagagaagccctacatctgtgaggagtgtgggaaggccttcacctacagcagcaccctcatcagccacaagaggatccacatggagctgcggccctacaagtgtgaggagtgtgggaagaccttcaagtggttcagtgacctgaccaaccacaagaggatccacactggagagaagccctacaagtgtgaggagtgtgggaagagcttcacctgcagcagcaacctgatcaagcacaagaggatccacatggaggtgcggccctacaagtgtgaggagtgtgggaagaccttcaagtggttcccagacctgaccaaccacaagaggatccacactggagagaagccctacaagtgtgaggagtgtgggaagaccttcacctgcagcagcagcctcatcaagcacaagaggagccacactggagaccggcccaccagcgccaagaatgtggccaagcccctgggcggcagccagaccctgctgaacatcagatag

SEQ ID NO: 43831 - DNA, 1869 bp, Artificial Sequence
  Description of Artificial Sequence: Synthetic coding sequence
atgggcagcctgaccttcagagatgtggccatccagttcagcctggaggagtggcagtgcctggacacagcccagcagaacctgtacagaaatgtgatgctggagaactacagaaacctggtgttcctgggcattgctgcccccaagccagacctgatcatcttcctggagcagggcaaggagccctggaacatgaagagacatgagctggtgaaggagccccctgtgatctgcagccactttgcccaggacctgtggccagagcagggccgggaggacagcttccagaaggtgatcctgcggcgctatgaaaaatgtggccacgagaacctgcagctgaagattggctgcaccaacgtggatgagtgcaaggtgcacaagaagggctacaacaagctgaaccagagcctgaccaccacccagagcaaggtgttccagtgtgggaagtatgccaacatcttccacaagtgcagcaacagcaagaggcacaagatccgccacacaggcaagaagctgctgaagtgcaaggagtatgtgcgctccttctgcatgctgagccacctgagccagcacaagaggatctacacccgggagaacagctacaagtctgaggagcacggcaaggccttcaactggagcagcgccctgacctacaagaggatccacactggagagaagccctgcaagtgtgaggagtgtgggaaggccttcagcaagttcagcatcctgaccaagcacaaggtgatccacactggagagaagcactacaagtgtgaggagtgtgggaaggccttcaccaggagcagcagcctcatcgagcacaagaggagccatgctggggagaagccctacaagtgtgaggagtgtgggaaggccttcagcaaggccagcaccctgacagcccacaagaccatccatgctggggagaagccctacaagtgtgaggagtgtgggaaggccttcaacagaagcagcaacctgatggagcacaagaggatccacactggagagaagccctgcaagtgtgaggagtgtgggaaggcctttggaaacttcagcaccctgaccaagcacaaggtgatccacactggagagaagccctacaagtgtgaggagtgtgggaaggccttctcctggcccagcagcctgacagagcacaagagaattcatgctggggacaagccctacaagtgtgaggagtgtgggaagaccttcaagtggagcagcaccctgaccaagcacaagatcatccacactggagagaagccctacaagtgtgaggagtgtgggaaggccttcaccaccttcagcagcctgaccaagcacaaggtgatccacactggagagaagcactacaagtgtgaggagtgtgggaaggtgttctcctggagcagcagcctgaccacccacaaggccatccatgctggggagaagctgtacaagtgtgaggagtgtgggaaggccttcaagtggagcagcaacctgatggagcacaagaggatccacactggagagaagccctacaagtgtgaggagtgtgggaaggccttcagcaaggtggccaacctgaccaagcacaaggtgatccacactggagagaagcagtacaagtgtgaggagtgtgggaaggccttcatctggagcagccggctgtctgagcacaagaggatccacactggagagaagccctacaagtgtgaggagtgtgggaaggccttctcctgggtgtctgtgctgaacaagcacaagaagatccatgctgggaagaagttctacaagtgtgaggagtgtgggaaggacttcaaccagagcagccacctgaccacccacaagaggatccacactggaggcaagaccctgcagatgtag

SEQ ID NO: 43832 - DNA, 3522 bp, Artificial Sequence
  Description of Artificial Sequence: Synthetic coding sequence
atgcctggggcccctggcagcctggagatgggccccctgaccttcagagatgtgaccatcgagttcagcctggaggagtggcagtgcctggacacagtgcagcagaacctgtacagagatgtgatgctggagaactacagaaacctggtgttcctgggcatggctgtgttcaagccagacctgatcacctgcctgaagcagggcaaggagccctggaacatgaagagacatgagatggtgaccaagccccctgtgatgaggagccacttcacccaggacctgtggccagaccagagcaccaaggacagcttccaggaggtgatcctgcggacctacgcccgctgtggccacaagaacctgcggctgaggaaggactgcaagagcgccaatgaaggcaagatgcacaaggagggctacaacaagctgaaccagtgcaggacagccacccagaggaagatcttccagtgcaacaagcacatgaaggtgttccacaagtacagcaacagaaacaaggtgcgccacaccaagaagaagaccttcaagtgcatcaagtgcagcaagagcttcttcatgctgagctgcctgatccgccacaagaggatccacatccggcagaacatctacaagtgtgaggagcggggcaaggccttcaagagcttcagcaccctgaccaagcacaagatcatccacacagaggacaagccctacaagtacaagaagtgtggaaatgccttcaagttcagcagcaccttcaccaagcacaagaggatccacactggagagacccccttccgctgtgaggagtgtgggaaggccttcaaccagagcagcaacctgacagaccacaagaggatccacactggagagaagacctacaagtgtgaggagtgtgggaaggccttcaagggcagcagcaacttcaatgcccacaaggtgatccacacagctgagaagccctacaagtgtgaggactgtgggaagaccttcaaccacttcagcgccctgaggaagcacaagatcatccacacaggcaagaagccctacaagcgggaggagtgtgggaaggccttcagccagagcagcaccctgaggaagcatgagatcatccacactggagagaagccctacaagtgtgaggagtgtgggaaggccttcaagtggagcagcaagctgactgtgcacaaggtggtgcacactggagagaagccctacaagtgtgaggagtgtgggaaggccttcagccagttcagcaccctgaagaagcacaagatcatccacacaggcaagaagccctacaagtgtgaggagtgtgggaaggccttcaacagcagcagcaccctgatgaagcacaagatcatccacactggagagaagccctacaagtgtgaggagtgtgggaaggccttccggcagagcagccacctgaccaggcacaaggccatccacactggagagaagccctacaagtgtgaggagtgtgggaaggccttcaaccacttcagtgacctgcggcggcacaagatcatccacacaggcaagaagccctacaagtgtgaggagtgtgggaaggccttcagccagagcagcaccctgaggaaccaccagatcatccacactggagagaagccctacaagtgtgaggagtgtgggaaggccttcaagtggagcagcaagctgactgtgcacaaggtgatccacactggagagaagccctgcaagtgtgaggagtgtgggaaggccttcaagcacttcagcgccctgaggaagcacaaggtgatccacacccgggagaagctgtacaagtgtgaggagtgtgggaaggccttcaacaacagcagcatcctggccaagcacaagatcatccacacaggcaagaagccctacaagtgtgaggagtgtgggaaggccttccggcagagcagccacctgaccaggcacaaggccatccacactggagagaagccctacaagtgtgaggagtgtgggaaggccttcagccacttcagcgccctgcggcggcacaagatcatccacacaggcaagaagccctacaagtgtgaggagtgtgggaaggccttcagccacttcagcgccctgcggcggcacaagatcatccacactggagagaagccctacaagtgtgaggagtgtgggaaggccttcaagtggagcagcaagctgactgtgcacaaggtgatccacacagctgagaagccctgcaagtgtgaggagtgtgggaagagcttcaagcacttcagcgccctgaggaagcacaaggtgatccacacccgggagaagctgtacaagtgtgaggagtgtgtgaaggccttcaacagcttcagcgccctgatgaagcacaaggtgatccacactggagagaagccctacaagtgtgaggagtgtgggaaggccttcaagtggagcagcaagctgactgtgcacaaggtgatccacactggagagaagccctgcaagtgtgaggagtgtgggaaggccttcaagcacttcagcgccctgaggaagcacaaggtgatccacacaggcaagaagccctacaagtgtgaggagtgtgggaaggccttcagccagagcagcagcctgaggaagcatgagatcatccacagcggggagaagccctacaagtgtgaggagtgtgggaaggccttcaagtggctgagcaagctgactgtgcacaagatcatccacacaggcaagaagccctacaagtgtgaggagtgtgggaaggccttcaatgacagcagcaccctgatgaagcacaagatcatccacacaggcaagaagccctacaagtgtgccgagtgtgggaaggccttcaagcagagcagccacctgaccaggcacaaggccatccacactggagagaagccctacaagtgtgaggagtgtgggaaggacttcaacaacagcagcaccctgaagaagcacaagctgatccacacccgggagaagctgtacaagtgtgaggagtgtgtgaaggccttcaacaacttcagcgccctgatgaagcacaagatcatccacactggagagaagccctacaagtgtgaggagtgtgggaaggccttcaagtggagcagcaagctgacagagcacaaggtgatccacactggagagaagccctgcaagtgtgaggagtgtgacaaggccttcaagcacttcagcgccctgaggaagcacaaggtgatccacacaggcaagaagccctaccagtgtgatgaatgtgggaaggccttcaacaacagcagcaccctgaccaagcacaagatcatccacactggagagaagccctacaagtgtgaggagtgtgggaaggccttcagccagagcagcatcctgaccaagcacaagatcatccacagcgtggagaagccctacaagtgtgaggagtgtgggaaggccttcaaccagagcagccacctgaccaggcacaagaccatccacactggagagaagccctacaagtacaagaccatccacactggagagaagccctacaagtag

SEQ ID NO: 43833 - DNA, 3759 bp, Artificial Sequence
  Description of Artificial Sequence: Synthetic coding sequence
atgcctggggcccctggcagcctggagatgggccccctgaccttcagagatgtgaccatcgagttcagcctggaggagtggcagtgcctggacacagtgcagcagaacctgtacagagatgtgatgctggagaactacagaaacctggtgttcctgggcatggctgtgttcaagccagacctgatcacctgcctgaagcagggcaaggagccctggaacatgaagagacatgagatggtgaccaagccccctgtgatgaggagccacttcacccaggacctgtggccagaccagagcaccaaggacagcttccaggaggtgatcctgcggacctacgcccgctgtggccacaagaacctgcggctgaggaaggactgcaagagcgccaatgaaggcaagatgcacaaggagggctacaacaagctgaaccagtgcaggacagccacccagaggaagatcttccagtgcaacaagcacatgaaggtgttccacaagtacagcaacagaaacaaggtgcgccacaccaagaagaagaccttcaagtgcatcaagtgcagcaagagcttcttcatgctgagctgcctgatccgccacaagaggatccacatccggcagaacatctacaagtgtgaggagcggggcaaggccttcaagagcttcagcaccctgaccaagcacaagatcatccacacagaggacaagccctacaagtacaagaagtgtggaaatgccttcaagttcagcagcaccttcaccaagcacaagaggatccacactggagagacccccttccgctgtgaggagtgtgggaaggccttcaaccagagcagcaacctgacagaccacaagaggatccacactggagagaagacctacaagtgtgaggagtgtgggaaggccttcaagggcagcagcaacttcaatgcccacaaggtgatccacacagctgagaagccctacaagtgtgaggactgtgggaagaccttcaaccacttcagcgccctgaggaagcacaagatcatccacacaggcaagaagccctacaagcgggaggagtgtgggaaggccttcagccagagcagcaccctgaggaagcatgagatcatccacactggagagaagccctacaagtgtgaggagtgtgggaaggccttcaagtggagcagcaagctgactgtgcacaaggtggtgcacactggagagaagccctacaagtgtgaggagtgtgggaaggccttcagccagttcagcaccctgaagaagcacaagatcatccacacaggcaagaagccctacaagtgtgaggagtgtgggaaggccttcaacagcagcagcaccctgatgaagcacaagatcatccacactggagagaagccctacaagtgtgaggagtgtgggaaggccttccggcagagcagccacctgaccaggcacaaggccatccacactggagagaagccctacaagtgtgaggagtgtgggaaggccttcaaccacttcagtgacctgcggcggcacaagatcatccacacaggcaagaagccctacaagtgtgaggagtgtgggaaggccttcagccagagcagcaccctgaggaaccaccagatcatccacactggagagaagccctacaagtgtgaggagtgtgggaaggccttcaagtggagcagcaagctgactgtgcacaaggtgatccacactggagagaagccctgcaagtgtgaggagtgtgggaaggccttcaagcacttcagcgccctgaggaagcacaaggtgatccacacccgggagaagctgtacaagtgtgaggagtgtgggaaggccttcaacaacagcagcatcctggccaagcacaagatcatccacacaggcaagaagccctacaagtgtgaggagtgtgggaaggccttccggcagagcagccacctgaccaggcacaaggccatccacactggagagaagccctacaagtgtgaggagtgtgggaaggccttcagccacttcagcgccctgcggcggcacaagatcatccacacaggcaagaagccctacaagtgtgaggagtgtgggaaggccttcagccacttcagcgccctgcggcggcacaagatcatccacactggagagaagccctacaagtgtgaggagtgtgggaaggccttcaagtggagcagcaagctgactgtgcacaaggtgatccacacagctgagaagccctgcaagtgtgaggagtgtgggaagagcttcaagcacttcagcgccctgaggaagcacaaggtgatccacacccgggagaagctgtacaagtgtgaggagtgtgtgaaggccttcaacagcttcagcgccctgatgaagcacaaggtgatccacactggagagaagccctacaagtgtgaggagtgtgggaaggccttcaagtggagcagcaagctgactgtgcacaaggtgatccacactggagagaagccctgcaagtgtgaggagtgtgggaaggccttcaagcacttcagcgccctgaggaagcacaaggtgatccacacaggcaagaagccctacaagtgtgaggagtgtgggaaggccttcagccagagcagcagcctgaggaagcatgagatcatccacagcggggagaagccctacaagtgtgaggagtgtgggaaggccttcaagtggctgagcaagctgactgtgcacaaggtgatccacacagctgagaagccctgcaagtgtgaggagtgtgggaaggccttcaagcacttcagcgccctgaggaagcacaagatcatccacacaggcaagaagccctacaagtgtgaggagtgtgggaaggccttcaatgacagcagcaccctgatgaagcacaagatcatccacacaggcaagaagccctacaagtgtgccgagtgtgggaaggccttcaagcagagcagccacctgaccaggcacaaggccatccacactggagagaagccctacaagtgtgaggagtgtgggaaggacttcaacaacagcagcaccctgaagaagcacaagctgatccacacccgggagaagctgtacaagtgtgaggagtgtgtgaaggccttcaacaacttcagcgccctgatgaagcacaagatcatccacactggagagaagccctacaagtgtgaggagtgtgggaaggccttcaagtggagcagcaagctgacagagcacaaggtgatccacactggagagaagccctgcaagtgtgaggagtgtgacaaggccttcaagcacttcagcgccctgaggaagcacaaggtgatccacacaggcaagaagccctaccagtgtgatgaatgtgggaaggccttcaacaacagcagcaccctgaccaagcacaagatcatccacactggagagaagccctacaagtgtgaggagtgtgggaaggccttcagccagagcagcatcctgaccaagcacaagatcatccacagcgtggagaagccctacaagtgtgaggagtgtgggaaggccttcaaccagagcagccacctgaccaggcacaagaccatccacactggagagaagccctacaagtgtgaggagtgtgggaaggccttcatccagtgcagctacctgatccgccacaagaccatccacacccgggagaagcccaccaacgtgaagaaggtgcccaagctgctgagcaacccccacaccctgctggacaagaccatccacactggagagaagccctacaagtgtgaagaatgtgccaaggccttctag

SEQ ID NO: 43834 - DNA, 576 bp, Artificial Sequence
  Description of Artificial Sequence: Synthetic coding sequence
atgacagaccccagcctgggcctgactgtgcccatggccccacccctggcccccctgcccccccgggaccccaatggagctggcagcgagtggaggaagccaggagctgtgtcctttgctgatgtggccgtgtacttcagccgggaggagtggggctgcctgcggcctgcccagagggccctgtacagagatgtgatgagggagacctacggccacctgggcgccctgggggagagccccacctgcctgcccggcccctgtgccagcacaggccctgctgcccccctgggcgccgcctgtggggtgggcggccctggagctggccaggccgccagcagccagaggggcgtgtgtgtgctgctgccccaggagagcgaggccgccagccgccgcagcagccctggctggaggcggcggcccaactgtggcatccggctgccccgcatccgccgctggaggtctgtgcggcagaagaggacccagcagatccctgagaccaggaagaggaaggacaagggcaagggccgggagccctggaggagccccaccctgtggcccccaggcctgctgggctag

SEQ ID NO: 43835 - DNA, 573 bp, Artificial Sequence
  Description of Artificial Sequence: Synthetic coding sequence
atgacagaccccagcctgggcctgactgtgcccatggccccacccctggcccccctgcccccccgggaccccaatggagctggcagcgagtggaggaagccaggagctgtgtcctttgctgatgtggccgtgtacttcagccgggaggagtggggctgcctgcggcctgcccagagggccctgtacagagatgtgatgagggagacctacggccacctgggcgccctgggggagagccccacctgcctgcccggcccctgtgccagcacaggccctgctgcccccctgggcgccgcctgtggggtgggcggccctggagctggccaggccgccagcagccagaggggcgtgtgtgtgctgctgccccaggagagcgaggccgccagccgccgcagcagccctggctggaggcggcggcccaactgtggcatccggctgccccgcatccgccgctggaggtctgtgcggcagaagaggacccagatccctgagaccaggaagaggaaggacaagggcaagggccgggagccctggaggagccccaccctgtggcccccaggcctgctgggctag

SEQ ID NO: 43836 - DNA, 993 bp, Artificial Sequence
  Description of Artificial Sequence: Synthetic coding sequence
atgacagaccccagcctgggcctgactgtgcccatggccccacccctggcccccctgcccccccgggaccccaatggagctggcagcgagtggaggaagccaggagctgtgtcctttgctgatgtggccgtgtacttcagccgggaggagtggggctgcctgcggcctgcccagagggccctgtacagagatgtgatgagggagacctacggccacctgggcgccctgggcgtgggcggcagcaagccagccctgatctcctgggtggaggagaaggccgagctgtgggaccctgctgcccaggaccctgaggtggccaagtgccccacagaggccgaccctgacagcaggaacaaggaggaggagcggcagcgggagggcaccggggccctggagaagccagaccctgtggccgccggcagccctggcctgaaggccccccaggccccctttgctggcctggagcagctgagcaaggcccggcggcgcagccggccccgcttctttgcccacccccctgtgcccagggctgaccagagacatggctgctacgtgtgtgggaagagctttgcctggaggagcaccctggtggagcacatctacagccacagaggagagaagcccttccactgtgccgactgtgggaagggcttcggccacgccagcagcctgagcaagcaccgggccatccacagaggagagcggccccaccgctgcccagaatgtggccgggccttcatgagaagaacagccctgaccagccacctgcgggtgcacactggagagaagccctaccgctgcccccagtgtggccgctgcttcggcctgaagacaggcatggccaagcaccagtgggtgcacaggcctggaggagagggccggcggggcagaagacctgggggcctgtctgtgaccctgacccctgtgcggggggacctggacccccctgtgggcttccagctgtacccagagatcttccaggagtgtggctag

SEQ ID NO: 43837 - DNA, 2496 bp, Artificial Sequence
  Description of Artificial Sequence: Synthetic coding sequence
atggagaaccagaggagcagccccctgtccttccccagcgtgccccaggaggagaccctgcggcaggccccagctggcctgccccgggagaccctcttccagagccgggtgctgccccccaaggagatccccagcctgagccccaccatcccccggcagggcagcctgccccagaccagcagcgcccccaagcaggagaccagcggccgcatgcctcatgtgctgcagaagggccccagcctgctgtgcagcgctgccagcgagcaggagaccagcctgcagggccccctggccagccaggagggcacccagtacccacctcctgctgctgctgagcaggaggtgtccctgctgagccacagcccccaccaccaggaggcccctgtgcacagccctgaggcccctgagaaggaccccctgaccctgagccccaccgtgcctgagacagacatggaccccctgctgcagagccctgtgtcccagaaggacacccccttccagatcagcagcgctgtgcagaaggagcagcccctgcccacagctgagatcacccggctggccgtgtgggccgctgtgcaggccgtggagaggaagctggaggcccaggccatgaggctgctgaccctggagggccgcacaggcaccaatgagaagaagattgctgactgtgagaagacagctgtggagtttgccaaccacctggagagcaagtgggtggtgctgggcaccctgctgcaggagtatggcctgctgcagaggcggctggagaacatggagaacctgctgaagaacagaaacttctggatcctgcggctgcccccaggcagcaatggagaggtgcccaaggtgcctgtgacctttgatgatgtggccgtgcacttcagcgagcaggagtggggcaacctgtctgagtggcagaaggagctgtacaagaatgtgatgaggggcaactatgagagcctggtgtccatggactatgccatcagcaagccagacctgatgagccagatggagcggggggagcggcccaccatgcaggagcaggaggacagcgaggagggggagacccccacagaccccagcgctgcccatgatggcatcgtcatcaagattgaggtgcagaccaatgatgagggcagcgagagcctggagaccccagagcccctgatgggccaggtggaggagcacggcttccaggacagcgagctgggggacccctgtggggagcagcctgacctggacatgcaggagcctgagaacaccctggaggagagcacagagggcagcagcgagttcagcgagctgaagcagatgctggtgcagcagaggaactgcacagagggcatcgtcatcaagacagaggagcaggatgaggaggaggaggaggaggaggaggatgagctgccccagcacctgcagagcctgggccagctgagcggccgctatgaggcctccatgtaccagacccccctgcccggggagatgagccctgagggggaggagagccccccacccctgcagctgggcaacccagctgtgaagaggctggcccccagcgtgcatggagagcggcacctgtctgagaacagaggagccagcagccagcagcagaggaacagaagaggagagcggcccttcacctgcatggagtgtgggaagagcttccggctgaagatcaacctgatcatccaccagaggaaccacatcaaggagggcccctatgaatgtgccgagtgtgagatctccttccgccacaagcagcagctgaccctgcaccagaggatccaccgggtgcggggcggctgtgtgtccccagagcggggccccaccttcaaccccaagcacgccctgaagccccggcccaagagccccagcagcggcagcggcggcggcggccccaagccctacaagtgcccagaatgtgacagcagcttcagccacaagagcagcctgaccaagcaccagatcacccacactggagagcggccctacacctgcccagagtgcaagaagagcttccggctgcacatcagcctggtgatccaccagagggtgcatgctgggaagcatgaggtgtccttcatctgcagcctgtgtgggaagagcttcagccggcccagccacctgctgcggcaccagaggacccacactggagagcggcccttcaagtgcccagaatgtgagaagagcttcagcgagaagagcaagctgaccaaccactgccgggtgcacagccgggagcggccccacgcctgcccagaatgtgggaagagcttcatcaggaagcaccacctgctggagcaccggcgcatccacactggagagcggccctaccactgtgccgagtgtgggaagcgcttcacccagaagcaccacctgctggagcaccagagggcccacactggagagcggccctacccctgcacccactgtgccaagtgcttccgctacaagcagagcctgaagtaccacctgcggacccacactggagagtag

SEQ ID NO: 43838 - DNA, 1575 bp, Artificial Sequence
  Description of Artificial Sequence: Synthetic coding sequence
atggagaacctgctgaagaacagaaacttctggatcctgcggctgcccccaggcagcaatggagaggtgcccaaggtgcctgtgacctttgatgatgtggccgtgcacttcagcgagcaggagtggggcaacctgtctgagtggcagaaggagctgtacaagaatgtgatgaggggcaactatgagagcctggtgtccatggactatgccatcagcaagccagacctgatgagccagatggagcggggggagcggcccaccatgcaggagcaggaggacagcgaggagggggagacccccacagaccccagcgctgcccatgatggcatcgtcatcaagattgaggtgcagaccaatgatgagggcagcgagagcctggagaccccagagcccctgatgggccaggtggaggagcacggcttccaggacagcgagctgggggacccctgtggggagcagcctgacctggacatgcaggagcctgagaacaccctggaggagagcacagagggcagcagcgagttcagcgagctgaagcagatgctggtgcagcagaggaactgcacagagggcatcgtcatcaagacagaggagcaggatgaggaggaggaggaggaggaggaggatgagctgccccagcacctgcagagcctgggccagctgagcggccgctatgaggcctccatgtaccagacccccctgcctggagagatgagccctgagggggaggagagccccccacccctgcagctgggcaacccagctgtgaagaggctggcccccagcgtgcacggggagcggcacctgtctgaaaatagaggagccagcagccagcagcagaggaacagaagaggagagcggcccttcacctgcatggagtgtgggaagagcttccggctgaagatcaacctgatcatccaccagaggaaccacatcaaggagggcccctatgaatgtgctgaatgtgagatctccttccgccacaagcagcagctgaccctgcaccagaggatccaccgggtgcggggcggctgtgtgtccccagagcggggccccaccttcaaccccaagcacgccctgaagccccggcccaagagccccagcagcggcagcggcggcggcggccccaagccctacaagtgcccagaatgtgacagcagcttcagccacaagagcagcctgaccaagcaccagatcacccacactggagagcggccctacacctgcccagatgctgctgcccggcctggggcccgggctgtgccccccctgggccaccggcaggcccgggcccagagagctggccgcggggccccccagcccctgtgccgggagctgcccctgagcagccggcccagcagccagggccatggaggcagcgagaccaggagcctggccgccgccttcccccggggcccccagggcggcggccggggccctggagagcccttccgggctgtgaacttcctggacaacaagatggatgagaccaaccagcacggcggccgggacctggccgccggccacagcgagggccgctgccgggcccacctggtgggggacaggaccctgtag

SEQ ID NO: 43839 - DNA, 984 bp, Artificial Sequence
  Description of Artificial Sequence: Synthetic coding sequence
atgcagagaaatgccatgtacctgaagaatgtggccgagacagcctgcaacttccagctgacccagtaccagatcagccacgccaaccagaagccctatgagtgccagatctgtgggaagcccttcaggaagagggcccacctgacccagcacaaccgcatccacactggaggcaagccctatgagtgcaaggaatgtgggaaggtgttcatctgctgcagcaccctcatccagcacaagaggacccacaccagcgagaagccctatgagtgcctggagtgcaggaagaccttcagaagaagtgcccacctgatccgccaccagaggatccacactggagagaagccctacaagtgcaagcagtgctggaaggcctttgcctctgtgtctgacctgattgatattggcaagttcaccctgatgagggacttcaccaacgtgcagaatgtgggccgccacctgaccatcgcccagctgctcttcagcatccgggagttcaccctggtgcgcagccccctgaatgtgagaaatgtggccaagcacagcatcatcgcccagcacctgctgaacacccgggagctgatcctgatgaggaacctgatgaatgtgagaaatgtgaagaggctgctgggcaaggtgcacatcctgctgaacatcaaggagttcatcctggtgaggaaccacatgtctgtgtccaatgtgggccgcctgagcctggtgttcctgatcctgattgacatccgggagttcaccctggtgaagaaccccatgaatgtgaagaatgtggtggagctgctgaccatcgtgcagctgctcttcaacacccgggagttcaccctggtgcggcggctgatgaacatcagctctgtgggccgcttcctgagccctgtgcagcacctgttcaacatccgggagcacatcctgatgaagaacctgatgaatgtgtccaatgcccggcggcccagcagcatcatgcacatctag

SEQ ID NO: 43840 - DNA, 1062 bp, Artificial Sequence
  Description of Artificial Sequence: Synthetic coding sequence
atgcagagaaatgccatgtacctgaagaatgtggccgagacagcctgcaacttccagctgacccagtaccagatcagccacgccaaccagaagccctatgagtgccagatctgtgggaagcccttcaggaagagggcccacctgacccagcacaaccgcatccacactggaggcaagccctatgagtgcaaggaatgtgggaaggtgttcatctgctgcagcaccctcatccagcacaagaggacccacaccagcgagaagccctatgagtgcctggagtgcaggaagaccttcagaagaagtgcccacctgatccgccaccagaggatccacactggagagaagccctacaagtgcaagcagtgctggaaggcctttgcctctgtgtctgacctgattgatattggcaagttcaccctgatgagggacttcaccaacgtgcagaatgtgggccgccacctgaccatcgcccagctgctcttcagcatccgggagttcaccctggtgcgcagccccctgaatgtgagaaatgtggccaagcacagcatcatcgcccagcacctgctgaacacccgggagctgatcctgatgaggaacctgatgaatgtgagaaatgtgaagaggctgctgggcaaggtgcacatcctgctgaacatcaaggagttcatcctggtgaggaaccacatgtctgtgtccaatgtgggccgcctgagcctggtgttcctgatcctgattgacatccgggagttcaccctggtgaagaaccccatgaatgtgaagaatgtggtggagctgctgaccatcgtgcagctgctcttcaacacccgggagttcaccctggtgcggcggctgatgaacatcagctctgtgggccgcttcctgagccctgtgcagcacctgttcaacatccgggagcacatcctgatgaagaacctgatgaatgtgtccaatgcccggcggcccagcagcatcatgcacatcgacatccgggagttcaccgtgggcaggaaccccatgaatgtgatgaatgtgggcatgcccagctttgtgttcctgatctag

SEQ ID NO: 43841 - DNA, 1122 bp, Artificial Sequence
  Description of Artificial Sequence: Synthetic coding sequence
ctggagtaccagatccctgtgtccttcaaggatgtggtggtgggcttcacccaggaggagtggcaccggctgagccctgcccagagggccctgtacagagatgtgatgctggagacctacagcaacctggtgtctgtgggctatgagggcaccaagccagatgtgatcctgcggctggagcaggaggaggccccctggattggagaggccgcctgccccggctgccactgctgggaggacatctggagggtgaacatccagaggaagaggcggcaggacatgctgctgcggcctggggccgccatcagcaagaagaccctgcccaaggagaagagctgtgagtacaacaagtttgggaagatcagcctgctgagcacagacctcttcagcagcatccagagccccagcaactggaacccctgtgggaagaacctgaaccacaacctggacctgattggcttcaagaggaactgtgccaagaagcaggatgagtgctacgcctacggcaagctgctgcagaggatcaaccacggcagaagacccaacggggagaagccccggggctgcagccactgtgagaaggccttcacccagaacccagccctgatgtacaagccagctgtgtctgacagcctgctgtacaagaggaagagggtgcccccaacagagaagccccacgtgtgcagtgaatgtgggaaggccttctgctacaagtctgagttcatccgccaccagaggagccacactggagagaagccctacggctgcacagactgtgggaaggccttcagccacaagagcaccctcatcaagcaccagaggatccacactggagtgcggccctttgagtgcttcttctgtgggaaggccttcacccagaagagccacaggacagagcaccagaggacccacactggagagcggccctttgtgtgcagtgaatgtgggaagagctttggagagaagagctacctgaatgtgcacaggaagatgcacactggagagcggccctaccgctgccgggagtgtgggaagagcttcagccagaagagctgcctgaacaagcactggaggacccactttggagagagcagcctgcggagcaagagcagcaacacctag

SEQ ID NO: 43842 - DNA, 1125 bp, Artificial Sequence
  Description of Artificial Sequence: Synthetic coding sequence
atgattgagtaccagatccctgtgtccttcaaggatgtggtggtgggcttcacccaggaggagtggcaccggctgagccctgcccagagggccctgtacagagatgtgatgctggagacctacagcaacctggtgtctgtgggctatgagggcaccaagccagatgtgatcctgcggctggagcaggaggaggccccctggattggagaggccgcctgccccggctgccactgctgggaggacatctggagggtgaacatccagaggaagaggcggcaggacatgctgctgcggcctggagctgccatcagcaagaagaccctgcccaaggagaagagctgtgagtacaacaagtttgggaagatcagcctgctgagcacagacctcttcagcagcatccagagccccagcaactggaacccctgtgggaagaacctgaaccacaacctggacctgattggcttcaagaggaactgtgccaagaagcaggatgaatgttatgcctacggcaagctgctgcagaggatcaaccacggccggcggcccaatggagagaagccccggggctgcagccactgtgagaaggccttcacccagaacccagccctgatgtacaagccagctgtgtctgacagcctgctgtacaagaggaagagggtgcccccaacagagaagccccacgtgtgcagtgaatgtgggaaggccttctgctacaagtctgagttcatccgccaccagaggagccacactggagagaagccctacggctgcacagactgtgggaaggccttcagccacaagagcaccctcatcaagcaccagaggatccacactggagtgcggccctttgagtgcttcttctgtgggaaggccttcacccagaagagccacaggacagagcaccagaggacccacactggagagcggccctttgtgtgcagtgaatgtgggaagagctttggagagaagagctacctgaatgtgcacaggaagatgcacactggagagcggccctaccgctgcagagaatgtgggaagagcttcagccagaagagctgcctgaacaagcactggaggacccacactggagagagcctggagccccggcggcagaggctgcagtag

SEQ ID NO: 43843 - DNA, 1221 bp, Artificial Sequence
  Description of Artificial Sequence: Synthetic coding sequence
atgattgagtaccagatccctgtgtccttcaaggatgtggtggtgggcttcacccaggaggagtggcaccggctgagccctgcccagagggccctgtacagagatgtgatgctggagacctacagcaacctggtgtctgtgggctatgagggcaccaagccagatgtgatcctgcggctggagcaggaggaggccccctggattggagaggccgcctgccccggctgccactgctgggaggacatctggagggtgaacatccagaggaagaggcggcaggacatgctgctgcggcctggagctgccatcagcaagaagaccctgcccaaggagaagagctgtgagtacaacaagtttgggaagatcagcctgctgagcacagacctcttcagcagcatccagagccccagcaactggaacccctgtgggaagaacctgaaccacaacctggacctgattggcttcaagaggaactgtgccaagaagcaggatgaatgttatgcctacggcaagctgctgcagaggatcaaccacggccggcggcccaatggagagaagccccggggctgcagccactgtgagaaggccttcacccagaacccagccctgatgtacaagccagctgtgtctgacagcctgctgtacaagaggaagagggtgcccccaacagagaagccccacgtgtgcagtgaatgtgggaaggccttctgctacaagtctgagttcatccgccaccagaggagccacactggagagaagccctacggctgcacagactgtgggaaggccttcagccacaagagcaccctcatcaagcaccagaggatccacactggagtgcggccctttgagtgcttcttctgtgggaaggccttcacccagaagagccacaggacagagcaccagaggacccacactggagagcggccctttgtgtgcagtgaatgtgggaagagctttggagagaagagctacctgaatgtgcacaggaagatgcacactggagagcggccctaccgctgcagagaatgtgggaagagcttcagccagaagagctgcctgaacaagcactggaggacccacactggagagaagccctacggctgcaatgaatgtgggaaggccttctaccagaagcccaacctgagccgccaccagaagatccacgccaggaagaatgcctacagaaatgaaaacctgatcatcgtgggcaacacctag

SEQ ID NO: 43844 - DNA, 1221 bp, Artificial Sequence; identical to SEQ ID NO: 43843
  Description of Artificial Sequence: Synthetic coding sequence

SEQ ID NO: 43845 - DNA, 4050 bp, Artificial Sequence
  Description of Artificial Sequence: Synthetic coding sequence
atggcctgctacctggtgatcagcagccgccacctgagcaatggccactaccggggcatcaagggcgtcttccggggccccctgtgcaagaatggcagccccagcccagactttgctgagaagaagagcacagccaaggccctggaggatgtgaaggccaacttctactgtgagctgtgtgacaagcagtaccacaagcaccaggagtttgacaaccacatcaacagctatgaccacgcccacaagcagaggctgaaggagctgaagcagcgggagtttgccagaaatgtggccagcaagtcctggaaggatgagaagaagcaggagaaggccctgaagaggctgcaccagctggccgagctgcggcagcagagtgaatgtgtgtctggaaatggacctgcctacaaggccccccgggtggccatcgagaagcagctgcagcagggcatcttccccatcaagaatggaaggaaggtgtcctgcatgaagagcgccctgctgctgaagggcaagaacctgccccgcatcatcagtgacaagcagaggagcaccatgcccaacagacaccagctgcagagcgaccggcgctgcctgtttggaaaccaggtgctgcagaccagcagtgacctgagcaatgccaaccacaggactggagtgtccttcaccttcagcaagaaggtgcacctgaagctggagagcagcgccagcgtcttcagcgagaacacagaggagacccatgactgcaacaagagccccatctacaagaccaagcagacagctgacaagtgcaagtgctgccgctttgccaacaaggacacccacctgaccaaggagaaggaggtgaacatcagccccagccacctggagagcgtgctgcacaacaccatcagcatcaacagcaagatcctgcaggacaagcatgacagcattgatgagaccctggaggacagcatcggcatccacgccagcttcagcaagagcaacatccacctgagtgatgtggacttcacccccaccagccgggagaaggagaccaggaacaccctgaagaacaccctggagaactgtgtgaaccacccctgccaggccaatgccagcttcagcccccccaacatctacaaccacagtgatgcccgcatcagcgagtgcctggatgagttcagcagcctggagcccagcgagcagaagagcacagtgcacctgaaccccaacagcagaattgagaaccgggagaagagcctggacaagacagagcgggtgtccaagaatgtgcagaggctggtgaaggaggcctgcacccacaacgtggccagcaagcccctgcccttcctgcacgtgcagagcaaggatggccacaccaccctgcagtggcccacagagctgctgctcttcaccaagacagagccctgcatctcctatggctgcaaccccctgtactttgacttcaagctgagcaggaacaccaaggaggaccacaacctggaggacctgaagacagagctgggcaagaagcccctggagctgaagaccaagcgggagagccaggtgtctggcctgacagaggaccagcagaagctgatccaggaggactaccagtaccccaagcccaagaccatgattgccaacccagactgggagaagttccagaggaagtacaacctggactacagcgacagcgagcccaacaagtctgagtacaccttcagcgccaatgacctggagatgaagaaccccaaggtgcccctgtacctgaacaccagcctgaaggactgtgccggcaagaacaacagcagcgagaacaagctgaaggaggccagccgggcccactggcagggctgcaggaaggctgtgctgaatgacattgatgaggacctgtccttccccagctacatcagccgcttcaagaagcacaagctgatcccctgcagcccccacctggagtttgaagatgagcggcagttcaactgcaagagcagcccctgcaccgtgggcggccacagcgaccacggcaaggacttcagcgtcatcctgaagagcaaccacatctccatgaccagcaaggtgtctggctgcggcaaccagcgctacaagcgctacagcccccagagctgcctgagccgctacagcagcagcctggacaccagccccagctccatgagcagcctgcggagcacctgcagcagccaccgcttcaacggcaacagccggggcaacctgctgtgcttccacaagcgggagcaccacagcgtggagcggcacaagaggaagtgcctgaagcacaactgcttctacctgagtgatgacatcaccaagagcagccagatgcagagcgagccccagaaggagaggaactgcaagctgtgggagagcttcaagaatgagaagtacagcaagaggcgctactgccactgccgggagcggcagaagctgggcaagaaccagcagcagttcagcggcctgaagagcacccgcatcatctactgtgacagcaacagccagatcagctgcaccggcagcagcaagaagccacccaactgccagggcacccagcacgaccggctggacagctacagcattgagaagatgtactacctgaacaagagcaagaggaaccaggagagcctgggcagcccccacatctgtgacctgggcaaggtgcggcccatgaagtgcaacagcggcaacatcagctgcctgctgaagaactgcagcagcggccccagcgagaccacagagagcaacacagctgagggggagaggacccccctgacagccaagatcctgctggagcgggtgcaggccaagaagtgccaggagcagagcagcaatgtggagatcagcagcaacagctgcaagtctgagctggaggcccccagccaggtgccctgcaccatccagctggcccccagcggctgcaaccggcaggccctgcccctgtctgagaagatccagtatgccagcgagagcagaaatgaccaggacagcgccatccccaggaccacagagaaggacaagagcaagagcagccacaccaacaacttcaccatcctggccgacacagactgtgacaaccacctgagcaagggcatcatccacctggtgacagagagccagagcctgaacatcaagagagatgccaccaccaaggagcagagcaagcccctcatcagcgagatccagcccttcatccagagctgtgaccctgtgcccaatgagttccctggggccttccccagcaacaagtacacaggagtgacagacagcacagagacccaggaggaccagatcaacctggacctgcaggatgtgtccatgcacatcaaccacgtggagggcaacatcaacagctactatgacaggaccatgcagaagccagacaaggtggaggatggcctggagatgtgccacaagagcatcagccccccactcatccagcagcccatcaccttctccccagatgaaattgacaagtacaagatcctgcagctgcaggcccagcagcacatgcagaagcagctgctgagcaagcacctgcgggtgctgcctgctgctggccccacagccttctccccagccagcacagtgcagacagtgcctgtgcaccagcacaccagcatcaccaccatccaccacaccttcctgcagcactttgctgtgtctgccagcctgagcagccacagcagccacctgcccatcgcccacctgcaccccctgagccaggcccacttcagccccatctccttcagcaccctgacccccaccatcatcccagcccaccccaccttcctggccggccaccccctgcacctggtggccgccacccccttccaccccagccacatcaccctgcagcccctgcccccaacagccttcatccccaccctgtttggcccccacctgaacccagccaccaccagcatcatccacctgaaccccctcatccagcccgtcttccagggccaggacttctgccaccacagctgcagcagccagatgcagcagctgaatgaggtgaaggaggccctgaatgtgtccacccacctgaactag

SEQ ID NO: 43846 - DNA, 1986 bp, Artificial Sequence
  Description of Artificial Sequence: Synthetic coding sequence
atgcctgccaatgaagatgccccccagcccggggagcacggcagcgcctgtgaggtgtctgtgtcctttgaagatgtgacagtggacttcagccgggaggagtggcagcagctggacagcacccagaggcggctgtaccaggatgtgatgctggagaactacagccacctgctgtctgtgggctttgaggtgcccaagccagaggtgatcttcaagctggagcagggcgagggcccctggaccctggagggggaggccccccaccagagctgcagtgatggcaagtttggcatcaagcccagccagaggcgcatcagcggcaagagcaccttccacagcgagatggagggggaggacaccagagatgacagcctgtacagcatcctggaggagctgtggcaggatgctgagcagatcaagcgctgccaggagaagcacaacaagctgctgagcaggaccaccttcctgaacaagaagatcctgaacacagagtgggactatgagtacaaggactttgggaagtttgtgcaccccagccccaacctgatcctgagccagaagaggccccacaagagggacagctttgggaagagcttcaagcacaacctggacctgcacatccacaacaagagcaatgctgccaagaacctggacaagaccatcggccacggccaggtgttcacccagaacagcagctacagccaccacgagaacacccacactggagtgaagttctgtgagaggaaccagtgtgggaaggtgctgagcctgaagcacagcctgagccagaatgtgaagttccccatcggggagaaggccaacacctgcacagaatttgggaagatcttcacccagaggagccacttctttgccccccagaagatccacacagtggagaagccccatgagctgagcaaatgtgtgaatgtgttcacccagaagcccctgctgagcatctacctgcgggtgcacagagatgagaagctgtacatctgcaccaagtgtgggaaggccttcatccagaacagcgagctgatcatgcatgagaagacccacacccgggagaagccctacaagtgcaatgaatgtgggaagagcttcttccaggtgagcagcctgctgcggcaccagaccacccacactggagagaagctgtttgaatgttctgaatgtgggaagggcttcagcctgaacagcgccctgaacatccaccagaagatccacactggagagcggcaccacaagtgcagtgaatgtgggaaggccttcacccagaagagcaccctgaggatgcaccagaggatccacactggagagaggagctacatctgcacccagtgtggccaggccttcatccagaaggcccacctgattgcccaccagaggatccacactggagagaagccctatgaatgtagtgactgtgggaagagcttccccagcaagagccagctgcagatgcacaagaggatccacactggagagaagccctacatctgcacagaatgtgggaaggccttcaccaacagaagcaacctgaacacccaccagaagagccacactggagagaagagctacatctgtgccgagtgtgggaaggccttcacagacaggagcaacttcaacaagcaccagaccatccacactggagagaagccctacgtgtgtgccgactgtggccgggccttcatccagaagtctgagctgatcacccaccagaggatccacaccacagagaagccctacaagtgcccagactgtgagaagagcttcagcaagaagccccacctgaaggtgcaccagaggatccacactggagagaagccctacatctgtgccgagtgtgggaaggccttcacagacaggagcaacttcaacaagcaccagaccatccacactggagacaagccctacaagtgcagcgactgtgggaagggcttcacccagaagtctgtgctgtccatgcacaggaacatccacacctag

SEQ ID NO: 43847 - DNA, 1365 bp, Artificial Sequence
  Description of Artificial Sequence: Synthetic coding sequence
atggctgtgacagacctgagccacggcttcttcccccgggagcccatctgcccctttgaggagaagaccaagattggcaccatggtggaggactacctggccaacagctaccaggacagcgtgacctttgatgatgtggccgtggagttcaccccagaggagtgggccctgctggacaccacagagaagtgcctgtacagagatgtgatgctggagaactacgtgaacctggcctctgtggaggccaccgtggatggcaacagcgagaactgtggggaggtgttcagcgagtggttctgcctgaagacccacatgagggcccagaatggaggcaacatctttgagggcaactgctacggcaaggacatcctgtctgtgcacaaggaggccagcatcggccaggagctgagcaagttcaacccctgtgggaaggtgttcaccctgaccccagacctggccgcccacctgggcatcctgaatgcccggcagccctacaagtgcaaggaatgtaggaagggcttcaagtactttgccagcctggacaaccacatgggcatccacatcggggagaagttctgtgagttccaggagtgcagaagagccatcacccacagcagccacctgaagcagtgtgtgacagtgcacacaggcaagaagagcaagaagaccaagaagcacggcaagagcttcaccaacttcagccagctgagcgcccacgtgaagatccacaagggggagaagagctttgagtgcaaggaatgtggccgctccttcaggaacagcagcagcttcaacgtgcacatccagatccacacaggcatcaagccccacaagtacacagaatgtgggaaggccttcaccaggagcacccacctgacccagcacgtgaggacccacacaggcatcaagccctatgagtgcaaggaatgtggccaggccttcacccagtacacaggcctggccatccacatccggaaccacactggagagaagcactaccagtgcaaggaatgtgggaaggccttcaacggcagcagcaccctgacccagcacaagatcatccacactggagagaagccctacggctgtgtggagtgtgggaagaccttcatcaccagcagctaccgcagcaagcacctgaagacccaccacgaggagcggccctttgtgtgcaagatctgtgggaaggccttcctgtacagcagccccctgaatgtgcacctgcagacccacacccgggagaaggccctgatctgcaaggaatgtgggaaggcctttgctgtgagcagccacctgagcagacatgagcgcatccacactggagaggagccctatgagtacaagggcatgaatgtgaccatctag

SEQ ID NO: 43848 - DNA, 1734 bp, Artificial Sequence
  Description of Artificial Sequence: Synthetic coding sequence
atggctgctgctgccaccctgcggctgagcgcccagggcaccgtgacctttgaagatgtggccgtgaacttcacctgggaggagtggaacctgctgtctgaggcccagcgctgcctgtacagagatgtgaccctggagaacctggccctgatcagcagcctgggctgctggtgtggggtggaggatgaggccgcccccagcaagcagagcatctacatccagcgggagacccaggtgaggacccccatggccggcgtgagccccaagaaggcccacccctgtgagatgtgtggccccatcctgggggacatcctgcacgtggccgaccaccagggcacccaccacaagcagaagctgcaccgctgtgaggcctggggcaacaagctgtatgacagcggcaacttccaccagcaccagaatgagcacatcggggagaagccctaccggggctctgtggaggaggccctgtttgccaagcgctgcaagctgcacgtgtctggagagagcagcgtcttcagcgagagcggcaaggacttcctgcccaggagcggcctgctgcagcaggaggccagccacactggagagaagagcaacagcaagacagaatgtgtgagccccatccagtgtggcggggcccactacagctgtggggagagcatgaagcacttcagcaccaagcacatcctgagccagcaccagaggctgctgacccgggaggagtgctacgtgtgctgtgaatgtgggaagagcttcagcaaatatgccagcttcagcaaccaccagagggtgcacacagacaagaagcactatgaatgtggggagtgtgggaagagcttcagccagaagagcagcctcatccagcaccagcgcttccacactggagagaagccctacggctgtgaggagtgtgggaagagcttcagccacaagaggagcctggtgcaccaccagagggtgcacagcggggagcggccctaccagtgtggggagtgtgggaagagcttcagccagaagggcaacctggtgctgcaccagagggtgcacactggagcccggccctatgaatgtggggagtgtgggaagagcttcagccacaagaggagcctggtgcaccaccagaggatgcacactggagagcggccctacaagtgtggggactgtgggaagagcttcaatgagaagggccacctgaggaaccaccagagggtgcacaccacagagcggcccttcaagtgtggggagtgtgggaagtgcttcagccacaagggcaacctgatcctgcaccagcacggccacactggagagcggccctacgtgtgccgggagtgtgggaagctgttcaagaagaagagccacctgctggtgcaccagaggatccacaatggagagaagccctatgcctgtgaggcctgccagaagttcttcaggaacaacagcaccttctgtgtgcacaagaggatccacactggagagaagccctatgaatgttctgaatgtgggaagagctttgctgagagcagcagcttcaccaagcacaagagggtgcacactggagagaagccctatgaatgttctgaatgtgggaagagctttgctgagagcagcagcctgaccaagcacaagagggtgcacactggagagaagccctacaagtgtgagaagtgtgggaagctgttcaacaagaagagccacctgctggtgcaccagagcagccactggaggaaggccatctag

SEQ ID NO: 43849 - DNA, 2568 bp, Artificial Sequence
  Description of Artificial Sequence: Synthetic coding sequence
atggctgctgctgccaccctgcggctgagcgcccagggcaccgtgacctttgaagatgtggccgtgaacttcacctgggaggagtggaacctgctgtctgaggcccagcgctgcctgtacagagatgtgaccctggagaacctggccctgatcagcagcctgggctgctggtgtggggtggaggatgaggccgcccccagcaagcagagcatctacatccagcgggagacccaggtgaggacccccatggccggcgtgagccccaagaaggcccacccctgtgagatgtgtggccccatcctgggggacatcctgcacgtggccgaccaccagggcacccaccacaagcagaagctgcaccgctgtgaggcctggggcaacaagctgtatgacagcggcaacttccaccagcaccagaatgagcacatcggggagaagccctaccggggctctgtggaggaggccctgtttgccaagcgctgcaagctgcacgtgtctggagagagcagcgtcttcagcgagagcggcaaggacttcctgcccaggagcggcctgctgcagcaggaggccagccacactggagagaagagcaacagcaagacagaatgtgtgagccccatccagtgtggcggggcccactacagctgtggggagagcatgaagcacttcagcaccaagcacatcctgagccagcaccagaggctgctgacccgggaggagtgctacgtgtgctgtgaatgtgggaagagcttcagcaaatatgccagcctgagcaaccaccagagggtgcacacagagaagaagcatgaatgtggagaatgtgggaagagcttcagcaaatatgtgtccttcagcaaccaccagagggtgcacacagagaagaagcatgaatgtggggagtgtgggaagagcttcagcaaatatgtgtccttcagcaaccaccagagggtgcacacaggcaagaggccctatgaatgtggggagtgtgggaagagcttcagcaaatatgccagcttcagcaaccaccagagggtgcacacagagaagaagcactatgaatgtggggagtgtgggaagagcttcagcaaatatgtgtccttcagcaaccaccagagggtgcacacaggcaagaggccctatgaatgtggggagtgtgggaagagcttcagcaaatatgccagcttcagcaaccaccagagggtgcacacagacaagaagcactatgaatgtggggagtgtgggaagagcttcagccagaagagcagcctcatccagcaccagcgcttccacactggagagaagccctacggctgtgaggagtgtgggaagagcttcagcagcgagggccacctgcggagccaccagagggtgcatgctggggagcggcccttcaagtgtggggagtgtgtgaagagcttcagccacaagaggagcctggtgcaccaccagagggtgcacagcggggagcggccctaccagtgtggggagtgtgggaagagcttcagccagaagggcaacctggtgctgcaccagagggtgcacactggagcccggccctatgaatgtggggagtgtgggaagagcttcagcagcaagggccacctgaggaaccaccagcagatccacactggagaccggctgtatgaatgtggggagtgtgggaagagcttcagccacaagggcaccctcatcctgcaccagagggtgcacccccgggagaggagctatggctgtggggagtgtgggaagagcttcagcagcatcggccacctgcggagccaccagagggtgcacactggagagcggccctatgaatgtggggagtgtgggaagagcttcagccacaagaggagcctggtgcaccaccagaggatgcacactggagagcggccctacaagtgtggggactgtgggaagagcttcaatgagaagggccacctgaggaaccaccagagggtgcacaccacagagcggcccttcaagtgtggggagtgtgggaagtgcttcagccacaagggcaacctgatcctgcaccagcacggccacactggagagcggccctacgtgtgccgggagtgtgggaagctgttcaagaagaagagccacctgctggtgcaccagaggatccacaatggagagaagccctatgcctgtgaggcctgccagaagttcttcaggaacaagtaccagctgattgcccaccagagggtgcacactggagagcggccctatgaatgtaatgactgtgggaagagcttcacccacagcagcaccttctgtgtgcacaagaggatccacactggagagaagccctatgaatgttctgaatgtgggaagagctttgctgagagcagcagcttcaccaagcacaagagggtgcacactggagagaagccctatgaatgttctgaatgtgggaagagctttgctgagagcagcagcctgaccaagcacaagagggtgcacactggagagaagccctacaagtgtgagaagtgtgggaagctgttcaacaagaagagccacctgctggtgcaccagagcagccactggaggaaggccatctag

SEQ ID NO: 43850 - DNA, 1113 bp, Artificial Sequence
  Description of Artificial Sequence: Synthetic coding sequence
atgagcaggaggaagcagaccaaccccaacaaggtgcactgtgacagtgaaggagatgaggaggagaccacccaggatgaggtgagcagccacaccagtgaagaagatggcggcgtggtgaaggtggagaaggagctggagaacacagagcagcctgtgggcggcaatgaggtggtggagcacgaggtgacaggcaacctgaacagcgaccccctgctggagctgtgccagtgccccctgtgccagctggactgtggcagccgggagcagctgattgcccacgtgtaccagcacacagctgctgtggtgtctgccaagagctacatgtgccctgtgtgtggccgggccctgagcagccctggcagcctgggccgccacctgctgatccacagcgaggaccagaggagcaactgtgctgtgtgtggggcccgcttcaccagccacgccaccttcaacagcgagaagctgcctgaggtgctgaacatggagagcctgcccaccgtgcacaatgaaggccccagcagcgctgagggcaaggacatcgccttcagcccccctgtgtacccagctggcatcctgctggtgtgcaacaactgtgccgcctacaggaagctgctggaggcccagacccccagcgtgaggaagtgggccctgcggcggcagaatgagcccctggaggtgcggctgcagaggctggagcgggagaggacagccaagaagagccggcgggacaatgagaccccagaggagcgggaggtgcggaggatgagggaccgggaggccaagaggctgcagaggatgcaggagacagatgagcagagggcccggcggctgcagagggaccgggaggccatgaggctgaagagggccaatgagaccccagagaagaggcaggcccggctcatccgggagcgggaggccaagaggctgaagaggcggctggagaagatggacatgatgctgcgggcccagtttggccaggaccccagcgccatggccgccctggccgctgagatgaacttcttccagctgcctgtgtctggagtggagctggacagccagctgctgggcaagatggcctttgaggagcagaacagcagcagcctgcactag

SEQ ID NO: 43851 - DNA, 1239 bp, Artificial Sequence
  Description of Artificial Sequence: Synthetic coding sequence
atgagcaggaggaagcagaccaaccccaacaaggtgcactgggaccaggtgtttgctggcctggaggagcaggcccggcaggccatgatgaagacagacttccctggggacctgggcagccagaggcaggccatccagcagctgcgggaccaggacagcagcagcagtgacagtgaaggagatgaggaggagaccacccaggatgaggtgagcagccacaccagtgaagaagatggcggcgtggtgaaggtggagaaggagctggagaacacagagcagcctgtgggcggcaatgaggtggtggagcacgaggtgacaggcaacctgaacagcgaccccctgctggagctgtgccagtgccccctgtgccagctggactgtggcagccgggagcagctgattgcccacgtgtaccagcacacagctgctgtggtgtctgccaagagctacatgtgccctgtgtgtggccgggccctgagcagccctggcagcctgggccgccacctgctgatccacagcgaggaccagaggagcaactgtgctgtgtgtggggcccgcttcaccagccacgccaccttcaacagcgagaagctgcctgaggtgctgaacatggagagcctgcccaccgtgcacaatgaaggccccagcagcgctgagggcaaggacatcgccttcagcccccctgtgtacccagctggcatcctgctggtgtgcaacaactgtgccgcctacaggaagctgctggaggcccagacccccagcgtgaggaagtgggccctgcggcggcagaatgagcccctggaggtgcggctgcagaggctggagcgggagaggacagccaagaagagccggcgggacaatgagaccccagaggagcgggaggtgcggaggatgagggaccgggaggccaagaggctgcagaggatgcaggagacagatgagcagagggcccggcggctgcagagggaccgggaggccatgaggctgaagagggccaatgagaccccagagaagaggcaggcccggctcatccgggagcgggaggccaagaggctgaagaggcggctggagaagatggacatgatgctgcgggcccagtttggccaggaccccagcgccatggccgccctggccgctgagatgaacttcttccagctgcctgtgtctggagtggagctggacagccagctgctgggcaagatggcctttgaggagcagaacagcagcagcctgcactag

SEQ ID NO: 43852 - DNA, 1113 bp, Artificial Sequence; identical to SEQ ID NO: 43850
  Description of Artificial Sequence: Synthetic coding sequence

SEQ ID NO: 43853 - DNA, 417 bp, Artificial Sequence
  Description of Artificial Sequence: Synthetic coding sequence
atgagcaggaggaagcagaccaaccccaacaaggtgcactgggaccaggtgtttgctggcctggaggagcaggcccggcaggccatgatgaagacagacttccctggggacctgggcagccagaggcaggccatccagcagctgcgggaccaggacagcagcagcagtgacagtgaaggagatgaggaggagaccacccaggatgaggtgagcagccacaccagtgaagaagatggcggcgtggtgaaggtggagaaggagctggagaacacagagcagcctgtgggcggcaatgaggtggtggagcacgaggccaggaacctgaacagcgaccccctgctggagctgtgccagtgccccctgtgccagctggactgtggcagccgggagcagctgattgcccacgtgtaccagtag

SEQ ID NO: 43854 - DNA, 1239 bp, Artificial Sequence; identical to SEQ ID NO: 43851
  Description of Artificial Sequence: Synthetic coding sequence

SEQ ID NO: 43855 - DNA, 1680 bp, Artificial Sequence
  Description of Artificial Sequence: Synthetic coding sequence
gtgcccggcagccagtgtgaccctgagaagagatgtgagatcaagacagctgcccagggcagcaggatggagggcctgctgtctgtggccctgcagggcgctgagctggagggcaactggaagcatgagggccaggtggaggacctgcaggagaaccaggagagctgcccagagcctgaggccgtggcctgcaagggggaccctgctggggacagcatgcaggagagagatgagttcagccgcatccccaggaccatcagcagccctgctgccacccaggcctctgtgcctgatgacagcagcagccgccgctgcagcgcccctggagagagccccaaggagcggcacccagacagccggcagcgggagcggggcggcggccccaagaagccctggaagtgtggggactgtgggaaggccttctcctactgcagcgccttcatcctgcaccagaggatccacactggagagaagccctttgcctgcccagaatgtgggaaggccttcagccagagcgtgcacctgaccctgcaccagaggacccacactggagagaagccctatgcctgccatgaatgtgggaaggccttcagccagggcagctacctggccagccactggaggacccacactggagagaagccccaccgctgtgccgactgtgggaaggccttcaccagggtgacccacctgacccagcacagaagagtgcacactggagagcggccctatgcctgtgcccagtgtgccaaggccttcaggaacagaagcagcctcatcgagcaccagaggatccacactggagagaagccctatgaatgttctgcctgtgccaaggccttccgcttcagcagcgccctgatccgccaccagaggatccacacagaggagaagccctaccgctgtggccagtgtgccaaggcctttgcccagatcgcccacctgacccagcacagaagagtgcacactggagagaagccctacacctgccaggactgtggggccctcttcagccagagcgccagcctggccgagcaccggcgcatccacactggagagaagccctatgcctgtggccagtgtgccaaggccttcacccaggtgagccacctgacccagcaccagaggacccacactggagagcggccctacccctgccacgactgtgggaagcgcttcagcaacagaagccacctgctgcagcaccggctggtgcacactggagagcggccctaccgctgcctgcagtgtggggccgccttcagccacgtgagcagcctcatcgagcaccagaagatccacactggagagcggccctacaagtgtggggagtgtgggaaggccttcagccagggcagcagcctggccctgcaccagaggacccacactggagagcggccctacacctgcccagaatgtgggaaggccttcagcaacagaagctacctgatccagcaccacatcgtgcacactggagagaagccctatgaatgttctggctgcggcaaggccttctccttcagcagcgccctgatccgccaccagaggacccatgctgacagcagcggccgcctgtgcccagcccccaccccagacagcaccccaggcctgagccagggcggggagacctgccagcagggctgccctggaagaaacccccggggccctgctgaggactag

SEQ ID NO: 43856 - DNA, 1614 bp, Artificial Sequence
  Description of Artificial Sequence: Synthetic coding sequence
atggagggcctgctgtctgtggccctgcagggcgctgagctggagggcaactggaagcatgagggccaggtggaggacctgcaggagaaccaggagagctgcccagagcctgaggccgtggcctgcaagggggaccctgctggggacagcatgcaggagagagatgagttcagccgcatccccaggaccatcagcagccctgctgccacccaggcctctgtgcctgatgacagcagcagccgccgctgcagcgcccctggagagagccccaaggagcggcacccagacagccggcagcgggagcggggcggcggccccaagaagccctggaagtgtggggactgtgggaaggccttctcctactgcagcgccttcatcctgcaccagaggatccacactggagagaagccctttgcctgcccagaatgtgggaaggccttcagccagagcgtgcacctgaccctgcaccagaggacccacactggagagaagccctatgcctgccatgaatgtgggaaggccttcagccagggcagctacctggccagccactggaggacccacactggagagaagccccaccgctgtgccgactgtgggaaggccttcaccagggtgacccacctgacccagcacagaagagtgcacactggagagcggccctatgcctgtgcccagtgtgccaaggccttcaggaacagaagcagcctcatcgagcaccagaggatccacactggagagaagccctatgaatgttctgcctgtgccaaggccttccgcttcagcagcgccctgatccgccaccagaggatccacacagaggagaagccctaccgctgtggccagtgtgccaaggcctttgcccagatcgcccacctgacccagcacagaagagtgcacactggagagaagccctacacctgccaggactgtggggccctcttcagccagagcgccagcctggccgagcaccggcgcatccacactggagagaagccctatgcctgtggccagtgtgccaaggccttcacccaggtgagccacctgacccagcaccagaggacccacactggagagcggccctacccctgccacgactgtgggaagcgcttcagcaacagaagccacctgctgcagcaccggctggtgcacactggagagcggccctaccgctgcctgcagtgtggggccgccttcagccacgtgagcagcctcatcgagcaccagaagatccacactggagagcggccctacaagtgtggggagtgtgggaaggccttcagccagggcagcagcctggccctgcaccagaggacccacactggagagcggccctacacctgcccagaatgtgggaaggccttcagcaacagaagctacctgatccagcaccacatcgtgcacactggagagaagccctatgaatgttctggctgcggcaaggccttctccttcagcagcgccctgatccgccaccagaggacccatgctgacagcagcggccgcctgtgcccagcccccaccccagacagcaccccaggcctgagccagggcggggagacctgccagcagggctgccctggaagaaacccccggggccctgctgaggactag

SEQ ID NO: 43857 - DNA, 2442 bp, Artificial Sequence
  Description of Artificial Sequence: Synthetic coding sequence
atgctgctgcccaccaccatccagccccagacagccaggaagagccagctgccccggggcaacagctgcctggtgggcctgcacatcgccagcccccagctgctgcgggtgcagcccctggtgaggacagagccccagagctgcttcctgagtgacctgtgccagcccccagcccagggctttgtgcagaggcccctgcctgccctgcaggtggtgcctgccaagagggtgcctgcccccaaggccccagatgagcagggctccatgctgacccccctgagcgccagtgaccccctggccgtgaccagcctgagcagcagcagcgcccaccccttcatcagcaacctgcacaccaggcacacagagaagctgaagaagagcctgaaggtgaagaccaggagcggccgggtgtcccggccccccaagtacaaggccaaggactacaagttcatcaagacagaggacctggctgatggccacctgagtgacagtgatgactacagcgagctgtgtgtggaggaggatgaggaccagcgggagagacatgccctgtttgacctgagcagctgcagcctgcggcccaagagcttcaagtgccagacctgtgagaagagctacatcggcaaaggaggcctggcccggcacttcaagctgaaccctggccacggccagctggaccctgagatggtgctgtctgagaaggccagcggcagcaccctgcggggctgcacagaggagaggaccctgagcctgaccagcctgggcctgtccatgcctgctgacccctgtgagggcggggcccggagctgcctggtgacagaaagtgcccggggcggcctgcagaatggccagagcgtggatgtggaggagaccctgcccagcgagccagaaaatggagccctgctgcggtctgagcgctaccagggcccccggcggcgggcctgcagcgagaccctggccgagagcaggacagctgtgctgcagcagaggcgggccgcccagctgcccggcggccctgctgctgctggggagcagagggccagccccagcaaggcccggctgaaggagttcctgcagcagtgtgaccgggaggacctggtggagctggccctgccccagctggcccaggtggtgacagtgtatgagttcctgctgatgaaggtggagaaggaccacctggccaagcccttcttccctgccatctacaaggagtttgaggagctgcacaagatggtgaagaagatgtgccaggactacctgagcagcagcggcctgtgcagccaggagaccctggagatcaacaatgacaaggtggccgagagcctgggcatcacagagttcctgaggaagaaggagatccacccagacaacctgggccccaagcacctgagccgggacatggatggagagcagctggagggcgccagcagcgagaagcgggagcgggaggccgctgaggagggcctggcctctgtgaagaggccccggcgggaggccctgagcaatgacaccacagagagcctggccgccaacagccggggccgggagaagccccggcccctgcacgccctggccgccggggagggcttcagcccccctgtgaatgtgacagtgagccccaggtctgaggagagccacaccaccaccgtgtctggaggaaatggcagcgtcttccaggccggcccccagctgcaggccctggccaacctggaggcccggcggggcagcattggagctgccctgagcagcagagatgtgtctggcctgcctgtgtatgcccagagcggggagccccggcggctgacccaggcccaggtggccgccttccctggagaaaatgccctggagcacagcagtgaccaggacacctgggacagcctgcggagccctggcttctgcagccccctgagcagcggcggcggcgctgagagcctgcccccaggcggccctggccatgctgaggccggccacctgggcaaggtgtgtgacttccacctgaaccaccagcagcccagccccacctctgtgctgcccacagaggtggccgccccacccctggagaagatcctgtctgtggacagcgtggccgtggactgtgcctacagaacagtgcccaagccaggcccccagcccggcccccacggcagcctgctgacagagggctgcctgcggagcctgagcggggacctgaaccgcttcccctgtggcatggaggtgcacagcggccagcgggagctggagagcgtggtggccgtgggggaggccatggcctttgagatcagcaatggcagccatgagctgctgagccagggccagaagcagatcttcatccagaccagtgatggcctcatcctgagccccccaggcaccatcgtgtcccaggaggaggacatcgtgacagtgacagatgctgagggccgggcctgtggctgggccaggtag

SEQ ID NO: 43858 - DNA, 1368 bp, Artificial Sequence
  Description of Artificial Sequence: Synthetic coding sequence
atgcctgctgacccctgtgagggcggggcccggagctgcctggtgacagagagcgcccggggcggcctgcagttcctgcagcagtgtgaccgggaggacctggtggagctggccctgccccagctggcccaggtggtgacagtgtatgagttcctgctgatgaaggtggagaaggaccacctggccaagcccttcttccctgccatctacaaggagtttgaggagctgcacaagatggtgaagaagatgtgccaggactacctgagcagcagcggcctgtgcagccaggagaccctggagatcaacaatgacaaggtggccgagagcctgggcatcacagagttcctgaggaagaaggagatccacccagacaacctgggccccaagcacctgagccgggacatggatggagagcagctggagggcgccagcagcgagaagcgggagcgggaggccgctgaggagggcctggcctctgtgaagaggccccggcgggaggccctgagcaatgacaccacagagagcctggccgccaacagccggggccgggagaagccccggcccctgcacgccctggccgccggcttcagcccccctgtgaatgtgacagtgagccccaggtctgaggagagccacaccaccaccgtgtctggaggaaatggcagcgtcttccaggccggcccccagctgcaggccctggccaacctggaggcccggcggggcagcattggagctgccctgagcagcagagatgtgtctggcctgcctgtgtatgcccagagcggggagccccggcggctgacccaggcccaggtggccgccttccctggagaaaatgccctggagcacagcagtgaccaggacacctgggacagcctgcggagccctggcttctgcagccccctgagcagcggcggcggcgctgagagcctgcccccaggcggccctggccatgctgaggccggccacctgggcaaggtgtgtgacttccacctgaaccaccagcagcccagccccacctctgtgctgcccacagaggtggccgccccacccctggagaagatcctgtctgtggacagcgtggccgtggactgtgcctacagaacagtgcccaagccaggcccccagcccggcccccacggcagcctgctgacagagggctgcctgcggagcctgagcggggacctgaaccgcttcccctgtggcatggaggtgcacagcggccagcgggagctggagagcgtggtggccgtgggggaggccatgctgaagttccccatgggcgccatgagctactgcctgcgggacaggagccgcttcctgttccggctgcccatgggcctgagctgccccctgcaggtgcagtag

SEQ ID NO: 43859 - DNA, 2784 bp, Artificial Sequence
  Description of Artificial Sequence: Synthetic coding sequence
atggctgatgctgagcctgaggccggcggcggctctgaagatggcggcggcggcggcggccctgcccctcctggccagagcggctctgtggcccgggtggcccccctgggccctgagcagctgcggcaggtgctggagcaggtgaccaaggcccagcccccacctcctcctcctccatttgtgctgagagatgctgcccggcggctgagagatgctgcccagcaggccgccctgcagaggggccggggcacagagcccccccggctgccccggctgctgcccccccagcagctggaggccatctgtgtgaaggtgaccagcggggagaccaagggccaggagcggcccatgctgctgcccaccaccatccagccccagacagccaggaagagccagctgccccggggcaacagctgcctggtgggcctgcacatcgccagcccccagctgctgcgggtgcagcccctggtgaggacagagccccagagctgcttcctgagtgacctgtgccagcccccagcccagggctttgtgcagaggcccctgcctgccctgcaggtggtgcctgccaagagggtgcctgcccccaaggccccagatgagcagggctccatgctgacccccctgagcgccagtgaccccctggccgtgaccagcctgagcagcagcagcgcccaccccttcatcagcaacctgcacaccaggcacacagagaagctgaagaagagcctgaaggtgaagaccaggagcggccgggtgtcccggccccccaagtacaaggccaaggactacaagttcatcaagacagaggacctggctgatggccacctgagtgacagtgatgactacagcgagctgtgtgtggaggaggatgaggaccagcgggagagacatgccctgtttgacctgagcagctgcagcctgcggcccaagagcttcaagtgccagacctgtgagaagagctacatcggcaaaggaggcctggcccggcacttcaagctgaaccctggccacggccagctggaccctgagatggtgctgtctgagaaggccagcggcagcaccctgcggggctgcacagaggagaggaccctgagcctgaccagcctgggcctgtccatgcctgctgacccctgtgagggcggggcccggagctgcctggtgacagaaagtgcccggggcggcctgcagaatggccagagcgtggatgtggaggagaccctgcccagcgagccagaaaatggagccctgctgcggtctgagcgctaccagggcccccggcggcgggcctgcagcgagaccctggccgagagcaggacagctgtgctgcagcagaggcgggccgcccagctgcccggcggccctgctgctgctggggagcagagggccagccccagcaaggcccggctgaaggagttcctgcagcagtgtgaccgggaggacctggtggagctggccctgccccagctggcccaggtggtgacagtgtatgagttcctgctgatgaaggtggagaaggaccacctggccaagcccttcttccctgccatctacaaggagtttgaggagctgcacaagatggtgaagaagatgtgccaggactacctgagcagcagcggcctgtgcagccaggagaccctggagatcaacaatgacaaggtggccgagagcctgggcatcacagagttcctgaggaagaaggagatccacccagacaacctgggccccaagcacctgagccgggacatggatggagagcagctggagggcgccagcagcgagaagcgggagcgggaggccgctgaggagggcctggcctctgtgaagaggccccggcgggaggccctgagcaatgacaccacagagagcctggccgccaacagccggggccgggagaagccccggcccctgcacgccctggccgccggcttcagcccccctgtgaatgtgacagtgagccccaggtctgaggagagccacaccaccaccgtgtctggaggaaatggcagcgtcttccaggccggcccccagctgcaggccctggccaacctggaggcccggcggggcagcattggagctgccctgagcagcagagatgtgtctggcctgcctgtgtatgcccagagcggggagccccggcggctgacccaggcccaggtggccgccttccctggagaaaatgccctggagcacagcagtgaccaggacacctgggacagcctgcggagccctggcttctgcagccccctgagcagcggcggcggcgctgagagcctgcccccaggcggccctggccatgctgaggccggccacctgggcaaggtgtgtgacttccacctgaaccaccagcagcccagccccacctctgtgctgcccacagaggtggccgccccacccctggagaagatcctgtctgtggacagcgtggccgtggactgtgcctacagaacagtgcccaagccaggcccccagcccggcccccacggcagcctgctgacagagggctgcctgcggagcctgagcggggacctgaaccgcttcccctgtggcatggaggtgcacagcggccagcgggagctggagagcgtggtggccgtgggggaggccatggcctttgagatcagcaatggcagccatgagctgctgagccagggccagaagcagatcttcatccagaccagtgatggcctcatcctgagccccccaggcaccatcgtgtcccaggaggaggacatcgtgacagtgacagatgctgagggccgggcctgtggctgggccaggtag

SEQ ID NO: 43860 - DNA, 2436 bp, Artificial Sequence
  Description of Artificial Sequence: Synthetic coding sequence
atgctgctgcccaccaccatccagccccagacagccaggaagagccagctgccccggggcaacagctgcctggtgggcctgcacatcgccagcccccagctgctgcgggtgcagcccctggtgaggacagagccccagagctgcttcctgagtgacctgtgccagcccccagcccagggctttgtgcagaggcccctgcctgccctgcaggtggtgcctgccaagagggtgcctgcccccaaggccccagatgagcagggctccatgctgacccccctgagcgccagtgaccccctggccgtgaccagcctgagcagcagcagcgcccaccccttcatcagcaacctgcacaccaggcacacagagaagctgaagaagagcctgaaggtgaagaccaggagcggccgggtgtcccggccccccaagtacaaggccaaggactacaagttcatcaagacagaggacctggctgatggccacctgagtgacagtgatgactacagcgagctgtgtgtggaggaggatgaggaccagcgggagagacatgccctgtttgacctgagcagctgcagcctgcggcccaagagcttcaagtgccagacctgtgagaagagctacatcggcaaaggaggcctggcccggcacttcaagctgaaccctggccacggccagctggaccctgagatggtgctgtctgagaaggccagcggcagcaccctgcggggctgcacagaggagaggaccctgagcctgaccagcctgggcctgtccatgcctgctgacccctgtgagggcggggcccggagctgcctggtgacagaaagtgcccggggcggcctgcagaatggccagagcgtggatgtggaggagaccctgcccagcgagccagaaaatggagccctgctgcggtctgagcgctaccagggcccccggcggcgggcctgcagcgagaccctggccgagagcaggacagctgtgctgcagcagaggcgggccgcccagctgcccggcggccctgctgctgctggggagcagagggccagccccagcaaggcccggctgaaggagttcctgcagcagtgtgaccgggaggacctggtggagctggccctgccccagctggcccaggtggtgacagtgtatgagttcctgctgatgaaggtggagaaggaccacctggccaagcccttcttccctgccatctacaaggagtttgaggagctgcacaagatggtgaagaagatgtgccaggactacctgagcagcagcggcctgtgcagccaggagaccctggagatcaacaatgacaaggtggccgagagcctgggcatcacagagttcctgaggaagaaggagatccacccagacaacctgggccccaagcacctgagccgggacatggatggagagcagctggagggcgccagcagcgagaagcgggagcgggaggccgctgaggagggcctggcctctgtgaagaggccccggcgggaggccctgagcaatgacaccacagagagcctggccgccaacagccggggccgggagaagccccggcccctgcacgccctggccgccggcttcagcccccctgtgaatgtgacagtgagccccaggtctgaggagagccacaccaccaccgtgtctggaggaaatggcagcgtcttccaggccggcccccagctgcaggccctggccaacctggaggcccggcggggcagcattggagctgccctgagcagcagagatgtgtctggcctgcctgtgtatgcccagagcggggagccccggcggctgacccaggcccaggtggccgccttccctggagaaaatgccctggagcacagcagtgaccaggacacctgggacagcctgcggagccctggcttctgcagccccctgagcagcggcggcggcgctgagagcctgcccccaggcggccctggccatgctgaggccggccacctgggcaaggtgtgtgacttccacctgaaccaccagcagcccagccccacctctgtgctgcccacagaggtggccgccccacccctggagaagatcctgtctgtggacagcgtggccgtggactgtgcctacagaacagtgcccaagccaggcccccagcccggcccccacggcagcctgctgacagagggctgcctgcggagcctgagcggggacctgaaccgcttcccctgtggcatggaggtgcacagcggccagcgggagctggagagcgtggtggccgtgggggaggccatggcctttgagatcagcaatggcagccatgagctgctgagccagggccagaagcagatcttcatccagaccagtgatggcctcatcctgagccccccaggcaccatcgtgtcccaggaggaggacatcgtgacagtgacagatgctgagggccgggcctgtggctgggccaggtag

SEQ ID NO: 43861 - DNA, 2436 bp, Artificial Sequence; identical to SEQ ID NO: 43860
  Description of Artificial Sequence: Synthetic coding sequence

SEQ ID NO: 43862 - DNA, 1047 bp, Artificial Sequence
  Description of Artificial Sequence: Synthetic coding sequence
atgaggagcctgccctttgccctgactgtggagagcgtgtctgcccgggcccccacctgctgcagcacaggccgcttcacccagggccggcagccctgcaagtgcaaggcctgtggccggggcttcacccagagcgccagcctgctgcagcactggagggtgcacagcgactggagggagaccctgagcctgagccctgtgcggcaggacctgctgtggcccctgcagccccaccaggccccagccagccccctgggccgcagccacagcagcgctggggtgcggcagggcttcagcggccagctgtgctgctggctgaccaaggagcacaccctggccgaggccctgcggctgagccctgtgcctgctggcttctggggccctgtggaggccgaccggcccccagccaacagccaccggcgggtgtgccccttctgctgctgcagctgtggggacagcgtgaatgagaagaccagcctgagccagagggtgctgccccaccctggagagaagacctgccggggcggctctgtggagagcgtgtccctggcccccagctctgtggccccagacagcaccagcggcctgcggccctgtggcagccctggcagcttcctgcagcacctgccccccagcaccctgctgccccggccccccttcctgtacccaggcccccccctgagcctgcagcccctggtgcccagcggcctgcctgctgtgcctgctgtgcccctgggcggcctggaggtggcccaggtgcccccagccacccagcctgctgcccagcaggagggcgccatgggccccaggagctgtgccagcgctggccgggacagccgggaggccgtgcaggcccctggctacccagagcccgccaggaaggccagccagcacagagctgctggccccctgggggaggcccgggcccggctgcagaggcagtgccgggcccctcctccacccagcaacccccactggaggggggccctgcctgtgtttcctgtgtggaaggccagcagcagaagaagcaacctggcccggcactag

SEQ ID NO: 43863 - DNA, 1788 bp, Artificial Sequence
  Description of Artificial Sequence: Synthetic coding sequence
atgggccccctgaccttcagagatgtggccatcgagttcagcctgaaggagtggcagtgcctggacacagcccagaggaacctgtacagaaatgtgatgctggagaactacagaaacctggtgttcctgggcatcaccgtgtccaagccagacctgatcacctgcctggagcagggcaaggaggcctggagcatgaagagacatgagatcatggtggccaagcccaccgtgatgtgcagccactttgcccaggacctgtggccagagcagaacatcaaggacagcttccagaaggtgaccctgaagagatatggcaagtgcagacatgagaacctgcccctgaggaagggctgtgagagcatggatgagtgcaagatgcacaagggcggctgcaatggcctgaaccagtgcctgacagccacccagagcaagatcttccagtgtgacaagtatgtgaaggtggcccacaagttcagcaacagcaacagacatgagatccgccacaccaagaagaagcccttcaagtgcaccaagtgtgggaagagctttggcatgatcagctgcctgacagagcacagccgcatccacaccagggtgaacttctacaagtgtgaggagtgtgggaaggccttcaactggagcagcaccctgaccaagcacaagaggatccacactggagagaagccctacaagtgtgaggagtgtgggaaggccttcaaccagagcagcaacctgatcaagcacaagaagatccacactggagagaagccctacaagtgtgaggagtgtgggaagaccttcaaccgcttcagcaccctgaccacccacaagatcatccacactggagagaagccctacaagtgcaaggaatgtgggaaggccttcaacagaagcagcaccctgaccacccacaggaagatccacactggagagaagccctacaagtgtgaggagtgtgggaaggccttcaagcagagcagcaacctgaccacccacaagatcatccacactggagagaagccctacaagtgcaagaagtgtgggaaggccttcaaccagagcgcccacctgaccacccatgaggtgatccacactggagagaagccctacaagtgtgagaagtgtgggaaggccttcaaccacttcagccacctgaccacccacaagatcatccacactggagagaagccctacaagtgcaaggaatgtgggaaggccttcaagcacagcagcaccctgaccaagcacaagatcatccacactggagagaagccctacaagtgcaaggaatgtgagaaggccttcaaccagagcagcaagctgacagagcacaagaagatccacactggagagaagccctatgaatgtgagaagtgtgggaaggccttcaaccagagcagcaacctgaccaggcacaagaagagccacacagaggagaagccctacaagtgtgaggagtgtgggaagggcttcaagtggcccagcaccctgaccatccacaagatcatccacactggagagaagccctacaagtgtgaggagtgtgggaaggccttcaaccagagcagcaagctgaccaagcacaagaagatccacactggagagaagccctacacctgtgaggagtgtgggaaggccttcaaccagagcagcaacctgaccaagcacaagaggatccacactggagagaagccctacaagtgtgaggagtgtgacaaggccttcaagtggagctctgtgctgaccaagcacaagatcatccacactggagagaagctgcagatctag

SEQ ID NO: 43864 - DNA, 3273 bp, Artificial Sequence
  Description of Artificial Sequence: Synthetic coding sequence
atgaacatggagggcctggtgatgttccaggacctgagcattgacttcagccaggaggagtgggagtgcctggatgctgcccagaaggacctgtacagagatgtgatgatggagaactacagcagcctggtgtccctgggcctgagcatccccaagccagatgtgatcagcctgctggagcagggcaaggagccctggatggtgtccagagatgtgctgggcggctggtgccgggacagcgagttccgctgcaagaccaaggacagctgcctgcccaaggagatctatgaggtgaccagcagccagtgggtgaggatggagaagtgccacagcctggtgggcagctctgtgagagatgactgggagtgcaagggccagttccagcaccaggacatcaaccaggagcgctacctggagaaggccatcatgacctatgagaccacccccaccttctgcctgcagaccagcctgaccctgcaccaccgcatccaccctggagagaagctgtacaagagcacagagtgcatggccttcaagtatggcagcgagctgacccagcagcaggagacccacactggagagaagctgtacaagtgcaaggaatgtgggaaggccttccaccacttctcctacctggtgaagcaccagaggatccacactggagagaagccctgtgcctgcaaggagtatggcaaggccttcatcagcggcagccacctgatccagcaccagaagatgtacacagatgagcggccccatgagtgccaggagagcgtgaaggccttccggcccagcgcccacctgatccagcactggaggatccacactggagacaagccctatgagtgcaaggaatgtgggaagagcttcaccagcggcagcaccctgaaccagcaccagcagatccacactggagagaagccctaccactgcaagcagtgtgggaagagcttcaccgtgggcagcaccctcatccgccaccagcagatccacactggagagaagccctatgactgcaaggaatgtgggaagagctttgccagcggcagcgccctgatccgccaccagaggatccacactggagagaagccctatgactgcaaggaatgtgggaagagcttcaccttccacagcgccctgatccgccaccagaggatccacactggagagaagccctatgactgcaaggaatgtgggaagagcttcaccttccgcagcggcctgattggccaccaggccatccacactggagagaagccctatgactgcaaggaatgtgggaagagcttcaccgctggcagcaccctcatccagcaccagaggatccacactggagagaagccctatgactgcaaggaatgtgggaagagctttgccagcggcagcgccctgctgcagcaccagaggatccacactggagagaagccctactgctgcaaggaatgtgggaagagcttcaccttccgcagcaccaggaacagacaccagaggatccacactggagagaagccctacaactgcaaggaatgtgggaagagctttgccagcggcagcgccctgctgcagcaccagaggatccacactggagagaagccctaccactgcaaggaatgtgggaagagcttcaccttccgcagcggcctgattggccaccaggccgtgcacactggagagaagccctatgactgcaaggaatgtgggaagagcttcaccagccgcagcgccctgatccagcaccagaggatccacactggagagaagccctaccactgcaaggaatgtgggaagagcttcaccgtgggcagcaccctgctgcagcaccagcagatccacactggagagaagccctatgactgcaaggaatgtgggaaggccttccggctgcggctgcggctgacccagcaccagcagatccacactggagagaagccctaccagtgccaggagtgtgggaaggcctttgtgtctgtgtctggcctgacccagcaccaccgcatccacactggagagaagccctatgagtgcccagactgtgggaaggccttccggcagaggacctacctgaaccagcaccggcgcatccacactggagagaagccctatgagtgcaaggaatgtgggaagagcttcaccttctgcagcggcctcatccagcaccagcagaaccacacagatgagaagccctatgatggcaaggaatgtgggaagagcttcaccagccacagcaccctcatccagcaccagcagatccacactggagagaagccctatgactgcaaggaatgtgggaagagcttcaccagccacagcaccctcatccagcaccagcagatccacactggagagaagctgtatgactgcaaggaatgtgggaagagcttcaccagccacagcaccctcatccagcaccagcccctgcacactggagagaagccctaccactgcaaggaatgtgggaagagcttcaccctgcggagcgccctgatccagcacaggcctgtgcacactggagagaagcgctacagctgcaaggaatgtgggaagagcttcaccagccgcagcaccctgattgagcaccagaggatccacactggagagaagccctaccactgcaaggaatgtgggaagagctttgccttccgcagcgccatcatccagcaccggcgcatccacactggagagaagccctatgactgcaaggaatgtgggaaggccttcagaagaagaagcaagctgacccagcaccagaggatccacactggagagaagccctaccgctgccatgaatgtgggaaggcctttgtgcgcttcagcggcctgaccaagcaccacagcatccacactggagagaagccctatgagtgcaagacctgtgggaagagcttccggcagaggacccacctgaccctgcaccagaggatccacactggagaccggccctatgagtgcaaggaatgtgggaagagcttcacctgtggcagcgagctgatccgccaccagaggacccacactggagagaagccctatgactgcaaggaatgtgggaaggccttccgctgccccagccagctgagccagcacaagaggatccacactggagagaagacctaccagtgcccagaatgtgggaaggccttcttctacgccagcggcctgagccgccaccagagcgtgcacactggagagaagccctatgagtgcaagacctgtgggaaggccttcaagcagctgacccagctgaccaggcaccagagaattcatgacctgacctag

SEQ ID NO: 43865 - DNA, 1593 bp, Artificial Sequence
  Description of Artificial Sequence: Synthetic coding sequence
atggtgcggccccaggacacagtggcctatgaggacctgtctgaggactacacccagaagaagtggaagggcctggccctgagccagagggccctgcactggaacatgatgctggagaatgaccgctccatggccagcctgggcaggaacatgatggagagcagcgagctgacccccaagcaggagatcttcaagggcagcgagagcagcaacagcaccagcggcggcctgtttggagtggtgcctgggggcacagaaacaggagatgtgtgtgaggacaccttcaaggagctggagggccagcccagcaatgaggagggcagccggctggagagtgacttcctggagatcattgatgaggacaagaagaagagcaccaaggacagatatgaggagtacaaggaggtggaggagcacccccccctgagcagcagccctgtggagcatgaaggagtgctgaagggccagaagagctaccgctgtgatgaatgtgggaaggccttctactggagcagccacctgattggccaccggcgcatccacactggagagaagccctatgagtgcaatgaatgtgggaagaccttccggcagaccagccagctgattgtgcacctgcggacccacactggagagaagccctatgagtgcagtgaatgtgggaaggcctaccgccacagcagccacctgatccagcaccagaggctgcacaacggggagaagccctacaagtgcaatgaatgtgccaaggccttcaaccagagcagcaagctgtttgaccaccagaggacccacactggagagaagccctatgagtgcaaggaatgtggggccgccttcagccgcagcaagaacctggtgcgccaccagttcctgcacacaggcaagaagccctacaagtgcaatgaatgtggccgggccttctgcagcaacagaaacctgattgaccaccagaggacccacactggagagaagccctacaagtgcaatgaatgtgggaaggccttcagccgcagcaagtgcctgatccgccaccagagcctgcacactggagagaagccctacaagtgcagtgaatgtgggaaggccttcaaccagatcagccagctggtggagcacgagcgcatccacactggagagaagcccttcaagtgcagtgaatgtgggaaggccttcggcctgagcaagtgcctgatccgccaccagaggctgcacaccagcgagaagccctacaagtgcaatgaatgtgggaagagcttcaaccagaacagctacctgatcatccaccagaggatccacactggagagaagccctatgagtgcaatgaatgtgggaaggtgttctcctacaacagcagcctgatggtgcaccagaggacccacactggagagaagccctacaagtgcaacagctgtgggaaggccttcagtgacagcagccagctgactgtgcaccagagggtgcacactggagagaagccctatgagtgcattgaatgtgggaaggccttcagccagaggagcaccttcaaccaccaccagaggacccacgccggggagaagcccagcggcctggcccggagcagcagctag

SEQ ID NO: 43866 - DNA, 1632 bp, Artificial Sequence
  Description of Artificial Sequence: Synthetic coding sequence
atggtgcggccccaggacacagtggcctatgaggacctgtctgaggactacacccagaagaagtggaagggcctggccctgagccagagggccctgcactggaacatgatgctggagaatgaccgctccatggccagcctgggcaggaacatgatggagagcagcgagctgacccccaagcaggagatcttcaagggcagcgagagcagcaacagcaccagcggcggcctgtttggagtggtgcctgggggcacagaaacaggagatgtgtgtgaggacaccttcaaggagctggagggccagcccagcaatgaggagggcagccggctggagagtgacttcctggagatcattgatgaggacaagaagaagagcaccaaggacagatatgaggagtacaaggaggtggaggagcacccccccctgagcagcagccctgtggagcatgaaggagtgctgaagggccagaagagctaccgctgtgatgaatgtgggaaggccttctactggagcagccacctgattggccaccggcgcatccacactggagagaagccctatgagtgcaatgaatgtgggaagaccttccggcagaccagccagctgattgtgcacctgcggacccacactggagagaagccctatgagtgcagtgaatgtgggaaggcctaccgccacagcagccacctgatccagcaccagaggctgcacaacggggagaagccctacaagtgcaatgaatgtgccaaggccttcaaccagagcagcaagctgtttgaccaccagaggacccacactggagagaagccctatgagtgcaaggaatgtggggccgccttcagccgcagcaagaacctggtgcgccaccagttcctgcacacaggcaagaagccctacaagtgcaatgaatgtggccgggccttctgcagcaacagaaacctgattgaccaccagaggacccacactggagagaagccctacaagtgcaatgaatgtgggaaggccttcagccgcagcaagtgcctgatccgccaccagagcctgcacactggagagaagccctacaagtgcagtgaatgtgggaaggccttcaaccagatcagccagctggtggagcacgagcgcatccacactggagagaagcccttcaagtgcagtgaatgtgggaaggccttcggcctgagcaagtgcctgatccgccaccagaggctgcacaccagcgagaagccctacaagtgcaatgaatgtgggaagagcttcaaccagaacagctacctgatcatccaccagaggatccacactggagagaagccctatgagtgcaatgaatgtgggaaggtgttctcctacaacagcagcctgatggtgcaccagaggacccacactggagagaagccctacaagtgcaacagctgtgggaaggccttcagtgacagcagccagctgactgtgcaccagagggtgcacactggagagaagaacctgatgaatgtgctgtctgtgggcaagcccctggtgtctgtgcccctgctgatcaccaccagcgagctgatgctggagaggagcccccaggtgtggctgggccacctgctgaaggcctggttcagcgagacagacagcaaggacctgtag

SEQ ID NO: 43867 - DNA, 1980 bp, Artificial Sequence
  Description of Artificial Sequence: Synthetic coding sequence
atgctgcaccagcccaccccaggcaacagaggcctgacagccaggatggaggtgggccctgccacagagacctttgtgctggagctgcagtgcctggaggatggcggccctggccctgacaccctgagcggcggcagcggcggcagcgagagccaggaggaggaggagccccaggagaggaacagcagcccccagaggcctgctgtgtctgcccctgtgggcgccagcgagattgctgaggagacccggcccggccagcgggagctgcagctgcagcagctggagcagcagcctgagccccagcagcagccccagcacgagcagctgcagcagccccagccccacctggagctgcagcagcagccccagcaggacggccagcagcagctgagccagctgcagcaggagaagcaccagagcgtgcaccaccaggagctgaagccagagctgcagctgatgcaccagcagcagcagctgcagccccagcaggtgcaggagcagcagaggctgcagcagcagcaggagcagctgcagacccagcaggcccaggagcagcaggtgctgcagcagcaggagcagctgcagcagcaggtgcaggagcagcagctgctgcagcagcagcaggagcagctgcagcagcagcagctgctgcagcagcaggagcagctgcagcagcagcagttccagcagcagcaggagcagctgcagcagcagcagcagctgctgctgctgcagcagcagggccagctgcagcagcagctgctgcagcagcagcaggcccagctgcagcagcagctgctggagcagcagcaggcccagctgcagcagcagctgctgctgcagcagcaggagcagctgcagcagcagcagcagcagcagctgctgcagcagcagcaggagcagctgcagcagcagcagctgcagcccccacccctggagcctgaggaggaggaggaggtggagctggagctgatgcctgtggacctgggcagcgagcaggagctggagcagcagaggcaggagctggagcggcagcaggagctggagcggcagcaggagcagaggcagctgcagctgaagctgcaggaggagctgcagcagctggagcagcagctggagcagcagcagcagcagctggagcagcaggaggtgcagctggagctgacccctgtggagctgggcgcccagcagcaggaggtgcagctggagctgacccctgtgcagcctgagctgcagctggagctggtgcctgctgctgggggcggcggcgctgctgtgcctggggccccagctgctgtggtggtggcccctcctggctacgtggtggtgcaggagctgatggtgctgcctgctgtggccgccccagctgtggtggccatccctggccctgctggcagcgctgccctgaccccagcccggcagaggagaagaagaagagcccgggaccggcccaccatctgtggagaatgtgggaagggcttcagccgcagcacagacctggtgcgccaccaggccacccacactggagagcggccccaccgctgtggagaatgtgggaagggcttcagccagcacagcaacctggtgacccaccagaggatccacactggagagaagccctatgcctgcagctactgtgccaagcgcttcagcgagagcagcgccctggtgcagcaccagaggacccacactggagagcggccctatgcctgtggggactgtgggaagcgcttctctgtgagcagcaacctgctgcggcacaggaggacccacagcggggagcggccctacgtgtgtgaggactgtggggagcgcttccgccacaaggtgcagatcagaagacatgagcggcagctgcacggggccggccgcagccggggcctgggcctgctgcgggccagcaggcctgctgccctgggcggccctgcccgggcagagcaggccgccacagccacagccccagctgacaaggccctgtag

SEQ ID NO: 43868 - DNA, 3180 bp, Artificial Sequence
  Description of Artificial Sequence: Synthetic coding sequence
atggaggccaacccagctggcagcggggccggcggcggcggcagcagcggcattggaggagaagatggagtgcacttccagagctacccctttgacttcctggagttcctgaaccaccagagatttgagcccatggagctgtatggagaacatgccaaggctgtggccgccctgccctgtgcccctggccccccaccccagcccccaccccagcccccaccaccccagtatgactacccaccccagagcaccttcaagcccaaggccgaggtgcccagcagcagcagcagcagcagcagcagcagcagcagcagcagcagcagcagcagcagcagcagcagcagcagcagccaggccaagaagccagacccccccctgcccccagccttcggggcccctcctccacccctgtttgatgctgccttccccaccccccagtggggcatcgtggacctgagcggccaccagcacctgtttggaaacctgaagagaggaggccctgccagcggccctggggtgaccccaggcctgggcgccccagctggggcccctggccccctgcctgcccccagccagaccccacctggccccccagctgctgctgcctgtgaccccaccaaggatgacaagggctacttccggcggctgaagtacctgatggagcggcgcttcccctgtggggtgtgccagaagagcttcaagcagagcagccacctggtgcagcacatgctggtgcacagcggggagcggccctatgaatgtggggtgtgtggccgcacctacaaccacgtgagcagcctcatccgccaccggcgctgccacaaggatgtgcccccagctgctgggggccccccccagcccggcccccacctgccccccctgggcctgcctgccccagctgccagcgctgccacagctgctgcccccagcacagtgagcagcggccccccagccacccctgtggccccagcccccagcgcagatggcagcgctgccccagctggggtgggcgtgcccccaccagccactggaggaggagatggcccctttgcctgccccctgtgctggaaggtgttcaagaagcccagccacctgcaccagcaccagatcatccacactggagagaagcccttcagctgcagcgtgtgcagcaagagcttcaacagaagagagagcctgaagagacatgtgaagacccacagcgctgacctgctgcggctgccctgtggcatctgtgggaaggccttcagagatgccagctacctgctgaagcaccaggccgcccacgccggggccggggccggcggccccaggcctgtgtacccctgtgacctgtgtgggaagagctacagcgccccccagagcctgctgcggcacaaggccgcccacgcccctcctgctgctgctgctgaggcccccaaggatggagctgccagcgccccccagcccccacccaccttccccccaggcccctacctgctgcccccagacccccccaccacagattctgagaaggctgctgctgctgctgctgctgtggtgtatggagctgtgcctgtgcccctgctgggcgcccaccccctgctgctgggcggggccggcaccagcggggccggcggcagcggggcctctgtgcctgggaagaccttctgctgcggcatctgtggccggggctttggaagaagagagaccctgaagagacatgagcgcatccacactggagagaagccccaccagtgccctgtgtgtgggaagcgcttccgggagagcttccacctgagcaagcaccacgtggtgcacacccgggagcggccctacaagtgtgagctgtgtgggaaggtgtttggctacccccagagcctgaccaggcaccggcaggtgcaccggctgcagctgccctgtgccctggccggggccgccggcctgcccagcacccagggcacccctggggcctgtggccctggggccagcggcaccagcgctggccccacagatggcctgtcctatgcctgcagcgactgtggggagcacttcccagacctcttccacgtgatgagccacaaggaggtgcacatggccgagaagccctacggctgtgatgcctgtgggaagaccttcggcttcatcgagaacctgatgtggcacaagctggtgcaccaggccgcccctgagcggctgctgcccccagcccctgggggcctgcagcccccagatggcagcagcggcacagatgctgcctctgtgctggacaatggcctggccggggaggtgggcgctgctgtggccgccctggccggcgtgtctggaggagaagatgctggaggagctgctgtggccggggccggcggcggggccagcagcggccctgagcgcttcagctgtgccacctgtggccagagcttcaagcacttcctgggcctggtgacccacaagtatgtgcacctggtgcggaggaccctgggctgcggcctgtgtggccagagctttgctggggcctatgacctgctgctgcacagaagaagccaccggcagaagaggggcttccgctgccctgtgtgtgggaagcgcttctgggaggccgccctgctgatgaggcaccagcgctgccacacagagcagaggccctaccgctgtggggtgtgtggccggggcttcctgcgctcctggtacctgcggcagcaccgggtggtgcacactggagagcgggccttcaagtgtggggtgtgtgccaagagatttgcccagagcagcagcctggccgagcaccggcggctgcatgctgtggcccggccccagcgctgcagcgcctgtgggaagaccttccgctaccgcagcaacctgctggagcaccagaggctgcacctgggggagcgggcctaccgctgtgagcactgtgggaagggcttcttctacctgagctctgtgctgcggcaccagagggcccacgagccccccaggcctgagctgcgctgcccagcctgcctgaaggccttcaaggaccccggctacttcaggaagcacctggccgcccaccagggcggccggcccttccgctgcagcagctgtggggagggctttgccaacacctacggcctgaagaagcaccggctggcccacaaggccgagaacctgggcggccctggagctggagctggcaccctggccggcaaggatgcctag

SEQ ID NO: 43869 - DNA, 1596 bp, Artificial Sequence
  Description of Artificial Sequence: Synthetic coding sequence
atggattctgtggcctttgaagatgtggccgtgaacttcacccaggaggagtgggccctgctggaccccagccagaagaacctgtaccgggaggtgatgcaggagaccctgaggaacctgaccagcatcggcaagaagtggaacaaccagtacattgaagatgagcaccagaaccccaggaggaacctgcggcggctgattggagagcggctgtctgagagcaaggagagccaccagcacggggaggtgctgacccaggtgcctgatgacaccctgaagaagaagaccccaggagtgcagagctatgagagctctgtgtgtggggagatcggcatcggcctgagcagcctgaacagacacctgcgggccttctcctacagcagcagcctggccatccacggccgcacccacactggagagaagccctatgagtgcaaggaatgtgggaaggccttccgcttccccagctctgtgagaagacatgagcgcatccacagcgccaagaagccctatgagtgcaagcagtgtgggaaggccttctccttccccagctctgtgagaagacatgagcgcatccacagcgccaagaagccctatgagtgcaagcagtgtgggaaggccctgagctacctggtgtccttccagacccacatgaggatgcacactggagagcggccccacaagtgcaacatctgtgggaaggccttcttcagccccagcagcctgaagagacatgagaagagccacactggagagaagcgctacaagtgcaagcagtgtgacaaggccttcaactgccccagcagcttccagtaccacgagaggacccacagcggggagaagccctatgagtgcacccagtgcaggaaggccttccgctctgtgaagtacctgcgggtgcatgagaggaagcacactggagagaagccctatgagtgcaagctgtgtgggaagggcttcatcagcagcaccagcttccgctaccacgagaagacccacactggagagaagccctatgagtgcaagaagtgtgtgaaggccttctcctttgtgaaggacctgcgcatccacgagaggacccacactggagagaagccctttgagtgcaagcagtgtgggaagaccttcaccagcagcaacagcttccactaccacgagaggacccacactggagagaagccctatgagtgcaagcagtgtgggaaggccttccgcagcgcctctgtgctgcagaagcacatccgcacccacactggagagaagccctacggctgcaagcagtgtgggaaggtgttccgggtggccagccagctgaagatgcatgagaggacccacactggagagaagccctatgagtgcaagcagtgtgggaaggccttcatcagcagcaacagcatccgctaccacaagaggacccacactggagagaagccctacaagtgcaagcagtgtgggaaggccttcatcagcagcaacagcttcctgtaccacgagcgcatccacactggagagaagccctatgagtgcaagcagtgtgggaaggccttccgcagcgccagcatcctgcagaagcacgtgaggacccacgccggctag

SEQ ID NO: 43870 - DNA, 297 bp, Artificial Sequence
  Description of Artificial Sequence: Synthetic coding sequence
atgctgcggcggggccacctggccttcagagatgtggccatcgagttcccccaggaggagtggaagtgcctggaccctgcccagaggaccctgtaccgggaggtgatggtggagaactacagaaacctggtgttcctgggcatctgcctgcctgacctgagcgtcatctccatgctggagcagaggcgggaccccaggaacctgcagagcgaggtgaagatcgccaacaaccctggcagctgcagcgtgacccaggccgtggtggagtggcagagctctgtggccatcgtggcctag

SEQ ID NO: 43871 - DNA, 1734 bp, Artificial Sequence
  Description of Artificial Sequence: Synthetic coding sequence
atgctgcggcggggccacctggccttcagagatgtggccatcgagttcccccaggaggagtggaagtgcctggaccctgcccagaggaccctgtaccgggaggtgatggtggagaactacagaaacctggtgttcctgggcatctgcctgcctgacctgagcgtcatctccatgctggagcagaggcgggaccccaggaacctgcagagcgaggtgaagatcgccaacaaccctgggggccgggagtgcatcaagggcgtgaatgctgagagcagcagcaagctgggcagcaatgccggcaacaagagcctgaagaaccagctgggcctgaccttccagctgcacctgtctgagctgcagctgttccaggccgagaggaacatcagcggctgcaagcacgtggagaagcccatcaacaacagcctggtgagccccctgcagaagatctacagctctgtgaagagccacatcctgaacaagtacagaaatgactttgatgacagccccttcctgccccaggagcagaaggcccagatccgggagaagccctgtgaatgtaatgaacatggcaaggccttccgggtgagcagccggctggccaacaaccaggtgatccacacagctgacaacccctacaagtgcaatgaatgtgacaaggtgttcagcaacagcagcaacctggtgcagcaccagaggatccacactggagagaagccctacaagtgccatgaatgtgggaagctgttcaaccgcatcagcctgctggcccggcaccagaggatccacactggagagaagccctacaagtgccatgaatgtgggaaggtgttcacccagaacagccacctggccaaccaccaccgcatccacactggagagaagccctacaagtgcaatgaatgtgggaaggtgttcaacagaaatgcccacctggcccggcaccagaagatccacagcggggagaagccctacaagtgcaaggaatgtgggaaggccttcagcggcggcagcggcctgacagcccacctggtgatccacactggagagaagctgtacaagtgcaacaagtgtgggaaggtgttcaacagaaatgcccacctgaccaggcaccagaggatccacactggagagaagccctatgagtgcaaggaatgtgggaaggtgttccgccacaagttctgcctgaccaaccaccacaggatgcacactggagagcagccctacaagtgcaatgaatgtgggaaggccttccgggactgcagcggcctgacagcccacctgctgatccacactggagagaagccctacaagtgcaaggaatgtgccaaggtgttccgccaccggctgagcctgagcaaccaccagcgcttccacactggagagaagccctaccgctgtgatgaatgtgggaaggacttcaccaggaacagcaacctggccaaccaccaccgcatccacactggagagaagccctacaagtgcagcgagtgccacaaggtgttcagccacaacagccacctggcccggcaccggcagatccacactggagagaagagctacaagtgcaatgaatgtgggaaggtgttcagccacaagctgtacctgaagaagcatgagcgcatccacactggagagaagccctaccgctgccatgaatgtgggaaggacttcaccaggaacagcaacctggccaaccaccaccgcatccacactggagagaagccctacagatag

SEQ ID NO: 43872 - DNA, 1635 bp, Artificial Sequence
  Description of Artificial Sequence: Synthetic coding sequence
atggctgtgatggacctgagcagcccctgggccctgaccaagcaggacagcgcctgcttccacctgagaaatgctgaggaggagaggatgattgctgtgttcctgaccacctggctgcaggagcccatgaccttcaaggatgtggccgtggagttcacccaggaggagtggatgatgctggacagcgcccagaggagcctgtacagagatgtgatgctggagaactacagaaacctgacctctgtggagtaccagctgtaccgcctgaccgtcatcagccccctggaccaggaggagatccggaacatgaagaagaggatcccccaggccatctgcccagaccagaagatccagcccaagaccaaggagagcacagtgcagaagatcctgtgggaggagcccagcaatgctgtgaagatgatcaagctgaccatgcacaactggagcagcaccctgcgggaggactgggagtgccacaagatcaggaagcagcacaagatccctgggggccactggaggcagatgatctatgcccccaagaagacagtgccccaggagctgttccgggactaccacgagctggaggagaacagcaagctgggcagcaagctgatcttcagccagagcatcttcaccagcaagcactgccagaagtgctacagcgagatcggctgcctgaagcacaacagcatcatcaacaactacgtgaagaacagcatcagcgagaagctgtatgagagccatgaatgtgacaccaccctgtggcacttccagaggaaccagacagtgcagaaggagtacacctacagcaagcacggcatgcacttcacccacaacatgtttcctgtgcccaacaacctgcacatggcccagaatgcctgtgagtgcaacaaggatgagaccctgtgccaccagagcagcctgaagaagcagggccagacccacacagagaagaagcatgagtgcaaccagtgtgggaaggccttcaagaggatcagcaacctgaccctgtacaagaagagccacatgggagagaagcagtatgagtgcaaggaatgtgggaaggtgttcaatgacagcagcaccctgcggcggcacgtgaggacccacactggagagaagccctatgagtgcaaccagtgtgggaaggccttcagccagaagaccagcctgaaggcccacatgaggacccacactggagagaagccctatgagtgcaaccagtgtgggaagagctttggcaccagcagctacctgattgtgcacaagaggatccacactggagagaagctgtatgaatgttctgaatgtgggaaggccttcaacaccagcagccacctgaaggtgcacaagaagatccacactggagaaaatgtgtatgaatgtagtgactgtgggaaggtgttcagcggcgtgagcagcctgaggatgcacatccgcacccacactggagagaagccctatgagtgcaaggagtgcaggaaggccttctctgtgagcagcagcctgcggcggcacgtgcgcatccacactggagagaagccctatgagtgcatccagtgtgggaaggccttcagccagagcagcagcctcatcatccacaagaggatccacacagagcgggagaccctgtag

SEQ ID NO: 43873 - DNA, 2820 bp, Artificial Sequence
  Description of Artificial Sequence: Synthetic coding sequence
atggccaccagccagtactttgattttgcccagggcggcggcccccagtacagcgcccagccccccaccctgcccctgcccaccgtgggcgccagctacacagcccagcccaccccaggcatggaccctgctgtgaacccagccttccccccagctgccccagctggctatggaggctaccagccccacagcggccaggactttgcctacggcagccggccccaggagcctgtgcccacagccaccaccatggccacctaccaggacagctacagctatggccagagcgctgctgcccggagctatgaagatcggccctacttccagagcgctgccctgcagagcggccgcatgacagctgctgacagcggccagcccggcacccaggaggcctgtggccagcccagcccccacggcagccacagccacgcccagcccccccagcaggcccccatcgtggagagcggccagcctgccagcaccctgagcagcggctacacctaccccacagccaccggggtgcagcctgagagcagcgccagcatcgtgaccagctaccccccacccagctacaaccccacctgcacagcctacacagcccccagctaccccaactatgatgcctctgtgtacagcgctgccagccccttctaccccccagcccagcccccacctcctcctggccccccccagcagctgcccccacctccagccccagctggcagcggcagcagccccagggctgacagcaagccacccctgcccagcaagctgccccggcccaaggccggcccccggcagctgcagctgcactactgtgacatctgcaagatcagctgtgccggcccccagacctaccgggagcacctgggcggccagaagcacaggaagaaggaggccgcccagaagacaggagtgcagcccaacggcagcccccggggcgtgcaggcccagctgcactgtgacctgtgtgctgtgtcctgcacaggagcagatgcctatgctgcccacatccggggcagcaagcaccagaaggtgttcaagctgcacgccaagctgggcaagcccatccccaccctggagcccgccctggccacagagagccccccaggagctgaggccaagcccaccagccccaccggccccagcgtgtgtgccagcagcaggcctgccctggccaagaggcctgtggccagcaaggccctgtgtgagggccccccagagccccaggccgccggctgccggccccagtggggcaagccagcccagcccaagctggagggccctggggcccccacccagggcggcagcaaggaggccccagctggctgcagtgatgcccagcctgtgggcccagaatatgtggaggaggtgttcagtgatgagggccgggtgctgcgcttccactgcaagctgtgtgagtgcagcttcaatgacctgaatgccaaggacctgcacgtgcggggccgccgccaccggctgcagtacaggaagaaggtgaacccagacctgcccatcgccacagagcccagcagccgggccaggaaggtgctggaggagaggatgaggaagcagaggcacctggccgaggagcggctggagcagctgcggcgctggcatgctgagcggcggcggctggaggaggagcccccccaggatgtgccccctcatgcccccccagactgggcccagcccctgctgatgggccggcctgagagccctgccagcgcccccctgcagcctggaagaagacctgccagcagtgatgacagacatgtgatgtgcaagcacgccaccatctaccccacagagcaggagctgctggccgtgcagagagctgtgtcccatgctgagcgggccctgaagctggtgtctgacaccctggccgaggaggaccggggcagaagagaggaggagggggacaagaggagctctgtggccccccagaccagggtgctgaagggcgtgatgagggtgggcatcctggccaagggcctgctgctgcggggggacagaaatgtgcggctggccctgctgtgcagcgagaagcccacccacagcctgctgcggcgcatcgcccagcagctgccccggcagctgcagatggtgacagaagatgaatatgaggtgtccagtgaccctgaggccaacatcgtcatcagcagctgtgaggagcccaggatgcaggtgaccatctctgtgaccagccccctgatgagggaggaccccagcacagatcctggggtggaggagccccaggctgatgctggagatgtgctgagccccaagaagtgcctggagagcctggccgccctgcggcatgcccgctggttccaggcccgggccagcggcctgcagccctgcgtcatcgtcatccgggtgctgcgggacctgtgccggcgggtgcccacctggggcgccctgcctgcctgggccatggagctgctggtggagaaggctgtgtcctctgctgctggccccctgggccctggagatgctgtgagaagagtgctggagtgtgtggccaccggcaccctgctgacagatggccctggcctgcaggacccctgtgagcgggaccagacagatgccctggagcccatgaccctgcaggagcgggaggatgtgacagccagcgcccagcacgccctgaggatgctggccttccggcagacccacaaggtgctgggcatggacctgctgccccccaggcaccggctgggcgcccgcttcaggaagaggcagaggggccctggagagggggaggagggcgctggggagaagaagaggggccggcggggcggggagggcctggtgtag

SEQ ID NO: 43874 - DNA, 1101 bp, Artificial Sequence
  Description of Artificial Sequence: Synthetic coding sequence
atggccaccagccagtactttgattttgcccagggcggcggcccccagtacagcgcccagccccccaccctgcccctgcccaccgtgggcgccagctacacagcccagcccaccccaggcatggaccctgctgtgaacccagccttccccccagctgccccagctggctatggaggctaccagccccacagcggccaggactttgcctacggcagccggccccaggagcctgtgcccacagccaccaccatggccacctaccaggacagctacagctatggccagagcgctgctgcccggagctatgaagatcggccctacttccagagcgctgccctgcagagcggccgcatgacagctgctgacagcggccagcccggcacccaggaggcctgtggccagcccagcccccacggcagccacagccacgcccagcccccccagcaggcccccatcgtggagagcggccagcctgccagcaccctgagcagcggctacacctaccccacagccaccggggtgcagcctgagagcagcgccagcatcgtgaccagctaccccccacccagctacaaccccacctgcacagcctacacagcccccagctaccccaactatgatgcctctgtgtacagcgctgccagccccttctaccccccagcccagcccccacctcctcctggccccccccagcagctgcccccacctccagccccagctggcagcggcagcagccccagggctgacagcaagccacccctgcccagcaagctgccccggcccaaggccggcccccggcagctgcagctgcactactgtgacatctgcaagatcagctgtgccggcccccagacctaccgggagcacctgggcggccagaagcacaggaagaaggaggccgcccagaagacaggagtgcagcccaacggcagcccccggggcgtgcaggcccagctgcactgtgacctgtgtgctgtgtcctgcacaggagcagatgcctatgctgcccacatccggggcagcaagcaccagaagggcctgctgagccaccggcagcaggccgctgaccccagcggcggcaaccagcccaacctgaactag

SEQ ID NO: 43875 - DNA, 213 bp, Artificial Sequence
  Description of Artificial Sequence: Synthetic coding sequence
atggccaccagccagtactttgattttgcccagggcggcggcccccagtacagccctgaggtggagaccaccccaccagccctggccagcggcctgccctgtgccctgccctggacagtgggctgcagcggcagtgatgctgtgacagccctgtgccccagcctgcggggcctggcctgcatctgcagcatcctgtgggaccctgcctggtag

SEQ ID NO: 43876 - DNA, 843 bp, Artificial Sequence
  Description of Artificial Sequence: Synthetic coding sequence
atgctgagctgcaacatctgtggggagaccgtgaccagcgagccagacatgaaggcccacctgattgtgcacatggagagcgagatcatctgccccttctgcaagctgtctggagtgaactatgatgagatgtgcttccacatcgagacagcccactttgagcagaacaccctggagaggaactttgagcgcatcaacacagtgcagtatggcaccagtgacaacaagaaggacaacaccctgcagtgtggcatggaggtgaacagcagcatcctgagcggctgtgccagcaaccaccccaagaacagcgcccagaacctgaccaaggacagcaccctgaagcatgagggcttctacagcgagaacctgacagagagcaggaagttcctgaagagccgggagaagcagagcagcctgacagagatcaagggctctgtgtatgagaccacctacagccccccagaatgtcccttctgtgggaagattgaggagcacagcgaggacatggagacccacgtgaagaccaagcacgccaacctgctggacatccccctggaggactgtgaccagcccctgtatgactgccccatgtgtggcctcatctgcaccaactaccacatcctgcaggagcacgtggacctgcacctggaggagaacagcttccagcagggcatggacagagtgcagtgcagcggggacctgcagctggcccaccagctgcagcaggaggaggacaggaagagaagaagtgaggagagccggcaggagattgaggagttccagaagctgcaggagctgctgaagcacttcatcggcatcatccgcatgctgccccagatgtag

SEQ ID NO: 43877 - DNA, 1737 bp, Artificial Sequence
  Description of Artificial Sequence: Synthetic coding sequence
atgctgagctgcaacatctgtggggagaccgtgaccagcgagccagacatgaaggcccacctgattgtgcacatggagagcgagatcatctgccccttctgcaagctgtctggagtgaactatgatgagatgtgcttccacatcgagacagcccactttgagcagaacaccctggagaggaactttgagcgcatcaacacagtgcagtatggcaccagtgacaacaagaaggacaacaccctgcagtgtggcatggaggtgaacagcagcatcctgagcggctgtgccagcaaccaccccaagaacagcgcccagaacctgaccaaggacagcaccctgaagcatgagggcttctacagcgagaacctgacagagagcaggaagttcctgaagagccgggagaagcagagcagcctgacagagatcaagggctctgtgtatgagaccacctacagccccccagaatgtcccttctgtgggaagattgaggagcacagcgaggacatggagacccacgtgaagaccaagcacgccaacctgctggacatccccctggaggactgtgaccagcccctgtatgactgccccatgtgtggcctcatctgcaccaactaccacatcctgcaggagcacgtggacctgcacctggaggagaacagcttccagcagggcatggacagagtgcagtgcagcggggacctgcagctggcccaccagctgcagcaggaggaggacaggaagagaagaagtgaggagagccggcaggagattgaggagttccagaagctgcagaggcagtatggcctggacaacagcggcggctacaagcagcagcagctgaggaacatggagattgaggtgaacagaggaaggatgcctccttctgagttccacaggaggaaggctgacatgatggagagcctggccctgggctttgatgatggcaagaccaagaccagcggcatcatcgaggccctgcaccgctactaccagaatgctgccacagatgtgcggcgggtgtggctgagctctgtggtggaccacttccacagcagcctgggggacaagggctggggctgcggctacagaaacttccagatgctgctgagcagcctgctgcagaatgatgcctacaatgactgcctgaagggcatgctgatcccctgcatccccaagatccagagcatgattgaagatgcctggaaggagggctttgacccccagggcgccagccagctgaacaaccggctgcagggcaccaaggcctggattggagcctgtgaggtgtacatcctgctgaccagcctgcgggtgaagtgccacatcgtggacttccacaagagcacaggccccctgggcacccacccccggctgtttgagtggatcctgaactactacagcagcgagggggagggcagccccaaggtggtgtgcaccagcaagccacccatctacctgcagcaccagggccacagcaggacagtcatcggcatcgaggagaagaagaacagaaccctgtgcctgctgatcctggaccccggctgccccagccgggagatgcagaagctgctgaagcaggacatcgaggccagcagcctgaagcagctgaggaagtccatgggcaacctgaagcacaagcagtaccagatcctggccgtggagggcgccctgagcctggaggagaagctggcccggcggcaggccagccaggtgttcaccgctgagaagatcccctag

SEQ ID NO: 43878 - DNA, 1260 bp, Artificial Sequence
  Description of Artificial Sequence: Synthetic coding sequence
atgcctggccggggccgctgcccagactgtggcagcacagagctggtggaggacagccactacagccagagccagctggtgtgcagcgactgtggctgtgtggtgacagagggcgtgctgaccaccaccttcagtgatgagggcaacctgcgggaggtgacctacagccgcagcactggagaaaatgagcaggtgagccgcagccagcagaggggcctgcggcgggtgcgggacctgtgccgggtgctgcagctgccccccacctttgaggacacagctgtggcctactaccagcaggcctaccgccacagcggcatccgggccgcccggctgcagaagaaggaggtgctggtgggctgctgcgtgctgatcacctgccggcagcacaactggcccctgaccatgggcgccatctgcaccctgctgtatgctgacctggatgtgttcagcagcacctacatgcagatcgtgaagctgctgggcctggatgtgcccagcctgtgcctggccgagctggtgaagacctactgcagcagcttcaagctgttccaggccagccccagcgtgcctgccaagtatgtggaggacaaggagaagatgctgagcaggaccatgcagctggtggagctggccaatgagacctggctggtgacaggccgccaccccctgcccgtcatcacagctgccaccttcctggcctggcagagcctgcagcctgctgaccggctgagctgcagcctggcccgcttctgcaagctggccaacgtggacctgccctacccagccagcagccggctgcaggagctgctggccgtgctgctgaggatggccgagcagctggcctggctgcgggtgctgcggctggacaagaggtctgtggtgaagcacatcggggacctgctgcagcaccggcagagcctggtgcgcagcgccttcagagatggaacagctgaggtggagacccgggagaaggagcccccaggctggggccagggccagggcgagggggaggtgggcaacaacagcctgggcctgccccagggcaagaggcctgccagccctgccctgctgctgcccccctgcatgctgaagagccccaagaggatctgccctgtgccccctgtgtccacagtgactggagatgagaacatcagtgacagcgagattgagcagtacctgcggaccccccaggaggtgcgggacttccagagggcccaggccgcccggcaggccgccacctctgtgcccaaccccccatag

SEQ ID NO: 43879 - DNA, 162 bp, Artificial Sequence
  Description of Artificial Sequence: Synthetic coding sequence
atggccgccacccagaagctggtgaaggacatcatcgacagcaagacaggagaaacagccagcaagcgctggaagggggccaagaacagcgagacagctgccaaggtggccctgatgaagctgaagatgcatgctgatggagacaagagcctgccccagtag

SEQ ID NO: 43880 - DNA, 132 bp, Artificial Sequence
  Description of Artificial Sequence: Synthetic coding sequence
atggccgccacccagaagctggtgaaggacatcatcgacagcaagacaggagaaacagccagcaagcgctggaagggggccaagaacagcgagacagctgccaaggtggccctgatgaagctgaagatgtag

SEQ ID NO: 43881 - DNA, 129 bp, Artificial Sequence
  Description of Artificial Sequence: Synthetic coding sequence
atggccgccacccagaagctggtgaaggacatcatcgacagcaagacaggagaaacagccagcaagcgctggaagggggccaagaacagcgagacagctgccaaggtggccctgatgaagctgaagtag

SEQ ID NO: 43882 - DNA, 294 bp, Artificial Sequence
  Description of Artificial Sequence: Synthetic coding sequence
atggccgccacccagaagctggtgaaggacatcatcgacagcaagacaggagaaacagccagcaagcgctggaagggggccaagaacagcgagacagctgccaaggtggccctgatgaagctgaagatgcatgctgatggagacaagagcctgccccagacagagcgcatctacttccaggtgttcctgcccaagggcagcaaggagaagagcaagcccatgttcttctgccaccgctggagcatcggcaaggccatcgactttgctgccagcctggcccggctgaagaactag

SEQ ID NO: 43883 - DNA, 360 bp, Artificial Sequence
  Description of Artificial Sequence: Synthetic coding sequence
atggccgccacccagaagctggtgaaggacatcatcgacagcaagacaggagaaacagccagcaagcgctggaagggggccaagaacagcgagacagctgccaaggtggccctgatgaagctgaagatgcatgctgatggagacaagagcctgccccagacagagcgcatctacttccaggtgttcctgcccaagggcagcaaggagaagagcaagcccatgttcttctgccaccgctggagcatcggcaaggccatcgactttgctgccagcctggcccggctgaagaatgacaacaacaagttcaccgccaagaagctgcggctgtgccacatcaccagcggggaggccctgccctag

SEQ ID NO: 43884 - DNA, 486 bp, Artificial Sequence
  Description of Artificial Sequence: Synthetic coding sequence
atggccgccacccagaagctggtgaaggacatcatcgacagcaagacaggagaaacagccagcaagcgctggaagggggccaagaacagcgagacagctgccaaggtggccctgatgaagctgaagatgcatgctgatggagacaagagcctgccccagacagagcgcatctacttccaggtgttcctgcccaagggcagcaaggagaagagcaagcccatgttcttctgccaccgctggagcatcggcaaggccatcgactttgctgccagcctggcccggctgaagaatgacaacaacaagttcaccgccaagaagctgcggctgtgccacatcaccagcggggaggccctgcccctggaccacaccctggagacctggatcgccaaggaggactgccccctgtacaatggaggcaacatcatcctggagtacctgaatgatgaggagcagttctgcaagaatgtggagagctacctggagtag

SEQ ID NO: 43885 - DNA, 162 bp, Artificial Sequence; identical to SEQ ID NO: 43879
  Description of Artificial Sequence: Synthetic coding sequence

SEQ ID NO: 43886 - DNA, 486 bp, Artificial Sequence; identical to SEQ ID NO: 43884
  Description of Artificial Sequence: Synthetic coding sequence

SEQ ID NO: 43887 - DNA, 186 bp, Artificial Sequence
  Description of Artificial Sequence: Synthetic coding sequence
atggccgccacccagaagctggtgaaggacatcatcgacagcaagacaggagaaacagccagcaagcgctggaagggggccaagaacagcgagacagctgccaaggtggccctgatgaagctgaagatgcatgctgatggagacaagagcctgccccagacagagcgcatctacttccaggtgtag

SEQ ID NO: 43888 - DNA, 348 bp, Artificial Sequence
  Description of Artificial Sequence: Synthetic coding sequence
atggacaacaggaaggagccccccttcttcaatgatgacaacatgggccccttctactaccgcctgcacttctgtgacaccatggagctgttcatcgagaccctgaccggcacctgctttgagctgcgggtgagcccctttgaaacagtcatctctgtgaaggccaagatccggcggctggagggcatccccatctgccggcagcacctgatctggaacaacatggagctggagaatgactactgcctgaatgactacaacatcagcgagggctgcaccctgaagctggtgctggccatgaggggcggccccatcaacacccggcgggacctgcagatccccaggtag

SEQ ID NO: 43889 - DNA, 2184 bp, Artificial Sequence
  Description of Artificial Sequence: Synthetic coding sequence
atggacaacaggaaggagccccccttcttcaatgatgacaacatgggccccttctactaccgcctgcacttctgtgacaccatggagctgttcatcgagaccctgaccggcacctgctttgagctgcgggtgagcccctttgaaacagtcatctctgtgaaggccaagatccggcggctggagggcatccccatctgccggcagcacctgatctggaacaacatggagctggagaatgactactgcctgaatgactacaacatcagcgagggctgcaccctgaagctggtgctggccatgaggggcggccccatcaacacccggcgggtgcccacagatgaccccctgaggaagatggccgagtacctggacagcagccgggtggaggtgtgggagaagaccagctgcagcaagcaggtgaccttcctggtgtaccaggagggggaccagctgaacttcttccctgctgtggacagaggagatggcaccctgacccccctgagtgacagcagcaagaagattgacttccacctgcacgtgctgcggaggaagggggagcacaggatgtctgggggctccatgtacaacagcgacacagatgaagatgaggagacagagcccagcagcagcggccagcagatcatcgagaacagcatcaccatgaacaagatgaagctgctgaaggccaagatgaagaacatgaacctgagcaagaagcccaagaaggctgtgaagatcaagccccacccccctgtggccccccggcccagcagcggcagcacagcccccagccgccaccggctgctgcgggtgctgcccaacatcggccagagctgcagccctgcctttggaaatgcctacccacctgagatcagcagaaatggcatcagcagcctggccacccagctgtctgctgagcgctacatcagcagcatcactggagagttcctgaaggaggacaacagctgggagaacaacaccctgagccacttcagcagcaatgtgaagctgcccccccagatcccccacctggagctgggcaatgaccaggagctggccgacagcgtgctgcacctgggcagcagcctgccccggcagaccaagcacttcctgggcaacctgcccagcagcaatggaaatattgtgctgcccagtgaagaatgtgtgacagagcagagcctgctgcccaaggtgggcagcctggccagctttgctgagggcaatgctgatgagcagagcagcggcctggagggcgcctgcaaggtgaacctggagctgctgctgaccaatgctgacaagggcctgaaggcccctgagcagcacctgaagcacgtggccggcgtgctgaatggagagagcgtggagacctctgtgctgaactaccgggagctgagcccccacaagaaccggctgctgagccccctgcgctgcagcgcccccatgagcctgcacaacagcctggtgaagccagagcggcagagcaaatgttttgaatttgggaagctgcagcccagcagcagccagagcctggatgtgcagaacatcacagacagcagcttcagcaggaccacctgcttccagggcgtgaaggtggacagcctgggcaagagaagtgatgtgatcagcaaggtggaggcccgggacatcacagagatgaccaacaaggccagcaaggagcctgtgggctgtgtgaacaacatctccttcctggccagcctggccggcagcaccagcaggaaccggctgcagagcaccaggggggccggccgcctgcagaacagcggcaccggcctgagcaccaacctgcagcacttccaggaggagaacttcaggaagagcagcccccagctggagcacactggagtcttcctgagcacccatggagtgggcatgaatggaaataatgctgctgctgggaagtctgtgggggagtgcaccacccaccacctgccccctgtgaaggcccccctgcagaccaagaagaagaccaccaaccactgcttcctgtgtgggaagaagacaggcctggccagcagctatgaatgtcgctgtggcaacaacttctgtgccagccacagatatgcagagacccacggctgcacctatgactacaagtctgctggaagacgctacctgcacgaggccaaccctgtggtgaatgcccccaagctgcccaagatctag

SEQ ID NO: 43890 - DNA, 1962 bp, Artificial Sequence
  Description of Artificial Sequence: Synthetic coding sequence
atggagctggagaatgactactgcctgaatgactacaacatcagcgagggctgcaccctgaagctggtgctggccatgaggggcggccccatcaacacccggcgggtgcccacagatgaccccctgaggaagatggccgagtacctggacagcagccgggtggaggtgtgggagaagaccagctgcagcaagcaggtgaccttcctggtgtaccaggagggggaccagctgaacttcttccctgctgtggacagaggagatggcaccctgacccccctgagtgacagcagcaagaagattgacttccacctgcacgtgctgcggaggaagggggagcacaggatgtctgggggctccatgtacaacagcgacacagatgaagatgaggagacagagcccagcagcagcggccagcagatcatcgagaacagcatcaccatgaacaagatgaagctgctgaaggccaagatgaagaacatgaacctgagcaagaagcccaagaaggctgtgaagatcaagccccacccccctgtggccccccggcccagcagcggcagcacagcccccagccgccaccggctgctgcgggtgctgcccaacatcggccagagctgcagccctgcctttggaaatgcctacccacctgagatcagcagaaatggcatcagcagcctggccacccagctgtctgctgagcgctacatcagcagcatcactggagagttcctgaaggaggacaacagctgggagaacaacaccctgagccacttcagcagcaatgtgaagctgcccccccagatcccccacctggagctgggcaatgaccaggagctggccgacagcgtgctgcacctgggcagcagcctgccccggcagaccaagcacttcctgggcaacctgcccagcagcaatggaaatattgtgctgcccagtgaagaatgtgtgacagagcagagcctgctgcccaaggtgggcagcctggccagctttgctgagggcaatgctgatgagcagagcagcggcctggagggcgcctgcaaggtgaacctggagctgctgctgaccaatgctgacaagggcctgaaggcccctgagcagcacctgaagcacgtggccggcgtgctgaatggagagagcgtggagacctctgtgctgaactaccgggagctgagcccccacaagaaccggctgctgagccccctgcgctgcagcgcccccatgagcctgcacaacagcctggtgaagccagagcggcagagcaaatgttttgaatttgggaagctgcagcccagcagcagccagagcctggatgtgcagaacatcacagacagcagcttcagcaggaccacctgcttccagggcgtgaaggtggacagcctgggcaagagaagtgatgtgatcagcaaggtggaggcccgggacatcacagagatgaccaacaaggccagcaaggagcctgtgggctgtgtgaacaacatctccttcctggccagcctggccggcagcaccagcaggaaccggctgcagagcaccaggggggccggccgcctgcagaacagcggcaccggcctgagcaccaacctgcagcacttccaggaggagaacttcaggaagagcagcccccagctggagcacactggagtcttcctgagcacccatggagtgggcatgaatggaaataatgctgctgctgggaagtctgtgggggagtgcaccacccaccacctgccccctgtgaaggcccccctgcagaccaagaagaagaccaccaaccactgcttcctgtgtgggaagaagacaggcctggccagcagctatgaatgtcgctgtggcaacaacttctgtgccagccacagatatgcagagacccacggctgcacctatgactacaagtctgctggaagacgctacctgcacgaggccaaccctgtggtgaatgcccccaagctgcccaagatctag

SEQ ID NO: 43891 - DNA, 1830 bp, Artificial Sequence
  Description of Artificial Sequence: Synthetic coding sequence
atggccgagtacctggacagcagccgggtggaggtgtgggagaagaccagctgcagcaagcaggtgaccttcctggtgtaccaggagggggaccagctgaacttcttccctgctgtggacagaggagatggcaccctgacccccctgagtgacagcagcaagaagattgacttccacctgcacgtgctgcggaggaagggggagcacaggatgtctgggggctccatgtacaacagcgacacagatgaagatgaggagacagagcccagcagcagcggccagcagatcatcgagaacagcatcaccatgaacaagatgaagctgctgaaggccaagatgaagaacatgaacctgagcaagaagcccaagaaggctgtgaagatcaagccccacccccctgtggccccccggcccagcagcggcagcacagcccccagccgccaccggctgctgcgggtgctgcccaacatcggccagagctgcagccctgcctttggaaatgcctacccacctgagatcagcagaaatggcatcagcagcctggccacccagctgtctgctgagcgctacatcagcagcatcactggagagttcctgaaggaggacaacagctgggagaacaacaccctgagccacttcagcagcaatgtgaagctgcccccccagatcccccacctggagctgggcaatgaccaggagctggccgacagcgtgctgcacctgggcagcagcctgccccggcagaccaagcacttcctgggcaacctgcccagcagcaatggaaatattgtgctgcccagtgaagaatgtgtgacagagcagagcctgctgcccaaggtgggcagcctggccagctttgctgagggcaatgctgatgagcagagcagcggcctggagggcgcctgcaaggtgaacctggagctgctgctgaccaatgctgacaagggcctgaaggcccctgagcagcacctgaagcacgtggccggcgtgctgaatggagagagcgtggagacctctgtgctgaactaccgggagctgagcccccacaagaaccggctgctgagccccctgcgctgcagcgcccccatgagcctgcacaacagcctggtgaagccagagcggcagagcaaatgttttgaatttgggaagctgcagcccagcagcagccagagcctggatgtgcagaacatcacagacagcagcttcagcaggaccacctgcttccagggcgtgaaggtggacagcctgggcaagagaagtgatgtgatcagcaaggtggaggcccgggacatcacagagatgaccaacaaggccagcaaggagcctgtgggctgtgtgaacaacatctccttcctggccagcctggccggcagcaccagcaggaaccggctgcagagcaccaggggggccggccgcctgcagaacagcggcaccggcctgagcaccaacctgcagcacttccaggaggagaacttcaggaagagcagcccccagctggagcacactggagtcttcctgagcacccatggagtgggcatgaatggaaataatgctgctgctgggaagtctgtgggggagtgcaccacccaccacctgccccctgtgaaggcccccctgcagaccaagaagaagaccaccaaccactgcttcctgtgtgggaagaagacaggcctggccagcagctatgaatgtcgctgtggcaacaacttctgtgccagccacagatatgcagagacccacggctgcacctatgactacaagtctgctggaagacgctacctgcacgaggccaaccctgtggtgaatgcccccaagctgcccaagatctag

SEQ ID NO: 43892 - DNA, 675 bp, Artificial Sequence
  Description of Artificial Sequence: Synthetic coding sequence
atggacaacaggaaggagccccccttcttcaatgatgacaacatgggccccttctactaccgcctgcacttctgtgacaccatggagctgttcatcgagaccctgaccggcacctgctttgagctgcgggtgagcccctttgaaacagtcatctctgtgaaggccaagatccggcggctggagggcatccccatctgccggcagcacctgatctggaacaacatggagctggagaatgactactgcctgaatgactacaacatcagcgagggctgcaccctgaagctggtgctggccatgaggggcggccccatcaacacccggcgggtgcccacagatgaccccctgaggaagatggccgagtacctggacagcagccgggtggaggtgtgggagaagaccagctgcagcaagcaggtgaccttcctggtgtaccaggagggggaccagctgaacttcttccctgctgtggacagaggagatggcaccctgacccccctgagtgacagcagcaagaagattgacttccacctgcacgtgctgcggaggaagggggagcacaggatgaggaggatgtactacagcagcccccccacctgtgagagccccagcagtgacaaggaggagaacaacaagagcctcttcagcctgtggaaggagaacagaactggatag

SEQ ID NO: 43893 - DNA, 675 bp, Artificial Sequence; identical to SEQ ID NO: 43892
  Description of Artificial Sequence: Synthetic coding sequence

SEQ ID NO: 43894 - DNA, 627 bp, Artificial Sequence
  Description of Artificial Sequence: Synthetic coding sequence
atggcccaggagaccaaccacagccaggtgcccatgctgtgcagcacaggctgcggcttctacggcaaccccaggaccaacggcatgtgcagcgtgtgctacaaggagcacctgcagaggcagaacagcagcaatggccgcatcagccccccagccacctctgtgagcagcctgtctgagagcctgcctgtgcagtgcacagatggctctgtgcctgaggcccagagcgccctggacagcaccagcagctccatgcagcccagccctgtgagcaaccagagcctgctgtctgagagcgtggccagcagccagctggacagcacctctgtggacaaggctgtgcctgagacagaagatgtgcaggcctctgtgtctgacacagcccagcagcccagcgaggagcagagcaagagcctggagaagcccaagcagaagaagaaccgctgcttcatgtgcaggaagaaggtgggcctgactggatttgagtgccgctgtggaaatgtgtactgcggcgtgcaccgctacagtgatgtgcacaactgcagctacaactacaaggcagatgctgctgagaagatcaggaaggagaaccctgtggtggtgggggagaagatccagaagatctag

SEQ ID NO: 43895 - DNA, 2520 bp, Artificial Sequence
  Description of Artificial Sequence: Synthetic coding sequence
atgaacaggaaggactttgtggtgctgccctggggcaagccaggcaacagcgtgaagctgaagtacagaaatgcccaggagctgaggatggagaaggtgcagctggagtttgagaaccaggagatggagaagaagctgcaggagttccgcagcaccaggaacaaggagaaggaggaccgggagagcagcgagtactactggaagagcggcaaggtgggcaagctggtgaaccagagctacatgatgagccagaacaagggaaatgtggtgaagttctctgctgggaaggtgaagctgaagctgctgaaggagcagatccaggagcctgtgaagcccaccgtgaactacaagatggccaacagcagtgaatgtgagaagcccaagatcaacgggaaggtgtgtggccagtgtgagaacaaggccgccctgctggtgtgcctggagtgtggggaggactactgcagcggctgctttgccaaggtgcaccagaagggggccctgaagctgcacaggaccaccctgctgcaggccaagagccagatcctcttcaacgtgctggatgtggcccaccagttcatcaaggatgtgaacccagatgagcccaaggaggagaacaacagcaccaaggagaccagcaagatccagcacaagcccaagtctgtgctgctgcagaggagcagcagcgaggtggagatcaccaccatgaagagggcccagaggaccaagcccaggaagagcctgctgtgtgagggcagctttgatgaggaggccagcgcccagagcttccaggaggtgctgagccagtggaggactggaaatcatgatgacaacaagaagcagaacctgcacgccgctgtgaaggacagcctggaggagtgtgaggtgcagaccaacctgaagatctggagggagcccctgaacatcgagctgaaggaggacatcctgagctacatggagaagctgtggctgaagaagcacaggaggaccccccaggagcagctgttcaagatgctgcctgacaccttcccccacccccatgagaccactggagatgcccagtgcagccagaatgaaaatgatgaagattctgatggagaggagaccaaggtgcagcacacagccctgctgctgcctgtggagaccctgaacatcgagaggcctgagcccagcctgaagatcgtggagctggatgacacctatgaggaggagtttgaggaggccgagaacatcgtgccctacaaggtgaagctggctgatgctgacagccagaggagctgtgccttccatgactgccagaagaacagcttcccctatgaaaatggcatccaccagcaccacgtgtttgacaagggcaagagggacttcctgaacctgtgcctgaggaacagcagcacctactacaaggacaacagcaaggccgagaccagcaacacagactttgacaacatcgtggaccctgatgtgtacagcagtgacatcgagaagattgaggagagcaccagctttgagaggaacctgaaggagaagaacatcggcctggagagcaaccagaagagtgatgacagctgtgtgtccctggagagcaaggacaccctgctgggccgggacctggagaaggcccccatcgaggagaagctgagccaggacatcaaggagagcctggagctgagcaacctgtacaagaggcccagctttgaggagagcaagaccaccaagagcagcctgctgctgcaggagatcgcctgccgcagcaagcccatcaccaagcagtaccagggcctggagcgcttcttcatctttgacaccaatgaaaggctgaacctgctgcccagccaccggctggagtgcaacaacagcagcacccgcatcaccctggctgaagatcgggagtggatcccagaccacagcctgtctgaatatgctgacaatgccatcgtgctgggcgtgctgcagggcgcccagagccccagcagcagcaggaagcagcagaagatgggccagaagagccagaggcccagcacagccaacttccccctgagcaacagcgtgaaggagagcagcagctgcctgagcagcagccaccccaggagccgctctgctgctgcccagagcagcagccgggccgccagcgagatcagcgagattgagtacatcgacatcacagaccagaatgagctgagcctggatgacaccacagaccagcacaccctggacaacctggagaaggagctgcaggtgctgcggagcctggccgacaccagcgagaagctgtacagcctgaccagcgaggagttcccagacttcagcagccagagcctgaacatcagccagatcagcacagacttcctgaagaccagccacgtgcggggcccctgtggggtggaggagctgagctgcagcggccgggacaccaagatccagagcctgctgagcctgtctgagagcagcacagatgaggaggaggaggacttcctgaacaagcagcacgtgatcaccctgccctggagcaagagcacctag

SEQ ID NO: 43896 - DNA, 2403 bp, Artificial Sequence
  Description of Artificial Sequence: Synthetic coding sequence
atgaacaggaaggactttgtggtgctgccctggggcaagccaggcaacagcgtgaagctgaagtacagaaatgcccaggagctgaggatggagaaggtgcagctggagtttgagaaccaggagatggagaagaagctgcaggagttccgcagcaccaggaacaaggagaaggaggaccgggagagcagcgagtactactggaagagcggcaaggtgggcaagctggtgaaccagagctacatgatgagccagaacaagggaaatgtggtgaagttctctgctgggaaggtgaagctgaagctgctgaaggagcagatccaggagcctgtgaagcccaccgtgaactacaagatggccaacagcagtgaatgtgagaagcccaagatcaacgggaaggtgtgtggccagtgtgagaacaaggccgccctgctggtgtgcctggagtgtggggaggactactgcagcggctgctttgccaaggtgcaccagaagggggccctgaagctgcacaggaccaccctgctgcaggccaagagccagatcctcttcaacgtgctggatgtggcccaccagttcatcaaggatgtgaacccagatgagcccaaggaggagaacaacagcaccaaggagaccagcaagatccagcacaagcccaagtctgtgctgctgcagaggagcagcagcgaggtggagatcaccaccatgaagagggcccagaggaccaagcccaggaagagcctgctgtgtgagggcagctttgatgaggaggccagcgcccagagcttccaggaggtgctgagccagtggaggactggaaatcatgatgacaacaagaagcagaacctgcacgccgctgtgaaggacagcctggaggagtgtgaggtgcagaccaacctgaagatctggagggagcccctgaacatcgagctgaaggaggacatcctgagctacatggagaagctgtggctgaagaagcacaggaggaccccccaggagcagctgttcaagatgctgcctgacaccttcccccacccccatgagaccactggagatgcccagtgcagccagaatgaaaatgatgaagattctgatggagaggagaccaaggtgcagcacacagccctgctgctgcctgtggagaccctgaacatcgagaggcctgagcccagcctgaagatcgtggagctggatgacacctatgaggaggagtttgaggaggccgagaacatcgtgccctacaaggtgaagctggctgatgctgacagccagaggagctgtgccttccatgactgccagaagaacagcttcccctatgaaaatggcatccaccagcaccacgtgtttgacaagggcaagagggacttcctgaacctgtgcctgaggaacagcagcacctactacaaggacaacagcaaggccgagaccagcaacacagactttgacaacatcgtggaccctgatgtgtacagcagtgacatcgagaagattgaggagagcaccagctttgagaggaacctgaaggagaagaacatcggcctggagagcaaccagaagagtgatgacagctgtgtgtccctggagagcaaggacaccctgctgggccgggacctggagaaggcccccatcgaggagaagctgagccaggacatcaaggagagcctggagctgagcaacctgtacaagaggcccagctttgaggagagcaagaccaccaagagcagcctgctgctgcaggagatcgcctgccgcagcaagcccatcaccaagcagtaccagggcctggagcgcttcttcatctttgacaccaatgaaaggctgaacctgctgcccagccaccggctggagtgcaacaacagcagcacccgcatcaccctggccggccagaagagccagaggcccagcacagccaacttccccctgagcaacagcgtgaaggagagcagcagctgcctgagcagcagccaccccaggagccgctctgctgctgcccagagcagcagcagagctgccagcgagatcagcgagattgagtacatcgacatcacagaccagaatgagctgagcctggatgacaccacagaccagcacaccctggacaacctggagaaggagctgcaggtgctgcggagcctggccgacaccagcgagaagctgtacagcctgaccagcgaggagttcccagacttcagcagccagagcctgaacatcagccagatcagcacagacttcctgaagaccagccacgtgcggggcccctgtggggtggaggagctgagctgcagcggccgggacaccaagatccagagcctgctgagcctgtctgagagcagcacagatgaggaggaggaggacttcctgaacaagcagcacgtgatcaccctgccctggagcaagagcacctag

SEQ ID NO: 43897 - DNA, 2403 bp, Artificial Sequence; identical to SEQ ID NO: 43896
  Description of Artificial Sequence: Synthetic coding sequence

SEQ ID NO: 43898 - DNA, 2520 bp, Artificial Sequence; identical to SEQ ID NO: 43895
  Description of Artificial Sequence: Synthetic coding sequence

SEQ ID NO: 43899 - DNA, 492 bp, Artificial Sequence
  Description of Artificial Sequence: Synthetic coding sequence
atgaacaggaaggactttgtggtgctgccctggggcaagccaggcaacagcgtgaagctgaagtacagaaatgcccaggagctgaggatggagaaggtgcagctggagtttgagaaccaggagatggagaagaagctgcaggagttccgcagcaccaggaacaaggagaaggaggaccgggagagcagcgagtactactggaagagcggcaaggtgggcaagctggtgaaccagagctacatgatgagccagaacaagggaaatgtggtgaagttctctgctgggaaggtgaagctgaagctgctgaaggagcagatccaggagcctgtgaagcccaccgtgaactacaagatggccaacagcagtgaatgtgagaagcccaagatcaacgggaaggtgtgtggccagtgtgagaacaaggccgccctgctggtgtgcctggagtgtggggaggactactgcagcggctgctttgccaaggtgcaccagtag

SEQ ID NO: 43900 - DNA, 657 bp, Artificial Sequence
  Description of Artificial Sequence: Synthetic coding sequence
atgatgagaagagaagatgaggaggaggagggcaccatgatgaaggccaagggggacctggagatgaaggaggaggaggagatcagcgagactggagagctggtgggcccctttgtgtctgccatgcccacccccatgccccacaacaagggcacccgcttcagcgaggcctgggagtacttccacctggccccagcccgggccggccaccaccccaaccagtatgccacctgccgcctgtgtggccggcaggtgtcccggggccctggggtgaatgtgggcaccacagccctgtggaagcacctgaagtccatgcaccgggaggagctggagaagagcggccacggccaggccggccagaggcaggacccccggccccacggcccccagctgcccactggaattgagggcaactggggccgcctgctggagcaggtgggcaccatggccctgtgggccagccagcgggagaaggaggtgctgcggcgggagagagctgtggagtggagggagagagctgtggagaagcgggagcgggccctggaggaggtggagcgggccatcctggagatgaagtggaaggtgcgggcagagaaggaggcctgccagcgggagaaggagctgcctgctgctgtgcaccccttccactttgtgtag

SEQ ID NO: 43901 - DNA, 705 bp, Artificial Sequence
  Description of Artificial Sequence: Synthetic coding sequence
atgaggtctggagagcccgcctgcaccatggaccaggcccggggcctggatgatgctgctgcccggggcggccagtgccccggcctgggccctgcccccacccccaccccacctggccgcctgggcgccccctacagcgaggcctggggctacttccacctggcccctggccggcccggccaccccagcggccactgggccacctgccgcctgtgtggggagcaggtgggccggggccctggcttccacgccggcaccagcgccctgtggaggcacctgcggagcgcccaccggcgggagctggagagcagcggggccggcagcagccccccagctgccccctgccccccacctcctggccctgctgctgcccctgagggggactgggcccggctgctggagcagatgggcgccctggccgtgcggggcagcagaagagagcgggagctggagcggcgggagctggccgtggagcagggcgagcgggccctggagaggagaagaagagccctgcaggaggaggagagagctgctgcccaggcccggcgggagctgcaggccgagcgggaggccctgcaggcccggctgagagatgtgtccagaagagagggcgccctgggctgggccccagctgcccccccacccctgaaggatgatcctgagggggacagagatggctgtgtgatcaccaaggtgctgctgtag

SEQ ID NO: 43902 - DNA, 453 bp, Artificial Sequence
  Description of Artificial Sequence: Synthetic coding sequence
atgaggtctggagagcccgcctgcaccatggaccaggcccggggcctggatgatgctgctgcccggggcggccagtgccccggcctgggccctgcccccacccccaccccacctggccgcctgggcgccccctacagcgaggcctggggctacttccacctggcccctggccggcccggccaccccagcggccactgggccacctgccgcctgtgtggggagcaggtgggccggggccctggcttccacgccggcaccagcgccctgtggaggcacctgcggagcgcccaccggcgggagctggagagcagcggggccggcagcagccccccagctgccccctgccccccacctcctggccctgctgctgcccctgagggggactgggcccggctgctggagcagatgggcgccctggccgtgcggggcagcagaagagagcgggagctgtag

SEQ ID NO: 43903 - DNA, 5970 bp, Artificial Sequence
  Description of Artificial Sequence: Synthetic coding sequence
atggccacagctgacaccccagccccagccagcagcggcctgagccccaaggaggagggggagctggaggatggagagatcagtgatgatgacaacaacagccagatccgcagccgcagcagcagcagcagcagcggcggcggcctgctgccctaccccaggagaagaccaccccacagcgcccggggcggcggcagcggcggcggcggcggcagcagcagcagcagcagcagcagccagcagcagctgaggaacttcagccgcagcagacatgccagcgagcggggccacctgcggggccccagcagctaccggcccaaggagcccttccgcagccacccccccagcgtgaggatgcccagcagcagcctgtctgagagcagcccccggcccagcttctgggagaggagccacctggccctggaccgcttccgcttccggggccggccctacagaggaggcagccgctggagccggggccggggcgtgggggagcggggcggcaagccaggctgccggccccccctgggcggcggggccggcagcggcttcagcagcagccagagctggagggagcccagcccccccaggaagagcagcaagagctttggccgcagccccagcaggaagcagaactacagcagcaagaatgaaaactgtgtggaggagacctttgaggacctgctgctgaagtacaagcagatccagctggagctggagtgcatcaacaaggatgagaagctggccctgagcagcaaggaggagaatgtgcaggaggaccccaagaccctgaactttgaggaccagaccagcacagacaacgtgtccatcaccaaggacagcagcaaggaggtggcccctgaggagaagacccaggtgaagaccttccaggcctttgagctgaagcccctgcggcagaagctgaccctgcccggggacaagaaccggctgaagaaggtgaaggatggagccaagcccctgagcctgaagagtgacaccacagacagcagccagggcctgcaggacaaggagcagaacctgacccggcgcatcagcaccagtgacatcctgtctgagaagaagctgggggaggatgaggaggagctgtctgagctgcagctgcggctgctggccctgcagagcgccagcaagaagtggcagcagaaggagcagcaggtgatgaaggagagcaaggagaagctgaccaagaccaagacagtgcagcagaaggtgaagaccagcaccaagacccacagcgccaagaaggtgtccaccacagccaagcaggccctgaggaagcagcagaccaaggcctggaagaagctgcagcagcagaaggagcaggagcggcagaaggaggaggaccagaggaagcaggccgaggaggaggagaggaggaagcgggaggaggagatcaggaagatccgggacctgagcaaccaggaggagcagtacaaccgcttcatgaagctggtgggcggcaagaggaggagccgcagcaagagcagtgaccctgacctgcggcgcagcctggacaagcagcccacagacagcggcggcggcatctaccagtatgacaactatgaggaggtggccatggacacagattctgagaccagcagccctgcccccagccctgtgcagccccccttcttcagcgagtgcagcctgggctacttcagccctgcccccagcctgagcctgcccccaccaccccaggtgagcagcctgccccccctgagccagccctacgtggagggcctgtgtgtgtccctggagcccctgccccccctgccccccctgccccccctgcccccagaagatcctgagcagccccccaagcccccatttgctgatgaggaggaggaggaggagatgctgctgcgggaggagctgctgaagagcctggccaacaagagggccttcaagccagaggagaccagcagcaacagcgacccccccagcccccctgtgctgaacaacagccaccctgtgcccaggagcaacctgagcatcgtgtccatcaacacagtgtcccagccccgcatccagaaccccaagttccaccggggcccccggctgcccaggacagtcatcagcctgcccaagcacaagtctgtggtggtgaccctgaatgacagtgatgattctgagagtgatggagaggccagcaagagcaccaacagcgtgtttggaggcctggagagcatgatcaaggaggcccggaggacagctgagcaggccagcaagcccaaggtgccccccaagtctgagaaggaaaatgaccccctgcggaccccagaggccctgcctgaggagaagaagattgagtaccgcctgctgaaggaggagatcgccaaccgggagaagcagaggctcatcaagagtgaccagctgaagaccagcagcagcagccctgccaacagtgatgtggagattgatggcatcggcagaattgccatggtgaccaagcaggtgacagatgctgagagcaagctgaagaagcaccgcatcctgctgatgaaggatgaatctgtgctgaagaacctggtgcagcaggaggccaagaagaaggagagcgtgagaaatgctgaggccaagatcaccaagctgacagagcagctgcaggccacagagaagatcctgaatgtgaacaggatgttcctgaagaagctgcaggagcagatccaccgggtgcagcagagggtgaccatcaagaaggccctgaccctgaagtatggagaggagctggcccgggccaaggctgtggccagcaaggagatcggcaagaggaagctggagcaggaccgcttcggccccaacaagatgatgaggctggacagcagccctgtgagcagccccaggaagcacagcgctgagctgattgccatggagaagaggcggctgcagaagctggagtatgaatatgccctgaagatccagaagctgaaggaggcccgggccctgaaggccaaggagcagcagaacatcagccctgtggtggaggaggagcctgagttcagcctgccccagcccagcctgcatgacctgacccaggacaagctgaccctggacacagaggagaatgatgtggatgatgagatcctgagcggcagcagccgggagcggcggcgctccttcctggagagcaactacttcaccaagcccaacctgaagcacacagacacagccaacaaggagtgcatcaacaagctgaacaagaacacagtggagaagccagagctgttcctgggcctgaagatcggggagctgcagaagctgtacagcaaggctgacagcctgaagcagctgatcctgaagaccaccaccggcatcacagagaaggtgctgcacggccaggagatctctgtggatgtggactttgtgacagcccagagcaagaccatggaggtgaagccctgccccttccggccctaccacagccccctgctggtgttcaagagctaccgcttcagcccctactaccgcaccaaggagaagctgcccctgagctctgtgtcctacagcaacatgattgaaccagaccagtgcttctgccgctttgacctgaccggcacctgcaatgatgatgactgccagtggcagcacatccaggactacaccctgagcaggaagcagctgttccaggacatcctgagctacaacctgagcctcatcggctgtgccgagaccagcaccaatgaggagatcacagccagcgctgagaagtatgtggagaagctgtttggagtgaacaaggacaggatgtccatggaccagatggctgtgctgctggtgagcaacatcaatgaaagcaagggccacaccccacccttcaccacctacaaggacaagaggaagtggaagcccaagttctggaggaagcccatcagtgacaacagcttcagcagtgatgaggagcagagcacaggccccatcaagtatgccttccagcctgagaaccagatcaacgtgcctgccctggacacagtggtgaccccagatgatgtgcgctacttcaccaatgaaacagatgacatcgccaacctggaggcctctgtgctggagaaccccagccacgtgcagctgtggctgaagctggcctacaagtacctgaaccagaatgaaggagagtgcagcgagagcctggacagcgccctgaatgtgctggcccgggccctggagaacaacaaggacaaccctgagatctggtgccactacctgcggctcttcagcaagaggggcaccaaggatgaggtgcaggagatgtgtgaaacagctgtggagtatgccccagactaccagagcttctggaccttcctgcacctggagagcacctttgaggagaaggactatgtgtgtgagaggatgctggagttcctgatgggcgccgccaagcaggagaccagcaacatcctgtccttccagctgctggaggccctgctcttccgggtgcagctgcacatcttcaccggccgctgccagagcgccctggccatcctgcagaatgccctgaagagcgccaatgatggcatcgtggccgagtacctgaagaccagtgaccgctgcctggcctggctggcctacatccacctgattgagttcaacatcctgcccagcaagttctatgaccccagcaatgacaaccccagcagaattgtgaacacagagagctttgtgatgccctggcaggccgtgcaggatgtgaagaccaacccagacatgctgctggccgtgtttgaagatgctgtgaaggcctgcacagatgagagcctggccgtggaggagcgcatcgaggcctgcctgcccctgtacaccaacatgattgccctgcaccagctgctggagagatatgaggccgccatggagctgtgcaagagcctgctggagagctgccccatcaactgccagctgctggaggccctggtggccctgtacctgcagaccaaccagcacgacaaggcccgggctgtgtggctgacagcctttgagaagaacccccagaatgctgaggtgttctaccacatgtgcaagttcttcatcctgcagaacagaggagacaacctgctgcccttcctgaggaagttcatcgccagcttcttcaagccaggctttgagaagtacaacaacctggacctcttccgctacctgctgaacatccctggccccatcgacatccccagccggctgtgcaagggcaactttgatgatgacatgttcaaccaccaggtgccctacctgtggctgatctactgcctgtgccaccccctgcagagcagcatcaaggagaccgtggaggcctatgaggccgccctgggcgtggccatgagatgtgacatcgtgcagaagatctggatggactacctggtgtttgccaacaacagagctgctggcagcaggaacaaggtgcaggagttcaagttcttcacagacctggtgaaccgctgcctggtgacagtgcctgcccgctaccccatccccttcagcagcgctgactactggagcaactatgagttccacaacagagtcatcttcttctacctgagctgtgtgcccaagacccagcacagcaagaccctggagcgcttctgcagcgtgatgcctgccaacagcggcctggccctgcggctgctgcagcacgagtgggaggagagcaatgtgcagatcctgaagctgcaggccaagatgttcacctacaacatccccacctgcctggccacctggaagatcgccatcgctgctgagatcgtgctgaagggccagcgggaggtgcaccggctgtaccagagggccctgcagaagctgcccctgtgtgccagcctgtggaaggaccagctgctgtttgaggccagcgagggcggcaagacagacaacctgaggaagctggtgtccaagtgccaggagattggagtgtccctgaatgagctgctgaacctgaacagcaacaagacagagagcaagaaccactag

SEQ ID NO: 43904 - DNA, 1041 bp, Artificial Sequence
  Description of Artificial Sequence: Synthetic coding sequence
atggccacagctgacaccccagccccagccagcagcggcctgagccccaaggaggagggggagctggaggatggagagatcagtgatgatgacaacaacagccagatccgcagccgcagcagcagcagcagcagcggcggcggcctgctgccctaccccaggagaagaccaccccacagcgcccggggcggcggcagcggcggcggcggcggcagcagcagcagcagcagcagcagccagcagcagctgaggaacttcagccgcagcagacatgccagcgagcggggccacctgcggggccccagcagctaccggcccaaggagcccttccgcagccacccccccagcgtgaggatgcccagcagcagcctgtctgagagcagcccccggcccagcttctgggagaggagccacctggccctggaccgcttccgcttccggggccggccctacagaggaggcagccgctggagccggggccggggcgtgggggagcggggcggcaagccaggctgccggccccccctgggcggcggggccggcagcggcttcagcagcagccagagctggagggagcccagcccccccaggaagagcagcaagagctttggccgcagccccagcaggaagcagaactacagcagcaagaatgaaaactgtgtggaggagacctttgaggacctgctgctgaagtacaagcagatccagctggagctggagtgcatcaacaaggatgagaagctggccctgagcagcaaggaggagaatgtgcaggaggaccccaagaccctgaactttgaggaccagaccagcacagacaacgtgtccatcaccaaggacagcagcaaggaggtggcccctgaggagaagacccaggtgaagaccttccaggcctttgagctgaagcccctgcggcagaagctgaccctgcccggggacaagaaccggctgaagaaggtgaaggatggagccaagcccctgagcctgaagagtgacaccacagacagcagccagggcaatggcatcaagtacttctcctag

SEQ ID NO: 43905 - DNA, 606 bp, Artificial Sequence
  Description of Artificial Sequence: Synthetic coding sequence
atggagaagatcaaggcccggctgaaggccgagtttgaggccctggagagcgaggagcggcacctgaaggagtacaagcaggagatggacctgctgctgcaggagaagatggcccacgtggaggagctgcggctcatccacgccgacatcaacgtgatggagaacaccatcaagcagagtgaaaatgacctgaacaagctgctggagagcacccggcggctgcatgatgagtacaagcccctgaaggagcacgtggatgccctgaggatgaccctgggcctgcagaggctgcctgacctgtgtgaggaggaggagaagctgagcctggactactttgagaagcagaaggccgagtggcagacagagccccaggagccccccatccctgagagcctggccgctgctgctgctgctgcccagcagctgcaggtggccaggaagcaggacacccggcagacagccaccttccggcagcagcccccacccatgaaggcctgcctgagctgccaccagcagatccacagaaatgcccccatctgccccctgtgcaaggccaagagccgcagcaggaaccccaagaagcccaagaggaagcaggatgaatag

SEQ ID NO: 43906 - DNA, 675 bp, Artificial Sequence
  Description of Artificial Sequence: Synthetic coding sequence
atggctgatgagcaggagatcatgtgcaagctggagagcatcaaggagatccggaacaagaccctgcagatggagaagatcaaggcccggctgaaggccgagtttgaggccctggagagcgaggagcggcacctgaaggagtacaagcaggagatggacctgctgctgcaggagaagatggcccacgtggaggagctgcggctcatccatgctgacatcaacgtgatggagaacaccatcaagcagagtgaaaatgacctgaacaagctgctggagagcacccggcggctgcatgatgagtacaagcccctgaaggagcacgtggatgccctgaggatgaccctgggcctgcagaggctgcctgacctgtgtgaggaggaggagaagctgagcctggactactttgagaagcagaaggccgagtggcagacagagccccaggagccccccatccctgagagcctggccgctgctgctgctgctgcccagcagctgcaggtggccaggaagcaggacacccggcagacagccaccttccggcagcagcccccacccatgaaggcctgcctgagctgccaccagcagatccacagaaatgcccccatctgccccctgtgcaaggccaagagccgcagcaggaaccccaagaagcccaagaggaagcaggatgaatag

SEQ ID NO: 43907 - DNA, 531 bp, Artificial Sequence
  Description of Artificial Sequence: Synthetic coding sequence
atggctgatgagcaggagatcatgtgcaagctggagagcatcaaggagatccggaacaagaccctgcagatggagaagatcaaggcccggctgaaggccgagtttgaggccctggagagcgaggagcggcacctgaaggagtacaagcaggagatggacctgctgctgcaggagaagatggcccacgtggaggagctgcggctcatccatgctgacatcaacgtgatggagaacaccatcaagcagagtgaaaatgacctgaacaagctgctggagagcacccggcggctgcatgatgagtacaagcccctgaaggagcacgtggatgccctgaggatgaccctgggcctgcagaggctgcctgacctgtgtgaggaggaggagaagctgagcctggagcccgcctgccacgtgaccagcaagttcaccggcatgcacctgtatgccctgtttgcccggccccgggtgggccctggcacccccaagagcagaaatggcagcaggatgaacaaggagcgggagagcacctag

SEQ ID NO: 43908 - DNA, 660 bp, Artificial Sequence
  Description of Artificial Sequence: Synthetic coding sequence
atgatccacttccacctgatcttcctgtatgtggccaggaacaagaccctgcagatggagaagatcaaggcccggctgaaggccgagtttgaggccctggagagcgaggagcggcacctgaaggagtacaagcaggagatggacctgctgctgcaggagaagatggcccacgtggaggagctgcggctcatccacgccgacatcaacgtgatggagaacaccatcaagcagagtgaaaatgacctgaacaagctgctggagagcacccggcggctgcatgatgagtacaagcccctgaaggagcacgtggatgccctgaggatgaccctgggcctgcagaggctgcctgacctgtgtgaggaggaggagaagctgagcctggactactttgagaagcagaaggccgagtggcagacagagccccaggagccccccatccctgagagcctggccgctgctgctgctgctgcccagcagctgcaggtggccaggaagcaggacacccggcagacagccaccttccggcagcagcccccacccatgaaggcctgcctgagctgccaccagcagatccacagaaatgcccccatctgccccctgtgcaaggccaagagccgcagcaggaaccccaagaagcccaagaggaagcaggatgaatag

SEQ ID NO: 43909 - DNA, 513 bp, Artificial Sequence
  Description of Artificial Sequence: Synthetic coding sequence
atggccacccccatgcaccggctgattgcccggcggcaggccgaggccaacaagcagcacgtgcgctgccagaagtgcctggagtttggccactggacctatgaatgtacaggcaagaggaagtacctgcaccggcccagcaggacagctgagctgaagaaggccctgaaggagaaggagaaccggctgctgctgcagcagagcattggagagaccaacgtggagaggaaggccaagaagaagaggagcaagtctgtgaccagcagcagcagcagcagcagtgacagcagcgccagtgacagcagcagcgagagcgaggagaccagcaccagcagcagcagtgaagattctgacacagatgagagcagcagcagcagcagcagcagcgccagcagcaccaccagcagcagcagcagtgacagcgacagcgacagcagcagcagcagcagcagcagcaccagcacagacagcagcagtgatgatgagccccccaagaagaagaagaagaagtag

SEQ ID NO: 43910 - DNA, 501 bp, Artificial Sequence
  Description of Artificial Sequence: Synthetic coding sequence
atgagcagcaaggacttctttgcctgtggccacagcggccactgggcccggggctgcccccggggcggggccggcggcagaagaggaggcggccacggccggggcagccagtgtggcagcaccaccctgagctacacctgctactgctgcggggagagcggcagaaatgccaagaactgtgtgctgctgggcaacatctgctacaactgtggccgcagcggccacatcgccaaggactgcaaggaccccaagcgggagcggcggcagcactgctacacctgtggccgcctgggccacctggcccgggactgtgaccggcagaaggagcagaagtgctacagctgtgggaagctgggccacatccagaaggactgtgcccaggtgaagtgctaccgctgtggggagatcggccacgtggccatcaactgcagcaaggcccggcccggccagctgctgcccctgcggcagatccccaccagcagccagggcatgagccagtag

SEQ ID NO: 43911 - DNA, 2850 bp, Artificial Sequence
  Description of Artificial Sequence: Synthetic coding sequence
atggccagcaaccacccagccttctccttccaccagaagcaggtgctgcggcaggagctgacccagatccagagcagcctgaatggaggcggcggccatggaggcaagggggcccctggccctggaggagccctgcccacctgcccagcctgccacaagatcacccccaggacagaggcccctgtgtcctctgtgagcaacagcctggagaatgccctgcacaccagcgcccacagcacagaggagagcctgcccaagaggcccctgggcaagcacagcaaggtgtctgtggagaagattgacctgaagggcctgagccacaccaagaatgacagaaatgtggagtgcagctttgaggtgctgtggagcgacagcagcatcacctctgtgaccaagagcagcagcgaggtgacagagttcatcagcaagctgtgccagctgtacccagaggagaacctggagaagctgatcccctgcctggccggcccagatgccttctacgtggagaggaaccacgtggacctggacagcggcctgcgctacctggccagcctgcccagccacgtgctgaagaatgaccacgtgcggcgcttcctgagcaccagcagccccccccagcagctgcagagccccagccctggcaaccccagcctgagcaaggtgggcaccgtgatgggcgtgtctggccggcctgtgtgtggggtggccggcatccccagcagccagagcggggcccagcaccacggccagcaccctgctggcagcgctgcccccctgccccactgcagccatgctggcagcgctggcagcgccctggcctaccgcacccagatggacaccagccctgccatcctgatgcccagcagcctgcagaccccccagacccaggagcagaatggcatcctggactggctgaggaagctgcggctgcacaagtactaccctgtgttcaagcagctgtccatggagaagttcctgagcctgacagaggaggacctgaacaagtttgagagcctgaccatgggcgccaagaagaagctgaagacccagctggagctggagaaggagaagtctgagcggcgctgcctgaaccccagcgccccacccctggtgaccagcagcggcgtggcccgggtgccccccaccagccacgtgggccctgtgcagagcggccggggcagccacgccgctgagctgcgggtggaggtggagcagccccaccaccagctgccccgggagggcagcagcagcgagtacagcagcagcagcagcagccccatgggcgtgcaggcccgggaggagagcagtgacagcgcagaagaaaatgaccggcgggtggagatccacctggagagcagtgacaaggagaagcctgtgatgctgctgaaccacttcaccagcagcagcgcccggcccacagcccaggtgctgcctgtgcagaatgaggccagcagcaaccccagcggccaccaccccctgcccccccagatgctgtctgctgccagccacatcacccccatccgcatgctgaacagcgtgcacaagccagagcggggcagcgctgacatgaagctgctgagcagctctgtgcacagcctgctgagcctggaggagagaaataaaggaagtggccccaggagctccatgaaggtggacaagagctttggaagtgccatgatggatgtgctgcctgccagcgccccccaccagcctgtgcaggtgctgagcggcctgtctgagagcagctccatgagccccaccgtgtcctttggccccaggaccaaggtggtgcacgccagcaccctggacagagtgctgaagacagcccagcagcctgccctggtggtggagaccagcacagctgccaccggcacccccagcacagtgctgcacgccgcccggccccccatcaagctgctgctgagcagctctgtgcctgctgacagcgccatcagcggccagaccagctgccccaacaacgtgcagatctctgtgcccccagccatcatcaaccccaggacagccctgtacacagccaacaccaaggtggccttcagcgccatgagctccatgcctgtgggccccctgcagggcggcttctgtgccaacagcaacacagccagccccagcagccaccccagcaccagctttgccaacatggccaccctgcccagctgcccagcccccagcagcagccctgccctgagctctgtgcctgagagcagcttctacagcagcagcggcggcggcggcagcactggaaacatcccagccagcaaccccaaccaccaccaccaccaccaccaccagcagcccccagccccaccccagcctgcccctcctcctcctggctgcatcgtgtgcaccagctgtggctgcagcggcagctgtggcagcagcggcctgactgtgtcctatgccaactacttccagcaccccttcagcggccccagcgtcttcaccttccccttcctgcccttcagccccatgtgcagcagcggctacgtgtctgcccagcagtatggaggcggcagcaccttccctgtggtgcacgccccctacagcagcagcggcaccccagaccctgtgctgagcggccagagcacctttgctgtgccccccatgcagaacttcatggccggcacagctggggtgtaccagacccagggcctggtgggcagcagcaatggcagcagccacaagaagagcggcaacctgagctgctacaactgtggggccaccggccaccgggcccaggactgcaagcagcccagcatggacttcaacagacctggcaccttccggctgaagtatgcccccccagctgagagcctggacagcacagactag

SEQ ID NO: 43912 - DNA, 933 bp, Artificial Sequence
  Description of Artificial Sequence: Synthetic coding sequence
atggagaagtgcaccaagagcagcagcaccatgcaggtggagcccagcttcctgcaggctgaaaatctcatcctgcggctgcagatgcagcaccccaccacagaaaatacagccaagaggggccaggtgatgcctgccctggccaccaccgtgatgcctgtgccctacagcctggagcacctgacccagttccatggagaccctgccaactgcagcgagttcctgacccaggtgaccacctacctgacagccctgcagatcagcaacccagccaatgatgcccagatcaagctgttctttgactacctgagccagcagctggagagctgtggcatcatcagcggccctgacaagagcaccctgctgaagcagtatgagaacctgatcctggagttccagcagagctttgggaagcccaccaagcaggagatcaaccccctgatgaatgccaagtttgacaagggggacaacagcagccagcaggaccctgccaccttccacctgctggcccagaacctgatctgcaatgagaccaaccagagcggccagtttgagaaggccctggccgaccccaaccaggatgaggagagcgtgacagacatgatggacaacctgcctgacctgatcacccagtgcatccagctggacaagaagcacagcgacaggcctgagctgctgcagagcgagacccagctgcccctgctggccagcctcatccagcaccaggccctcttcagccccacagaccccccacccaagaagggccccatccagctgcgggagggccagctgcccctgaccccagccaagagggcccggcagcaggagacccagctgtgcctgtactgcagccagagcggccacttcacccgggactgcctggccaagaggagccgggccccagccaccaccaacaacacagcccaccagtag

SEQ ID NO: 43913 - DNA, 687 bp, Artificial Sequence
  Description of Artificial Sequence: Synthetic coding sequence
atgcaggaggtgtgcagcggggaggacacccatggaggccacttccccagcaggcctggccacactggagctgagcagcagtgtgtgcagggccgcctgaccctgtggctgccccagcagcaccggcgctggccccagctgccccaccgggccctgctgcggccagacccccacctgcggggcagccaggcccagcaggccgcccccacccagctgcctgtgccccctgtgctgcagcagaggaccctgcaccagggcctgcccccaggcaccccccagaggcggggccctgacagcatccctggccagaaggccctgctgcggcgggtgcaggtgtcccaggtgcaggagaagatggatgagcgggagctgctgggccagcacggggccggcgtgcaccaggtgccccaccagagggtgtccacccaggccgagaccccaggagaggcccggcggcccggccgggtgcggcctgagcagggcgccccagctgcccccctgcgggaggtgcagggccctggcctgctgctgcccagcagagctgtgacaggctgccccccagccccccgggccaccccccggcagcctgaggagaccctgctgccctgtgccaccccccggggctgtgtgagcccctgtgcctggggcgccctggccggcctgcggggctgggccggcggcagctag

SEQ ID NO: 43914 - DNA, 726 bp, Artificial Sequence
  Description of Artificial Sequence: Synthetic coding sequence
atgagcctgctgagcgccatcgacaccagcgctgcctctgtgtaccagcctgcccagctgctgaactgggtgtacctgagcctgcaggacacccaccaggccagcgcctttgatgccttccggcctgagcccacagctggggccgcccctcctgagctggccttcggcaagggccggcctgagcagctgggcagccccctgcacagcagctacctgaacagcttcttccagctgcagagaggagaggccctgagcaacagcgtgtacaagggggccagcccctacggcagcctgaacaacattgctgatggcctgagcagcctgacagagcacttcagtgacctgaccctgaccagcgaggccaggaagcccagcaagaggcccccacccaactacctgtgccacctgtgcttcaacaagggccactacatcaaggactgcccccaggcccggcccaagggggagggcctgaccccctaccagggcaagaagcgctgctttggagagtacaagtgccccaagtgcaagaggaagtggatgagcggcaacagctgggccaacatgggccaggagtgcatcaagtgccacatcaacgtgtacccccacaagcagaggcccctggagaagccagatggcctggatgtgtctgaccagagcaaggagcacccccagcacctgtgtgagaagtgcaaggtgctgggctactactgccggcgggtgcagtag

SEQ ID NO: 43915 - DNA, 1215 bp, Artificial Sequence
  Description of Artificial Sequence: Synthetic coding sequence
atggccactggaggcggcgctgaggaggagaggaagaggggccggccccagctgctgcccccagcccggcctgctgcccggggggaggaggctgatggcggccgggagaagatgggctgggcccaggtggtgaagaacctggccgagaagaagggggagttccgggagccccggcccccaagaagagaggaggagagcggcggcggcggcggcagcgctggcctgggcggccctgctggcctggccgccccagacctgggggacttccccccagctggccgcggggaccccaagggcagaagaagagatcctgctggggaggccgtggaccccaggaagaagaagggagctgctgaggccggccgcaggaagaaggccgaggccgctgctgctgccatggccaccccagcccggcctggagaggctgaagatgctgctgagcggcccctgcaggatgagcctgctgctgctgctgctggccctgggaagggccgcttcctggtgcgcatctgcttccagggagatgaaggagcctgccccacccgggactttgtggtgggcgccctgatcctgcggagcatcggcatggaccccagcgacatctatgctgtgatccagatccctggcagccgggagtttgatgtgtccttccgctctgctgagaagctggccctcttcctgcgggtgtatgaggagaagcgggagcaggaggactgctgggagaactttgtggtgctgggccgcagcaagagcagcctgaagaccctcttcatcctcttcagaaatgagaccgtggatgtggaggacatcgtgacctggctgaagaggcactgtgatgtgctggccgtgcctgtgaaggtgacagacagatttggcatctggacaggagagtacaagtgtgaaattgagctgcggcagggcgagggcggcgtgcgccacctgcccggggccttcttcctgggcgctgagcggggctacagctggtacaagggccagcccaagacctgcttcaagtgtggcagcaggacccacatgagcggcagctgcacccaggaccgctgcttccgctgtggggaggagggccacctgagcccctactgcaggaaaggaattgtgtgcaacctgtgtgggaagaggggccacgcctttgcccagtgccccaaggctgtgcacaacagcgtggccgcccagctgactggagtggccggccactag

SEQ ID NO: 43916 - DNA, 1428 bp, Artificial Sequence
  Description of Artificial Sequence: Synthetic coding sequence
atggtggaggacctggccgccagctacatcgtgctgaagctggagaatgagatccggcaggcccaggtgcagtggctgatggaggagaatgctgccctgcaggcccagatccctgagctgcagaagagccaggccgccaaggagtatgacctgctgaggaagagcagcgaggccaaggagccccagaagctgcctgagcacatgaaccccccagctgcctgggaggcccagaagaccccagagttcaaggagccccagaagcccccagagccccaggacctgctgccctgggagcccccagctgcctgggagctgcaggaggccccagctgcccctgagagcctggcccccccagccacccgggagagccagaagccacccatggcccacgagatccccaccgtgctggagggccagggccctgccaacacccaggatgccaccatcgcccaggagcccaagaacagcgagccccaggacccccccaacatcgagaagccccaggaggcccctgagtaccaggagacagctgcccagctggagttcctggagctgcccccaccccaggagcccctggagcccagcaatgcccaggagttcctggagctgtctgctgcccaggagagcctggagggcctcatcgtggtggagaccagcgctgccagcgagttcccccaggcccccatcggcctggaggccacagacttccccctgcagtacaccctgaccttcagcggggacagccagaagctgcctgagttcctggtgcagctgtacagctacatgagggtgcggggccacctgtaccccacagaagctgccctggtgtcctttgtgggcaactgcttcagcggccgggccggctggtggttccagctgctgctggacatccagagccccctgctggagcagtgtgagagcttcatccctgtgctgcaggacacctttgacaaccctgagaacatgaaggatgccaaccagtgcatccaccagctgtgccagggcgagggccacgtggccacccacttccacctgattgcccaggagctgaactgggatgagagcaccctgtggatccagttccaggagggcctggccagcagcatccaggatgagctgagccacaccagccctgccaccaacctgagtgacctgatcacccagtgcatcagcctggaggagaagccagaccccaaccccctgggcaagagcagcagcgcagaaggagatggccctgagagccccccagctgagaaccagcccatgcaggccgccatcaactgcccccacatcagcgaggccgagtgggtgcgctggcacaagggccgcctgtgcctgtactgcggctacccaggccactttgcccgggactgccctgtgaagccccaccaggccctgcaggccggcaacatccaggcctgccagtag

SEQ ID NO: 43917 - DNA, 2355 bp, Artificial Sequence
  Description of Artificial Sequence: Synthetic coding sequence
atgggaaatgagcacatctctgtgcacccagaaaattctgactgcatccaggctgatgtgaacagtgatgactacaagggggacaaggtgtaccaccctgagactggaaggaagaatgagaaggagaaggtgggcaggaagggcaagcacctgctgactgtggaccagaagagaggagaacatgtggtgtgtggcagcaccaggaacaatgaaagtgagagcaccctggacctggagggcttccagaaccccacagccaaggaatgtgagggcctggccaccctggacaacaaggctgacctggatggagagagcacagagggcacagaggagctggaggacagcctgaaccacttcacccacagcgtgcagggccagaccagcgagatgatccccagtgatgaggaggaggaggatgatgaggaggaggaggaggaggaggagccccggctgaccatcaaccagagagaagatgaagatggcatggccaatgaagatgagctggacaacacctacacaggcagcggagatgaagatgccctgtctgaggaggatgatgagctgggggaggccgccaagtatgaagatgtgaaggaatgtgggaagcacgtggagcgggccctgctggtggagctgaacaagatcagcctgaaggaggagaatgtgtgtgaggagaagaacagccctgtggaccagagcgacttcttctatgagttcagcaagctgatcttcaccaagggcaagagccccaccgtggtgtgcagcctgtgcaagcgggagggccacctgaagaaggactgcccagaggacttcaagaggatccagctggagcccctgccccccctgacccccaagttcctgaacatcctggaccaggtgtgcatccagtgctacaaggacttcagccccaccatcatcgaggaccaggcccgggagcacatccggcagaacctggagagcttcatccggcaggacttccctggcaccaagctgagcctgtttggcagcagcaagaatggatttggcttcaagcagagcgacctggatgtgtgcatgaccatcaatggcctggagacagctgagggcctggactgtgtgaggaccatcgaggagctggcccgggtgctgaggaagcacagcggcctgaggaacatcctgcccatcaccacagccaaggtgcccatcgtgaagttcttccacctgcggagcggcctggaggtggacatcagcctgtacaacaccctggccctgcacaacacccggctgctgagcgcctacagcgccatcgacccccgggtgaagtacctgtgctacaccatgaaggtgttcaccaagatgtgtgacattggagatgccagccggggcagcctgagcagctatgcctacaccctgatggtgctgtacttcctgcagcagagaaatcctcctgtgattcctgtgctgcaggagatctacaagggggagaagaagccagagatctttgtggatggctggaacatctacttctttgaccagattgatgagctgcccacctactggagcgaatgtgggaagaacacagagagcgtgggccagctgtggctgggcctgctgcgcttctacacagaggagtttgacttcaaggagcacgtgatcagcatccggaggaagagcctgctgaccaccttcaagaagcagtggaccagcaagtacatcgtgattgaggacccctttgacctgaaccacaacctgggcgccggcctgagcaggaagatgaccaacttcatcatgaaggccttcatcaatggaagaagagtgtttggcatccctgtgaagggcttccccaaggactaccccagcaagatggagtacttctttgatcctgatgtgctgacagaaggagagctggccccaaatgaccgctgctgccgcatctgtgggaagattggccacttcatgaaggactgccccatgaggaggaaggtgagaagaagaagagaccaggaggatgccctgaaccagcgctacccagagaacaaggagaagaggagcaaagaagacaaggagatccacaacaagtacacagagcgggaggtgtccaccaaggaggacaagcccatccagtgcaccccccagaaggccaagcccatgagagctgctgctgacctgggccgggagaagatcctgcggccccctgtggagaagtggaagaggcaggatgacaaggacctgcgggagaagcgctgcttcatctgtggccgggagggccacatcaagaaggagtgcccccagttcaagggcagcagcggcagcctgagcagcaagtacatgacccagggcaaggccagcgccaagaggacccagcaggagagctag

SEQ ID NO: 43918 - DNA, 507 bp, Artificial Sequence
  Description of Artificial Sequence: Synthetic coding sequence
atggaggccggcagccctgagaacaagaagcagaggagccggcccaggaagcccaggaagaccagaaatgaagaaaatgagcaggatggagacctggagggccctgtgattgatgagagcgtgctgagcaccaaggagctgctgggcctgcagcaggccgaggagcggctgaagagggactgcatcgaccggctgaagagaagacccaggaactaccccacagccaagtacacctgccgcctgtgtgatgtgctgattgagagcatcgcctttgcccacaagcacatcaaggagaagaggcacaagaagaacatcaaggagaagcaggaggaggagctgctgaccaccctgcccccacccacccccagccagatcaatgctgtgggcatcgccatcgacaaggtggtgcaggagtttggcctgcacaatgaaaacctggagcagaggctggagatcaagaggatcatggagaatgtgttccagcacaagctgcccggcatcttctag

SEQ ID NO: 43919 - DNA, 375 bp, Artificial Sequence
  Description of Artificial Sequence: Synthetic coding sequence
atgagccagccagatgtgctgctgctggtgcaggagtgcctgaagaacagcgacagcttcattgatgtggatgctgacttccacgcccgggtgcctgtggtggtgtgccgggagaagcagagcggcctgctgtgcaaggtgtctgctggaaatgaaaatgcctgcctgaccaccaagcacctgacagccctgggcaagctggagcccaagctggtgcccctggtgattgccttccgctactgggccaagctgtgcagcattgacaggcctgaggagggcggcctgcccccctacgtgtttgccctgatggccatcttcttcctgcagcagaggaaggagcccctgctgcctgtgtacctgggctcctgggtgtag

SEQ ID NO: 43920 - DNA, 1188 bp, Artificial Sequence
  Description of Artificial Sequence: Synthetic coding sequence
atgaccatcaatggcctggagacagctgagggcctggactgtgtgaggaccatcgaggagctggcccgggtgctgaggaagcacagcggcctgaggaacatcctgcccatcaccacagccaaggtgcccatcgtgaagttcttccacctgcggagcggcctggaggtggacatcagcctgtacaacaccctggccctgcacaacacccggctgctgagcgcctacagcgccatcgacccccgggtgaagtacctgtgctacaccatgaaggtgttcaccaagatctacaagggggagaagaagccagagatctttgtggatggctggaacatctacttctttgaccagattgatgagctgcccacctactggagcgaatgtgggaagaacacagaatctgtgggccagctgtggctgggcctgctgcgcttctacacagaggagtttgacttcaaggagcacgtgatcagcatccggaggaagagcctgctgaccaccttcaagaagcagtggaccagcaagtacatcgtgattgaggacccctttgacctgaaccacaacctgggcgccggcctgagcaggaagatgaccaacttcatcatgaaggccttcatcaatggccggcgggtgtttggcatccctgtgaagggcttccccaaggactaccccagcaagatggagtacttctttgatcctgatgtgctgacagaaggagagctggccccaaatgaccgctgctgccgcatctgtgggaagattggccacttcatgaaggactgccccatgaggaggaaggtgagaagaagaagagaccaggaggatgccctgaaccagcgctacccagagaacaaggagaagaggagcaaggaggacaaggagatccacaacaagtacacagagcgggaggtgtccaccaaggaggacaagcccatccagtgcaccccccagaaggccaagcccatgagagctgctgctgacctgggccgggagaagatcctgcggccccctgtggagaagtggaagaggcaggatgacaaggacctgcgggagaagcgctgcttcatctgtggccgggagggccacatcaagaaggaatgtccccagttcaagggcagcagcggcagcctgagcagcaagtacatgacccagggcaaggccagcgccaagaggacccagcaggagagctag

SEQ ID NO: 43921 - DNA, 3780 bp, Artificial Sequence
  Description of Artificial Sequence: Synthetic coding sequence
atgggagacacagccaagccctactttgtgaagaggaccaaggaccggggcaccatggatgatgatgacttcagaagaggccacccccagcaggactacctgatcattgatgaccacgccaagggccacggcagcaagatggagaagggcctgcagaagaagaagatcaccccaggcaactacggcaacacccccaggaagggcccctgtgctgtgagcagcaacccctatgccttcaagaaccccatctacagccagcctgcctggatgaatgacagccacaaggaccagagcaagcgctggctgagtgatgagcacactggaaacagcgacaactggagggagttcaagccaggcccccgcatccctgtgatcaaccggcagaggaaggacagcttccaggagaatgaagatggctaccgctggcaggacacccggggctgcaggacagtgcggcggctcttccacaaggacctgaccagcctggagaccaccagcgagatggaggccggcagccctgagaacaagaagcagaggagccggcccaggaagcccaggaagaccagaaatgaggagaatgagcaggatggagacctggagggccctgtgattgatgaatctgtgctgagcaccaaggagctgctgggcctgcagcaggccgaggagcggctgaagagggactgcatcgaccggctgaagaggcggcccaggaactaccccacagccaagtacacctgccgcctgtgtgatgtgctgattgagagcatcgcctttgcccacaagcacatcaaggagaagaggcacaagaagaacatcaaggagaagcaggaggaggagctgctgaccaccctgcccccacccacccccagccagatcaatgctgtgggcatcgccatcgacaaggtggtgcaggagtttggcctgcacaatgaaaacctggagcagaggctggagatcaagaggatcatggagaatgtgttccagcacaagctgcctgactgcagcctgcggctgtatggcagcagctgcagccggctgggcttcaagaacagtgatgtgaacatcgacatccagtttcctgccatcatcgagggcttcagcctgagcaagctgggcaacttcaacctgcaggacatcgagaaggatgtggtgatctgggagcacacagattctgctgctggggacaccggcatcaccaaggaggaggccccccgggagacccccatcaagaggggccaggtgtccctcatcctggatgtgaagcaccagcccagcgtgcctgtgggccagctgtgggtggagctgctgcgcttctacgccctggagttcaacctggccgacctggtgatcagcatccgggtgaaggagctggtgtcccgggagctgaaggactggcccaagaagagaattgccatcgaggacccctacagcgtgaagagaaatgtggcccggaccctgaacagccagcctgtgtttgagtacatcctgcactgcctgcggaccacctacaagtactttgccctgccccacaagatcaccaagagcagcctgctgaagcccctgaatgccatcacctgcatcagcgagcacagcaaggaggtgatcaaccaccacccagatgtgcagaccaaggatgacaagctgaagaacagcgtgctggcccagggccctggggccaccagcagcgctgccaacacctgcaaggtgcagcccctgaccctgaaggagacagctgagagctttggcagcccccccaaggaggagatgggaaatgagcacatctctgtgcacccagaaaattctgactgcatccaggctgatgtgaacagtgatgactacaagggggacaaggtgtaccaccctgagactggaaggaagaatgagaaggagaaggtgggcaggaagggcaagcacctgctgactgtggaccagaagagaggagaacatgtggtgtgtggcagcaccaggaacaatgaaagtgagagcaccctggacctggagggcttccagaaccccacagccaaggaatgtgagggcctggccaccctggacaacaaggctgacctggatggagagagcacagagggcacagaggagctggaggacagcctgaaccacttcacccacagcgtgcagggccagaccagcgagatgatccccagtgatgaggaggaggaggatgatgaggaggaggaggaggaggaggagccccggctgaccatcaaccagagagaagatgaagatggcatggccaatgaagatgagctggacaacacctacacaggcagcggagatgaagatgccctgtctgaggaggatgatgagctgggggaggccgccaagtatgaagatgtgaaggaatgtgggaagcacgtggagcgggccctgctggtggagctgaacaagatcagcctgaaggaggagaatgtgtgtgaggagaagaacagccctgtggaccagagcgacttcttctatgagttcagcaagctgatcttcaccaagggcaagggcctggactgtgtgaggaccatcgaggagctggcccgggtgctgaggaagcacagcggcctgaggaacatcctgcccatcaccacagccaaggtgcccatcgtgaagttcttccacctgcggagcggcctggaggtggacatcagcctgtacaacaccctggccctgcacaacacccggctgctgagcgcctacagcgccatcgacccccgggtgaagtacctgtgctacaccatgaaggtgttcaccaagatgtgtgacattggagatgccagccggggcagcctgagcagctatgcctacaccctgatggtgctgtacttcctgcagcagaggaacccccctgtgattcctgtgctgcaggagatctacaagggggagaagaagccagagatctttgtggatggctggaacatctacttctttgaccagattgatgagctgcccacctactggagcgaatgtgggaagaacacagaatctgtgggccagctgtggctgggcctgctgcgcttctacacagaggagtttgacttcaaggagcacgtgatcagcatccggaggaagagcctgctgaccaccttcaagaagcagtggaccagcaagtacatcgtgattgaggacccctttgacctgaaccacaacctgggcgccggcctgagcaggaagatgaccaacttcatcatgaaggccttcatcaatggccggcgggtgtttggcatccctgtgaagggcttccccaaggactaccccagcaagatggagtacttctttgatcctgatgtgctgacagaaggagagctggccccaaatgaccgctgctgccgcatctgtgggaagattggccacttcatgaaggactgccccatgaggaggaaggtgagaagaagaagagaccaggaggatgccctgaaccagcgctacccagagaacaaggagaagaggagcaaggaggacaaggagatccacaacaagtacacagagcgggaggtgtccaccaaggaggacaagcccatccagtgcaccccccagaaggccaagcccatgagagctgctgctgacctgggccgggagaagatcctgcggccccctgtggagaagtggaagaggcaggatgacaaggacctgcgggagaagcgctgcttcatctgtggccgggagggccacatcaagaaggaatgtccccagttcaagggcagcagcggcagcctgagcagcaagtacatgacccagggcaaggccagcgccaagaggacccagcaggagagctag

SEQ ID NO: 43922 - DNA, 4374 bp, Artificial Sequence
  Description of Artificial Sequence: Synthetic coding sequence
atgggagacacagccaagccctactttgtgaagaggaccaaggaccggggcaccatggatgatgatgacttcagaagaggccacccccagcaggactacctgatcattgatgaccacgccaagggccacggcagcaagatggagaagggcctgcagaagaagaagatcaccccaggcaactacggcaacacccccaggaagggcccctgtgctgtgagcagcaacccctatgccttcaagaaccccatctacagccagcctgcctggatgaatgacagccacaaggaccagagcaagcgctggctgagtgatgagcacactggaaacagcgacaactggagggagttcaagccaggcccccgcatccctgtgatcaaccggcagaggaaggacagcttccaggagaatgaagatggctaccgctggcaggacacccggggctgcaggacagtgcggcggctcttccacaaggacctgaccagcctggagaccaccagcgagatggaggccggcagccctgagaacaagaagcagaggagccggcccaggaagcccaggaagaccagaaatgaggagaatgagcaggatggagacctggagggccctgtgattgatgaatctgtgctgagcaccaaggagctgctgggcctgcagcaggccgaggagcggctgaagagggactgcatcgaccggctgaagaggcggcccaggaactaccccacagccaagtacacctgccgcctgtgtgatgtgctgattgagagcatcgcctttgcccacaagcacatcaaggagaagaggcacaagaagaacatcaaggagaagcaggaggaggagctgctgaccaccctgcccccacccacccccagccagatcaatgctgtgggcatcgccatcgacaaggtggtgcaggagtttggcctgcacaatgaaaacctggagcagaggctggagatcaagaggatcatggagaatgtgttccagcacaagctgcctgactgcagcctgcggctgtatggcagcagctgcagccggctgggcttcaagaacagtgatgtgaacatcgacatccagtttcctgccatcatgagccagccagatgtgctgctgctggtgcaggagtgcctgaagaacagcgacagcttcattgatgtggatgctgacttccacgcccgggtgcctgtggtggtgtgccgggagaagcagagcggcctgctgtgcaaggtgtctgctggaaatgaaaatgcctgcctgaccaccaagcacctgacagccctgggcaagctggagcccaagctggtgcccctggtgattgccttccgctactgggccaagctgtgcagcattgacaggcctgaggagggcggcctgcccccctacgtgtttgccctgatggccatcttcttcctgcagcagaggaaggagcccctgctgcctgtgtacctgggctcctggattgagggcttcagcctgagcaagctgggcaacttcaacctgcaggacatcgagaaggatgtggtgatctgggagcacacagacagcgctgctggggacaccggcatcaccaaggaggaggccccccgggagacccccatcaagaggggccaggtgtccctcatcctggatgtgaagcaccagcccagcgtgcctgtgggccagctgtgggtggagctgctgcgcttctacgccctggagttcaacctggccgacctggtgatcagcatccgggtgaaggagctggtgtcccgggagctgaaggactggcccaagaagagaattgccatcgaggacccctacagcgtgaagagaaatgtggcccggaccctgaacagccagcctgtgtttgagtacatcctgcactgcctgcggaccacctacaagtactttgccctgccccacaagatcaccaagagcagcctgctgaagcccctgaatgccatcacctgcatcagcgagcacagcaaggaggtgatcaaccaccacccagatgtgcagaccaaggatgacaagctgaagaacagcgtgctggcccagggccctggggccaccagcagcgctgccaacacctgcaaggtgcagcccctgaccctgaaggagacagctgagagctttggcagcccccccaaggaggagatgggaaatgagcacatctctgtgcaccctgagaacagcgactgcatccaggctgatgtgaacagtgatgactacaagggggacaaggtgtaccaccctgagaccggcaggaagaatgagaaggagaaggtgggcaggaagggcaagcacctgctgactgtggaccagaagagaggagagcacgtggtgtgtggcagcaccagaaataatgaaagtgagagcaccctggacctggagggcttccagaaccccacagccaaggaatgtgagggcctggccaccctggacaacaaggctgacctggatggagagagcacagagggcacagaggagctggaggacagcctgaaccacttcacccacagcgtgcagggccagaccagcgagatgatccccagtgatgaggaggaggaggatgatgaggaggaggaggaggaggaggagccccggctgaccatcaaccagcgggaggatgaagatggcatggccaatgaagatgagctggacaacacctacacaggcagcggagatgaagatgccctgtctgaagaagatgatgagctgggggaggccgccaagtatgaagatgtgaaggaatgtgggaagcacgtggagcgggccctgctggtggagctgaacaagatcagcctgaaggaggagaatgtgtgtgaggagaagaacagccctgtggaccagagcgacttcttctatgagttcagcaagctgatcttcaccaagggcaagagccccaccgtggtgtgcagcctgtgcaagcgggagggccacctgaagaaggactgcccagaggacttcaagaggatccagctggagcccctgccccccctgacccccaagttcctgaacatcctggaccaggtgtgcatccagtgctacaaggacttcagccccaccatcatcgaggaccaggcccgggagcacatccggcagaacctggagagcttcatccggcaggacttccctggcaccaagctgagcctgtttggcagcagcaagaatggcttcggcttcaagcagagcgacctggatgtgtgcatgaccatcaatggcctggagacagctgagggcctggactgtgtgaggaccatcgaggagctggcccgggtgctgaggaagcacagcggcctgaggaacatcctgcccatcaccacagccaaggtgcccatcgtgaagttcttccacctgcggagcggcctggaggtggacatcagcctgtacaacaccctggccctgcacaacacccggctgctgagcgcctacagcgccatcgacccccgggtgaagtacctgtgctacaccatgaaggtgttcaccaagatctacaagggggagaagaagccagagatctttgtggatggctggaacatctacttctttgaccagattgatgagctgcccacctactggagcgaatgtgggaagaacacagaatctgtgggccagctgtggctgggcctgctgcgcttctacacagaggagtttgacttcaaggagcacgtgatcagcatccggaggaagagcctgctgaccaccttcaagaagcagtggaccagcaagtacatcgtgattgaggacccctttgacctgaaccacaacctgggcgccggcctgagcaggaagatgaccaacttcatcatgaaggccttcatcaatggccggcgggtgtttggcatccctgtgaagggcttccccaaggactaccccagcaagatggagtacttctttgatcctgatgtgctgacagaaggagagctggccccaaatgaccgctgctgccgcatctgtgggaagattggccacttcatgaaggactgccccatgaggaggaaggtgagaagaagaagagaccaggaggatgccctgaaccagcgctacccagagaacaaggagaagaggagcaaggaggacaaggagatccacaacaagtacacagagcgggaggtgtccaccaaggaggacaagcccatccagtgcaccccccagaaggccaagcccatgagagctgctgctgacctgggccgggagaagatcctgcggccccctgtggagaagtggaagaggcaggatgacaaggacctgcgggagaagcgctgcttcatctgtggccgggagggccacatcaagaaggaatgtccccagttcaagggcagcagcggcagcctgagcagcaagtacatgacccagggcaaggccagcgccaagaggacccagcaggagagctag

SEQ ID NO: 43923 - DNA, 4488 bp, Artificial Sequence
  Description of Artificial Sequence: Synthetic coding sequence
atgggagacacagccaagccctactttgtgaagaggaccaaggaccggggcaccatggatgatgatgacttcagaagaggccacccccagcaggactacctgatcattgatgaccacgccaagggccacggcagcaagatggagaagggcctgcagaagaagaagatcaccccaggcaactacggcaacacccccaggaagggcccctgtgctgtgagcagcaacccctatgccttcaagaaccccatctacagccagcctgcctggatgaatgacagccacaaggaccagagcaagcgctggctgagtgatgagcacactggaaacagcgacaactggagggagttcaagccaggcccccgcatccctgtgatcaaccggcagaggaaggacagcttccaggagaatgaagatggctaccgctggcaggacacccggggctgcaggacagtgcggcggctcttccacaaggacctgaccagcctggagaccaccagcgagatggaggccggcagccctgagaacaagaagcagaggagccggcccaggaagcccaggaagaccagaaatgaggagaatgagcaggatggagacctggagggccctgtgattgatgaatctgtgctgagcaccaaggagctgctgggcctgcagcaggccgaggagcggctgaagagggactgcatcgaccggctgaagaggcggcccaggaactaccccacagccaagtacacctgccgcctgtgtgatgtgctgattgagagcatcgcctttgcccacaagcacatcaaggagaagaggcacaagaagaacatcaaggagaagcaggaggaggagctgctgaccaccctgcccccacccacccccagccagatcaatgctgtgggcatcgccatcgacaaggtggtgcaggagtttggcctgcacaatgaaaacctggagcagaggctggagatcaagaggatcatggagaatgtgttccagcacaagctgcctgactgcagcctgcggctgtatggcagcagctgcagccggctgggcttcaagaacagtgatgtgaacatcgacatccagtttcctgccatcatgagccagccagatgtgctgctgctggtgcaggagtgcctgaagaacagcgacagcttcattgatgtggatgctgacttccacgcccgggtgcctgtggtggtgtgccgggagaagcagagcggcctgctgtgcaaggtgtctgctggaaatgaaaatgcctgcctgaccaccaagcacctgacagccctgggcaagctggagcccaagctggtgcccctggtgattgccttccgctactgggccaagctgtgcagcattgacaggcctgaggagggcggcctgcccccctacgtgtttgccctgatggccatcttcttcctgcagcagaggaaggagcccctgctgcctgtgtacctgggctcctggattgagggcttcagcctgagcaagctgggcaacttcaacctgcaggacatcgagaaggatgtggtgatctgggagcacacagacagcgctgctggggacaccggcatcaccaaggaggaggccccccgggagacccccatcaagaggggccaggtgtccctcatcctggatgtgaagcaccagcccagcgtgcctgtgggccagctgtgggtggagctgctgcgcttctacgccctggagttcaacctggccgacctggtgatcagcatccgggtgaaggagctggtgtcccgggagctgaaggactggcccaagaagagaattgccatcgaggacccctacagcgtgaagagaaatgtggcccggaccctgaacagccagcctgtgtttgagtacatcctgcactgcctgcggaccacctacaagtactttgccctgccccacaagatcaccaagagcagcctgctgaagcccctgaatgccatcacctgcatcagcgagcacagcaaggaggtgatcaaccaccacccagatgtgcagaccaaggatgacaagctgaagaacagcgtgctggcccagggccctggggccaccagcagcgctgccaacacctgcaaggtgcagcccctgaccctgaaggagacagctgagagctttggcagcccccccaaggaggagatgggaaatgagcacatctctgtgcaccctgagaacagcgactgcatccaggctgatgtgaacagtgatgactacaagggggacaaggtgtaccaccctgagaccggcaggaagaatgagaaggagaaggtgggcaggaagggcaagcacctgctgactgtggaccagaagagaggagagcacgtggtgtgtggcagcaccagaaataatgaaagtgagagcaccctggacctggagggcttccagaaccccacagccaaggaatgtgagggcctggccaccctggacaacaaggctgacctggatggagagagcacagagggcacagaggagctggaggacagcctgaaccacttcacccacagcgtgcagggccagaccagcgagatgatccccagtgatgaggaggaggaggatgatgaggaggaggaggaggaggaggagccccggctgaccatcaaccagcgggaggatgaagatggcatggccaatgaagatgagctggacaacacctacacaggcagcggagatgaagatgccctgtctgaagaagatgatgagctgggggaggccgccaagtatgaagatgtgaaggaatgtgggaagcacgtggagcgggccctgctggtggagctgaacaagatcagcctgaaggaggagaatgtgtgtgaggagaagaacagccctgtggaccagagcgacttcttctatgagttcagcaagctgatcttcaccaagggcaagagccccaccgtggtgtgcagcctgtgcaagcgggagggccacctgaagaaggactgcccagaggacttcaagaggatccagctggagcccctgccccccctgacccccaagttcctgaacatcctggaccaggtgtgcatccagtgctacaaggacttcagccccaccatcatcgaggaccaggcccgggagcacatccggcagaacctggagagcttcatccggcaggacttccctggcaccaagctgagcctgtttggcagcagcaagaatggcttcggcttcaagcagagcgacctggatgtgtgcatgaccatcaatggcctggagacagctgagggcctggactgtgtgaggaccatcgaggagctggcccgggtgctgaggaagcacagcggcctgaggaacatcctgcccatcaccacagccaaggtgcccatcgtgaagttcttccacctgcggagcggcctggaggtggacatcagcctgtacaacaccctggccctgcacaacacccggctgctgagcgcctacagcgccatcgacccccgggtgaagtacctgtgctacaccatgaaggtgttcaccaagatgtgtgacattggagatgccagccggggcagcctgagcagctatgcctacaccctgatggtgctgtacttcctgcagcagaggaacccccctgtgattcctgtgctgcaggagatctacaagggggagaagaagccagagatctttgtggatggctggaacatctacttctttgaccagattgatgagctgcccacctactggagcgaatgtgggaagaacacagaatctgtgggccagctgtggctgggcctgctgcgcttctacacagaggagtttgacttcaaggagcacgtgatcagcatccggaggaagagcctgctgaccaccttcaagaagcagtggaccagcaagtacatcgtgattgaggacccctttgacctgaaccacaacctgggcgccggcctgagcaggaagatgaccaacttcatcatgaaggccttcatcaatggccggcgggtgtttggcatccctgtgaagggcttccccaaggactaccccagcaagatggagtacttctttgatcctgatgtgctgacagaaggagagctggccccaaatgaccgctgctgccgcatctgtgggaagattggccacttcatgaaggactgccccatgaggaggaaggtgagaagaagaagagaccaggaggatgccctgaaccagcgctacccagagaacaaggagaagaggagcaaggaggacaaggagatccacaacaagtacacagagcgggaggtgtccaccaaggaggacaagcccatccagtgcaccccccagaaggccaagcccatgagagctgctgctgacctgggccgggagaagatcctgcggccccctgtggagaagtggaagaggcaggatgacaaggacctgcgggagaagcgctgcttcatctgtggccgggagggccacatcaagaaggaatgtccccagttcaagggcagcagcggcagcctgagcagcaagtacatgacccagggcaaggccagcgccaagaggacccagcaggagagctag

SEQ ID NO: 43924 - DNA, 498 bp, Artificial Sequence
  Description of Artificial Sequence: Synthetic coding sequence
atggaggccggcagccctgagaacaagaagcagaggagccggcccaggaagcccaggaagaccagaaatgaagaaaatgagcaggatggagacctggagggccctgtgattgatgagagcgtgctgagcaccaaggagctgctgggcctgcagcaggccgaggagcggctgaagagggactgcatcgaccggctgaagagaagacccaggaactaccccacagccaagtacacctgccgcctgtgtgatgtgctgattgagagcatcgcctttgcccacaagcacatcaaggagaagaggcacaagaagaacatcaaggagaagcaggaggaggagctgctgaccaccctgcccccacccacccccagccagatcaatgctgtgggcatcgccatcgacaaggtggtgcaggagtttggcctgcacaatgaaaacctggagcagaggctggagatcaagaggatcatggagaatgtgttccagcacaagctgccctag

SEQ ID NO: 43925 - DNA, 618 bp, Artificial Sequence
  Description of Artificial Sequence: Synthetic coding sequence
atgtttggaggctatgagaccatcgaggcctatgaagatgacctgtacagagatgagagcagcagcgagctgtctgtggacagcgaggtggagttccagctgtacagccagatccactacgcccaggacctggatgatgtgatccgggaggaggagcacgaggagaagaacagcggcaacagcgagagcagcagcagcaagcccaaccagaagaagctgattgtgctgagtgacagcgaggtgatccagctgagtgatggcagcgaggtgatcaccctgagtgatgaggacagcatctaccgctgcaagggcaagaatgtgcgggtgcaggcccaggagaatgcccacggcctgagcagcagcctgcagagcaatgagctggtggacaagaagtgcaagagtgacatcgagaagcccaagtctgaggagaggtctggagtcatccgggaggtgatgatcatcgaggtgagcagcagcgaggaggaggagagcaccatcagcgagggggacaacgtggagagctggatgctgctgggctgtgaggtggatgacaaggatgatgacatcctgctgaacctggtgggctgtgaaaattctgtgacagagggccaggagtag

SEQ ID NO: 43926 - DNA, 1632 bp, Artificial Sequence
  Description of Artificial Sequence: Synthetic coding sequence
atgatgtttggaggctatgagaccatcgaggcctatgaagatgacctgtacagagatgagagcagcagcgagctgtctgtggacagcgaggtggagttccagctgtacagccagatccactacgcccaggacctggatgatgtgatccgggaggaggagcacgaggagaagaacagcggcaacagcgagagcagcagcagcaagcccaaccagaagaagctgattgtgctgagtgacagcgaggtgatccagctgagtgatggcagcgaggtgatcaccctgagtgatgaagattccatctaccgctgcaagggcaagaatgtgcgggtgcaggcccaggagaatgcccacggcctgagcagcagcctgcagagcaatgagctggtggacaagaagtgcaagagtgacatcgagaagcccaagtctgaggagaggtctggagtcatccgggaggtgatgatcatcgaggtgagcagcagcgaggaggaggagagcaccatcagcgagggggacaacgtggagagctggatgctgctgggctgtgaggtggatgacaaggatgatgacatcctgctgaacctggtgggctgtgagaacagcgtgacagaaggagaagatggcatcaactggagcatcagtgacaaggacatcgaggcccagatcgccaacaacagaacacctggccgctggacccagcgctactacagcgccaacaagaacatcatctgcaggaactgtgacaagaggggccacctgagcaagaactgccccctgcccaggaaggtgcggcgctgcttcctgtgcagccggcggggccacctgctgtacagctgcccagcccccctgtgtgagtactgccctgtgcccaagatgctggaccacagctgcctcttccgccacagctgggacaagcagtgtgaccgctgccacatgctgggccactacacagatgcctgcacagagatctggaggcagtaccacctgaccaccaagccaggcccccccaagaagcccaagacccccagccggcccagcgccctggcctactgctaccactgtgcccagaagggccactacggccacgagtgcccagagcgggaggtgtatgaccccagccctgtgagccccttcatctgctactatgatgacaagtatgagatccaggagcgggagaagaggctgaagcagaagatcaaggtgctgaagaagaatggagtcatccctgagcccagcaagctgccctacatcaaggccgccaatgaaaacccccaccacgacatcaggaagggccgggcctcctggaagagcaaccgctggccccaggagaacaaggagacccagaaggagatgaagaacaagaacagaaactgggagaagcacaggaaggctgacagacaccgggaggtggatgaggacttcccccggggccccaagacctacagcagccctggcagcttcaagacccagaagcccagcaagcccttccacaggagcagccactaccacaccagccgggaggacaagagccccaaggagggcaagaggggcaagcagaagaagaaggagcgctgctgggaggatgatgacaatgacaacctcttcctgatcaagcagaggaagaagaagagctag

SEQ ID NO: 43927 - DNA, 762 bp, Artificial Sequence
  Description of Artificial Sequence: Synthetic coding sequence
atgctggaccacagctgcctcttccgccacagctgggacaagcagtgtgaccgctgccacatgctgggccactacacagatgcctgcacagagatctggaggcagtaccacctgaccaccaagccaggcccccccaagaagcccaagacccccagccggcccagcgccctggcctactgctaccactgtgcccagaagggccactacggccacgagtgcccagagcgggaggtgtatgaccccagccctgtgagccccttcatctgctactatgatgacaagtatgagatccaggagcgggagaagaggctgaagcagaagatcaaggtgctgaagaagaatggagtcatccctgagcccagcaagctgccctacatcaaggccgccaatgaaaacccccaccacgacatcaggaagggccgggcctcctggaagagcaaccgctggccccaggagaacaaggagacccagaaggagatgaagaacaagaacagaaactgggagaagcacaggaaggctgacagacaccgggaggtggatgaggacttcccccggggccccaagacctacagcagccctggcagcttcaagacccagaagcccagcaagcccttccacaggagcagccactaccacaccagccgggaggacaagagccccaaggagggcaagaggggcaagcagaagaagaaggagcgctgctgggaggatgatgacaatgacaacctcttcctgatcaagcagaggaagaagaagagctag

SEQ ID NO: 43928 - DNA, 2124 bp, Artificial Sequence
  Description of Artificial Sequence: Synthetic coding sequence
atggctgctgaggtgtactttggagacctggagctgtttgagccctttgaccaccctgaggagagcatccccaagcctgtgcacacccgcttcaaggatgatgatggagatgaagaagatgaaaatggagtgggagatgctgagctgcgggagcggctgcggcagtgtgaggagaccatcgagcagctgcgggcagagaaccaggagctgaagaggaagctgaacatcctgacccggcccagcggcatcctggtgaatgacaccaagctggatggccccatcctgcagatcctcttcatgaacaatgccatcagcaagcagtaccaccaggagattgaggagtttgtgagcaacctggtgaagagatttgaggagcagcagaagaatgatgtggagaagaccagcttcaacctgctgccccagcccagcagcatcgtgctggaggaggaccacaaggtggaggagagctgtgccatcaagaacaacaaggaggccttctctgtggtgggctctgtgctgtacttcaccaacttctgcctggacaagctgggccagcccctgctgaatgaaaacccccagctgtctgagggctgggagatccccaagtaccaccaggtgttcagccacatcgtgtccctggagggccaggagatccaggtgaaggccaagaggcccaagccccactgcttcaactgtggcagcgaggagcaccagatgaaggactgccccatgcccagaaatgctgcccgcatcagcgagaagaggaaggagtacatggatgcctgtggggaggccaacaaccagaacttccagcagcgctaccacgccgaggaggtggaggagagatttggccgcttcaagccaggagtcatcagcgaggagctgcaggatgccctgggcgtgacagacaagagcctgccccccttcatctacaggatgaggcagctgggctacccacctggctggctgaaggaggccgagctggagaacagcggcctggccctgtatgatggcaaggatggaacagatggagaaacagaggtgggggagatccagcagaacaagtctgtgacctatgacctgagcaagctggtgaactacccaggcttcaacatcagcaccccccggggcatcccagatgagtggaggatcttcggcagcatccccatgcaggcctgccagcagaaggatgtgtttgccaactacctgaccagcaacttccaggcccctggggtgaagagcggcaacaagaggagcagcagccacagcagccctggcagccccaagaagcagaagaatgaaagcaacagcgctggcagccctgctgacatggagctggacagcgacatggaggtgccccacggcagccagagcagcgagagcttccagttccagccccccctgcccccagacaccccacccctgccccggggcaccccacctcctgtgttcaccccacccctgcccaagggcaccccacccctgacccccagcgacagcccccagaccaggacagccagcggggctgtggatgaagatgccctgaccctggaggagctggaggagcagcagaggcgcatctgggccgccctggagcaggccgagagcgtgaacagcgacagtgatgtgcctgtggacacccccctgaccggcaacagcgtggccagcagcccctgccccaatgagctggacctgcctgtgcctgagggcaagaccagcgagaagcagaccctggatgagcctgaggtgcctgagatcttcaccaagaagtctgaggccggccacgccagcagcccagattctgaggtgaccagcctgtgccagaaggagaaggccgagctggcccctgtgaacacagaaggagccctgctggacaatggatctgtggtgcccaactgtgacatcagcaatggaggcagccagaagctgtttcctgctgacaccagccccagcacagccaccaagatccacagccccatcccagacatgagcaagtttgccaccggcatcaccccatttgaatttgagaacatggccgagagcacaggcatgtacctgcgcatccgcagcctgctgaagaacagccccaggaaccagcagaagaacaagaaggccagcgagtag

SEQ ID NO: 43929 - DNA, 1410 bp, Artificial Sequence
  Description of Artificial Sequence: Synthetic coding sequence
atgaaggactgccccatgcccagaaatgctgcccgcatcagcgagaagaggaaggagtacatggatgcctgtggggaggccaacaaccagaacttccagcagcgctaccacgccgaggaggtggaggagagatttggccgcttcaagccaggagtcatcagcgaggagctgcaggatgccctgggcgtgacagacaagagcctgccccccttcatctacaggatgaggcagctgggctacccacctggctggctgaaggaggccgagctggagaacagcggcctggccctgtatgatggcaaggatggaacagatggagaaacagaggtgggggagatccagcagaacaagtctgtgacctatgacctgagcaagctggtgaactacccaggcttcaacatcagcaccccccggggcatcccagatgagtggaggatcttcggcagcatccccatgcaggcctgccagcagaaggatgtgtttgccaactacctgaccagcaacttccaggcccctggggtgaagagcggcaacaagaggagcagcagccacagcagccctggcagccccaagaagcagaagaatgaaagcaacagcgctggcagccctgctgacatggagctggacagcgacatggaggtgccccacggcagccagagcagcgagagcttccagttccagccccccctgcccccagacaccccacccctgccccggggcaccccacctcctgtgttcaccccacccctgcccaagggcaccccacccctgacccccagcgacagcccccagaccaggacagccagcggggctgtggatgaagatgccctgaccctggaggagctggaggagcagcagaggcgcatctgggccgccctggagcaggccgagagcgtgaacagcgacagtgatgtgcctgtggacacccccctgaccggcaacagcgtggccagcagcccctgccccaatgagctggacctgcctgtgcctgagggcaagaccagcgagaagcagaccctggatgagcctgaggtgcctgagatcttcaccaagaagtctgaggccggccacgccagcagcccagattctgaggtgaccagcctgtgccagaaggagaaggccgagctggcccctgtgaacacagaaggagccctgctggacaatggatctgtggtgcccaactgtgacatcagcaatggaggcagccagaagctgtttcctgctgacaccagccccagcacagccaccaagatccacagccccatcccagacatgagcaagtttgccaccggcatcaccccatttgaatttgagaacatggccgagagcacaggcatgtacctgcgcatccgcagcctgctgaagaacagccccaggaaccagcagaagaacaagaaggccagcgagtag

SEQ ID NO: 43930 - DNA, 117 bp, Artificial Sequence
  Description of Artificial Sequence: Synthetic coding sequence
atgaaggactgccccatgcccagaaatgctgcccgcatcagcgagaagaggaaggagtacatggatgcctgtggggaggccaacaaccagaacttccagcagcgctaccacgcctag

SEQ ID NO: 43931 - DNA, 1410 bp, Artificial Sequence; identical to SEQ ID NO: 43929
  Description of Artificial Sequence: Synthetic coding sequence

SEQ ID NO: 43932 - DNA, 816 bp, Artificial Sequence
  Description of Artificial Sequence: Synthetic coding sequence
atgacccgctgggcccgggtgtccaccacctacaacaagaggcccctgcctgccacctcctgggaggacatgaagaagggcagctttgagggcaccagccagaacctgcccaagaggaagcagctggaggccaaccggctgagcctgaagaatgatgccccccaggccaagcacaagaagaacaagaagaagaaggagtacctgaatgaagatgtgaatggcttcatggagtacctgcggcagaacagccagatggtgcacaacggccagatcatcgccacagacagcgaggaggtgcgggaggagattgctgtggccctgaagaaggacagccggcgggagggccggcggctgaagaggcaggccgccaagaagaatgccatggtgtgcttccactgcaggaagccaggccacggcattgctgactgcccagctgccctggagaaccaggacatgggcaccggcatctgctaccgctgtggcagcacagaacatgagatcaccaagtgcaaggccaaggtggaccctgccctgggggagttcccctttgccaagtgctttgtgtgtggggagatgggccacctgagccgcagctgcccagacaaccccaagggcctgtatgcagatggcggcggctgcaagctgtgtggctctgtggagcacctgaagaaggactgcccagagagccagaacagcgagaggatggtgacagtgggccgctgggccaagggcatgtctgctgactatgaggagatcctggatgtgcccaagccccagaagcccaagaccaagatccccaaggtggtgaacttctag

SEQ ID NO: 43933 - DNA, 816 bp, Artificial Sequence; identical to SEQ ID NO: 43932
  Description of Artificial Sequence: Synthetic coding sequence

SEQ ID NO: 43934 - DNA, 816 bp, Artificial Sequence; identical to SEQ ID NO: 43932
  Description of Artificial Sequence: Synthetic coding sequence

SEQ ID NO: 43935 - DNA, 816 bp, Artificial Sequence; identical to SEQ ID NO: 43932
  Description of Artificial Sequence: Synthetic coding sequence

SEQ ID NO: 43936 - DNA, 1434 bp, Artificial Sequence
  Description of Artificial Sequence: Synthetic coding sequence
atgggcagcggcctggactttgctgagaccagctgtgcccagcctgtggtgtccacccagagcgacaaggagcccggcatcacagccagcgccacagacacagacaatgccaacggggaggaggtgccccacacccaggagatctctgtgtcctgggagggggaggccgcccctgagatccgcaccagcaagctgggccagcctgaccctgcccccagcaagaagaagagcaaccggctgaccctgagcaagaggaagaaggaggcccaggatgagaaggtggagaagacccagggcggccacgagcaccggcaggaggaccggctgaagaagacagtgcaggaccacagccagatccgggaccagcagaagggggagatcagcggcttcggccagtgcctggtgtgggtgcagtgcagcttccccaactgtgggaagtggaggcggctgtgtggcaacatcgaccccagcgtgctgcctgacaactggagctgtgaccagaacacagatgtgcagtacaacagatgtgacatccctgaggagacctggacaggcctggagagtgatgtggcctatgccagctacatccctggcagcatcatctgggccaagcagtatggctacccctggtggccaggcatgattgaaagtgaccctgacctgggggagtacttcctgttcaccagccacctggacagcctgcccagcaagtaccacgtgaccttctttggagagaccgtgtcccgggcctggatccctgtgaacatgctgaagaacttccaggagctgagcctggagctgtctgtgatgaagaagagaagaaatgactgcagccagaagctgggcgtggccctgatgatggcccaggaggccgagcagatcagcatccaggagcgggtgaacctgtttggcttctggagccgcttcaacggcagcaacagcaatggagagaggaaggacctgcagctgagcggcctgaacagccctggcagctgcctggagaagaaggagaaggaggaggagctggagaaggaggagggggagaagacagaccccatcctgcccatcaggaagagggtgaagatccagacccagaagaccaagccccggggccccaagaagaagttcaaggccccccagagcaaggccctggccgccagcttcagcgagggcaaggaggtgaggacagtgcccaagaacctgggcctgagcgcctgcaagggggcctgccccagcagcgccaaggaggagcccaggcaccgggagcccctgacccaggaggccggctctgtgcccctggaggatgaggccagcagtgacctggacctggagcagctgatggaggatgtgggccgggagctgggccagagcggggagctgcagcacagcaacagtgatggagaggacttccctgtggccctgtttgggaagtag

SEQ ID NO: 43937 - DNA, 1410 bp, Artificial Sequence
  Description of Artificial Sequence: Synthetic coding sequence
atgatgaccaccctgcagaacaaggaggagtgtgggaagggccccaagaggatctttgcccccccagcccagaagagctacagcctgctgccctgcagccccaacagccccaaggaggagaccccaggcatcagcagccctgagacagaggcccgcatcagcctgcccaaggccagcctgaagaagaaggaggagaaggccaccatgaagaatgtgcccagccgggagcaggagaagaagaggaaggcccagatcaacaagcaggccgagaagaaggagaaggagaagagcagcctgaccaatgctgagtttgaggagatcgtgcagatcgtgctgcagaagagcctgcaggagtgcctgggcggcatgggcagcggcctggactttgctgagaccagctgtgcccagcctgtggtgtccacccagagcgacaaggagcccggcatcacagccagcgccacagacacagacaatgccaacggggaggaggtgccccacacccaggagatctctgtgtcctgggagggggaggccgcccctgagatccgcaccagcaagctgggccagcctgaccctgcccccagcaagaagaagagcaaccggctgaccctgagcaagaggaagaaggaggcccaggatgagaaggtggagaagacccagggcggccacgagcaccggcaggaggaccggctgaagaagacagtgcaggaccacagccagatccgggaccagcagaagggggagatcagcggcttcggccagtgcctggtgtgggtgcagtgcagcttccccaactgtgggaagtggaggcggctgtgtggcaacatcgaccccagcgtgctgcctgacaactggagctgtgaccagaacacagcagatgtgcagtacaacagatgtgacatccctgaggagacctggacaggcctggagagtgatgtggcctatgccagctacatccctggcagcatcatctgggccaagcagtatggctacccctggtggccaggcatgattgaaagtgaccctgacctgggggagtacttcctgttcaccagccacctggacagcctgcccagcaagtaccacgtgaccttcttcggggagaccgtgtcccgggcctggatccctgtgaacatgctgaagaacttccaggagctgagcctggagctgtctgtgatgaagaagagaagaaatgactgcagccagaagctgggcgtggccctgatgatggcccaggaggccgagcagatcagcatccaggagcgggtgaacctgtttggcttctggagccgcttcaacggcagcaacagcaatggagagaggaaggacctgcagctgagcggcctgaacagccctggcagctgcctggagaatggcaaggagcggcggccccgggagttccgcttctag

SEQ ID NO: 43938 - DNA, 1947 bp, Artificial Sequence
  Description of Artificial Sequence: Synthetic coding sequence
atgatgaccaccctgcagaacaaggaggagtgtgggaagggccccaagaggatctttgcccccccagcccagaagagctacagcctgctgccctgcagccccaacagccccaaggaggagaccccaggcatcagcagccctgagacagaggcccgcatcagcctgcccaaggccagcctgaagaagaaggaggagaaggccaccatgaagaatgtgcccagccgggagcaggagaagaagaggaaggcccagatcaacaagcaggccgagaagaaggagaaggagaagagcagcctgaccaatgctgagtttgaggagatcgtgcagatcgtgctgcagaagagcctgcaggagtgcctgggcatgggcagcggcctggactttgctgagaccagctgtgcccagcctgtggtgtccacccagagcgacaaggagcccggcatcacagccagcgccacagacacagacaatgccaatggagaggaggtgccccacacccaggagatctctgtgtcctgggagggggaggccgcccctgagatccgcaccagcaagctgggccagcctgaccctgcccccagcaagaagaagagcaaccggctgaccctgagcaagaggaagaaggaggcccacgagaaggtggagaagacccagggcggccacgagcaccggcaggaggaccggctgaagaagacagtgcaggaccacagccagatccgggaccagcagaagggggagatcagcggcttcggccagtgcctggtgtgggtgcagtgcagcttccccaactgtgggaagtggaggcggctgtgtggcaacatcgaccccagcgtgctgcctgacaactggagctgtgaccagaacacagatgtgcagtacaacagatgtgacatccctgaggagacctggacaggcctggagagtgatgtggcctatgccagctacatccctggcagcatcatctgggccaagcagtatggctacccctggtggccaggcatgattgaaagtgaccctgacctgggggagtacttcctgttcaccagccacctggacagcctgcccagcaagtaccacgtgaccttctttggagagaccgtgtcccgggcctggatccctgtgaacatgctgaagaacttccaggagctgagcctggagctgtctgtgatgaagaagagaagaaatgactgcagccagaagctgggcgtggccctgatgatggcccaggaggccgagcagatcagcatccaggagcgggtgaacctgtttggcttctggagccgcttcaacggcagcaacagcaatggagagaggaaggacctgcagctgagcggcctgaacagccctggcagctgcctggagaagaaggagaaggaggaggagctggagaaggaggagggggagaagacagaccccatcctgcccatcaggaagagggtgaagatccagacccagaagaccaagccccggggcctgggcggagatgctggaacagcagatggccggggccgcaccctgcagaggaagatcatgaagaggagcctgggcaggaagagcacagcccccccagcccccaggatgggcaggaaggagggccagggcaacagcgacagcgaccagcccggccccaagaagaagttcaaggccccccagagcaaggccctggccgccagcttcagcgagggcaaggaggtgaggacagtgcccaagaacctgggcctgagcgcctgcaagggggcctgccccagcagcgccaaggaggagcccaggcaccgggagcccctgacccaggaggccggctctgtgcccctggaggatgaggccagcagtgacctggacctggagcagctgatggaggatgtgggccgggagctgggccagagcggggagctgcagcacagcaacagtgatggagaggacttccctgtggccctgtttgggaagtag

SEQ ID NO: 43939 - DNA, 1071 bp, Artificial Sequence
  Description of Artificial Sequence: Synthetic coding sequence
atggacaaggagaagctggatgtgaagattgagtactgcaactatgccatggacagctctgtggagaacatgtatgtgaacaaggtgtgggtgcagtgtgaaaatgaaaactgcctgaagtggaggctgctgagcagtgaagattctgccaaggtggaccatgatgagccctggtactgcttcatgaacacagacagccgctacaacaactgcagcatcagcgaggaggacttccctgaggagagccagctgcaccagtgtggcttcaagatcgtgtacagccagctgcccctgggcagcctggtgctggtgaagctgcagaactggcccagctggccaggcatcctgtgcccagaccgcttcaagggcaagtatgtgacctatgaccctgatggaaatgtggaggagtaccacatcgagttcctgggggacccccacagccgctcctggatcaaggccacctttgtgggccactacagcatcaccctgaagccagagaagtgcaagaacaagaagaagtggtacaagagcgccctgcaggaggcctgcctgctgtatggctacagccatgagcagaggctggagatgtgctgcctgagcaagctgcaggacaagtctgagacccatgacaaggtggccgccctggtgaagaagaggaagcagaccagcaagaacaacatcgagaagaagaagcccaagttcaggaagaggaagaggaaggccatcctgaagtgcagctttgaaaatgtgtacagtgatgatgccctgagcaaagaaaatagagtggtgtgtgaaacagaggtgctgctgaaggagctggagcagatgctgcagcaggccctgcagcccacagccaccccagatgagagcgaggagggccacggggaggagatcaacatgggagagaagctgagcaagtgcagccctgaggccccagctggcagcctgtttgagaaccactatgaggaggactacctggtgattgatggcatcaagctgaaggctggagaatgtattgaggacatcaccaacaagttcaaggagattgatgccctgatgtctgagttctag

SEQ ID NO: 43940 - DNA, 384 bp, Artificial Sequence
  Description of Artificial Sequence: Synthetic coding sequence
atggacaaggagaagctggatgtgaagattgagtactgcaactatgccatggacagctctgtggagaacatgtatgtgaacaaggtgtgggtgcagtgtgaaaatgaaaactgcctgaagtggaggctgctgagcagtgaagattctgccaaggtggaccatgatgagccctggtactgcttcatgaacacagacagccgctacaacaactgcagcatcagcgaggaggacttccctgaggagagccagctgcaccagtgtggcttcaagatcgtgtacagccagctgcccctgggcagcctggtgctggtgaagctgcagaactggcccagctggccaggcatcctgtgcccagaccgcttcaagggcaagtatgtgacctag

SEQ ID NO: 43941 - DNA, 1071 bp, Artificial Sequence; identical to SEQ ID NO: 43939
  Description of Artificial Sequence: Synthetic coding sequence

SEQ ID NO: 43942 - DNA, 7065 bp, Artificial Sequence
  Description of Artificial Sequence: Synthetic coding sequence
atgcagaagaggcagggctactgcagctactgccgggtgcagtacaacaacctggagcagcacctgttcagcgcccagcacaggagcctgacccggcagagccggcggcagatctgcaccagcagcctgatggagcgcttcctgcaggatgtgctgcagcaccacccctaccactgccaggagagcagcagcacccaggatgagacccacgtgaacacaggcagcagcagcgaggtggtgcacctggatgatgccttcagcgaggaggaggaggaggatgaggacaaggtggaggatgaagatgccacagaggagcggcccagcgaggtgtctgagcccatcgaggagctgcacagccggccccacaagagccaggagggcacccaggaggtgtctgtgcggcccagcgtcatccagaagctggagaagggccagcagcagcccctggagtttgtgcacaagattggagcctctgtgaggaagtgcaacctggtggacatcggccaggccaccaacaacagaagcaacctggtgcggccccctgtgatctgcaatgccccagccagctgcctgcctgagagcagcaatgacaggcctgtgacagccaacaccaccagcctgcccccagctgcccacctggacagcgtgtccaaatgtgaccccaacaaggtggagaagtacctggagcagccagatggagccagcaggaaccctgtgcccagcagccacgtggagaccaccagcttctcctaccagaagcacaaggagagcaacaggaagagcctgaggatgaacagcgacaagctggtgctgtggaaggatgtgaagagccagggcaagaccctgtctgctggcctgaagttccacgagaggatgggcaccaagggcagcctgcgggtgaagagccccagcaagctggccgtgaaccccaacaagacagacatgcccagcaacaagggcatctttgaggacaccatcgccaagaaccacgaggagttcttcagcaacatggactgcacccaggaggagaagcacctggtgttcaacaagacagccttctgggagcagaagtgcagcgtgagcagcgagatgaagtttgactgcatcagcctgcagagcgccagtgaccagccccaggagacagcccaggacctgagcctgtggaaggaggagcagattgaccaggaggacaactatgagagccggggcagcgagatgagctttgactgcagcagcagcttccacagcctgacagaccagagcaaggtgtctgccaaggaggtgaacctgagcaaggaggtgaggacagatgtgcagtacaagaacaacaagagctatgtgtccaagatcagcagtgactgtgatgacatcctgcacctggtgaccaaccagagccagatgattgtgaaggagatcagcctgcagaatgcccggcacatcagcctggtggaccagagctatgagagcagcagcagcgagaccaactttgactgtgatgccagcccccagagcaccagtgactacccccagcagagcgtgacagaggtgaacctgcccaaggaggtgcacatcggcctggtggacaagaactacggcagcagcagcagcgaggtgtctgctgacagcgtcttccccctgcagagcgtggtggacaggcctcctgtggccgtgacagagaccaagctgaggaagaaggcccacaccagcctggtggacaactacggcagcagctgcagcgagaccagctttgactgtgatgtgtccctggagagcgtggtggaccacccccagctgactgtgaagggcaggaacctgaagggccggcaggtgcacctgaagcacaagaagaggaagcccagcagcgccaaggcccacctggactgtgatgtgtccctgggcaccgtggctgatgagagccagagagctgtggagaagatcaacctgctgaaggagaagaatgctgacctgatggacatgaactgtgagagccacggccctgagatgggcttccaggctgatgcccagctggccgaccagagccaggtggccgagattgagcggcagaaggtggatgtggacctggagaacaagtctgtgcagagcagccgcagcagcctgagcagtgacagccctgccagcctgtaccacagcgcccatgatgagccccaggaggccctggatgaggtgaacctgaaggagctgaacatcgacatggaggtgcgctcctatgactgcagcagcagcgagctgacctttgacagcgacccccccctgctgtctgtgacagagcagagccacctggatgctgagggcaaggagcggcacatcgacctggaggatgagagctgtgagagtgacagcagcgagatcacctttgacagcgacatccccctgtacagcgtcatcgaccagcctgaggtggccgtgtatgaggaggagaccgtggacctggagagcaagagcaatgaaagctgtgtgtctgagatcacctttgacagcgacatccccctgcacagcggaaatgaccaccctgaggtggccgtgaaggaggtgatccagaaggaggagtacatccacctggagaggaagaatgatgagcccagcggcagcgagatcagcagtgacagccacgcccccctgcacagcgtgaccaacagccctgaggtggccgtgaagaagctgaacccccagaaggaggagcaggtgcacctggagaacaaggaaaatgagcccatcgacagcgaggtgtccctggactacaacatcatcttccacagcgtgacaggccgctctgaggaccccatcaaggagatcagcctgcacaccaaggagcacatgtacctggagaacaagtctgtgtttgagaccagcctggacagtgatgtgcccctgcaggccgccacccacaagccagaggtgattgtgaaggagacctggctgcagcgggagaagcacgccgagttccagggccgcagcacagagttcagcggcagcaagaccagcctggacagcggcgtgccccactacagcgtgacagagccccaggtggccgtgaacaagatcaacaggaagaagcagtatgtgctggagaacaagaatgacaagtgcagcggcagcgagatcatcctggacagcaatgtgcccccccagagcatgacagaccagccccagctggccttcctgaaggagaagcacgtgaacctgaaggacaagaacagcaagagcggggacagcaagatcacctttgacagcgagcagctgcaggaggccgtgaagaagattgaccagtggaaggaggaggtgattggcctgaagaacaagatcaatgagcccagcacctacaagctgatccaccacccagatgtgtctgtgcagagcgtggccgaccagcccaaggtggccatcaagcacgtgaacctgggcaatgaaaaccacatgtacctggaggtgaagaacagccagtacagctgcagcgagatgaacctggacagcggcttcctgggccagagcatcgtgaaccggccccagatcaccatcctggagcaggagcacatcgagctggagggcaagcacaaccagtgctgcggcagcgaggtgtcctttgacagtgatgaccccctgcagagcgtggccgaccggctgcgggagaccgtgaaggagatcagcctgtggaaggatgaggaggtggacacagaggacagaagaaatgaggccaagggctttgagatcatgtatgacagtgatgtgctgcagcctgtggccggccagcctgaggaggtggtgaaggaggtgtccctgtggaaggagcacgtggacctggagaacaagatcgtgaagcccacagacagccgcatcaactttgacagccatgagcccctgcagagcgtgaccaacaagatccctggggccaacaaggagatcaacctgctgcgggaggagcacgtgtgcctggatgacaagggctacgtgcccagcgacagcgagatcatctacgtgagcaacatccccctgcagagcgtcatcaagcagccccacatcctggaggaggagcacgccagcctggaggacaagagcagcaacagctacagccctgaggagagcagtgacagcaatgacagcttccaggccgctgctgatgagctgcagaagcctgtgaaggagatcaacctgtggaaggaggaccacatctacctggaggacaagagctacaagctgggggactttgatgtgtcctatgccagccacatccctgtgcagtttgtgacagaccagagctctgtgcctgtgaaggagatcaacctgcagaagaaggaccacaatgacctggagaacaagaactgtgaggtgtgtggcagcgagatcaagtgccacagctgtgtgcacctgcagagcgaggtggaccagccccaggtgtcctacaaggaggccgacctgcagaaggaggagcacgtggtgatggaggagaagacagaccagcccagcgacagcgagatgatgtatgacagtgatgtgcccttccagatcgtggtgaaccagtttcctggctctgtgaaggagacccacctgcccaaggtggtgctggtggacctggtgcctggggacagcgactatgaagtcatcagtgatgacatccccctgcagctggtgacagaccccccccagctgactgtgaaggacatcagctgcatcaacacagagtgcatcgacatcgaggacaagagctgtgacttcttcggcagcgaggtgcgctgcaactgcaaggccagcacccccagcatgaccaaccagtgcaaggagaccttcaagatcatcaacaggaagaaggactacatcatcctgggggagcccagctgccagagctgtggcagcgagatgaacttcaacgtggatgccagtgaccagagcatgacctatgagagccagggcccagatgagaagatggtgaagtacattgattctgaggacaagagctgtggctacaacggcagcaagggcaagttcaacctggaggacaccagccacaggaccacccaccggctgcagaaggcccacaaggaggccagcctgaggaaggaccccagaaatgccggcctgaagggcaagagctgccagagcagcgccagcgctgtggactttggagccagcagcaagagcgccctgcaccggcgggctgacaagaagaagaggagcaagctgaagcaccgggacctggaggtgtcctgtgagccagatggctttgagatgaacttccagtgtgccccacccctgcccagcgacacagaccagccccaggagaccgtgaagaagaggcacccctgcaagaaggtgtccagtgacctgaaggagaagaaccacgacagccagagcagctctgtgctgaaggtggacagcgtgaggaacctgaagaaggccaaggatgtgattgaggacaacccagatgagcctgtgctggaggccctgccccacgtgccccccagctttgtgggcaagacctggagccagatcatgagagaagatgacatcaagatcaatgccctggtgaaggagttccgggagggccgcttccactgctactttgatgatgactgtgagaccaagaaggtgagcagcaagggcaagaagaaggtgacctgggccgacctgcagggcaaggaggacacagcccccacccaggccgtgtctgagagtgatgacatcgtgtgtggcatcagtgacattgatgacctgtctgtggccctggacaagccctgccaccgccaccccccagctgagcggccccccaagcagaagggccgggtggccagccagtgccagacagccaagatcagccacagcacccagaccagctgcaagaactaccctgtgatgaagaggaagatcatccggcaggaggaggacccccccaagagcaagtgcagccggctgcaggatgacaggaagaccaagaagaaggtgaagattggaacagtggagttccctgccagctgcaccaaggtgctgaagcccatgcagcccaaggccctggtgtgtgtgctgagcagcctgaacatcaagctgaaggagggggagggcctgcccttccccaagatgaggcaccacagctgggacaatgacatccgcttcatctgcaagtacaagaggaacatctttgactactatgagcccctcatcaagcagatcgtcatcagcccccccctgtctgtgattgtgcctgagtttgaaagaagaaactgggtgaagatccacttcaacagaagcaaccagaacagcagcgctggggacaatgatgctgatggccagggcagcgccagcgcccccctgatggctgtgcctgcccgctatggcttcaacagccaccagggcaccagtgacagcagcctcttcctggaggagagcaaggtgctgcacgcccgggagctgcccaagaagaggaacttccagctgaccttcctgaaccatgatgtggtgaagatcagccccaagtctgtgaggaacaagctgctggagagccagagcaagaagaagatccacggcaagagggtgaccaccagcagcaacaagctgggcttccccaagaaggtgtacaagcccatcatcctgcagcagaagcccaggaaggccagcgagaagcagagcatctggatccgcaccaagcccagcgacatcatcaggaagtacatcagcaagtacagcgtcttcctgcggcaccgctaccagagccgcagcgccttcctgggccgctacctgaagaagaagaagtctgtggtgtcccggctgaagaaggccaagaggacagccaaggtgctgctgaacagctctgtgcccccagctggagctgaggagctgagcagcgccatggccaaccccccacccaagaggcctgtgcgggccagctgccgggtggcccggcggaggaagaagacagatgagagctaccacggccggcagaagggccccagcacccctgtgcgggcctatgacctgcggagcagcagctgcctgcagcagcgggagaggatgatgacccggctggccaacaagctgcggggaaatgaggtgaagtag

SEQ ID NO: 43943 - DNA, 1116 bp, Artificial Sequence
  Description of Artificial Sequence: Synthetic coding sequence
atggacaccaggagcggcagccagtgcagcgtgaccccagaggccatcagaaataatgaggagctggtgctgcccccacgcatcagccgggtgaatggctggagcctgcccctgcactacttccgggtggtgacctgggccgtgtttgtgggcctgagcctggccaccttccgcatcttcatccccctgctgccccacagctggaagtacatcgcctacgtggtgactggaggcatcttctccttccacctggtggtgcacctgattgccagctgcattgatcctgctgacagcaatgtgcggctgatgaagaactacagccagcccatgcccctgtttgacaggagcaagcacgcccacgtgatccagaaccagttctgccacctgtgcaaggtgacagtgaacaagaagaccaagcactgcatcagctgcaacaagtgtgtgtctggctttgaccaccactgcaagtggatcaacaactgtgtgggcagcaggaactactggttcttcttcagcacagtggccagcgccacagctggcatgctgtgcctgattgccatcctgctgtatgtgctggtgcagtacctggtgaacccccgggtgctgaggacagaccccaggtatgaagatgtgaagaacatgaacacctggctgctcttcctgcccctcttccctgtgcaggtgcagaccctcatcgtggtgatcatccgcatgctggtgctgctgctggacctgctgggcctggtgcagctgggccagctgctgatcttccacatctacctgaaggccaagaagatgaccacctttgagtacctgatcaacaccaggaaggaggagagcagcaagcaccaggccgtgaggaaggacccctacgtgcagatggacaagggcttcctgcagcagggcgctggggccctgggcagcagcgcccagggcgtgaaggccaagagcagcctgctgatctacaagtgcccctgccacttctgcacctctgtgaaccaggatggagacagcaaggcccaggaggctgatgatgcccccagcaccagcaccctgggcctgcagcaggagaccacagagcccatgaagacagacagcgctgagagcgaggactag

SEQ ID NO: 43944 - DNA, 1212 bp, Artificial Sequence
  Description of Artificial Sequence: Synthetic coding sequence
atgaactatgacagccagcagccccccctgccccccctgccctatgccggctgcagaagagccagcggcttccctgccctgggccggggcggcaccgtgcctgtgggcgtgtggggcggggccggccagggccgggagggccgctcctggggcgagggcccccggggccctggcctgggcagaagagacctgagcagcgctgaccctgctgtgctgggcgccaccatggagagccgctgctacggctgtgctgtgaagttcaccctcttcaagaaggagtatggctgcaagaactgtggccgggccttctgcagcggctgcctgtccttctctgctgctgtgcccaggactggaaacacccagcagaaggtgtgcaagcagtgccacgaggtgctgacccggggcagcagcgccaatgccagcaagtggagccccccccagaactacaagaagagggtggccgccctggaggccaagcagaagcccagcaccagccagagccagggcctgacccggcaggaccagatgattgctgagcggctggcccggctgcggcaggagaacaagcccaagctggtgcccagccaggccgagattgaggcccggctggccgccctgaaggatgagcggcagggcagcatccccagcacccaggagatggaggcccggctggccgccctgcagggccgggtgctgcccagccagaccccccagcctgcccaccacaccccagacaccaggacccaggcccagcagacccaggacctgctgacccagctggccgctgaggtggccattgatgagagctggaagggcggcggccctgtgaccctgcaggactaccgcctgcctgacagtgatgatgatgaagatgaggagacagccatccagagggtgctgcagcagctgacagaggaggccagcctggatgaggccagcggcttcaacatcccagctgagcaggccagccggccctggacccagcccagaggagctgagcctgaggcccaggatgtggaccccaggcctgaggccgaggaggaggagctgccctggtgctgcatctgcaatgaagatgccaccctgcgctgtgccggctgtgatggagacctcttctgtgcccgctgcttccgggagggccatgatgcctttgagctgaaggagcaccagaccagcgcctacagcccccccagggctggccaggagcactag

SEQ ID NO: 43945 - DNA, 1386 bp, Artificial Sequence
  Description of Artificial Sequence: Synthetic coding sequence
atgcctgctgtggccgaggccctgggccaggagggccccccagacctgagccgcagcgccttcctggccaccgtgctgaccagcctgtctgctgccttcagctccatgcccagcagcgcctacagcctgcccttcagccgcagcctggagctggactaccacaccagcagctgcttccggggcaccatggtgaaggctgactgccctgtgcccatcacagacctgcctgacagcagcggcaagctgcagtatggctgcaagaactgtggccgggccttctgcagcggctgcctgtccttctctgctgctgtgcccaggactggaaacacccagcagaaggtgtgcaagcagtgccacgaggtgctgacccggggcagcagcgccaatgccagcaagtggagccccccccagaactacaagaagagggtggccgccctggaggccaagcagaagcccagcaccagccagagccagggcctgacccggcaggaccagatgattgctgagcggctggcccggctgcggcaggagaacaagcccaagctggtgcccagccaggccgagattgaggcccggctggccgccctgaaggatgagcggcagggcagcatccccagcacccaggagatggaggcccggctggccgccctgcagggccgggtgctgcccagccagaccccccagcctgcccaccacaccccagacaccaggacccaggcccagcagacccaggacctgctgacccagctggccgctgaggtggccattgatgagagctggaagggcggcggccctgctgccagcctgcagaatgacctgaaccagggcggccctggcagcaccaacagcaagaggcaggccaactggagcctggaggaggagaagagccggctgctggccgaggccgccctggagctgcgggaggagaacacccggcaggagcgcatcctggccctggccaagaggctggccatgctgcggggccaggaccctgagcgggtgaccctgcaggactaccgcctgcctgacagtgatgatgatgaagatgaggagacagccatccagagggtgctgcagcagctgacagaggaggccagcctggatgaggccagcggcttcaacatcccagctgagcaggccagccggccctggacccagcccagaggagctgagcctgaggcccaggatgtggaccccaggcctgaggccgaggaggaggagctgccctggtgctgcatctgcaatgaagatgccaccctgcgctgtgccggctgtgatggagacctcttctgtgcccgctgcttccgggagggccatgatgcctttgagctgaaggagcaccagaccagcgcctacagcccccccagggctggccaggagcactag

SEQ ID NO: 43946 - DNA, 1416 bp, Artificial Sequence
  Description of Artificial Sequence: Synthetic coding sequence
atgaactatgacagccagcagccccccctgccccccctgccctatgccggctgcagaagagccagcggcttccctgccctgggccggggcggcaccgtgcctgtgggcgtgtggggcggggccggccagggccgggagggccgctcctggggcgagggcccccggggccctggcctgggcagaagagacctgagcagcgctgaccctgctgtgctgggcgccaccatggagagccgctgctacggctgtgctgtgaagttcaccctcttcaagaaggagtatggctgcaagaactgtggccgggccttctgcagcggctgcctgtccttctctgctgctgtgcccaggactggaaacacccagcagaaggtgtgcaagcagtgccacgaggtgctgacccggggcagcagcgccaatgccagcaagtggagccccccccagaactacaagaagagggtggccgccctggaggccaagcagaagcccagcaccagccagagccagggcctgacccggcaggaccagatgattgctgagcggctggcccggctgcggcaggagaacaagcccaagctggtgcccagccaggccgagattgaggcccggctggccgccctgaaggatgagcggcagggcagcatccccagcacccaggagatggaggcccggctggccgccctgcagggccgggtgctgcccagccagaccccccagcctgcccaccacaccccagacaccaggacccaggcccagcagacccaggacctgctgacccagctggccgctgaggtggccattgatgagagctggaagggcggcggccctgctgccagcctgcagaatgacctgaaccagggcggccctggcagcaccaacagcaagaggcaggccaactggagcctggaggaggagaagagccggctgctggccgaggccgccctggagctgcgggaggagaacacccggcaggagcgcatcctggccctggccaagaggctggccatgctgcggggccaggaccctgagcgggtgaccctgcaggactaccgcctgcctgacagtgatgatgatgaagatgaggagacagccatccagagggtgctgcagcagctgacagaggaggccagcctggatgaggccagcggcttcaacatcccagctgagcaggccagccggccctggacccagcccagaggagctgagcctgaggcccaggatgtggaccccaggcctgaggccgaggaggaggagctgccctggtgctgcatctgcaatgaagatgccaccctgcgctgtgccggctgtgatggagacctcttctgtgcccgctgcttccgggagggccatgatgcctttgagctgaaggagcaccagaccagcgcctacagcccccccagggctggccaggagcactag

SEQ ID NO: 43947 - DNA, 465 bp, Artificial Sequence
  Description of Artificial Sequence: Synthetic coding sequence
atggtggagaagaagacctctgtgcgcagccaggaccccggccagaggagagtgctggaccgggccgcccggcagaggcgcatcaaccggcagctggaggccctggagaatgacaacttccaggatgacccccacgccggcctgccccagctgggcaagaggctgccccagtttgatgatgatgctgacaccgggaagaagaagaagaagaccaggggggaccacttcaagctgcgcttcaggaagaacttccaggccctgctggaggagcagaacctgtctgtggccgagggccccaactacctgacagcctgtgccggcccccccagccggccccagaggcccttctgtgctgtgtgtggcttccccagcccctacacctgtgtgtcctgtggggcccgctactgcaccgtgcgctgcctgggcacccaccaggagacccgctgcctgaagtggacagtgtag

SEQ ID NO: 43948 - DNA, 1413 bp, Artificial Sequence
  Description of Artificial Sequence: Synthetic coding sequence
atggagtttgctgctgaaaatgaaggcaagagcggcggcggcctgcacagcgtggccgagggcgtgcggctgagccctgagcccggccgggagggcgtgcgggacctggccggggctgaggagtttggaggaggagaggagggcaccggcctgaccggcatcaaggagattggagatggagaggagggcagcggccagaggcctgaggagatccccatggacctgactgtggtgaagcaggagatcatcgactggccaggcacagagggccgcctggccggccagtgggtggagcaggaggtggaggacaggcctgaggtgaaggatgaaaatgctggggtgctggaggtgaagcaggagacagacagcagcctggtggtgaaggaggccaaggtgggggagcctgaggtgaaggaggagaaggtgaaggaggaggtgatggactggagcgaggtgaaggaggagaaggacaacctggagatcaagcaggaggagaagtttgtgggccagtgcatcaaggaggagctgatgcacggggagtgtgtgaaggaggagaaggacttcctgaagaaggagatcgtggatgacaccaaggtgaaggaggagccccccatcaaccaccctgtgggctgcaagaggaagctggccatgagccgctgtgagacctgtggcacagaggaggccaagtaccgctgcccccgctgcatgagatacagctgcagcctgccctgtgtgaagaagcacaaggccgagctgacctgcaatggagtgcgggacaagacagcctacatcagcatccagcagttcacagagatgaacctgctgagtgactaccgcttcctggaggatgtggccaggacagctgaccacatcagcagagatgccttcctgaagaggcccatcagcaacaagtacatgtacttcatgaagaacagagcccggcggcagggcatcaacctgaagctgctgcccaacggcttcaccaagaggaaggagaacagcaccttctttgacaagaagaagcagcagttctgctggcacgtgaagctgcagttcccccagagccaggccgagtacatcgagaagagggtgcctgatgacaagaccatcaatgagatcctgaagccctacatcgaccctgagaagagtgaccctgtgatccggcagaggctgaaggcctacatccgcagccagacaggagtgcagatcctgatgaagattgagtacatgcagcagaacctggtgcgctactatgagctggacccctacaagagcctgctggacaacctgaggaacaaggtgatcatcgagtaccccaccctgcacgtggtgctgaagggcagcaacaatgacatgaaggtgctgcaccaggtgaagtctgagagcaccaagaatgtgggcaatgaaaattag

SEQ ID NO: 43949 - DNA, 1296 bp, Artificial Sequence
  Description of Artificial Sequence: Synthetic coding sequence
atggagtttgctgctgaaaatgaaggcaagagcggcggcggcctgcacagcgtggccgagggcgtgcggctgagccctgagcccggccgggagggcgtgcgggacctggccggggctgaggagtttggaggaggagaggagggcaccggcctgaccggcatcaaggagattggagatggagaggagggcagcggccagaggcctgaggagatccccatggacctgactgtggtgaagcaggagacagacagcagcctggtggtgaaggaggccaaggtgggggagcctgaggtgaaggaggagaaggtgaaggaggaggtgatggactggagcgaggtgaaggaggagaaggacaacctggagatcaagcaggaggagaagtttgtgggccagtgcatcaaggaggagctgatgcatggagaatgtgtgaaggaggagaaggacttcctgaagaaggagatcgtggatgacaccaaggtgaaggaggagccccccatcaaccaccctgtgggctgcaagaggaagctggccatgagccgctgtgagacctgtggcacagaggaggccaagtaccgctgcccccgctgcatgagatacagctgcagcctgccctgtgtgaagaagcacaaggccgagctgacctgcaatggagtgcgggacaagacagcctacatcagcatccagcagttcacagagatgaacctgctgagtgactaccgcttcctggaggatgtggccaggacagctgaccacatcagcagagatgccttcctgaagaggcccatcagcaacaagtacatgtacttcatgaagaacagagcccggcggcagggcatcaacctgaagctgctgcccaacggcttcaccaagaggaaagaaaacagcaccttctttgacaagaagaagcagcagttctgctggcacgtgaagctgcagttcccccagagccaggccgagtacatcgagaagagggtgcctgatgacaagaccatcaatgagatcctgaagccctacattgatcctgagaagagtgaccccgtcatccggcagaggctgaaggcctacatccgcagccagacaggagtgcagatcctgatgaagattgagtacatgcagcagaacctggtgcgctactatgagctggacccctacaagagcctgctggacaacctgaggaacaaggtgatcatcgagtaccccaccctgcacgtggtgctgaagggcagcaacaatgacatgaaggtgctgcaccaggtgaagtctgagagcaccaagaatgtgggcaatgaaaattag

SEQ ID NO: 43950 - DNA, 4647 bp, Artificial Sequence
  Description of Artificial Sequence: Synthetic coding sequence
atggccgagcgggaggtggagagcggccccaggaagagatttgagcagaagagcggggctgtgtttgatgaaattgtggagaactgtggcggcatcatggacacagagatgtctgaagatattgaccacaacctgacccccaccctggacagcatgtcctatggcatgcccaaccagacaggcagcgagaacagcctgctggatgaagatgactacttcctgaacagcggggacctggccggcatccctgtggtgggcagtgacaatgaagatgagcaggacttcagcagcaaggacaacctggtgagcagcatccacacagatgacagcctggaggtggagaggagagtgacccagcacgagagtgacaatgaaaatgagatccagatccagaacaagctgaagaaggacttccccaagcagtttgaccaggtgtctgtgttcaagagcatcaggaaggacttcagcctggtgcgggagaacagcaaggagaccttcagcggcaaggagaagaacagagacctgacctatgagcgggagaagaggctggacaagccccacaaggacctggacagccggctgaagagcagcttctttgacaaggccgccaaccaggtggaggagaccctgcacacccacctgccccagaccccagagaccaacttccgggacagcagctacccctttgccaacaaggagagcatcggcagcgagctgggcaacagctttgccagcaacatccgcatcaaggaggagcccctggatgatgaatatgacaaggccatggccccccagcagggcctgctggacaagatcaaggatgagccagacaatgcccaggagtacagccacggccagcagcagaagacccaggagggggagctgaagatctctgctgtgttttctgtgtctggcagccccctggccccccagctgaccaccggcttccagcccagcctggccagcagcggcatgaacaagatgctgcccagcgtgcctgccacagctgtgcgggtgtcctgcagcggctgcaagaagatcctgcagaagggccagacagcctaccagaggaagggcagcacccagctgttctgcagcaccctgtgcctgaccggctacacagtgcccccagcccggcccccaccacccctgaccaagaagacctgcagcagctgcagcaaggacatcctgaaccccaaggatgtgatcagcgcccagtttgagaacaccaccaccagcaaggacttctgcagccagagctgcctgagcacctatgagctgaagaagaagcccatcgtgaccatcaacaccaacagcatcagcaccaagtgcagcatgtgccagaagaatgctgtgatcagacatgaggtgaactaccagaatgtggtgcacaagctgtgcagtgatgcctgcttcagcaagttccgcagcgccaacaacctgaccatgaactgctgtgagaactgtggcggctactgctacagcggcagcggccagtgccacatgctgcagatcgagggccagagcaagaagttctgcagcagcagctgcatcacagcctacaagcagaagagcgccaagatcaccccctgtgccctgtgcaagagcctgcggagcagcgctgagatgattgagaacaccaacagcctgggcaagacagagctgttctgcagcgtgaactgcctgagcgcctacagagtgaagatggtgaccagcgctggggtgcaggtgcagtgcaacagctgcaagaccagcgccatcccccagtaccacctggccatgtctgatggcagcatccggaacttctgcagctacagctgtgtggtggccttccagaacctcttcaacaagcccaccggcatgaacagctctgtggtgcccctgagccagggccaggtgattgtgtccatccccaccggcagcacagtgtctgctgggggcggcagcaccagcgctgtgagccccaccagcatcagcagcagcgctgctgctggcctgcagaggctggccgcccagagccagcacgtgggctttgcccggtctgtggtgaagctgaagtgccagcactgcaacagactctttgccaccaagccagagctgctggactacaagggcaagatgttccagttctgtgggaagaactgcagtgatgagtacaagaagatcaacaacgtgatggccatgtgtgagtactgcaagattgagaagatcgtgaaggagaccgtgcgcttctctggagctgacaagagcttctgcagcgagggctgcaagctgctgtacaagcatgacctggccaagcgctggggcaaccactgcaagatgtgcagctactgcctgcagaccagccccaagctggtgcagaacaacctgggcggcaaggtggaggagttctgctgtgaggagtgcatgagcaagtacacagtgctcttctaccagatggccaagtgtgatgcctgcaagaggcagggcaagctgtctgagagcctgaagtggagaggagagatgaagcacttctgcaacctgctgtgcatcctgatgttctgcaaccagcagagcgtgtgtgacccccccagccagaacaatgctgccaacatctccatggtgcaggccgccagcgctggcccccccagcctgaggaaggacagcacccctgtgattgccaacgtggtgtccctggccagcgccccagctgcccagcccaccgtgaacagcaacagcgtgctgcagggcgctgtgcccaccgtgacagccaagatcattggagatgccagcacccagacagatgccctgaagctgccccccagccagcccccccggctgctgaagaacaaggccctgctgtgcaagcccatcacccagaccaaggccaccagctgcaagccccacacccagaacaaggagtgccagacagaggacacccccagccagccccagatcatcgtggtgcctgtgcctgtgcctgtgtttgtgcccatccccctgcacctgtacacccagtatgcccctgtgcccttcggcatccctgtgcccatgcctgtgcccatgctgatccccagctccatggattctgaggacaaggtgacagagagcattgaggacatcaaggagaagctgcccacccacccctttgaagctgacctgctggagatggccgagatgattgctgaagatgaggagaagaagaccctgagccagggcgagagccagaccagcgagcacgagctgttcctggacaccaagatctttgagaaggaccagggcagcacctacagcggggacctggagagcgaggccgtgtccaccccccacagctgggaggaggagctgaaccactacgccctgaagagcaatgctgtgcaggaggccgacagcgagctgaagcagttcagcaaaggagaaacagagcaggacctggaggccgacttccccagcgacagctttgaccccctgaacaagggccagggcatccaggcccggagcaggacccggcggcggcacagagatggcttcccccagcccaggagaagaggaaggaagaagagcatcgtggccgtggagcccaggagcctcatccagggcgccttccagggctgcagcgtgtctggcatgaccctgaagtacatgtatggagtgaatgcctggaagaactgggtgcagtggaagaatgccaaggaggagcagggcgacctgaagtgtggcggcgtggagcaggccagcagcagccccaggagtgaccccctgggcagcacccaggaccacgccctgagccaggagagcagcgagcccggctgccgggtgcgcagcatcaagctgaaggaggacatcctgagctgcacctttgctgagctgagcctgggcctgtgccagttcatccaggaggtgagaagacccaacggggagaagtatgaccctgacagcatcctgtacctgtgcctgggcatccagcagtacctgtttgaaaatggaagaattgacaacatcttcacagagccctacagccgcttcatgattgagctgaccaagctgctgaagatctgggagcccaccatcctgcccaacggctacatgttcagccgcatcgaggaggagcacctgtgggagtgcaagcagctgggcgcctacagccccatcgtgctgctgaacaccctgctcttcttcaacaccaagtacttccagctgaagaatgtgacagagcacctgaagctgagctttgcccacgtgatgaggaggaccaggaccctgaagtacagcaccaagatgacctacctgcgcttcttcccccccctgcagaagcaggagagcgagccagacaagctgactgtgggcaagaggaagagaaatgaagatgatgaggtgcctgtgggcgtggagatggccgagaacacagacaaccccctgcgctgccctgtgcggctgtatgagttctacctgagcaaatgttctgagagcgtgaagcagagaaatgatgtgttctacctgcagcctgagaggagctgtgtgcccaacagccccatgtggtacagcaccttccccatcgaccccggcaccctggacaccatgctgacccgcatcctgatggtgcgggaggtgcatgaggagctggccaaggccaagtctgaggacagtgatgtggagctgagtgactag

SEQ ID NO: 43951 - DNA, 4380 bp, Artificial Sequence
  Description of Artificial Sequence: Synthetic coding sequence
atggccgagcgggaggtggagagcggccccaggaagagatttgagcagaagagcggggctgtgtttgatgaaattgtggagaactgtggcggcatcatggacacagagatgtctgaagatattgaccacaacctgacccccaccctggacagcatgtcctatggcatgcccaaccagacaggcagcgagaacagcctgctggatgaagatgactacttcctgaacagcggggacctggccggcatccctgtggtgggcagtgacaatgaagatgagcaggacttcagcagcaaggacaacctggtgagcagcatccacacagatgacagcctggaggtggagaggagagtgacccagcacgagagtgacaatgaaaatgagatccagatccagaacaagctgaagaaggacttccccaagcagtttgaccaggtgtctgtgttcaagagcatcaggaaggacttcagcctggtgcgggagaacagcaaggagaccttcagcggcaaggagaagaacagagacctgacctatgagcgggagaagaggctggacaagccccacaaggacctggacagccggctgaagagcagcttctttgacaaggccgccaaccaggtggaggagaccctgcacacccacctgccccagaccccagagaccaacttccgggacagcagctacccctttgccaacaaggagagcatcggcagcgagctgggcaacagctttgccagcaacatccgcatcaaggaggagcccctggatgatgaatatgacaaggccatggccccccagcagggcctgctggacaagatcaaggatgagccagacaatgcccaggagtacagccacggccagcagcagaagacccaggagggggagctgaagatctctgctgtgttttctgtgtctggcagccccctggccccccagctgaccaccggcttccagcccagcctggccagcagcggcatgaacaagatgctgcccagcgtgcctgccacagctgtgcgggtgtcctgcagcggctgcaagaagatcctgcagaagggccagacagcctaccagaggaagggcagcacccagctgttctgcagcaccctgtgcctgaccggctacacagtgcccccagcccggcccccaccacccctgaccaagaagacctgcagcagctgcagcaaggacatcctgaaccccaaggatgtgatcagcgcccagtttgagaacaccaccaccagcaaggacttctgcagccagagctgcctgagcacctatgagctgaagaagaagcccatcgtgaccatcaacaccaacagcatcagcaccaagtgcagcatgtgccagaagaatgctgtgatcagacatgaggtgaactaccagaatgtggtgcacaagctgtgcagtgatgcctgcttcagcaagttccgcagcgccaacaacctgaccatgaactgctgtgagaactgtggcggctactgctacagcggcagcggccagtgccacatgctgcagatcgagggccagagcaagaagttctgcagcagcagctgcatcacagcctacaagcagaacctcttcaacaagcccaccggcatgaacagctctgtggtgcccctgagccagggccaggtgattgtgtccatccccaccggcagcacagtgtctgctgggggcggcagcaccagcgctgtgagccccaccagcatcagcagcagcgctgctgctggcctgcagaggctggccgcccagagccagcacgtgggctttgcccggtctgtggtgaagctgaagtgccagcactgcaaccggctgtttgccaccaagccagagctgctggactacaagggcaagatgttccagttctgtgggaagaactgcagtgatgagtacaagaagatcaacaacgtgatggccatgtgtgagtactgcaagattgagaagatcgtgaaggagaccgtgcgcttcagcggggctgacaagagcttctgcagcgagggctgcaagctgctgtacaagcatgacctggccaagcgctggggcaaccactgcaagatgtgcagctactgcctgcagaccagccccaagctggtgcagaacaacctgggcggcaaggtggaggagttctgctgtgaggagtgcatgagcaagtacacagtgctcttctaccagatggccaagtgtgatgcctgcaagaggcagggcaagctgtctgagagcctgaagtggagaggagagatgaagcacttctgcaacctgctgtgcatcctgatgttctgcaaccagcagagcgtgtgtgacccccccagccagaacaatgctgccaacatctccatggtgcaggccgccagcgctggcccccccagcctgaggaaggacagcacccctgtgattgccaacgtggtgtccctggccagcgccccagctgcccagcccaccgtgaacagcaacagcgtgctgcagggcgctgtgcccaccgtgacagccaagatcattggagatgccagcacccagacagatgccctgaagctgccccccagccagcccccccggctgctgaagaacaaggccctgctgtgcaagcccatcacccagaccaaggccaccagctgcaagccccacacccagaacaaggagtgccagacagaggacacccccagccagccccagatcatcgtggtgcctgtgcctgtgcctgtgtttgtgcccatccccctgcacctgtacacccagtatgcccctgtgcccttcggcatccctgtgcccatgcctgtgcccatgctgatccccagctccatggacagcgaggacaaggtgacagagagcattgaggacatcaaggagaagctgcccacccacccctttgaggccgacctgctggagatggccgagatgattgctgaagatgaggagaagaagaccctgagccagggcgagagccagaccagcgagcacgagctgttcctggacaccaagatctttgagaaggaccagggcagcacctacagcggggacctggagagcgaggccgtgtccaccccccacagctgggaggaggagctgaaccactacgccctgaagagcaatgctgtgcaggaggccgacagcgagctgaagcagttcagcaagggggagacagagcaggacctggaggccgacttccccagcgacagctttgaccccctgaacaagggccagggcatccaggcccggagcaggaccaggagaagacacagagatggcttcccccagccccggcggcggggcaggaagaagagcatcgtggccgtggagcccaggagcctcatccagggcgccttccagggctgcagcgtgtctggcatgaccctgaagtacatgtatggagtgaatgcctggaagaactgggtgcagtggaagaatgccaaggaggagcagggcgacctgaagtgtggcggcgtggagcaggccagcagcagccccaggagtgaccccctgggcagcacccaggaccacgccctgagccaggagagcagcgagcccggctgccgggtgcgcagcatcaagctgaaggaggacatcctgagctgcacctttgctgagctgagcctgggcctgtgccagttcatccaggaggtgcggcggcccaatggagagaagtatgaccctgacagcatcctgtacctgtgcctgggcatccagcagtacctgtttgaaaatggaagaattgacaacatcttcacagagccctacagccgcttcatgattgagctgaccaagctgctgaagatctgggagcccaccatcctgcccaacggctacatgttcagcagaattgaggaggagcacctgtgggagtgcaagcagctgggcgcctacagccccatcgtgctgctgaacaccctgctcttcttcaacaccaagtacttccagctgaagaatgtgacagagcacctgaagctgagctttgcccacgtgatgaggaggaccaggaccctgaagtacagcaccaagatgacctacctgcgcttcttcccccccctgcagaagcaggagagcgagccagacaagctgactgtgggcaagaggaagagaaatgaagatgatgaggtgcctgtgggcgtggagatggctgaaaatacagacaaccccctgcgctgccctgtgcggctgtatgagttctacctgagcaagtgcagcgagagcgtgaagcagagaaatgatgtgttctacctgcagcctgagaggagctgtgtgcccaacagccccatgtggtacagcaccttccccattgatcctggcaccctggacaccatgctgacccgcatcctgatggtgcgggaggtgcatgaggagctggccaaggccaagtcagaagattctgatgtggagctgagtgactag

SEQ ID NO: 43952 - DNA, 297 bp, Artificial Sequence
  Description of Artificial Sequence: Synthetic coding sequence
atggacacagagatgtctgaagatattgaccacaacctgacccccaccctggacagcatgtcctatggcatgcccaaccagacaggcagcgagaacagcctgctggatgaagatgactacttcctgaacagcggggacctggccggcatccctgtggtgggcagtgacaatgaagatgagcaggacttcagcagcaaggacaacctggtgagcagcatccacacagatgacagcctggaggtggagaggagagtgacccagcacgagagtgacaatgaaaatgagatccagatctag

SEQ ID NO: 43953 - DNA, 3624 bp, Artificial Sequence
  Description of Artificial Sequence: Synthetic coding sequence
tgacccctggatgatgaatatgacaaggccatggccccccagcagggcctgctggacaagatcaaggatgagccagacaatgcccaggagtacagccacggccagcagcagaagacccaggagggggagctgaagatctctgctgtgttttctgtgtctggcagccccctggccccccagctgaccaccggcttccagcccagcctggccagcagcggcatgaacaagatgctgcccagcgtgcctgccacagctgtgcgggtgtcctgcagcggctgcaagaagatcctgcagaagggccagacagcctaccagaggaagggcagcacccagctgttctgcagcaccctgtgcctgaccggctacacagtgcccccagcccggcccccaccacccctgaccaagaagacctgcagcagctgcagcaaggacatcctgaaccccaaggatgtgatcagcgcccagtttgagaacaccaccaccagcaaggacttctgcagccagagctgcctgagcacctatgagctgaagaagaagcccatcgtgaccatcaacaccaacagcatcagcaccaagtgcagcatgtgccagaagaatgctgtgatcagacatgaggtgaactaccagaatgtggtgcacaagctgtgcagtgatgcctgcttcagcaagttccgcagcgccaacaacctgaccatgaactgctgtgagaactgtggcggctactgctacagcggcagcggccagtgccacatgctgcagatcgagggccagagcaagaagttctgcagcagcagctgcatcacagcctacaagcagaacctcttcaacaagcccaccggcatgaacagctctgtggtgcccctgagccagggccaggtgattgtgtccatccccaccggcagcacagtgtctgctgggggcggcagcaccagcgctgtgagccccaccagcatcagcagcagcgctgctgctggcctgcagaggctggccgcccagagccagcacgtgggctttgcccggtctgtggtgaagctgaagtgccagcactgcaacagactctttgccaccaagccagagctgctggactacaagggcaagatgttccagttctgtgggaagaactgcagtgatgagtacaagaagatcaacaacgtgatggccatgtgtgagtactgcaagattgagaagatcgtgaaggagaccgtgcgcttctctggagctgacaagagcttctgcagcgagggctgcaagctgctgtacaagcatgacctggccaagcgctggggcaaccactgcaagatgtgcagctactgcctgcagaccagccccaagctggtgcagaacaacctgggcggcaaggtggaggagttctgctgtgaggagtgcatgagcaagtacacagtgctcttctaccagatggccaagtgtgatgcctgcaagaggcagggcaagctgtctgagagcctgaagtggagaggagagatgaagcacttctgcaacctgctgtgcatcctgatgttctgcaaccagcagagcgtgtgtgacccccccagccagaacaatgctgccaacatctccatggtgcaggccgccagcgctggcccccccagcctgaggaaggacagcacccctgtgattgccaacgtggtgtccctggccagcgccccagctgcccagcccaccgtgaacagcaacagcgtgctgcagggcgctgtgcccaccgtgacagccaagatcattggagatgccagcacccagacagatgccctgaagctgccccccagccagcccccccggctgctgaagaacaaggccctgctgtgcaagcccatcacccagaccaaggccaccagctgcaagccccacacccagaacaaggagtgccagacagacacccccagccagccccagatcatcgtggtgcctgtgcctgtgcctgtgtttgtgcccatccccctgcacctgtacacccagtatgcccctgtgcccttcggcatccctgtgcccatgcctgtgcccatgctgatccccagctccatggacagcgaggacaaggtgacagagagcattgaggacatcaaggagaagctgcccacccacccctttgaggccgacctgctggagatggccgagatgattgctgaagatgaggagaagaagaccctgagccagggcgagagccagaccagcgagcacgagctgttcctggacaccaagatctttgagaaggaccagggcagcacctacagcggggacctggagagcgaggccgtgtccaccccccacagctgggaggaggagctgaaccactacgccctgaagagcaatgctgtgcaggaggccgacagcgagctgaagcagttcagcaagggggagacagagcaggacctggaggccgacttccccagcgacagctttgaccccctgaacaagggccagggcatccaggcccggagcaggaccaggagaagacacagagatggcttcccccagccccggcggcggggcaggaagaagagcatcgtggccgtggagcccaggagcctcatccagggcgccttccagggctgcagcgtgtctggcatgaccctgaagtacatgtatggagtgaatgcctggaagaactgggtgcagtggaagaatgccaaggaggagcagggcgacctgaagtgtggcggcgtggagcaggccagcagcagccccaggagtgaccccctgggcagcacccaggaccacgccctgagccaggagagcagcgagcccggctgccgggtgcgcagcatcaagctgaaggaggacatcctgagctgcacctttgctgagctgagcctgggcctgtgccagttcatccaggaggtgcggcggcccaatggagagaagtatgaccctgacagcatcctgtacctgtgcctgggcatccagcagtacctgtttgaaaatggaagaattgacaacatcttcacagagccctacagccgcttcatgattgagctgaccaagctgctgaagatctgggagcccaccatcctgcccaacggctacatgttcagcagaattgaggaggagcacctgtgggagtgcaagcagctgggcgcctacagccccatcgtgctgctgaacaccctgctcttcttcaacaccaagtacttccagctgaagaatgtgacagagcacctgaagctgagctttgcccacgtgatgaggaggaccaggaccctgaagtacagcaccaagatgacctacctgcgcttcttcccccccctgcagaagcaggagagcgagccagacaagctgactgtgggcaagaggaagagaaatgaagatgatgaggtgcctgtgggcgtggagatggctgaaaatacagacaaccccctgcgctgccctgtgcggctgtatgagttctacctgagcaagtgcagcgagagcgtgaagcagagaaatgatgtgttctacctgcagcctgagaggagctgtgtgcccaacagccccatgtggtacagcaccttccccattgatcctggcaccctggacaccatgctgacccgcatcctgatggtgcgggaggtgcatgaggagctggccaaggccaagtcagaagattctgatgtggagctgagtgactag

SEQ ID NO: 43954 - DNA, 1098 bp, Artificial Sequence
  Description of Artificial Sequence: Synthetic coding sequence
atgaatgtcatctaccccctggccgtgcccaagggccgccgcctgtgctgtgaggtgtgtgaggccccagctgagcgggtgtgtgccgcctgcaccgtgacctactactgcggcgtggtgcaccagaaggctgactgggacagcatccacgagaagatctgccagctgctgatccccctgcggacctccatgcccttctacaacagcgaggaggagcggcagcacggcctgcagcagctgcagcagaggcagaagtacctgattgagttctgctacaccatcgcccagaagtacctgtttgagggcaagcatgaagatgctgtgcctgctgccctgcagagcctgcgcttccgggtgaagctgtatggcctgagctctgtggagctggtgcctgcctacctgctgctggccgaggccagcctgggcctgggccgcatcgtgcaggccgaggagtacctgttccaggcccagtggacagtgctgaagagcacagactgcagcaatgccacccacagcctgctgcacaggaacctgggcctgctgtacatcgccaagaagaactatgaggaggcccgctaccacctggccaatgacatctactttgccagctgtgccttcggcacagaggacatccgcaccagcggcggctacttccacctggccaacatcttctatgacctgaagaagctggacctggccgacaccctgtacaccaaggtgtctgagatctggcacgcctacctgaacaaccactaccaggtgctgagccaggcccacatccagcagatggacctgctgggcaagctgtttgaaaatgacaccggcctggatgaggcccaggaggccgaggccatccgcatcctgaccagcatcctgaacatccgggagagcaccagtgacaaggccccccagaagaccatctttgtgctgaagatcctggtgatgttctactacctgatgatgaacagcagcaaggcccaggagtatggcatgagggccctgagcctggccaaggagcagcagctggatgtgcatgagcagagcaccatccaggagctgctgagcctcatcagcacagaggaccaccccatcacctag

SEQ ID NO: 43955 - DNA, 768 bp, Artificial Sequence
  Description of Artificial Sequence: Synthetic coding sequence
atgtctgccctggacagcacagcccacttccacgccctgctgcagttccggggccgcacagctgcctggccagctgctgctgctgctgctgctggcctgggccgcatcgtgcaggccgaggagtacctgttccaggcccagtggacagtgctgaagagcacagactgcagcaatgccacccacagcctgctgcacaggaacctgggcctgctgtacatcgccaagaagaactatgaggaggcccgctaccacctggccaatgacatctactttgccagctgtgccttcggcacagaggacatccgcaccagcggcggctacttccacctggccaacatcttctatgacctgaagaagctggacctggccgacaccctgtacaccaaggtgtctgagatctggcacgcctacctgaacaaccactaccaggtgctgagccaggcccacatccagcagatggacctgctgggcaagctgtttgaaaatgacaccggcctggatgaggcccaggaggccgaggccatccgcatcctgaccagcatcctgaacatccgggagagcaccagtgacaaggccccccagaagaccatctttgtgctgaagatcctggtgatgttctactacctgatgatgaacagcagcaaggcccaggagtatggcatgagggccctgagcctggccaaggagcagcagctggatgtgcatgagcagagcaccatccaggagctgctgagcctcatcagcacagaggaccaccccatcacctag

SEQ ID NO: 43956 - DNA, 1383 bp, Artificial Sequence
  Description of Artificial Sequence: Synthetic coding sequence
atggcccccaggagcagaagaagaagacacaagaagccacccagctctgtggcccccatcatcatggcccccaccaccatcgtgacccctgtgcccctgacccccagcaagccaggccccagcattgacaccctgggcttcttcagcctggatgacaacgtgcccggcctgagccagctgatcctgcagaagctgaacatgaagagctatgaggagtacaagctggtggtggatggcggcacccctgtgtctggcttcggcttccgctgcccccaggagatgttccagaggatggaggacaccttccgcttctgtgcccactgccgggccctgcccagcggcctgagtgacagcaaggtgctgcggcactgcaagcgctgcagaaatgtgtactactgcggccctgagtgccagaagagtgactggccagcccaccggcgggtgtgccaggagctgcggctggtggccgtggaccggctgatggagtggctgctggtgactggagactttgtgctgcccagcggcccctggccctggcccccagaggccgtgcaggactgggacagctggttctccatgaagggcctgcacctggatgccaccctggatgctgtgctggtgtcccatgctgtgaccaccctgtgggcctctgtgggccggcccaggccagaccctgatgtgctgcagggcagcctgaagaggctgctgacagatgtgctgagccggcccctgaccctgggcctgggcctgcgggccctgggcattgatgtgcggaggactggaggcagcacagtgcacgtggtgggcgccagccacgtggagaccttcctgaccaggcctggggactatgatgagctgggctacatgtttcctggccacctgggcctgcgggtggtgatggtgggcgtggatgtggccaccggcttcagccagagcaccagcaccagccccctggagcccggcaccatccagctgagcgcccaccggggcctgtaccatgacttctgggaggagcaggtggagaccggccagacccaccacccagacctggtggccgccttccaccctggcttccacagcagcccagacctgatggaggcctggctgcccaccctgctgctgctgcgggactacaagatccccaccctcatcaccgtgtacagccaccaggagctggtgagcagcctgcagatcctggtggagctggacacccacatcacagccttcggcagcaaccccttcatgagcctgaagccagagcaggtgtacagcagccccaacaagcagcctgtgtactgcagcgcctactacatcatgttcctgggcagcagctgccagctggacaaccggcagctggaggagaaggtggatggcggcatctag

SEQ ID NO: 43957 - DNA, 1383 bp, Artificial Sequence; identical to SEQ ID NO: 43956
  Description of Artificial Sequence: Synthetic coding sequence

SEQ ID NO: 43958 - DNA, 3240 bp, Artificial Sequence
  Description of Artificial Sequence: Synthetic coding sequence
atgccccgggtgcacaacatcaagaagagcctgaccccccacatcagctgtgtgaccaatgaaagtgacaacctgctggacttcctgcctgaccggctgcgggccaagctgctgcccttccagaaggatggcatcatctttgccctgaagagaaatggccgctgcatggtggctgatgagatgggcctgggcaagaccatccaggccatcggcatcacctacttctacaaggaggagtggcccctgctgattgtggtgcccagcagcctgcgctacccctggacagaggagattgagaagtggatccctgagctgagccctgaggagatcaacgtcatccagaacaagacagatgtgcggaggatgagcaccagcaaggtgacagtgctgggctacggcctgctgacagcagatgccaagaccctgattgatgccctgaacaaccagaacttcaaggtggtgattgtggatgagagccactacatgaagagcagaaatgccaccaggagccgcatcctgctgcccatcgtgcagaaggcccggcgggccatcctgctgaccggcaccccagccctgggccggcctgaggagctgttcatgcagatcgaggccctcttcccccagaagtttggccgctggacagattatgccaagcgctactgcaatgcccacatccgctactttgggaagaggccccagtgggactgccgcggggccagcaacctgaatgagctgcaccagctgctgagtgacatcatgatccggcggctgaagacagaggtgctgacccagctgccccccaaggtgcggcagaggatcccctttgacctgcccagcgctgctgccaaggagctgaacaccagctttgaggagtgggagaagatcatgaggacccccaacagcggggccatggagaccgtgatgggcctcatcaccaggatgttcaagcagacagccatcgccaaggccggggctgtgaaggactacatcaagatgatgctgcagaatgacagcctgaagttcctggtgtttgcccaccacctgtccatgctgcaggcctgcacagaagctgtgattgagaacaagacccgctacatcagaattgatggctctgtgagcagcagcgagcgcatccacctggtgaaccagttccagaaggaccctgacaccagggtggccatcctgagcatccaggccgccggccagggcctgaccttcaccgctgccagccacgtggtgtttgctgagctgtactgggaccccggccacatcaagcaggccgaggaccgggcccaccgcatcggccagtgcagctctgtgaacatccactacctgattgccaacggcaccctggacaccctgatgtggggcatgctgaacaggaaggcccaggtgacaggcagcaccctgaatggaaggaaggagaagatccaggccgaggagggggacaaggagaagtgggacttcctgcagtttgctgaggcctggaccccaaatgacagcagcgaggagctgaggaaggaggccctcttcacccactttgagaaggagaagcagcacgacatccgctccttctttgtgccccagcccaagaagaggcagctgatgaccagctgtgatgagagcaagcgcttccgggaggagaacacagtggtgtccagtgaccccaccaagacagctgcccgggacatcattgattatgaaagtgatgtggagcctgagaccaagaggctgaagctggccgccagcgaggaccactgcagccccagcgaggagacccccagccagagcaagcagatccgcacccccctggtggagagcgtgcaggaggccaaggcccagctgaccaccccagccttccctgtggagggctggcagtgcagcctgtgcacctacatcaacaacagcgagctgccctactgtgagatgtgtgagaccccccagggcagcgctgtgatgcagattgacagcctgaaccacatccaggacaagaatgagaaggatgacagccagaaggacaccagcaagaaggtgcagaccatcagtgactgtgagaagcaggccctggcccagagcgagcccggccagctggccgacagcaaggaggagacccccaagattgagaaggaggatggcctgaccagccagcctggaaatgagcagtggaagagcagtgacaccctgcctgtgtatgacaccctgatgttctgtgccagcaggaacacagaccgcatccacatctacaccaaggatggcaagcagatgagctgcaacttcatccccctggacatcaagctggacctgtgggaggacctgcctgccagcttccagctgaagcagtaccgcagcctcatcctgcgctttgtgcgggagtggagcagcctgacagccatgaagcagaggatcatcaggaagagcggccagctgttctgcagccccatcctggccctggaggagatcaccaagcagcagaccaagcagaactgcaccaagcgctacatcaccaaggaggatgtggccgtggcctccatggacaaggtgaagaatgtgggcggccacgtgcggctcatcaccaaggagagccggccccgggaccccttcaccaagaagctgctggaggatggagcctgtgtgcccttcctgaacccctacacagtgcaggccgacctgactgtgaagcccagcaccagcaagggctacctgcaggccgtggacaatgaaggcaaccccctgtgcctgcgctgccagcagcccacctgccagaccaagcaggcctgcaaggccaacagctgggacagccgcttctgcagcctgaagtgccaggaggagttctggatccgcagcaacaacagctacctgcgggccaaggtgtttgaaacagagcacggcgtgtgccagctgtgcaatgtgaatgcccaggagctgttcctgcggctgagagatgcccccaagagccagaggaagaacctgctgtatgccacctggaccagcaagctgcccctggagcagctgaatgagatgatcagaaatcctggagagggccacttctggcaggtggaccacatcaagcctgtgtatggaggcggcggccagtgcagcctggacaacctgcagaccctgtgcaccgtgtgccacaaggagaggacagcccggcaggccaaggagaggagccaggtgcggcggcagagcctggccagcaagcacggcagtgacatcacccgcttcctggtgaagaagtag

SEQ ID NO: 43959 - DNA, 1797 bp, Artificial Sequence
  Description of Artificial Sequence: Synthetic coding sequence
atgaccagctgtgatgagagcaagcgcttccgggaggagaacacagtggtgtccagtgaccccaccaagacagctgcccgggacatcatcgactatgaaagtgatgtggagcctgagaccaagaggctgaagctggccgccagcgaggaccactgcagccccagcgaggagacccccagccagagcaagcagatccgcacccccctggtggagagcgtgcaggaggccaaggcccagctgaccaccccagccttccctgtggagggctggcagtgcagcctgtgcacctacatcaacaacagcgagctgccctactgtgagatgtgtgagaccccccagggcagcgctgtgatgcagattgacagcctgaaccacatccaggacaagaatgagaaggatgacagccagaaggacaccagcaagaaggtgcagaccatcagtgactgtgagaagcaggccctggcccagagcgagcccggccagctggccgacagcaaggaggagacccccaagattgagaaggaggatggcctgaccagccagcctgagcagtggaagagcagtgacaccctgcctgtgtatgacaccctgatgttctgtgccagcaggaacacagaccgcatccacatctacaccaaggatggcaagcagatgagctgcaacttcatccccctggacatcaagctggacctgtgggaggacctgcctgccagcttccagctgaagcagtaccgcagcctcatcctgcgctttgtgcgggagtggagcagcctgacagccatgaagcagaggatcatcaggaagagcggccagctgttctgcagccccatcctggccctggaggagatcaccaagcagcagaccaagcagaactgcaccaagcgctacatcaccaaggaggatgtggccgtggcctccatggacaaggtgaagaatgtgggcggccacgtgcggctcatcaccaaggagagccggccccgggaccccttcaccaagaagctgctggaggatggagcctgtgtgcccttcctgaacccctacacagtgcaggccgacctgactgtgaagcccagcaccagcaagggctacctgcaggccgtggacaatgaaggcaaccccctgtgcctgcgctgccagcagcccacctgccagaccaagcaggcctgcaaggccaacagctgggacagccgcttctgcagcctgaagtgccaggaggagttctggatccgcagcaacaacagctacctgcgggccaaggtgtttgaaacagaacatggagtgtgccagctgtgcaatgtgaatgcccaggagctgttcctgcggctgagagatgcccccaagagccagaggaagaacctgctgtatgccacctggaccagcaagctgcccctggagcagctgaatgagatgatccggaaccctggagagggccacttctggcaggtggaccacatcaagcctgtgtatggaggcggcggccagtgcagcctggacaacctgcagaccctgtgcaccgtgtgccacaaggagaggacagcccggcaggccaaggagaggagccaggtgcggcggcagagcctggccagcaagcacggcagtgacatcacccgcttcctggtgaagaagaagctgcacgagagccacaaggtgactggagctgagcagggcctgcaggtgtctggcctgcctgattctgctgcccctgagggcggggccgcccacaccaatgaccagaggcgctgccagaggatgaagcagcccctgacagaggtgcagatcctgagccacagcagctag

SEQ ID NO: 43960 - DNA, 1107 bp, Artificial Sequence
  Description of Artificial Sequence: Synthetic coding sequence
atgggcctgggcaagaccatccaggccatcggcatcacctacttctacaaggaggagtggcccctgctgattgtggtgcccagcagcctgcgctacccctggacagaggagattgagaagtggatccctgagctgagccctgaggagatcaacgtcatccagaacaagacagatgtgcggaggatgagcaccagcaaggtgacagtgctgggctacggcctgctgacagcagatgccaagaccctgattgatgccctgaacaaccagaacttcaaggtggtgattgtggatgagagccactacatgaagagcagaaatgccaccaggagccgcatcctgctgcccatcgtgcagaaggcccggcgggccatcctgctgaccggcaccccagccctgggccggcctgaggagctgttcatgcagatcgaggccctcttcccccagaagtttggccgctggacagattatgccaagcgctactgcaatgcccacatccgctactttgggaagaggccccagtgggactgccgcggggccagcaacctgaatgagctgcaccagctgctgagtgacatcatgatccggcggctgaagacagaggtgctgacccagctgccccccaaggtgcggcagaggatcccctttgacctgcccagcgctgctgccaaggagctgaacaccagctttgaggagtgggagaagatcatgaggacccccaacagcggggccatggagaccgtgatgggcctcatcaccaggatgttcaagcagacagccatcgccaaggccggggctgtgaaggactacatcaagatgatgctgcagaatgacagcctgaagttcctggtgtttgcccaccacctgtccatgctgcaggcctgcacagaagctgtgattgagaacaagacccgctacatcagaattgatggctctgtgagcagcagcgagcgcatccacctggtgaaccagttccagaaggaccctgacaccagggtggccatcctgagcatccaggccgccggccaggacctgtatgacaaggtggcctggggcaagaggaccctggtgtctggcctcttcatggagtgcttctgctttgtgccctag

SEQ ID NO: 43961 - DNA, 3234 bp, Artificial Sequence
  Description of Artificial Sequence: Synthetic coding sequence
atgccccgggtgcacaacatcaagaagagcctgaccccccacatcagctgtgtgaccaatgaaagtgacaacctgctggacttcctgcctgaccggctgcgggccaagctgctgcccttccagaaggatggcatcatctttgccctgaagagaaatggccgctgcatggtggctgatgagatgggcctgggcaagaccatccaggccatcggcatcacctacttctacaaggaggagtggcccctgctgattgtggtgcccagcagcctgcgctacccctggacagaggagattgagaagtggatccctgagctgagccctgaggagatcaacgtcatccagaacaagacagatgtgcggaggatgagcaccagcaaggtgacagtgctgggctacggcctgctgacagcagatgccaagaccctgattgatgccctgaacaaccagaacttcaaggtggtgattgtggatgagagccactacatgaagagcagaaatgccaccaggagccgcatcctgctgcccatcgtgcagaaggcccggcgggccatcctgctgaccggcaccccagccctgggccggcctgaggagctgttcatgcagatcgaggccctcttcccccagaagtttggccgctggacagattatgccaagcgctactgcaatgcccacatccgctactttgggaagaggccccagtgggactgccgcggggccagcaacctgaatgagctgcaccagctgctgagtgacatcatgatccggcggctgaagacagaggtgctgacccagctgccccccaaggtgcggcagaggatcccctttgacctgcccagcgctgctgccaaggagctgaacaccagctttgaggagtgggagaagatcatgaggacccccaacagcggggccatggagaccgtgatgggcctcatcaccaggatgttcaagcagacagccatcgccaaggccggggctgtgaaggactacatcaagatgatgctgcagaatgacagcctgaagttcctggtgtttgcccaccacctgtccatgctgcaggcctgcacagaagctgtgattgagaacaagacccgctacatcagaattgatggctctgtgagcagcagcgagcgcatccacctggtgaaccagttccagaaggaccctgacaccagggtggccatcctgagcatccaggccgccggccagggcctgaccttcaccgctgccagccacgtggtgtttgctgagctgtactgggaccccggccacatcaagcaggccgaggaccgggcccaccgcatcggccagtgcagctctgtgaacatccactacctgattgccaacggcaccctggacaccctgatgtggggcatgctgaacaggaaggcccaggtgacaggcagcaccctgaatggaaggaaggagaagatccaggccgaggagggggacaaggagaagtgggacttcctgcagtttgctgaggcctggaccccaaatgacagcagcgaggagctgaggaaggaggccctcttcacccactttgagaaggagaagcagcacgacatccgctccttctttgtgccccagcccaagaagaggcagctgatgaccagctgtgatgagagcaagcgcttccgggaggagaacacagtggtgtccagtgaccccaccaagacagctgcccgggacatcattgattatgaaagtgatgtggagcctgagaccaagaggctgaagctggccgccagcgaggaccactgcagccccagcgaggagacccccagccagagcaagcagatccgcacccccctggtggagagcgtgcaggaggccaaggcccagctgaccaccccagccttccctgtggagggctggcagtgcagcctgtgcacctacatcaacaacagcgagctgccctactgtgagatgtgtgagaccccccagggcagcgctgtgatgcagattgacagcctgaaccacatccaggacaagaatgagaaggatgacagccagaaggacaccagcaagaaggtgcagaccatcagtgactgtgagaagcaggccctggcccagagcgagcccggccagctggccgacagcaaggaggagacccccaagattgagaaggaggatggcctgaccagccagcctgagcagtggaagagcagtgacaccctgcctgtgtatgacaccctgatgttctgtgccagcaggaacacagaccgcatccacatctacaccaaggatggcaagcagatgagctgcaacttcatccccctggacatcaagctggacctgtgggaggacctgcctgccagcttccagctgaagcagtaccgcagcctcatcctgcgctttgtgcgggagtggagcagcctgacagccatgaagcagaggatcatcaggaagagcggccagctgttctgcagccccatcctggccctggaggagatcaccaagcagcagaccaagcagaactgcaccaagcgctacatcaccaaggaggatgtggccgtggcctccatggacaaggtgaagaatgtgggcggccacgtgcggctcatcaccaaggagagccggccccgggaccccttcaccaagaagctgctggaggatggagcctgtgtgcccttcctgaacccctacacagtgcaggccgacctgactgtgaagcccagcaccagcaagggctacctgcaggccgtggacaatgaaggcaaccccctgtgcctgcgctgccagcagcccacctgccagaccaagcaggcctgcaaggccaacagctgggacagccgcttctgcagcctgaagtgccaggaggagttctggatccgcagcaacaacagctacctgcgggccaaggtgtttgaaacagagcacggcgtgtgccagctgtgcaatgtgaatgcccaggagctgttcctgcggctgagagatgcccccaagagccagaggaagaacctgctgtatgccacctggaccagcaagctgcccctggagcagctgaatgagatgatcagaaatcctggagagggccacttctggcaggtggaccacatcaagcctgtgtatggaggcggcggccagtgcagcctggacaacctgcagaccctgtgcaccgtgtgccacaaggagaggacagcccggcaggccaaggagaggagccaggtgcggcggcagagcctggccagcaagcacggcagtgacatcacccgcttcctggtgaagaagtag

SEQ ID NO: 43962 - DNA, 1797 bp, Artificial Sequence
  Description of Artificial Sequence: Synthetic coding sequence
atgaccagctgtgatgagagcaagcgcttccgggaggagaacacagtggtgtccagtgaccccaccaagacagctgcccgggacatcatcgactatgaaagtgatgtggagcctgagaccaagaggctgaagctggccgccagcgaggaccactgcagccccagcgaggagacccccagccagagcaagcagatccgcacccccctggtggagagcgtgcaggaggccaaggcccagctgaccaccccagccttccctgtggagggctggcagtgcagcctgtgcacctacatcaacaacagcgagctgccctactgtgagatgtgtgagaccccccagggcagcgctgtgatgcagattgacagcctgaaccacatccaggacaagaatgagaaggatgacagccagaaggacaccagcaagaaggtgcagaccatcagtgactgtgagaagcaggccctggcccagagcgagcccggccagctggccgacagcaaggaggagacccccaagattgagaaggaggatggcctgaccagccagcctgagcagtggaagagcagtgacaccctgcctgtgtatgacaccctgatgttctgtgccagcaggaacacagaccgcatccacatctacaccaaggatggcaagcagatgagctgcaacttcatccccctggacatcaagctggacctgtgggaggacctgcctgccagcttccagctgaagcagtaccgcagcctcatcctgcgctttgtgcgggagtggagcagcctgacagccatgaagcagaggatcatcaggaagagcggccagctgttctgcagccccatcctggccctggaggagatcaccaagcagcagaccaagcagaactgcaccaagcgctacatcaccaaggaggatgtggccgtggcctccatggacaaggtgaagaatgtgggcggccacgtgcggctcatcaccaaggagagccggccccgggaccccttcaccaagaagctgctggaggatggagcctgtgtgcccttcctgaacccctacacagtgcaggccgacctgactgtgaagcccagcaccagcaagggctacctgcaggccgtggacaatgaaggcaaccccctgtgcctgcgctgccagcagcccacctgccagaccaagcaggcctgcaaggccaacagctgggacagccgcttctgcagcctgaagtgccaggaggagttctggatccgcagcaacaacagctacctgcgggccaaggtgtttgaaacagaacatggagtgtgccagctgtgcaatgtgaatgcccaggagctgttcctgcggctgagagatgcccccaagagccagaggaagaacctgctgtatgccacctggaccagcaagctgcccctggagcagctgaatgagatgatccggaaccctggagagggccacttctggcaggtggaccacatcaagcctgtgtatggaggcggcggccagtgcagcctggacaacctgcagaccctgtgcaccgtgtgccacaaggagaggacagcccggcaggccaaggagaggagccaggtgcggcggcagagcctggccagcaagcacggcagtgacatcacccgcttcctggagaccagcaagctgcacgagagccacaaggtgactggagctgagcagggcctgcaggtgtctggcctgcctgattctgctgcccctgagggcggggccgcccacaccaatgaccagaggcgctgccagaggatgaagcagcccctgacagaggtgcagatcctgagccacagcagctag

SEQ ID NO: 43963 - DNA, 3234 bp, Artificial Sequence
  Description of Artificial Sequence: Synthetic coding sequence
atgccccgggtgcacaacatcaagaagagcctgaccccccacatcagctgtgtgaccaatgaaagtgacaacctgctggacttcctgcctgaccggctgcgggccaagctgctgcccttccagaaggatggcatcatctttgccctgaagagaaatggcagcagaattgactgtgaccagatgggcctgggcaagaccatccaggccatcggcatcacctacttctacaaggaggagtggcccctgctgattgtggtgcccagcagcctgcgctacccctggacagaggagattgagaagtggatccctgagctgagccctgaggagatcaacgtcatccagaacaagacagatgtgcggaggatgagcaccagcaaggtgacagtgctgggctacggcctgctgacagcagatgccaagaccctgattgatgccctgaacaaccagaacttcaaggtggtgattgtggatgagagccactacatgaagagcagaaatgccaccaggagccgcatcctgctgcccatcgtgcagaaggcccggcgggccatcctgctgaccggcaccccagccctgggccggcctgaggagctgttcatgcagatcgaggccctcttcccccagaagtttggccgctggacagattatgccaagcgctactgcaatgcccacatccgctactttgggaagaggccccagtgggactgccgcggggccagcaacctgaatgagctgcaccagctgctgagtgacatcatgatccggcggctgaagacagaggtgctgacccagctgccccccaaggtgcggcagaggatcccctttgacctgcccagcgctgctgccaaggagctgaacaccagctttgaggagtgggagaagatcatgaggacccccaacagcggggccatggagaccgtgatgggcctcatcaccaggatgttcaagcagacagccatcgccaaggccggggctgtgaaggactacatcaagatgatgctgcagaatgacagcctgaagttcctggtgtttgcccaccacctgtccatgctgcaggcctgcacagaagctgtgattgagaacaagacccgctacatcagaattgatggctctgtgagcagcagcgagcgcatccacctggtgaaccagttccagaaggaccctgacaccagggtggccatcctgagcatccaggccgccggccagggcctgaccttcaccgctgccagccacgtggtgtttgctgagctgtactgggaccccggccacatcaagcaggccgaggaccgggcccaccgcatcggccagtgcagctctgtgaacatccactacctgattgccaacggcaccctggacaccctgatgtggggcatgctgaacaggaaggcccaggtgacaggcagcaccctgaatggaaggaaggagaagatccaggccgaggagggggacaaggagaagtgggacttcctgcagtttgctgaggcctggaccccaaatgacagcagcgaggagctgaggaaggaggccctcttcacccactttgagaaggagaagcagcacgacatccgctccttctttgtgccccagcccaagaagaggcagctgatgaccagctgtgatgagagcaagcgcttccgggaggagaacacagtggtgtccagtgaccccaccaagacagctgcccgggacatcattgattatgaaagtgatgtggagcctgagaccaagaggctgaagctggccgccagcgaggaccactgcagccccagcgaggagacccccagccagagcaagcagatccgcacccccctggtggagagcgtgcaggaggccaaggcccagctgaccaccccagccttccctgtggagggctggcagtgcagcctgtgcacctacatcaacaacagcgagctgccctactgtgagatgtgtgagaccccccagggcagcgctgtgatgcagattgacagcctgaaccacatccaggacaagaatgagaaggatgacagccagaaggacaccagcaagaaggtgcagaccatcagtgactgtgagaagcaggccctggcccagagcgagcccggccagctggccgacagcaaggaggagacccccaagattgagaaggaggatggcctgaccagccagcctgagcagtggaagagcagtgacaccctgcctgtgtatgacaccctgatgttctgtgccagcaggaacacagaccgcatccacatctacaccaaggatggcaagcagatgagctgcaacttcatccccctggacatcaagctggacctgtgggaggacctgcctgccagcttccagctgaagcagtaccgcagcctcatcctgcgctttgtgcgggagtggagcagcctgacagccatgaagcagaggatcatcaggaagagcggccagctgttctgcagccccatcctggccctggaggagatcaccaagcagcagaccaagcagaactgcaccaagcgctacatcaccaaggaggatgtggccgtggcctccatggacaaggtgaagaatgtgggcggccacgtgcggctcatcaccaaggagagccggccccgggaccccttcaccaagaagctgctggaggatggagcctgtgtgcccttcctgaacccctacacagtgcaggccgacctgactgtgaagcccagcaccagcaagggctacctgcaggccgtggacaatgaaggcaaccccctgtgcctgcgctgccagcagcccacctgccagaccaagcaggcctgcaaggccaacagctgggacagccgcttctgcagcctgaagtgccaggaggagttctggatccgcagcaacaacagctacctgcgggccaaggtgtttgaaacagagcacggcgtgtgccagctgtgcaatgtgaatgcccaggagctgttcctgcggctgagagatgcccccaagagccagaggaagaacctgctgtatgccacctggaccagcaagctgcccctggagcagctgaatgagatgatcagaaatcctggagagggccacttctggcaggtggaccacatcaagcctgtgtatggaggcggcggccagtgcagcctggacaacctgcagaccctgtgcaccgtgtgccacaaggagaggacagcccggcaggccaaggagaggagccaggtgcggcggcagagcctggccagcaagcacggcagtgacatcacccgcttcctggtgaagaagtag

SEQ ID NO: 43964 - DNA, 1794 bp, Artificial Sequence
  Description of Artificial Sequence: Synthetic coding sequence
atgaccagctgtgatgagagcaagcgcttccgggaggagaacacagtggtgtccagtgaccccaccaagacagctgcccgggacatcatcgactatgaaagtgatgtggagcctgagaccaagaggctgaagctggccgccagcgaggaccactgcagccccagcgaggagacccccagccagagcaagcagatccgcacccccctggtggagagcgtgcaggaggccaaggcccagctgaccaccccagccttccctgtggagggctggcagtgcagcctgtgcacctacatcaacaacagcgagctgccctactgtgagatgtgtgagaccccccagggcagcgctgtgatgcagattgacagcctgaaccacatccaggacaagaatgagaaggatgacagccagaaggacaccagcaagaaggtgcagaccatcagtgactgtgagaagcaggccctggcccagagcgagcccggccagctggccgacagcaaggaggagacccccaagattgagaaggaggatggcctgaccagccagcctgagcagtggaagagcagtgacaccctgcctgtgtatgacaccctgatgttctgtgccagcaggaacacagaccgcatccacatctacaccaaggatggcaagcagatgagctgcaacttcatccccctggacatcaagctggacctgtgggaggacctgcctgccagcttccagctgaagcagtaccgcagcctcatcctgcgctttgtgcgggagtggagcagcctgacagccatgaagcagaggatcatcaggaagagcggccagctgttctgcagccccatcctggccctggaggagatcaccaagcagcagaccaagcagaactgcaccaagcgctacatcaccaaggaggatgtggccgtggcctccatggacaaggtgaagaatgtgggcggccacgtgcggctcatcaccaaggagagccggccccgggaccccttcaccaagaagctgctggaggatggagcctgtgtgcccttcctgaacccctacacagtgcaggccgacctgactgtgaagcccagcaccagcaagggctacctgcaggccgtggacaatgaaggcaaccccctgtgcctgcgctgccagcagcccacctgccagaccaagcaggcctgcaaggccaacagctgggacagccgcttctgcagcctgaagtgccaggaggagttctggatccgcagcaacaacagctacctgcgggccaaggtgtttgaaacagaacatggagtgtgccagctgtgcaatgtgaatgcccaggagctgttcctgcggctgagagatgcccccaagagccagaggaagaacctgctgtatgccacctggaccagcaagctgcccctggagcagctgaatgagatgatccggaaccctggagagggccacttctggcaggtggaccacatcaagcctgtgtatggaggcggcggccagtgcagcctggacaacctgcagaccctgtgcaccgtgtgccacaaggagaggacagcccggcaggccaaggagaggagccaggtgcggcggcagagcctggccagcaagcacggcagtgacatcacccgcttcctggtgaagaagctgcacgagagccacaaggtgactggagctgagcagggcctgcaggtgtctggcctgcctgacagcgctgcccctgagggcggggccgcccacaccaatgaccagaggcgctgccagaggatgaagcagcccctgacagaggtgcagatcctgagccacagcagctag

SEQ ID NO: 43965 - DNA, 1902 bp, Artificial Sequence
  Description of Artificial Sequence: Synthetic coding sequence
atgctgcggcggggctacaaggccagcgagcggcggcggcacctgtctgagcggctgtcctggcaccaggaccaggccctgagcagcagcatctacctgctgcgggagatgggccccaccggcttcctgctgcgggaggaggagcctgagtacatggacttccgggtcttcctgggcaacccccacgtgtgcaactgcagcaccttccccaagggcggggagctgtgcaagcacatctgctgggtgctgctgaagaagttcaagctgcccagaaatcatgaaagtgccctgcagctgggcctgggggagcgggagatcagtgacctgctgcggggcatccaccgggtgcagaccccccagcccggcaccaatgatgaaaatgaacatgtggaggaggatggctacatcaagcagaaggagattgattctgaggacatctgcagcatctgccaggagctgctgctggagaagaagctgcctgtgaccttctgccgcttcggctgcggcaacagcatccacatcaagtgcatgaagatcctggccaactaccagagcaccagcaacacctccatgctgaagtgccccctgtgcaggaaggagtttgcccccctgaagctgatcctggaggagttcaagaacagcagcaagctggtggccgctgctgagaaggagcggctggacaagcacctgggcatcccctgcaacaactgcaagcagttccccatcgagggcaagtgctacaagtgcacagaatgtattgagtaccacctgtgccaggagtgctttgacagctgctgccacctgagccacaccttcaccttccgggagaagaggaaccagaagtggaggagcctggagaagagagcagatgaggtggtgaagtacatcgacaccaagaatgaaattgaggagaagatgagccacttccaggagaagcagggccaggtgtacacccccaagcacatcgtgcgcagcctgcccctgcagctgatcaccaagaacagcaagctgctggcccctggctaccagtgcctgctgtgcctgaaggccttccacctgggccagcacacccggctgctgccctgcacccacaagttccacaggaaatgtattgacaactggctgttccacaagtgcaacagctgccccattgatggccaggtgatctacaaccccctgacctggaagaacagcgctgtgaatggccaggcccaccagagcgtgagcaacagagacatcatccacctgagcaagcagaaggagccagacctcttcatccctggcaccggcctggtgctgaagcagaaccggctgggcatcctgcccagcatcccccagtgcaactttgatgagctgaacaccccccagagccccaaggatgcctatgagaacaccaccatcgacaacctgtgcagcatcaagctggacaacagcaacagcaagaagctgacctatgactacaagatcagccagcacttcccccgctacctgcaggacctgcccaccgtgtcctttgggaagatccccagccagaccctgctgccccccatcgtgcacaagaacatcgtgtgccccacagccatggagagcccctgcatcagcggcaagttccacaccagcctgagcaggatgaccaagggctgcaagtgcaacaaccacaacctgaagaagaccccagccaccaagatccgggaggacaacaagaggagcaccctgctgcctgaggacttcaacctgattgtgaactggagcacagccaagctgagcctgagcaagcgctacagcaactgcatgggagagatcaccaggaagtgcagccacctgagccggcagcctgtgagccacagcgtgaacaccaagagcacagagctgagcctcatcatcgagggcgtgcagctgtag

SEQ ID NO: 43966 - DNA, 2091 bp, Artificial Sequence
  Description of Artificial Sequence: Synthetic coding sequence
atggagctgggcagctgcttcaagacctatgaggacttcaaggagtgcttcagcgcctacaagagagaaaatcgctgcagcttcatcctgcgggactgtgtgtctgtgcgcttccacaacctgaaccacggcaccagcatccgggaggacatcctgtatgtgcaggtgaagtttgtgtgcatccgcacccagagcaacaggaagaggacccgggaggccgacatgtgcccagcctacctgctgctgcgctacaatgaaaggctggacaggctcttcatcagcgagctgaacacccagcacatccacggggacagcaaggtggccagccctggaggagacaccaccgggaagagccagaagaccatgtgcctgcagaggctgcagcctgtgcagcccaccaccaagaaggacctggacacagctgagaagagcctggtggagcccagcttctgcctggacaaggtgcaggtgagcagcaagccagagcaggagggcatcacccccagcgacctggccaagatcgccaaggtgatgaagaacttcctgaaggtggatgagggctccatggccagcttctctgtgggggacagccagcacctggaccggctgtccttccagagcagcaagatgacagacctcttcatccgcttccctgagaacctgctgctgcaccgggtggagaacacccagggccacatcctgtatgccttcctggtggagaacaaggagcgggagagccgggtggtgcactttgctgtgctgaaggccgagaccgtgacctctgtggccaagatgctgagcatcttcacagagttcaacagcgactggcccaaggtgaaggtggtgtttgtggaccccagcttccactaccgggccatcctgcaggagatcttccctgctgcccgcatcctgctgagcatctaccacaccacccggctgctggagaagaagctgcacaggagcagcgccaaccccagcttcaagaggctgatgaaggaggccctgcgggaggccgtgtttgtgaccagcgaggccagcctgaagaacctgtgccagatgagccaggccgtgctggatgaggacctcttcaacttcctgcaggcccactggttcacctgtgagctgctgtggtacatgcacgtgaggaagggcctgctggcctgcaacacctacatggacagcctggacatcgtgaccagcaaggtgagcagcctcttccgggagcagcagagcctgctggactgcatcctgtgctttgtggactacatcgacttcttcaacaccaagggcctgaagaacctgcccaccccaccacccaagctgaagagggcccggcctgcctccatgcccctgaagagcaagaaggccttcggcatctgtggggagagcctgaccagcctgcctgctgaggagaccaagccagatgcccagcaggtgcaggtgcagcagcagagccaggtgccccccagccaggtgggcatgctggacaccctgcaccagagcggcagcgagctggcctacaagctgtgccacaatgagtgggaggtggtgcagaacagcacccacctggtggacatggccggcagctctgtggatgtgcagctgctggaggacagccaccaggtgtccaaggatggctgcagctgcagctgcagcttccagcagtggtaccacctgccctgccgccacatcctggccctgctgcacaccagccagcagcctgtgggggaggccatggtgtgccgccgctggcagaagaagtaccagtacctgctgggccccaatggagagctgcaggaccggggcatggtgcccaacacaggccagcctgagaagcagggcagaaatgacatgatccaggacctgagccgggagctggccaacctgctgatgcagacagagggccctgagctggaggagcgctacagcaccctgaggaagatcgtggacatctgggccggccccagccagcccagcgagctgttccagcagcccggggacttcaaggatgtgggccgcctgcccttcctgtggggcaagcaggaggagggggagggcttccccccagccacagctgtgatgcactactag

SEQ ID NO: 43967 - DNA, 2073 bp, Artificial Sequence
  Description of Artificial Sequence: Synthetic coding sequence
atgaagacccggctggagcggcaggccgagaccaccagcggccaccccagcctggccagcctgtactactggacagccccagccctgcccggccctgagctggagatggcccccccaccccactgtgcccacaacagatatgtgcaggtgaagtttgtgtgcatccgcacccagagcaacaggaagaggacccgggaggccgacatgtgcccagcctacctgctgctgcgctacaatgaaaggctggacaggctcttcatcagcgagctgaacacccagcacatccacggggacagcaaggtggccagccctggaggagacaccaccgggaagagccagaagaccatgtgcctgcagaggctgcagcctgtgcagcccaccaccaagaaggacctggacacagctgagaagagcctggtggagcccagcttctgcctggacaaggtgcaggtgagcagcaagccagagcaggagggcatcacccccagcgacctggccaagatcgccaaggtgatgaagaacttcctgaaggtggatgagggctccatggccagcttctctgtgggggacagccagcacctggaccggctgtccttccagagcagcaagatgacagacctcttcatccgcttccctgagaacctgctgctgcaccgggtggagaacacccagggccacatcctgtatgccttcctggtggagaacaaggagcgggagagccgggtggtgcactttgctgtgctgaaggccgagaccgtgacctctgtggccaagatgctgagcatcttcacagagttcaacagcgactggcccaaggtgaaggtggtgtttgtggaccccagcttccactaccgggccatcctgcaggagatcttccctgctgcccgcatcctgctgagcatctaccacaccacccggctgctggagaagaagctgcacaggagcagcgccaaccccagcttcaagaggctgatgaaggaggccctgcgggaggccgtgtttgtgaccagcgaggccagcctgaagaacctgtgccagatgagccaggccgtgctggatgaggacctcttcaacttcctgcaggcccactggttcacctgtgagctgctgtggtacatgcacgtgaggaagggcctgctggcctgcaacacctacatggacagcctggacatcgtgaccagcaaggtgagcagcctcttccgggagcagcagagcctgctggactgcatcctgtgctttgtggactacatcgacttcttcaacaccaagggcctgaagaacctgcccaccccaccacccaagctgaagagggcccggcctgcctccatgcccctgaagagcaagaaggccttcggcatctgtggggagagcctgaccagcctgcctgctgaggagaccaagccagatgcccagcaggtgcaggtgcagcagcagagccaggtgccccccagccaggtgggcatgctggacaccctgcaccagagcggcagcgagctggcctacaagctgtgccacaatgagtgggaggtggtgcagaacagcacccacctggtggacatggccggcagctctgtggatgtgcagctgctggaggacagccaccaggtgtccaaggatggctgcagctgcagctgcagcttccagcagtggtaccacctgccctgccgccacatcctggccctgctgcacaccagccagcagcctgtgggggaggccatggtgtgccgccgctggcagaagaagtaccagtacctgctgggccccaatggagagctgcaggaccggggcatggtgcccaacacaggccagcctgagaagcagggcagaaatgacatgatccaggacctgagccgggagctggccaacctgctgatgcagacagagggccctgagctggaggagcgctacagcaccctgaggaagatcgtggacatctgggccggccccagccagcccagcgagctgttccagcagcccggggacttcaaggatgtgggccgcctgcccttcctgtggggcaagcaggaggagggggagggcttccccccagccacagctgtgatgcactactag

SEQ ID NO: 43968 - DNA, 2970 bp, Artificial Sequence
  Description of Artificial Sequence: Synthetic coding sequence
atggagcccccagctgccaagaggagccggggctgcccagctggccctgaggagagagatgctggagctggagctgcccggggccggggccggcctgaggccctgctggacctgagcgccaagagggtggccgagagctgggcctttgagcaggtggaggagcgcttcagccgggtgcctgagcctgtgcagaagagaattgtgttctggagcttccccaggtctgagcgggagatctgcatgtacagcagcctgggctacccacctcctgagggggagcatgatgcccgggtgcccttcacccggggcctgcacctgctgcagagcggggctgtggacagagtgctgcaggtgggcttccacctgagcggcaacatccgggagcccggcagccctggagagcctgagcggctgtaccacgtgtccatcagctttgaccgctgcaagatcacctctgtgtcctgtggctgtgacaacagagacctcttctactgtgcccacgtggtggccctgagcctgtaccgcatcagacatgcccaccaggtggagctgcggctgcccatcagcgagaccctgagccagatgaacagagaccagctgcagaagtttgtgcagtacctgatcagcgcccaccacacagaggtgctgcccacagcccagaggctggctgatgagatcctgctgctgggcagcgagatcaacctggtgaatggagccccagaccccacagctggggccggcattgaagatgccaactgctggcacctggatgaggagcagatccaggagcaggtgaagcagctgctgagcaatggaggctactatggagccagccagcagctgcgctccatgttcagcaaggtgcgggagatgctgaggatgagggacagcaatggagccaggatgctgatcctgatgacagagcagttcctgcaggacacccggctggccctgtggaggcagcagggcgccggcatgacagacaagtgccggcagctgtgggatgagctgggcgccctgtgggtgtgtgtggtgctgagcccccactgcaagccagaggagcgggccggctggctgcagctgctgagccgctgggacaagctggatgtgtgccccctggaggagggcaactacagctttgatggccccagcctgcagcccaccatggccccagcccctgagctgctgcagaagggcagcacctgcatcaccaacacagagggctgggtgggccaccccctggaccccatcggctgcctgtgccgggccctgctggaggcctgccgcctggaggaggagaccctgaccctgtacccagattctggccctgagaagaggaaggtggcctaccagcacgtgcctgtgcccggcagccctggagagagctacctggtgctggccctggaggtggccctgctgggcctgggccagcagagggccctgcctgagggcctgtatgcccaggacaaggtggtgagaaatgaggagcagctgctggccctgctggaggaggtggagctggatgagcggctggtgcaggtgctgaggaagcaggccggcctgctgctggagggcggccccttcagcggctttggagaggtgctcttccgggagagcgtgcccatgcacacctgtgcccgctacctgttcaccgccctgctgccccatgaccctgacctggcctaccgcctggccctgcgggccatgaggctgcccatcctggagacagccttccctgctggggagccccaccccagccccctggacagcatcatgagcaaccgcttcccccgctggttcatcctgggccacctggagacccggcagtgtgagctggccagcaccatgctgacagctgccaagggggaccccaagtggctgcacacagtgctgggcagcatccagcagaacatccacagccctgccctgctcttcaagctggcccaggatgcctgcaagacagccacccctgtgtctgcccccccagacaccaccctgctgggcatcgccctggagctgggcctgcaggtgatgaggatgaccctgaatgtgatgacctggaggagaagagagatggtgcgctggctggtgtcctgtgccacagaaattggcccccaggccctgatgaacatcatgcagaactggtacagcctcttcacccctgtggaggccgccaccatcgtggccgtgacaggcaccacccacgccaccctgctgcggctgcagctggacaccagcagaagagaggagctgtgggcctgtgcccggaccctggccctgcagtgtgccatgaaggacccccagaactgtgccctgcctgccctgaccctgtgtgagaagaaccacagcgcctttgaagctgcctaccagatcgtgctggatgctgctgctgggggcctgggccacgcccacctgttcaccgtggcccgctacatggagcaccggggcctgcccctgcgggcctacaagctggccaccctggccctggcccagctgagcatcgccttcaaccaggacagccaccctgctgtgaatgatgtgctgtgggcctgcagcctgagccacagcctgggcagacatgagctgagcgccatcgtgcccctcatcatccgcagcatccactgtgcccccatgctgagtgacatcctgcggcgctggaccctgagcgcccctggcctgggccccctgggcgccaggagagctgccaagcccctgggcgctgaccgggcccccctgtgccagctgctggatgctgctgtgacagcctacatcaccaccagccacagccggctgacccacatcagccccaggcactatggagacttcatcgagttcctgggcaaggcccgggagaccttcctgctggccccagatggccacctgcagttcagccagttcctggagaacctgaagcagacctacaagggcaagaagaagctgatgctgctggtgcgggagcgcttcggctag

SEQ ID NO: 43969 - DNA, 2472 bp, Artificial Sequence
  Description of Artificial Sequence: Synthetic coding sequence
atgttcagcaaggtgcgggagatgctgaggatgagggacagcaatggagccaggatgctgatcctgatgacagagcagttcctgcaggacacccggctggccctgtggaggcagcagggcgccggcatgacagacaagtgccggcagctgtgggatgagctgggcgccctgtgggtgtgtgtggtgctgagcccccactgcaagccagaggagagagctggctggctgcagctgctgagccgctgggacaagctggatgtgtgccccctggaggagggcaactacagctttgatggccccagcctgcagcccaccatggccccagcccctggcagcgaggaggaggaggaggtggccgccaccagccccaggcacacagtgtttggccgggccctgctggccggggagctgcactggaatgatgcctacctgcagaggatcctggccagtgacagctatggccccagcctgaccggctctgtgggcggggacaagcccacctttgacccccagggccggcccctgtggctgggggagcccttccccacagcctgtgcccgggtggacaccctgcgggcccacggctacccccggcaggccctgcggctggccagcgccatcatcaacaccctgcggctgcagcagaggcaccagctggagagctacaagcagcagaagaaggagctgctgcagaagggcagcacctgcatcaccaacacagagggctgggtgggccaccccctggaccccatcggctgcctgtgccgggccctgctggaggcctgccgcctggaggaggagaccctgaccctgtacccagattctggccctgagaagaggaaggtggcctaccagcacgtgcctgtgcccggcagccctggagagagctacctggtgctggccctggaggtggccctgctgggcctgggccagcagagggccctgcctgagggcctgtatgcccaggacaaggtggtgagaaatgaggagcagctgctggccctgctggaggaggtggagctggatgagcggctggtgcaggtgctgaggaagcaggccggcctgctgctggagggcggccccttcagcggctttggagaggtgctcttccgggagagcgtgcccatgcacacctgtgcccgctacctgttcaccgccctgctgccccatgaccctgacctggcctaccgcctggccctgcgggccatgaggctgcccatcctggagacagccttccctgctggggagccccaccccagccccctggacagcatcatgagcaaccgcttcccccgctggttcatcctgggccacctggagacccggcagtgtgagctggccagcaccatgctgacagctgccaagggggaccccaagtggctgcacacagtgctgggcagcatccagcagaacatccacagccctgccctgctcttcaagctggcccaggatgcctgcaagacagccacccctgtgtctgcccccccagacaccaccctgctgggcatcgccctggagctgggcctgcaggtgatgaggatgaccctgaatgtgatgacctggaggagaagagagatggtgcgctggctggtgtcctgtgccacagaaattggcccccaggccctgatgaacatcatgcagaactggtacagcctcttcacccctgtggaggccgccaccatcgtggccgtgacaggcaccacccacgccaccctgctgcggctgcagctggacaccagcagaagagaggagctgtgggcctgtgcccggaccctggccctgcagtgtgccatgaaggacccccagaactgtgccctgcctgccctgaccctgtgtgagaagaaccacagcgcctttgaagctgcctaccagatcgtgctggatgctgctgctgggggcctgggccacgcccacctgttcaccgtggcccgctacatggagcaccggggcctgcccctgcgggcctacaagctggccaccctggccctggcccagctgagcatcgccttcaaccaggacagccaccctgctgtgaatgatgtgctgtgggcctgcagcctgagccacagcctgggcagacatgagctgagcgccatcgtgcccctcatcatccgcagcatccactgtgcccccatgctgagtgacatcctgcggcgctggaccctgagcgcccctggcctgggccccctgggcgccaggagagctgccaagcccctgggcgctgaccgggcccccctgtgccagctgctggatgctgctgtgacagcctacatcaccaccagccacagccggctgacccacatcagccccaggcactatggagacttcatcgagttcctgggcaaggcccgggagaccttcctgctggccccagatggccacctgcagttcagccagttcctggagaacctgaagcagacctacaagggcaagaagaagctgatgctgctggtgcgggagcgcttcggctag

SEQ ID NO: 43970 - DNA, 3558 bp, Artificial Sequence
  Description of Artificial Sequence: Synthetic coding sequence
atggctgatggaggagagcgggaggagctgctgagccccagccctgtgtccccagccaagaggcagtgctcctggcccagcccccaggcccaccacccccggggcagccctggagctgctgggggcggggccggcggcgtgggcagcagctgcctggtgctgggcgcccggccccacctgcagcctgacagcctgctggactgtgccgccaagacagtggccgagaagtgggcctatgagcgggtggaggagagatttgagcgcatccctgagcctgtgcagaggagaattgtgtactggagcttccccagaaatgaaagagagatctgcatgtacagcagcttccagtacagaggaggccctggagctggagctgctgggggcgccgccggggccagccctgctgaggagggcccccagcccccacctggagctgctgccccagctggcagcgcccctggaggagtggccgccggggccagccctggcctgggcgctggggccggggctgctggctgcggcggggagggcctgcccttcagaagaggcatccggctgctggacagcggctctgtggagaatgtgctgcaggtgggcttccacctgtctggaacagtgacagagctggccacagccagcgagcctgctgtgacctacaaggtggccatcagctttgaccgctgcaagatcacctctgtgacctgtggctgcggcaacaaggacatcttctactgtgcccacgtggtggccctgagcctgtaccgcatcaggaagccagaccaggtgaagctgcggctgcccatcagcgagaccctcttccagatgaacagagaccagctgcagaagttcatccagtacctgatcacagcccaccacacagaggtgctgcccacagcccagaagctggctgatgagatcctgagcagcaacagcgagatcaaccaggtgaatggagccccagaccccacagctggggccagcattgatgatgagaactgctggcacctggatgaggagcaggtgaaggagcaggtgaagctgttcctgagccagggcggctactgcggcagcggcaagcagctgaacagcatgtttgccaaggtgcgggagatgctgaggatgagggacagcaatggagccaggatgctgaccctcatcacagagcagtttgtggccgacccccggctgaccctgtggaggcagcagggcaccaacatgacagacaagtgccggcagctgtgggatgagctgggcgccctgtgggtgtgcatcatcctgaacccccactgcaagctggaggagaagagctgctggctgcagcagctgcagaagtggagcgacctggatgtgtgccccctggaggatggcaactacggccacgagctgcccaacatcaccaatgccctgccccagagcgccatccacagcccagacagcctgagccggcccaggagaacagtgttcacccgggccatcgagggccgggagctgcactggcaggacagccacctgcagaggatcatcagcagtgatgtgtacacagccccagcctgccagcgggagagcgagcggctgctcttcaacagccagggccagcccctgtggctggagcacgtgcccacagcctgtgcccgggtggatgccctgcggagccacggctaccccaaggaggccctgcggctgactgtggccatcatcaacaccctgcggctgcagcagcagaggcagctggagatctacaagcaccagaagaaggagctgctgcagaggggcaccaccaccatcaccaacctggagggctgggtgggccaccccctggaccccatcgactgcctcttcctgaccctgacagaggcctgccgcctgaatgatgatggctacctggagatgtctgacatgaatgaaagccggccccctgtgtaccagcacgtgcctgtggccgccggcagccccaacagcagcgagagctacctgagcctggccctggaggtggccctgatgggcctgggccagcagaggctgatgcctgagggcctgtatgcccaggacaaggtgtgcagaaatgaggagcagctgctgagccagctgcaggagctgcagctggatgatgagctggtgcagaccctgcagaagcagtgcatcctgctgctggagggcggccccttcagcggcctgggggaggtgatccaccgggagagcgtgcccatgcacacctttgccaagtacctgttcagcgccctgctgccccatgaccctgacctgagctacaagctggccctgcgggccatgaggctgcctgtgctggagaacagcgccagcgctggggacaccagccacccccaccacatggtgtctgtggtgcccagccgctacccccgctggttcaccctgggccacctggagagccagcagtgtgagctggccagcaccatgctgacagctgccaagggggacaccctgcggctgcggaccatcctggaggccatccagaagcacatccacagcagcagcctcatcttcaagctggcccaggatgccttcaagatcgccacccccacagacagcagcacagacagcaccctgctgaatgtggccctggagctgggcctgcaggtgatgaggatgaccctgagcaccctgaactggaggcggcgggagatggtgcgctggctggtgacctgtgccacagaggtgggcgtgcgggccctggtgtccatcctgcagagctggtacaccctcttcacccccacagaggccaccagcatcgtggccgccacagctgtgagccacaccaccatcctgcggctgagcctggactacccccagcgggaggagctggccagctgtgcccggaccctggccctgcagtgtgccatgaaggacccccagagctgtgccctgagcgccctgaccctgtgtgagaaggaccacatcgcctttgaggccgcctaccagatcgccattgatgctgctgctgggggcatgacccacagccagctgttcaccatcgcccgctacatggagctgcggggctaccccctgcgggccttcaagctggccagcctggccatgagccacctgaacctggcctacaaccaggacacccacccagccatcaatgatgtgctgtgggcctgtgccctgagccacagcctgggcaagaatgagctggccgccctgatccccctggtggtgaagtctgtgcactgtgccaccgtgctgagtgacatcctgcggcgctgcaccgtgacagcccctggcctggccggcatccctggccgccgcagcagcggcaagctgatgagcacagacaaggcccccctgcggcagctgctggatgccaccatcaatgcctacatcaacaccacccacagccggctgacccacatcagccccaggcactatggagagttcatcgagttcctgagcaaggcccgggagaccttcctgctgccccaggacggccacctgcagtttgcccagttcatcgacaacctgaagcagatctacaagggcaagaagaagctgatgctgctggtgcgggagcgcttcggctag

SEQ ID NO: 43971 - DNA, 3648 bp, Artificial Sequence
  Description of Artificial Sequence: Synthetic coding sequence
atggccgagcggggccagcagcccccaccagccaagaggctgtgctgcaggcctgggggcggcggcggcggcggcggcagcagcggcggcggcggcggggccggcggcggctacagcagcgcctgccggcccggcccccgggccggcggcgctgctgctgctgctgcctgtggcggcggggccgccctgggcctgctgcccccaggcaagacccagagccctgagagcctgctggacattgctgccaggagagtggccgagaagtggcccttccagagggtggaggagagatttgagcgcatccctgagcctgtgcagaggagaattgtgtactggagcttccccaggtctgagcgggagatctgcatgtacagcagcttcaacacaggaggaggagctgctgggggccctggagatgattctgggggcggcggcggggccggcggcggcggcggcggcggcagcagcagcagccctgctgccaccagcgctgctgccaccagcgctgctgctgctgctgctgctgctgctgctgctgctgctgctgctgctggggccggggcccccagcgtgggcgccgccggggctgctgatggaggagatgagacccggctgcccttccggcggggcatcgccctgctggagagcggctgtgtggacaacgtgctgcaggtgggcttccacctgagcggcaccgtgacagagcccgccatccagagcgagcctgagaccgtgtgcaatgtggccatcagctttgaccgctgcaagatcacctctgtgacctgcagctgtggcaacaaggacatcttctactgtgcccacgtggtggccctgagcctgtaccgcatcaggaagccagaccaggtgaagctgcacctgcccatcagcgagaccctcttccagatgaacagagaccagctgcagaagtttgtgcagtacctgatcaccgtgcaccacacagaggtgctgcccacagcccagaagctggctgatgagatcctgagccagaacagcgagatcaaccaggtgcacggggccccagaccccacagctggggccagcattgatgatgagaactgctggcacctggatgaggagcaggtgcaggagcaggtgaagctgttcctgagccagggcggctaccacggcagcggcaagcagctgaacctgctgtttgccaaggtgcgggagatgctgaagatgagggacagcaatggagccaggatgctgaccctcatcacagagcagttcatggctgacccccggctgagcctgtggaggcagcagggcacagccatgacagacaagtaccggcagctgtgggatgagctgggcgccctgtggatgtgcatcgtgctgaacccccactgcaagctggagcagaaggcctcctggctgaagcagctgaagaagtggaacagcgtggatgtgtgcccctgggaggatggcaaccacggcagcgagctgcccaacctgaccaatgccctgccccagggcgccaatgccaaccaggacagcagcaaccggccccacaggacagtgttcacccgggccatcgaggcctgtgacctgcactggcaggacagccacctgcagcacatcatcagcagtgacctgtacaccaactactgctaccatgatgacacagagaacagcctgtttgacagccggggctggcccctgtggcatgaacatgtgcccacagcctgtgcccgggtggatgccctgcggagccacggctacccccgggaggccctgcggctggccatcgccatcgtgaacaccctgcggcggcagcagcagaagcagctggagatgttccgcacccagaagaaggagctgccccacaagaacatcaccagcatcaccaacctggagggctgggtgggccaccccctggaccctgtgggcaccctcttcagcagcctgatggaggcctgcagaattgatgatgagaacctgagcggcttcagtgacttcacagagaacatgggccagtgcaagagcctggagtaccagcacctgcctgcccacaagttcctggaggagggggagagctacctgaccctggccgtggaggtggccctgattggcctgggccagcagaggatcatgccagatggcctgtacacccaggagaaggtgtgcagaaatgaggagcagctgatcagcaagctgcaggagattgagctggatgacaccctggtgaagatcttcaggaagcaggccgtgttcctgctggaggccggcccctacagcggcctgggggagatcatccaccgggagagcgtgcccatgcacacctttgccaagtacctgttcaccagcctgctgccccatgatgctgagctggcctacaagatcgccctgcgggccatgaggctgctggtgctggagagcacagcccccagcggggacctgacccggccccaccacatcgcctctgtggtgcccaaccgctacccccgctggttcaccctgagccacatcgagagccagcagtgtgagctggccagcaccatgctgacagctgccaagggagatgtgcggcggctggagaccgtgctggagagcatccagaagaacatccacagcagcagccacatcttcaagctggcccaggatgccttcaagatcgccaccctgatggacagcctgcctgacatcaccctgctgaaggtgtccctggagctgggcctgcaggtgatgaggatgaccctgagcaccctgaactggaggcggcgggagatggtgcgctggctggtgacctgtgccacagaggtgggcgtgtatgccctggacagcatcatgcagacctggttcaccctcttcacccccacagaggccaccagcatcgtggccaccaccgtgatgagcaacagcaccatcgtgcggctgcacctggactgccaccagcaggagaagctggccagcagcgcccggaccctggccctgcagtgtgccatgaaggacccccagaactgtgccctgagcgccctgaccctgtgtgagaaggaccacatcgcctttgaaacagcctaccagatcgtgctggatgctgccaccaccggcatgagctacacccagctgttcaccatcgcccgctacatggagcaccggggctaccccatgagggcctacaagctggccaccctggccatgacccacctgaacctgagctacaaccaggacacccacccagccatcaatgatgtgctgtgggcctgtgccctgagccacagcctgggcaagaatgagctggccgccatcatccccctggtggtgaagtctgtgaagtgtgccaccgtgctgagtgacatcctgcggcgctgcaccctgaccaccccaggcatggtgggcctgcacggcagaagaaattctgggaagctgatgagcctggacaaggcccccctgcggcagctgctggatgccaccatcggggcctacatcaacaccacccacagccggctgacccacatcagccccaggcactacagcgagttcatcgagttcctgagcaaggcccgggagaccttcctgatggcccatgatggccacatccagttcacccagttcatcgacaacctgaagcagatctacaagggcaagaagaagctgatgatgctggtgcgggagcgcttcggctag

SEQ ID NO: 43972 - DNA, 8886 bp, Artificial Sequence
  Description of Artificial Sequence: Synthetic coding sequence
atgggaaatgcccccagccacagcagtgaagatgaagctgctgctgctggaggagagggctggggcccccaccaggactgggccgctgtgtctggcaccaccccaggccctggggtggccgccccagccctgcccccagctgctgccctgctggagcccgcccggctgcgggaggccgctgctgccctgctgcccaccccaccctgtgagagcctggtgagccgccacagaggagccctcttccgctggctggaggagcggctgggccgcggggaggagagcgtgaccctggagcagttccgggagctgctggaggcccggggagctggctgcagcagcgagcagtttgaggaggcctttgcccagtttgatgctgaaggagatggcaccgtggatgctgagaacatgctggaggccctgaagaacagcagcggggccaacctgcagggcgagctgagccacatcatccggcagctgcaggcctgcagcctggtgcccggcttcacagacatcttcagcgagagcaaggagggcctggacatccacagctccatgatcctgcgcttcctgcacaggaaccggctgagcagcgctgtgatgccctaccccatgctggagcactgcaacaacatgtgcaccatgaggagctctgtgctgaaggagagcctggaccagctggtgcagaaggagaaggagagccctggggacctgaccaggagccctgagatggacaagctgaagtctgtggccaagtgctacgcctacatcgagaccagcagcaacagcgctgacatcgacaagatgaccaacggggagaccagcagctactggcagagtgatggcagcgcctgcagccactggatccggctgaagatgaagccagatgtggtgctgcggcacctgagcattgctgtggccgccacagaccagagctacatgccccagcaggtgacagtggccgtgggcagaaatgccagtgacctgcaggaggtgagagatgtgcacatccccagcaatgtgacaggctacgtgaccctgctggagaatgccaacgtgtcccagctgtatgtgcagatcaacatcaagcgctgcctgagtgatggctgtgacacccgcatccacggcctgcgggctgtgggcttccagagggtgaagaagtctggagtgtctgtgtctgatgccagcgccatctggtactggagcctgctgaccagcctggtgacagcctccatggagaccaacccagcctttgtgcagacagtgctgcacaacacccagaaggccctgcggcacatgccacccctgagcctgagccctggcagcacagacttcagcaccttcctgagccccaacgtgctggaggaggtggacagcttcctgatccgcatcaccagctgctgcagcaccccagaggtggagctgaccctgctggcctttgccctggcccggggctctgtggccaaggtgatgagcagcctgtgcaccatcacagaccacctggacacccagtatgatgccagcagcctcatcctgtccatggcctctgtgcggcagaacctgctgctgaagtatggcaagcccctgcagctgaccctgcaggcctgtgatgtgaagggcaaggaggacaagagcggccctgagaacctgctggtggagccctggaccagagatggcttcctgacagaaacaggcaagacccgggccagcaccatcttcagcactggaacagagagcgccttccaggtgacccagatccgcatcatggtgcggcggggcggcatcggggcccagtgtggcctggtgtttgcctacaacagcagcagtgacaagttctgtgccgaggagcacttcaagagatttgagaagtatgacaagtggaagctgcaggagctgcggcagtttgtgaagagcagaattggctgcagcagtgatgacctgggggaggatgaccccatcggctggtttgagctggaggaggagtgggatgaagcagatgtgaagctgcagcagtgccgggtggccaagtacctgatggtgaagttcctgtgcacccggcaggagagcgctgagcggctgggcgtgcagggcctgaccatcagcggctacctgcggcctgcccgggcagaggccgagcagagcgtgacctgtgcccactgcaggaaggacacagaggagagcgtgtgtggggccaccctgctgctgcggaccctgcagttcatccagcagctggcccatgacctggtgcagcagaaggagagcggcctgaagtacaagagcttcctggactttgctggcctggacctgcagatcttctggaacttctacagcaagctgaagcagaacccccgggaggagtgtgtgtctgcccagaccctgctgctgcagctgctgcagagctgcttctctgtgctgcagggagatgtgctggccgccagcgaggaggagaaggcccccatccagagccccaagggcgtggaggccgccaaggagctgtacacccacctgtgtgatgtggtggacaaggtggatggagacagcgtgcccatggagatcctgaagcaggaggtgaggaacaccctgctgaatggagctgccatcttcttccccaaccggcagaccaggaggaaccacctgttcaccatgatgaatgtgacagagcaggagcacaagcagagcctgcagctgaccttccgcagcctgtgcacctacttcagtgacaaggaccccggcggcctgctgctgctgcctgagaagaatgacctggccaagatgaacatcagcgaggtgctggccgtgatggacaccctggtgtctgtggccgccagagaatgtgagctgctgatgctgagcggggcccctggagaggtgggctctgtgctcttcagcctcttctggagcgtgcagggcagcctgctgtcctggtgctacctgcagctgaagagcacagacagcggggccaaggacctggccgtggacctgattgagaagtatgtgggccagttcctggcctccatgagggccatcctggagagcctcttcagccagtacagcggcaagaccatcgtggagcggctgtgcaacagcgtcttctccatggccgcccggcagctggtgatcttcctgctggacttctgcaccctggacatcccccactgtgtgctgctgcgggagttctctgtgctgacagagctgctgaagaagctgtgcagcggccctgagggcggcctgaggaagctggatgtggagacctggcagcaggagcagcctgtggtgctgcacacctggaccaaggagagcgcccacaactatgagaacaactgccacgaggtgtctgtgtttgtgtcccctggggccacctactttgaggtggagtttgatgacagatgtgaaacagagaagagatatgactacctggagttcacagatgcccggggcaggaagaccaggtatgacaccaaggtgggcacagacaagtggcccaagaaggtgaccttcaaggccggcccccggctgcagttcctgttccacagcgacagcagccacaatgagtggggctacaagttcaccgtgacagcctgtggcctgcctgatgtggccgtgtcctggggcctggacctgcagctgctggtgtcccggctgatgggccgcctggccagccagtgcatggccctgaagtctgtgcggcagctgggcagcaacatggtggtgccccaggccaagatggccctggtgctgagcagccccctgtggaagcctgtgttccgccaccaggtgtgcccagagctggagctggaggcctcctggcccacccacccccacaggaacagcaaggaggtgaagaacatcccagatgacccctgccgccacttcctgctggactttgcccagagcgagcccgcccagaacttctgtggcccctacagcgagctgttcaagggcttcatccaggcctgcaggaagcaggcccccaagacagacatcgtggccggcagcaccatcgaccaggccgtgaatgccacctttgctgccctggtgtaccgcaccccagacctgtatgagaagctgcagaagtatgtgaacagcggcggcaagatcgccctgtctgaggagtttgcccaggtgtacagcctggctgatggcatccgcatctggatgctggagatgaagcagaagagcctgatgagcctgggcaatgaggccgaggagaagcacagcagcgaggccacagaggtgaaccctgagagcctggccaaggaatgtattgagaagagcctgctgctgctgaagttcctgcccaccggcatcagcagcaaggagagctgtgagaagctggagacagcagatgagaccagccacctgcagcccctgaacaagaggcagaggaccagctctgtggtggaggagcacttccaggcctctgtgagccccacagaagctgcccccccagccaccggggaccagagccctggcctgggcacccagcccaagctgcccagcagcagcggcctgcctgctgctgatgtgtccccagccacagctgaggagcccctgagccccagcacccccacccggcggccccccttcacccggggccgcctgcggctgctgtccttccgctccatggaggaggcccggctggtgcccaccgtgaaggagaagtaccctgtgctgaaggatgtgatggacttcatcaaggaccagagcctgagccacaggtctgtggtgaaggtgctgagcctgaggaaggcccaggcccagagcatcctggaggtgctgaagatcacccagcactgtgccgagagcctgggccagccccactgcttccacccccccttcatcctcttcctgctggagctgctgacctgccagaaggacttcaccaactacttcggccacctggagggctgtggggctgacctgcacaaggagatccgggacacctactaccagctggtgctcttcctggtgaaggctgtgaagggcttcagcagcctgaatgacaggagcctgctgcctgccctgagctgtgtgcagacagccctgctgcacctgctggacatgggctgggagcccaatgacctggccttctttgtggacatccagctgcctgacctgctgatgaagatgagccaggagaacatctctgtgcatgattctgtcatcagccagtggagcgaagaagatgagctggctgatgccaagcagaacagcgagtggatggatgagtgccaggacggcatgtttgaggcctggtatgagaagatcgcccaggaggaccctgagaagcagaggaagatgcacatgttcatcgcccgctactgtgacctgctgaatgtggacatcagctgtgatggctgtgatgaaattgccccctggcaccgctaccgctgcctgcagtgcagcgacatggacctgtgcaagacctgcttcctgggcggcgtgaagccagagggccatggagatgaccacgagatggtgaacatggagttcacctgtgaccactgccagggcctcatcatcggccgcaggatgaactgcaatgtgtgtgatgactttgacctgtgctacggctgctacgccgccaagaagtacagctatggccacctgcccacccacagcatcacagcccaccccatggtgaccatccgcatcagtgaccggcagaggctcatccagccctacatccacaactacagctggctgctgtttgctgccctggccctgtacagcgcccacctggccagcgcagaagatgtggatggagagaagctggacccccagaccaggagcagcgccaccaccctgcggagccagtgcatgcagctggtgggggactgcctgatgaaggcccaccagggcaagggcctgaaggccctggccctgctgggcgtgctgcctgatggagacagcagcctggaggaccaggccctgcctgtgacagtgcccactggagccagcgaggagcagctggagaagaaggctgtgcagggcgctgagctgtctgaggccggaaatggcaagagagctgtgcatgaggagatccggcctgtggacttcaagcagaggaacaaggctgacaagggcgtgtccctgagcaaggaccccagctgccagacccagatcagtgacagccctgcagatgccagcccccccaccggcctgcctgatgctgaggacagcgaggtgagcagccagaagcccatcgaggagaaggctgtgacccccagccctgagcaggtgtttgctgaatgttcccagaagaggatcctgggcctgctggccgccatgctgccccccctgaagagcggccccaccgtgcccctgattgacctggagcacgtgctgcccctgatgttccaggtggtgatcagcaatgccggccacctgaatgagacctaccacctgaccctgggcctgctgggccagctgatcatccggctgctgcctgctgaggtggatgctgctgtgatcaaggtgctgagcgccaagcacaacctgtttgctgctggggacagcagcatcgtgcctgatggctggaagaccacccacctgctcttcagcctgggcgctgtgtgcctggacagccgggtgggcctggactgggcctgcagcatggccgagatcctgcggagcctgaacagcgcccccctgtggagagatgtgattgccaccttcacagaccactgcatcaagcagctgcccttccagctgaagcacaccaacatcttcaccctgctggtgctggtgggcttcccccaggtgctgtgtgtgggcacccgctgtgtgtacatggacaatgccaatgagccccacaacgtcatcatcctgaagcacttcacagagaagaacagagctgtgattgtggatgtgaagaccaggaagaggaagacagtgaaggactaccagctggtgcagaagggcggcggccaggagtgtggggacagccgggcccagctgagccagtacagccagcactttgccttcatcgccagccacctgctgcagagctccatggacagccactgcccagaggccgtggaggccacctgggtgctgagcctggccctgaagggcctgtacaagaccctgaaggcccacggctttgaggagatccgggccaccttcctgcagacagacctgctgaagctgctggtgaagaagtgcagcaagggcaccggcttcagcaagacctggctgctgcgggacctggagatcctgagcatcatgctgtacagcagcaagaaggagatcaatgccctggccgagcacggggacctggagctggatgagcggggggaccgggaggaggaggtggagaggcctgtgagcagccctggggaccctgagcagaagaagctggaccccctggagggcctggatgagcccacccgcatctgcttcctgatggcccatgatgccctgaatgcccccctgcacatcctgcgggccatctatgagctgcagatgaagaagacagactacttcttcctggaggtgcagaagagatttgatggagatgagctgaccacagatgagcgcatccgcagcctggcccagcgctggcagcccagcaagagcctgcggctggaggagcagagcgccaaggctgtggacacagacatgatcatcctgccctgcctgagcaggcctgcccgctgtgaccaggccacagctgagagcaaccctgtgacccagaagctgatcagcagcacagaaagtgagctgcagcagagctatgccaagcagaggaggagcaagtctgctgccctgctgcacaaggagctgaactgcaagagcaagagagctgtgcgggactacctgttccgggtgaatgaggccacagctgtgctgtatgcccggcacgtgctggccagcctgctggccgagtggcccagccacgtgcctgtgtctgaggacatcctggagctgagcggccctgcccacatgacctacatcctggacatgttcatgcagctggaggagaagcatgagtgggagaagatcctgcagaaggtgctgcagggctgccgggaggacatgctgggcaccatggccctggccgcctgccagttcatggaggagcccggcatggaggtgcaggtgcgggagagcaagcacccctacaacaacaacaccaactttgaggacaaggtgcacatccctggggccatctacctgagcatcaagtttgacagccagtgcaacacagaggagggctgtgatgagctggccatgagcagcagcagtgacttccagcaggacagacacagcttcagcggcagccagcagaagtggaaggactttgagctgcccggggacaccctgtactaccgcttcaccagtgacatgagcaacacagagtggggctaccgcttcaccgtgacagctggccacctgggccgcttccagacaggctttgagatcctgaagcagatgctgtctgaggagcgggtggtgccccacctgcccctggccaagatctgggagtggctggtgggcgtggcctgccggcagacaggccaccagaggctgaaggccatccacctgctgctgagaattgtgcgctgctgcggccacagcgacctgtgtgacctggccctgctgaagcccctgtggcagctgttcacccacatggagtatggcctgtttgaagatgtgacccagcccggcatcctgctgcccctgcaccgggccctgacagagctgttctttgtgacagaaaatagagcccaggagctgggcgtgctgcaggactacctgctggccctgaccacagatgaccacctgctgcgctgtgccgcccaggccctgcagaacattgctgccatcagcctggccatcaactaccccaacaaggccacccggctgtggaatgtggagtgctag

SEQ ID NO: 43973 - DNA, 588 bp, Artificial Sequence
  Description of Artificial Sequence: Synthetic coding sequence
atgggcgtgtggggcaagaagcacctgcggctgacccacgcccccagccccaccttcagccacctgccccccagcccccaggccggggagcccggcattgatggcatcagcctggccgtggtgtgtgccgccttcatccgcatccacccagcccggcggcacccagccagaaatggcagccggctggcctgcacccccaccccccggcccaatgccggcctggaggtggtgtcctctgcccgggtggccgccagcctgcccagcgagggcggctggaccagcggggcccccaggagcagcggcctgagcctgcccggcagcgcctggcagcccccacccctgcctgtgctgaggaagccagcctggccaggcagccctgctgtgaagaatgaaagcaagttccccaacagaggcagcaggaacttcccccggcggcggctgcccccagcccctgtgtctggagagcccccagagcgctgcaagctggcccgggagatccgctggaggctgtggaaggcccacgagggctggggcggcggggccaagaggcccctgggggaccctgcctggagcggcgtgaagaggtag

SEQ ID NO: 43974 - DNA, 7872 bp, Artificial Sequence
  Description of Artificial Sequence: Synthetic coding sequence
atggtgccccctgtgtggaccctgctgctgctggtgggcgccgccctcttcaggaaggagaagcccccagaccagaagctggtggtgcgcagcagccgggacaactacgtgctgacccagtgtgactttgaagatgatgccaagcccctgtgtgactggagccaggtgtctgcagatgatgaggactgggtgcgggccagcggccccagccccaccggcagcactggagcccctgggggctacccaaatggagagggcagctacctgcacatggagagcaacagcttccacagaggaggagtggcccggctgctgagcccagacctgtgggagcagggccccctgtgtgtgcactttgcccaccacatgtttggcctgtcctggggcgcccagctgcggctgctgctgctgagcggggaggagggcagaagaccagatgtgctgtggaagcactggaacacccagaggcccagctggatgctgaccaccgtgacagtgcctgctggcttcaccctgcccacccggctgatgtttgagggcacccggggcagcacagcctacctggacatcgccctggatgccctgagcatccggcggggcagctgcaacagagtgtgcatgatgcagacctgcagctttgacatccccaatgacctgtgtgactggacctggatccccacagccagcggggccaagtggacccagaagaagggcagcagcggcaagccaggagtgggcccagatggagacttcagcagccctggcagcggctgctacatgctgctggaccccaagaatgcccggcccggccagaaggctgtgctgctgagccctgtgtccctgagcagcggctgcctgtccttctccttccactacatcctgcggggccagagccctggagctgccctgcacatctatgcctctgtgctgggcagcatcaggaagcacaccctcttcagcggccagcccggccccaactggcaggccgtgtctgtgaactacacagctgtgggccgcatccagtttgctgtggtgggcgtgtttgggaagaccccagagcctgctgtggccgtggatgccaccagcatcgccccctgtggggagggcttcccccagtgtgactttgaggacaatgcccaccccttctgtgactgggtgcagaccagcggagatggcggccactgggccctgggccacaagaatggacctgtgcacggcatgggccctgctgggggcttccccaatgctgggggccactacatctacctggaggctgatgagttcagccaggccggccagagcgtgcggctggtgtcccggcccttctgtgcccctggggacatctgtgtggagtttgcctaccacatgtatggcctgggggagggcaccatgctggagctgctgctgggcagccctgctggcagcccccccatccccctgtggaagagggtgggcagccagaggccctactggcagaacacctctgtgacagtgcccagcggccaccagcagcccatgcagctgatcttcaagggcatccagggcagcaacacagcctctgtggtggccatgggcttcatcctgatcaaccctggcacctgccctgtgaaggtgctgcctgagctgccccctgtgtcccctgtgagcagcacaggccccagcgagaccaccggcctgacagagaaccccaccatcagcaccaagaagcccaccgtgtccattgagaagcccagcgtgaccacagagaagcccaccgtgcccaaggagaagcccaccatccccacagagaagcccaccatcagcacagagaagcccaccatccccagcgagaagcccaacatgcccagcgagaagcccaccatccccagcgagaagcccaccatcctgacagagaagcccaccatccccagcgagaagcccaccatccccagcgagaagcccaccatcagcacagagaagcccaccgtgcccacagaggagcccaccacccccacagaggagaccaccacctccatggaggagcctgtgatccccacagagaagcccagcatccccacagagaagcccagcatccccacagagaagcccaccatctccatggaggagaccatcatcagcacagagaagcccaccatcagccctgagaagcccaccatccccacagagaagcccaccatccccacagagaagagcaccatcagccctgagaagcccaccacccccacagagaagcccaccatccccacagagaagcccaccatcagccctgagaagcccaccacccccacagagaagcccaccatcagccctgagaagctgaccatccccacagagaagcccaccatccccacagagaagcccaccatccccacagagaagcccaccatcagcacagaggagcccaccacccccacagaggagaccaccatcagcacagagaagcccagcatccccatggagaagcccaccctgcccacagaggagaccaccacctctgtggaggagaccaccatcagcacagagaagctgaccatccccatggagaagcccaccatcagcacagagaagcccaccatccccacagagaagcccaccatcagccctgagaagctgaccatccccacagagaagctgaccatccccacagagaagcccaccatccccatcgaggagaccaccatcagcacagagaagctgaccatccccacagagaagcccaccatcagccctgagaagcccaccatcagcacagagaagcccaccatccccacagagaagcccaccatccccacagaggagaccaccatcagcacagagaagctgaccatccccacagagaagcccaccatcagccctgagaagctgaccatccccacagagaagcccaccatcagcacagagaagcccaccatccccacagagaagctgaccatccccacagagaagcccaccatccccacagagaagcccaccatccccacagagaagctgacagccctgcggcccccccaccccagccccacagccaccggcctggccgccctggtgatgagcccccacgcccccagcacccccatgaccagcgtcatcctgggcaccaccaccaccagccgcagcagcacagagcgctgccccccaaatgcccgctatgagagctgtgcctgcccagccagctgcaagagcccccggcccagctgtggccccctgtgccgggagggctgtgtgtgcaaccctggcttcctgttcagtgacaaccactgcatccaggccagcagctgcaactgcttctacaacaatgactactatgagcccggggctgagtggttcagccccaactgcacagagcactgccgctgctggccaggcagccgggtggagtgccagatcagccagtgtggcacccacacagtgtgccagctgaagaatggccagtatggctgccacccctatgccggcacagccacctgcctggtgtatggagacccccactacgtgacctttgatggccgccacttcggcttcatgggcaagtgcacctacatcctggcccagccctgtggcaacagcacagaccccttcttccgggtgacagccaagaatgaggagcagggccaggagggcgtgtcctgcctgagcaaggtgtatgtgaccctgcctgagagcacagtgaccctgctgaagggccgccgcaccctggtgggcggccagcaggtgaccctgcctgccatccccagcaagggcgtcttcctgggcgccagcggccgctttgtggagctgcagacagaatttggcctgcgggtgcgctgggatggagaccagcagctgtatgtgacagtgagcagcacctacagcggcaagctgtgtggcctgtgtggcaactatgatggcaacagcgacaatgaccacctgaagctggatggcagccctgctggggacaaggaggagctgggcaacagctggcagacagaccaggatgaggaccaggagtgccagaagtaccaggtggtgaacagccccagctgtgacagcagcctgcagagctccatgagcggccctggcttctgtggccgcctggtggacacccacggcccctttgagacctgcctgctgcacgtgaaggccgccagcttctttgacagctgcatgctggacatgtgtggcttccagggcctgcagcacctgctgtgcacccacatgagcaccatgaccaccacctgccaggatgctggccatgctgtgaagccctggagggagccccacttctgccccatggcctgcccccccaacagcaagtacagcctgtgtgccaagccctgcccagacacctgccacagcggcttcagcggcatgttctgcagcgacagatgtgtggaggcctgtgagtgcaaccctggctttgtgctgagcggcctggagtgcatccccaggagccagtgtggctgcctgcaccctgctggcagctacttcaaggtgggggagcgctggtacaagccaggctgcaaggagctgtgtgtgtgtgagagcaacaaccgcatccgctgccagccctggcgctgccgggcccaggagttctgtggccagcaggacggcatctacggctgccacgcccagggcgccgccacctgcacagccagcggggacccccactacctgacctttgatggagccctgcaccacttcatgggcacctgcacctacgtgctgacccggccctgctggagccgcagccaggacagctactttgtggtgtctgccaccaatgaaaatagaggaggcatcctggaggtgtcctacatcaaggctgtgcacgtgacagtgtttgacctgagcatcagcctgctgcggggctgcaaggtgatgctgaatggccaccgggtggccctgcctgtgtggctggcccagggccgggtgaccatccggctgagcagcaacctggtgctgctgtacaccaactttggcctgcaggtgcgctatgatggcagccacctggtggaggtgacagtgcccagcagctatggaggccagctgtgtggcctgtgtggcaactacaacaacaacagcctggatgacaacctgcggccagacaggaagctggccggggacagcatgcagctgggcgccgcctggaagctgcctgagagcagcgagcccggctgcttcctggtgggcggcaagcccagcagctgccaggagaacagcatggctgatgcctggaacaagaactgtgccatcctgatcaacccccagggccccttcagccagtgccaccaggtggtgcccccccagagcagctttgccagctgtgtgcacggccagtgtggcaccaagggggacaccacagccctgtgccgcagcctgcaggcctatgccagcctgtgtgcccaggccggccaggccccagcctggaggaacagaaccttctgccccatgcgctgccccccaggcagcagctacagcccctgcagcagcccctgcccagacacctgcagcagcatcaacaacccccgggactgccccaaggccctgccctgtgccgagagctgtgagtgccagaagggccacatcctgagcggcaccagctgtgtgcccctgggccagtgtggctgcacagatcctgctggcagctaccaccctgtgggggagcgctggtacacagagaacacctgcacccggctgtgcacctgcagcgtgcacaacaacatcacctgcttccagagcacctgcaagcccaaccagatctgctgggccctggatggcctgctgcggcgggccagcggcgtgggcgtgtgccagctgcctggagagagccactacgtgtcctttgatggcagcaaccacagcatcccagatgcctgcaccctggtgctggtgaaggtgtgccacccagccatggccctgcccttcttcaagatcagcgccaagcatgagaaggaggagggcggcacagaggccttccggctgcacgaggtgtacatcgacatctatgatgcccaggtgaccctgcagaagggccaccgggtgctgatcaacagcaagcaggtgaccctgcctgccatcagccagatccctggggtgtctgtgaagagcagcagcatctacagcatcgtgaacatcaagattggagtgcaggtgaagtttgatggcaaccacctgctggagattgagatccccaccacctactacggcaaggtgtgtggcatgtgtggcaacttcaatgatgaggaggaggatgagctgatgatgcccagtgatgaggtggccaacagcgacagcgagtttgtgaacagctggaaggacaaggacatcgaccccagctgccagagcctgctggtggatgagcagcagatcccagctgagcagcaggagaaccccagcggcaactgcagagctgctgacctgcggcgggcccgggagaagtgtgaggccgccctgcgggcccctgtgtgggcccagtgtgccagcagaattgacctgacccccttcctggtggactgtgccaacaccctgtgtgaatttggaggcctgtaccaggccctgtgccaggccctgcaggccttcggggccacctgccagagccagggcctgaagccacccctgtggaggaacagcagcttctgccccctggagtgcccagcctacagcagctacaccaactgcctgcccagctgcagccccagctgctgggacctggatggccgctgtgagggcgccaaggtgcccagcgcctgtgccgagggctgcatctgccagcccggctacgtgctgtctgaagataaatgtgtgcccaggagccagtgtggctgcaaggatgcccacggcggcagcatccccctgggcaagtcctgggtgagcagcggctgcacagagaagtgtgtgtgcaccggcggggccatccagtgtggggacttccgctgccccagcggcagccactgccagctgaccagtgacaacagcaacagcaactgtgtgtctgacaagtctgagcagtgcagcgtgtatggagacccccgctacctgacctttgatggcttctcctaccgcctgcagggccgcatgacctacgtgctgatcaagacagtggatgtgctgcctgagggcgtggagcccctgctggtggagggcaggaacaagatggacccccccaggagcagcatcttcctgcaggaggtgatcaccaccgtgtatggctacaaggtgcagctgcaggccggcctggagctggtggtgaacaaccagaagatggctgtgccctaccggcccaatgagcacctgcgggtgaccctgtggggccagaggctgtacctggtgacagactttgagctggtggtgtcctttggaggcaggaagaatgctgtgatcagcctgcccagcatgtatgagggcctggtgtctggcctgtgtggcaactatgacaagaacaggaagaatgacatgatgctgcccagcggggccctgacccagaacctgaacaccttcggcaacagctgggaggtgaagacagaagatgccctgctgcgcttcccccgggccatcccagctgaggaggagggccagggcgctgagctgggcctgaggacaggcctgcaggtgtctgagtgcagccctgagcagctggccagcaacagcacccaggcctgccgggtgctggccgacccccagggcccctttgctgcctgccaccagacagtggcccctgagcccttccaggagcactgtgtgctggacctgtgcagcgcccaggacccccgggagcaggaggagctgcgctgccaggtgctgagcggctacgccatcctgtgccaggaggccggggccgccctggccggctggagggacaggaccctgtgtgccggccagcagctgagtgactag

SEQ ID NO: 43975 - DNA, 8067 bp, Artificial Sequence
  Description of Artificial Sequence: Synthetic coding sequence
atggtgccccctgtgtggaccctgctgctgctggtgggcgccgccctcttcaggaaggagaagcccccagaccagaagctggtggtgcgcagcagccgggacaactacgtgctgacccagtgtgactttgaagatgatgccaagcccctgtgtgactggagccaggtgtctgcagatgatgaggactgggtgcgggccagcggccccagccccaccggcagcactggagcccctgggggctacccaaatggagagggcagctacctgcacatggagagcaacagcttccacagaggaggagtggcccggctgctgagcccagacctgtgggagcagggccccctgtgtgtgcactttgcccaccacatgtttggcctgtcctggggcgcccagctgcggctgctgctgctgagcggggaggagggcagaagaccagatgtgctgtggaagcactggaacacccagaggcccagctggatgctgaccaccgtgacagtgcctgctggcttcaccctgcccacccggctgatgtttgagggcacccggggcagcacagcctacctggacatcgccctggatgccctgagcatccggcggggcagctgcaacagagtgtgcatgatgcagacctgcagctttgacatccccaatgacctgtgtgactggacctggatccccacagccagcggggccaagtggacccagaagaagggcagcagcggcaagccaggagtgggcccagatggagacttcagcagccctggcagcggctgctacatgctgctggaccccaagaatgcccggcccggccagaaggctgtgctgctgagccctgtgtccctgagcagcggctgcctgtccttctccttccactacatcctgcggggccagagccctggagctgccctgcacatctatgcctctgtgctgggcagcatcaggaagcacaccctcttcagcggccagcccggccccaactggcaggccgtgtctgtgaactacacagctgtgggccgcatccagtttgctgtggtgggcgtgtttgggaagaccccagagcctgctgtggccgtggatgccaccagcatcgccccctgtggggagggcttcccccagtgtgactttgaggacaatgcccaccccttctgtgactgggtgcagaccagcggagatggcggccactgggccctgggccacaagaatggacctgtgcacggcatgggccctgctgggggcttccccaatgctgggggccactacatctacctggaggctgatgagttcagccaggccggccagagcgtgcggctggtgtcccggcccttctgtgcccctggggacatctgtgtggagtttgcctaccacatgtatggcctgggggagggcaccatgctggagctgctgctgggcagccctgctggcagcccccccatccccctgtggaagagggtgggcagccagaggccctactggcagaacacctctgtgacagtgcccagcggccaccagcagcccatgcagctgatcttcaagggcatccagggcagcaacacagcctctgtggtggccatgggcttcatcctgatcaaccctggcacctgccctgtgaaggtgctgcctgagctgccccctgtgtcccctgtgagcagcacaggccccagcgagaccaccggcctgacagagaaccccaccatcagcaccaagaagcccaccgtgtccattgagaagcccagcgtgaccacagagaagcccaccgtgcccaaggagaagcccaccatccccacagagaagcccaccatcagcacagagaagcccaccatccccagcgagaagcccaacatgcccagcgagaagcccaccatccccagcgagaagcccaccatcctgacagagaagcccaccatccccagcgagaagcccaccatccccagcgagaagcccaccatcagcacagagaagcccaccgtgcccacagaggagcccaccacccccacagaggagaccaccacctccatggaggagcctgtgatccccacagagaagcccagcatccccacagagaagcccagcatccccacagagaagcccaccatctccatggaggagaccatcatcagcacagagaagcccaccatcagccctgagaagcccaccatccccacagagaagcccaccatccccacagagaagagcaccatcagccctgagaagcccaccacccccacagagaagcccaccatccccacagagaagcccaccatcagccctgagaagcccaccacccccacagagaagcccaccatcagccctgagaagctgaccatccccacagagaagcccaccatccccacagagaagcccaccatccccacagagaagcccaccatcagcacagaggagcccaccacccccacagaggagaccaccatcagcacagagaagcccagcatccccatggagaagcccaccctgcccacagaggagaccaccacctctgtggaggagaccaccatcagcacagagaagctgaccatccccatggagaagcccaccatcagcacagagaagcccaccatccccacagagaagcccaccatcagccctgagaagctgaccatccccacagagaagctgaccatccccacagagaagcccaccatccccatcgaggagaccaccatcagcacagagaagctgaccatccccacagagaagcccaccatcagccctgagaagcccaccatcagcacagagaagcccaccatccccacagagaagcccaccatccccacagaggagaccaccatcagcacagagaagctgaccatccccacagagaagcccaccatcagccctgagaagctgaccatccccacagagaagcccaccatcagcacagagaagcccaccatccccacagagaagctgaccatccccacagagaagcccaccatccccacagagaagcccaccatccccacagagaagctgacagccctgcggcccccccaccccagccccacagccaccggcctggccgccctggtgatgagcccccacgcccccagcacccccatgaccagcgtcatcctgggcaccaccaccaccagccgcagcagcacagagcgctgccccccaaatgcccgctatgagagctgtgcctgcccagccagctgcaagagcccccggcccagctgtggccccctgtgccgggagggctgtgtgtgcaaccctggcttcctgttcagtgacaaccactgcatccaggccagcagctgcaactgcttctacaacaatgactactatgagcccggggctgagtggttcagccccaactgcacagagcactgccgctgctggccaggcagccgggtggagtgccagatcagccagtgtggcacccacacagtgtgccagctgaagaatggccagtatggctgccacccctatgccggcacagccacctgcctggtgtatggagacccccactacgtgacctttgatggccgccacttcggcttcatgggcaagtgcacctacatcctggcccagccctgtggcaacagcacagaccccttcttccgggtgacagccaagaatgaggagcagggccaggagggcgtgtcctgcctgagcaaggtgtatgtgaccctgcctgagagcacagtgaccctgctgaagggccgccgcaccctggtgggcggccagcaggtgaccctgcctgccatccccagcaagggcgtcttcctgggcgccagcggccgctttgtggagctgcagacagaatttggcctgcgggtgcgctgggatggagaccagcagctgtatgtgacagtgagcagcacctacagcggcaagctgtgtggcctgtgtggcaactatgatggcaacagcgacaatgaccacctgaagctggatggcagccctgctggggacaaggaggagctgggcaacagctggcagacagaccaggatgaggaccaggagtgccagaagtaccaggtggtgaacagccccagctgtgacagcagcctgcagagctccatgagcggccctggcttctgtggccgcctggtggacacccacggcccctttgagacctgcctgctgcacgtgaaggccgccagcttctttgacagctgcatgctggacatgtgtggcttccagggcctgcagcacctgctgtgcacccacatgagcaccatgaccaccacctgccaggatgctggccatgctgtgaagccctggagggagccccacttctgccccatggcctgcccccccaacagcaagtacagcctgtgtgccaagccctgcccagacacctgccacagcggcttcagcggcatgttctgcagcgacagatgtgtggaggcctgtgagtgcaaccctggctttgtgctgagcggcctggagtgcatccccaggagccagtgtggctgcctgcaccctgctggcagctacttcaaggtgggggagcgctggtacaagccaggctgcaaggagctgtgtgtgtgtgagagcaacaaccgcatccgctgccagccctggcgctgccgggcccaggagttctgtggccagcaggacggcatctacggctgccacgcccagggcgccgccacctgcacagccagcggggacccccactacctgacctttgatggagccctgcaccacttcatgggcacctgcacctacgtgctgacccggccctgctggagccgcagccaggacagctactttgtggtgtctgccaccaatgaaaatagaggaggcatcctggaggtgtcctacatcaaggctgtgcacgtgacagtgtttgacctgagcatcagcctgctgcggggctgcaaggtgatgctgaatggccaccgggtggccctgcctgtgtggctggcccagggccgggtgaccatccggctgagcagcaacctggtgctgctgtacaccaactttggcctgcaggtgcgctatgatggcagccacctggtggaggtgacagtgcccagcagctatggaggccagctgtgtggcctgtgtggcaactacaacaacaacagcctggatgacaacctgcggccagacaggaagctggccggggacagcatgcagctgggcgccgcctggaagctgcctgagagcagcgagcccggctgcttcctggtgggcggcaagcccagcagctgccaggagaacagcatggctgatgcctggaacaagaactgtgccatcctgatcaacccccagggccccttcagccagtgccaccaggtggtgcccccccagagcagctttgccagctgtgtgcacggccagtgtggcaccaagggggacaccacagccctgtgccgcagcctgcaggcctatgccagcctgtgtgcccaggccggccaggccccagcctggaggaacagaaccttctgccccatgcgctgccccccaggcagcagctacagcccctgcagcagcccctgcccagacacctgcagcagcatcaacaacccccgggactgccccaaggccctgccctgtgccgagagctgtgagtgccagaagggccacatcctgagcggcaccagctgtgtgcccctgggccagtgtggctgcacagatcctgctggcagctaccaccctgtgggggagcgctggtacacagagaacacctgcacccggctgtgcacctgcagcgtgcacaacaacatcacctgcttccagagcacctgcaagcccaaccagatctgctgggccctggatggcctgctgcggcgggccagcggcgtgggcgtgtgccagctgcctggagagagccactacgtgtcctttgatggcagcaaccacagcatcccagatgcctgcaccctggtgctggtgaaggtgtgccacccagccatggccctgcccttcttcaagatcagcgccaagcatgagaaggaggagggcggcacagaggccttccggctgcacgaggtgtacatcgacatctatgatgcccaggtgaccctgcagaagggccaccgggtgctgatcaacagcaagcaggtgaccctgcctgccatcagccagatccctggggtgtctgtgaagagcagcagcatctacagcatcgtgaacatcaagattggagtgcaggtgaagtttgatggcaaccacctgctggagattgagatccccaccacctactacggcaaggtgtgtggcatgtgtggcaacttcaatgatgaggaggaggatgagctgatgatgcccagtgatgaggtggccaacagcgacagcgagtttgtgaacagctggaaggacaaggacatcgaccccagctgccagagcctgctggtggatgagcagcagatcccagctgagcagcaggagaaccccagcggcaactgcagagctgctgacctgcggcgggcccgggagaagtgtgaggccgccctgcgggcccctgtgtgggcccagtgtgccagcagaattgacctgacccccttcctggtggactgtgccaacaccctgtgtgaatttggaggcctgtaccaggccctgtgccaggccctgcaggccttcggggccacctgccagagccagggcctgaagccacccctgtggaggaacagcagcttctgccccctggagtgcccagcctacagcagctacaccaactgcctgcccagctgcagccccagctgctgggacctggatggccgctgtgagggcgccaaggtgcccagcgcctgtgccgagggctgcatctgccagcccggctacgtgctgtctgaagataaatgtgtgcccaggagccagtgtggctgcaaggatgcccacggcggcagcatccccctgggcaagtcctgggtgagcagcggctgcacagagaagtgtgtgtgcaccggcggggccatccagtgtggggacttccgctgccccagcggcagccactgccagctgaccagtgacaacagcaacagcaactgtgtgtctgacaagtctgagcagtgcagcgtgtatggagacccccgctacctgacctttgatggcttctcctaccgcctgcagggccgcatgacctacgtgctgatcaagacagtggatgtgctgcctgagggcgtggagcccctgctggtggagggcaggaacaagatggacccccccaggagcagcatcttcctgcaggaggtgatcaccaccgtgtatggctacaaggtgcagctgcaggccggcctggagctggtggtgaacaaccagaagatggctgtgccctaccggcccaatgagcacctgcgggtgaccctgtggggccagaggctgtacctggtgacagactttgagctggtggtgtcctttggaggcaggaagaatgctgtgatcagcctgcccagcatgtatgagggcctggtgtctggcctgtgtggcaactatgacaagaacaggaagaatgacatgatgctgcccagcggggccctgacccagaacctgaacaccttcggcaacagctgggaggtgaagacagaagatgccctgctgcgcttcccccgggccatcccagctgaggaggagggccagggcgctgagctgggcctgaggacaggcctgcaggtgtctgagtgcagccctgagcagctggccagcaacagcacccaggcctgccgggtgctggccgacccccagggcccctttgctgcctgccaccagacagtggcccctgagcccttccaggagcactgtgtgctggacctgtgcagcgcccaggacccccgggagcaggaggagctgcgctgccaggtgctgagcggctacgccatcctgtgccaggaggccggggccgccctggccggctggagggacaggaccctgtgtgccatggagtgcccagctggcaccatctaccagagctgcatgaccccctgcccagccagctgtgccaacctggccgaccccggggactgtgagggcccctgtgtggagggctgtgccagcatccctggctacgcctacagcggcacccagagcctgccctggctgactgtggccgccccagccatggccagcaccacctcctgggccgccgccttctag

SEQ ID NO: 43976 - DNA, 3555 bp, Artificial Sequence
  Description of Artificial Sequence: Synthetic coding sequence
atggcctgcccccccaacagcaagtacagcctgtgtgccaagccctgcccagacacctgccacagcggcttcagcggcatgttctgcagcgacagatgtgtggaggcctgtgagtgcaaccctggctttgtgctgagcggcctggagtgcatccccaggagccagtgtggctgcctgcaccctgctggcagctacttcaaggtgggggagcgctggtacaagccaggctgcaaggagctgtgtgtgtgtgagagcaacaaccgcatccgctgccagccctggcgctgccgggcccaggagttctgtggccagcaggacggcatctacggctgccacgcccagggcgccgccacctgcacagccagcggggacccccactacctgacctttgatggagccctgcaccacttcatgggcacctgcacctacgtgctgacccggccctgctggagccgcagccaggacagctactttgtggtgtctgccaccaatgaaaatagaggaggcatcctggaggtgtcctacatcaaggctgtgcacgtgacagtgtttgacctgagcatcagcctgctgcggggctgcaaggtgatgctgaatggccaccgggtggccctgcctgtgtggctggcccagggccgggtgaccatccggctgagcagcaacctggtgctgctgtacaccaactttggcctgcaggtgcgctatgatggcagccacctggtggaggtgacagtgcccagcagctatggaggccagctgtgtggcctgtgtggcaactacaacaacaacagcctggatgacaacctgcggccagacaggaagctggccggggacagcatgcagctgggcgccgcctggaagctgcctgagagcagcgagcccggctgcttcctggtgggcggcaagcccagcagctgccaggagaacagcatggctgatgcctggaacaagaactgtgccatcctgatcaacccccagggccccttcagccagtgccaccaggtggtgcccccccagagcagctttgccagctgtgtgcacggccagtgtggcaccaagggggacaccacagccctgtgccgcagcctgcaggcctatgccagcctgtgtgcccaggccggccaggccccagcctggaggaacagaaccttctgccccatgcgctgccccccaggcagcagctacagcccctgcagcagcccctgcccagacacctgcagcagcatcaacaacatcacctgcttccagagcacctgcaagcccaaccagatctgctgggccctggatggcctgctgcggcgggccagcggcgtgggcgtgtgccagctgcccggggagagccactacgtgtcctttgatggcagcaaccacagcatcccagatgcctgcaccctggtgctggtgaaggtgtgccacccagccatggccctgcccttcttcaagatcagcgccaagcatgagaaggaggagggcggcacagaggccttccggctgcacgaggtgtacatcgacatctatgatgcccaggtgaccctgcagaagggccaccgggtgctgatcaacagcaagcaggtgaccctgcctgccatcagccagatccctggggtgtctgtgaagagcagcagcatctacagcatcgtgaacatcaagattggagtgcaggtgaagtttgatggcaaccacctgctggagattgagatccccaccacctactacggcaaggtgtgtggcatgtgtggcaacttcaatgatgaggaggaggatgagctgatgatgcccagtgatgaggtggccaacagcgacagcgagtttgtgaacagctggaaggacaaggacatcgaccccagctgccagagcctgctggtggatgagcagcagatcccagctgagcagcaggagaaccccagcggcaactgcagagctgctgacctgcggcgggcccgggagaagtgtgaggccgccctgcgggcccctgtgtgggcccagtgtgccagcagaattgacctgacccccttcctggtggactgtgccaacaccctgagcctggagtgcccagcctacagcagctacaccaactgcctgcccagctgcagccccagctgctgggacctggatggccgctgtgagggcgccaaggtgcccagcgcctgtgccgagggctgcatctgccagcccggctacgtgctgtctgaagataaatgtgtgcccaggagccagtgtggctgcaaggatgcccacggcggcagcatccccctgggcaagtcctgggtgagcagcggctgcacagagaagtgtgtgtgcaccggcggggccatccagtgtggggacttccgctgccccagcggcagccactgccagctgaccagtgacaacagcaacagcaactgtgtgtctgacaagtctgagcagtgcagcgtgtatggagacccccgctacctgacctttgatggcttctcctaccgcctgcagggccgcatgacctacgtgctgatcaagacagtggatgtgctgcctgagggcgtggagcccctgctggtggagggcaggaacaagatggacccccccaggagcagcatcttcctgcaggaggtgatcaccaccgtgtatggctacaaggtgcagctgcaggccggcctggagctggtggtgaacaaccagaagatggctgtgccctaccggcccaatgagcacctgcgggtgaccctgtggggccagaggctgtacctggtgacagactttgagctggtggtgtcctttggaggcaggaagaatgccggcctgtaccagaggagaagaagagacaagggccgctcctgggccagcgcccgggccagcaagtgccccaacgtggcccggagctcctggagggccacagcccccaggcctgtgggctgctggcagaccccccgggcccccctgctgcctgtgacccggcgctggccccagagccccagcaagagcacagcctgctggatctgtgccctgctgcggacccaggagagcaagaggagctgtgtggcccggagctctgtgggcacccccagcagcgccaggagaagagccctgccctggctggccggcggcacagcccccagcgccctgggcagcagcttcctgacagaggactgcagccagcgctgcacctgtgccagcagccgcatcctgctgtgtgagcccttcagctgccgggccggggaggtgtgcaccctgggcaaccacacccagggctgcttccctgagagcccctgcctgcagaacccctgccagaatgatggccagtgccgggagcagggcgccaccttcacctgtgaatgtgaggtgggctatggaggcggcctgtgcatggagcccagagatgcccccccacccaggaagccagaggccagcaacctggtgggcgtgctgctgggcctgctggtgcctgtggtggtggtgctgctggccgtgacccgggagtgcatctaccgcaccaggaggaagcgggagaagacccaggagggggaccggctggcccggctggtggacacagacacagtgctggactgtgcctgctag

SEQ ID NO: 43977 - DNA, 8163 bp, Artificial Sequence
  Description of Artificial Sequence: Synthetic coding sequence
atggtgccccctgtgtggaccctgctgctgctggtgggcgccgccctcttcaggaaggagaagcccccagaccagaagctggtggtgcgcagcagccgggacaactacgtgctgacccagtgtgactttgaagatgatgccaagcccctgtgtgactggagccaggtgtctgcagatgatgaggactgggtgcgggccagcggccccagccccaccggcagcactggagcccctgggggctacccaaatggagagggcagctacctgcacatggagagcaacagcttccacagaggaggagtggcccggctgctgagcccagacctgtgggagcagggccccctgtgtgtgcactttgcccaccacatgtttggcctgtcctggggcgcccagctgcggctgctgctgctgagcggggaggagggcagaagaccagatgtgctgtggaagcactggaacacccagaggcccagctggatgctgaccaccgtgacagtgcctgctggcttcaccctgcccacccggctgatgtttgagggcacccggggcagcacagcctacctggacatcgccctggatgccctgagcatccggcggggcagctgcaacagagtgtgcatgatgcagacctgcagctttgacatccccaatgacctgtgtgactggacctggatccccacagccagcggggccaagtggacccagaagaagggcagcagcggcaagccaggagtgggcccagatggagacttcagcagccctggcagcggctgctacatgctgctggaccccaagaatgcccggcccggccagaaggctgtgctgctgagccctgtgtccctgagcagcggctgcctgtccttctccttccactacatcctgcggggccagagccctggagctgccctgcacatctatgcctctgtgctgggcagcatcaggaagcacaccctcttcagcggccagcccggccccaactggcaggccgtgtctgtgaactacacagctgtgggccgcatccagtttgctgtggtgggcgtgtttgggaagaccccagagcctgctgtggccgtggatgccaccagcatcgccccctgtggggagggcttcccccagtgtgactttgaggacaatgcccaccccttctgtgactgggtgcagaccagcggagatggcggccactgggccctgggccacaagaatggacctgtgcacggcatgggccctgctgggggcttccccaatgctgggggccactacatctacctggaggctgatgagttcagccaggccggccagagcgtgcggctggtgtcccggcccttctgtgcccctggggacatctgtgtggagtttgcctaccacatgtatggcctgggggagggcaccatgctggagctgctgctgggcagccctgctggcagcccccccatccccctgtggaagagggtgggcagccagaggccctactggcagaacacctctgtgacagtgcccagcggccaccagcagcccatgcagctgatcttcaagggcatccagggcagcaacacagcctctgtggtggccatgggcttcatcctgatcaaccctggcacctgccctgtgaaggtgctgcctgagctgccccctgtgtcccctgtgagcagcacaggccccagcgagaccaccggcctgacagagaaccccaccatcagcaccaagaagcccaccgtgtccattgagaagcccagcgtgaccacagagaagcccaccgtgcccaaggagaagcccaccatccccacagagaagcccaccatcagcacagagaagcccaccatccccagcgagaagcccaacatgcccagcgagaagcccaccatccccagcgagaagcccaccatcctgacagagaagcccaccatccccagcgagaagcccaccatccccagcgagaagcccaccatcagcacagagaagcccaccgtgcccacagaggagcccaccacccccacagaggagaccaccacctccatggaggagcctgtgatccccacagagaagcccagcatccccacagagaagcccagcatccccacagagaagcccaccatctccatggaggagaccatcatcagcacagagaagcccaccatcagccctgagaagcccaccatccccacagagaagcccaccatccccacagagaagagcaccatcagccctgagaagcccaccacccccacagagaagcccaccatccccacagagaagcccaccatcagccctgagaagcccaccacccccacagagaagcccaccatcagccctgagaagctgaccatccccacagagaagcccaccatccccacagagaagcccaccatccccacagagaagcccaccatcagcacagaggagcccaccacccccacagaggagaccaccatcagcacagagaagcccagcatccccatggagaagcccaccctgcccacagaggagaccaccacctctgtggaggagaccaccatcagcacagagaagctgaccatccccatggagaagcccaccatcagcacagagaagcccaccatccccacagagaagcccaccatcagccctgagaagctgaccatccccacagagaagctgaccatccccacagagaagcccaccatccccatcgaggagaccaccatcagcacagagaagctgaccatccccacagagaagcccaccatcagccctgagaagcccaccatcagcacagagaagcccaccatccccacagagaagcccaccatccccacagaggagaccaccatcagcacagagaagctgaccatccccacagagaagcccaccatcagccctgagaagctgaccatccccacagagaagcccaccatcagcacagagaagcccaccatccccacagagaagctgaccatccccacagagaagcccaccatccccacagagaagcccaccatccccacagagaagctgacagccctgcggcccccccaccccagccccacagccaccggcctggccgccctggtgatgagcccccacgcccccagcacccccatgaccagcgtcatcctgggcaccaccaccaccagccgcagcagcacagagcgctgccccccaaatgcccgctatgagagctgtgcctgcccagccagctgcaagagcccccggcccagctgtggccccctgtgccgggagggctgtgtgtgcaaccctggcttcctgttcagtgacaaccactgcatccaggccagcagctgcaactgcttctacaacaatgactactatgagcccggggctgagtggttcagccccaactgcacagagcactgccgctgctggccaggcagccgggtggagtgccagatcagccagtgtggcacccacacagtgtgccagctgaagaatggccagtatggctgccacccctatgccggcacagccacctgcctggtgtatggagacccccactacgtgacctttgatggccgccacttcggcttcatgggcaagtgcacctacatcctggcccagccctgtggcaacagcacagaccccttcttccgggtgacagccaagaatgaggagcagggccaggagggcgtgtcctgcctgagcaaggtgtatgtgaccctgcctgagagcacagtgaccctgctgaagggccgccgcaccctggtgggcggccagcaggtgaccctgcctgccatccccagcaagggcgtcttcctgggcgccagcggccgctttgtggagctgcagacagaatttggcctgcgggtgcgctgggatggagaccagcagctgtatgtgacagtgagcagcacctacagcggcaagctgtgtggcctgtgtggcaactatgatggcaacagcgacaatgaccacctgaagctggatggcagccctgctggggacaaggaggagctgggcaacagctggcagacagaccaggatgaggaccaggagtgccagaagtaccaggtggtgaacagccccagctgtgacagcagcctgcagagctccatgagcggccctggcttctgtggccgcctggtggacacccacggcccctttgagacctgcctgctgcacgtgaaggccgccagcttctttgacagctgcatgctggacatgtgtggcttccagggcctgcagcacctgctgtgcacccacatgagcaccatgaccaccacctgccaggatgctggccatgctgtgaagccctggagggagccccacttctgccccatggcctgcccccccaacagcaagtacagcctgtgtgccaagccctgcccagacacctgccacagcggcttcagcggcatgttctgcagcgacagatgtgtggaggcctgtgagtgcaaccctggctttgtgctgagcggcctggagtgcatccccaggagccagtgtggctgcctgcaccctgctggcagctacttcaaggtgggggagcgctggtacaagccaggctgcaaggagctgtgtgtgtgtgagagcaacaaccgcatccgctgccagccctggcgctgccgggcccaggagttctgtggccagcaggacggcatctacggctgccacgcccagggcgccgccacctgcacagccagcggggacccccactacctgacctttgatggagccctgcaccacttcatgggcacctgcacctacgtgctgacccggccctgctggagccgcagccaggacagctactttgtggtgtctgccaccaatgaaaatagaggaggcatcctggaggtgtcctacatcaaggctgtgcacgtgacagtgtttgacctgagcatcagcctgctgcggggctgcaaggtgatgctgaatggccaccgggtggccctgcctgtgtggctggcccagggccgggtgaccatccggctgagcagcaacctggtgctgctgtacaccaactttggcctgcaggtgcgctatgatggcagccacctggtggaggtgacagtgcccagcagctatggaggccagctgtgtggcctgtgtggcaactacaacaacaacagcctggatgacaacctgcggccagacaggaagctggccggggacagcatgcagctgggcgccgcctggaagctgcctgagagcagcgagcccggctgcttcctggtgggcggcaagcccagcagctgccaggagaacagcatggctgatgcctggaacaagaactgtgccatcctgatcaacccccagggccccttcagccagtgccaccaggtggtgcccccccagagcagctttgccagctgtgtgcacggccagtgtggcaccaagggggacaccacagccctgtgccgcagcctgcaggcctatgccagcctgtgtgcccaggccggccaggccccagcctggaggaacagaaccttctgccccatgcgctgccccccaggcagcagctacagcccctgcagcagcccctgcccagacacctgcagcagcatcaacaacccccgggactgccccaaggccctgccctgtgccgagagctgtgagtgccagaagggccacatcctgagcggcaccagctgtgtgcccctgggccagtgtggctgcacagatcctgctggcagctaccaccctgtgggggagcgctggtacacagagaacacctgcacccggctgtgcacctgcagcgtgcacaacaacatcacctgcttccagagcacctgcaagcccaaccagatctgctgggccctggatggcctgctgcggcgggccagcggcgtgggcgtgtgccagctgcctggagagagccactacgtgtcctttgatggcagcaaccacagcatcccagatgcctgcaccctggtgctggtgaaggtgtgccacccagccatggccctgcccttcttcaagatcagcgccaagcatgagaaggaggagggcggcacagaggccttccggctgcacgaggtgtacatcgacatctatgatgcccaggtgaccctgcagaagggccaccgggtgctgatcaacagcaagcaggtgaccctgcctgccatcagccagatccctggggtgtctgtgaagagcagcagcatctacagcatcgtgaacatcaagattggagtgcaggtgaagtttgatggcaaccacctgctggagattgagatccccaccacctactacggcaaggtgtgtggcatgtgtggcaacttcaatgatgaggaggaggatgagctgatgatgcccagtgatgaggtggccaacagcgacagcgagtttgtgaacagctggaaggacaaggacatcgaccccagctgccagagcctgctggtggatgagcagcagatcccagctgagcagcaggagaaccccagcggcaactgcagagctgctgacctgcggcgggcccgggagaagtgtgaggccgccctgcgggcccctgtgtgggcccagtgtgccagcagaattgacctgacccccttcctggtggactgtgccaacaccctgtgtgaatttggaggcctgtaccaggccctgtgccaggccctgcaggccttcggggccacctgccagagccagggcctgaagccacccctgtggaggaacagcagcttctgccccctggagtgcccagcctacagcagctacaccaactgcctgcccagctgcagccccagctgctgggacctggatggccgctgtgagggcgccaaggtgcccagcgcctgtgccgagggctgcatctgccagcccggctacgtgctgtctgaagataaatgtgtgcccaggagccagtgtggctgcaaggatgcccacggcggcagcatccccctgggcaagtcctgggtgagcagcggctgcacagagaagtgtgtgtgcaccggcggggccatccagtgtggggacttccgctgccccagcggcagccactgccagctgaccagtgacaacagcaacagcaactgtgtgtctgacaagtctgagcagtgcagcgtgtatggagacccccgctacctgacctttgatggcttctcctaccgcctgcagggccgcatgacctacgtgctgatcaagacagtggatgtgctgcctgagggcgtggagcccctgctggtggagggcaggaacaagatggacccccccaggagcagcatcttcctgcaggaggtgatcaccaccgtgtatggctacaaggtgcagctgcaggccggcctggagctggtggtgaacaaccagaagatggctgtgccctaccggcccaatgagcacctgcgggtgaccctgtggggccagaggctgtacctggtgacagactttgagctggtggtgtcctttggaggcaggaagaatgctgtgatcagcctgcccagcatgtatgagggcctggtgtctggcctgtgtggcaactatgacaagaacaggaagaatgacatgatgctgcccagcggggccctgacccagaacctgaacaccttcggcaacagctgggaggtgaagacagaagatgccctgctgcgcttcccccgggccatcccagctgaggaggagggccagggcgctgagctgggcctgaggacaggcctgcaggtgtctgagtgcagccctgagcagctggccagcaacagcacccaggcctgccgggtgctggccgacccccagggcccctttgctgcctgccaccagacagtggcccctgagcccttccaggagcactgtgtgctggacctgtgcagcgcccaggacccccgggagcaggaggagctgcgctgccaggtgctgagcggctacgccatcctgtgccaggaggccggggccgccctggccggctggagggacaggaccctgtgtgagagcccctgcctgcagaacccctgccagaatgatggccagtgccgggagcagggcgccaccttcacctgtgaatgtgaggtgggctacggcggcggcctgtgcatggagcccagagatgcccccccacccaggaagccagccagcaacctggtgggcgtgctgctgggcctgctggtgcctgtggtggtggtgctgctggccgtgacccgggagtgcatctaccgcaccaggaggaagcgggagaagacccaggagggggaccggctggcccggctggtggacacagacacagtgctggactgtgcctgctag

SEQ ID NO: 43978 - DNA, 2280 bp, Artificial Sequence
  Description of Artificial Sequence: Synthetic coding sequence
atggtgcacttcctgcaccctggccacacccccaggaacatcgtgcccccagatgcccagaaggatgccctgggctgctgcgtggtgcaggaggaggccagcccctacaccctggtgaacatctgcctgaatgtgctgattgccaacctggagaagctgtgcagcgagaggccagatggcaccctgtgcctgcctgagcactggagcttcccccaggaggtggccgagcgcttcctgcgggtgatgacctggcagggcaagctgacagacagaacagccagcatcttccggggcaaccagatgaagctgaagctggtgaacatccagaaggccaagatcagcacagctgccttcatcaaggccttctgccgccacaagctgattgagctgaatgccacagctgtgcatgctgacctgcctgtgcctgacatcatcagcggcctgtgcagcaaccgctggatccagcagaacctgcagtgcctgctgctggacagcaccagcatcccccagaacagccggctgctcttcttcagccagctgaccggcctgcgcatcctgtctgtgttcaacgtgtgcttccacacagaggacctggccaacgtgtcccagctgccccggctggagagcctggacatcagcaacaccctggtgacagacatcagcgccctgctgacctgcaaggaccggctgaagagcctgaccatgcactacctgaagtgcctggccatgaccaagagccagatcctggccgtcatccgggagctgaagtgcctgctgcacctggacatcagtgaccaccggcagctgaagagtgacctggccttccacctgctgcagcagaaggacatcctgcccaacgtggtgtccctggacatcagcggcggcaactgcatcacagatgaggccgtggagctgttcatccggctgcggcctgccatgcagtttgtgggcctgctggccacagatgctggcagcagtgacttcttcaccaccaagcagggcctgcgggtggccggcggggcctccatgagccagatcagcgaggccctgagccgctacagaaacagaagctgctttgtgaaggaggccctgcacaggctcttcacagagaccttctccatggaggtgaccatgcctgccatcctgaagctggtggccatcggcatgaggaaccaccccctggacctgcgggtgcagttcaccgccagcgcctgtgccctgaacctgacccggcagggcctggccaagggcatgcctgtgcggctgctgtctgaggtgacctgcctgctcttcaaggccctgaagaacttcccccactaccagcagctgcagaagaactgcctgctgagcctgaccaacagccgcatcctggtggatgtgccctttgacagatttgatgctgccaagtttgtgatgcgctggctgtgcaagcatgagaaccccaagatgcagaccatggctgtgtctgtgaccagcatcctggccctgcagctgagccctgagcagacagcccagctggaggagctgttcatggctgtgaaggagctgctggccatcgtgaagcagaagaccacagagaacctggatgatgtgaccttcctgttcaccctgaaggccctgtggaacctgacagatggcagccctgctgcctgcaagcacttcatcgagaaccagggcctgcagatcttcatccaggtgctggagaccttcagcgagagcgccatccagagcaaggtgctgggcctgctgaacaacattgctgaggtgcgggagctgagcagcaagctggtgacagaagatgtgctgaagcacatcaacagcctgctgtgcagccgggagatggaggtgtcctactttgctgctggcatcatcgcccacctgaccagtgaccggcagctgtggatcagccgggacttccagaggaggaccctgctgcaggacctgcacgccaccatccagaactggcccagcagcagctgcaagatgacagccctggtgacctaccgctccttcaagaccttcttccccctgctgggcaacttcagccagcctgaggtgcagctgtgggccctgtgggccatgtaccacgtgtgcagcaagaaccccagcaagtactgcaagatgctggtggaggaggagggcctgcagctgctgtgtgacatccaggagcacagcgaggccacccccaaggcccagcagattgctgccagcatcctggatgacttcaggatgcacttcatgaactaccagaggcccaccctgtgccagatgcccttctag

SEQ ID NO: 43979 - DNA, 1254 bp, Artificial Sequence
  Description of Artificial Sequence: Synthetic coding sequence
atgagccagatcagcgaggccctgagccgctacagaaacagaagctgctttgtgaaggaggccctgcacaggctcttcacagagaccttctccatggaggtgaccatgcctgccatcctgaagctggtggccatcggcatgaggaaccaccccctggacctgcgggtgcagttcaccgccagcgcctgtgccctgaacctgacccggcagggcctggccaagggcatgcctgtgcggctgctgtctgaggtgacctgcctgctcttcaaggccctgaagaacttcccccactaccagcagctgcagaagaactgcctgctgagcctgaccaacagccgcatcctggtggatgtgccctttgacagatttgatgctgccaagtttgtgatgcgctggctgtgcaagcatgagaaccccaagatgcagaccatggctgtgtctgtgaccagcatcctggccctgcagctgagccctgagcagacagcccagctggaggagctgttcatggctgtgaaggagctgctggccatcgtgaagcagaagaccacagagaacctggatgatgtgaccttcctgttcaccctgaaggccctgtggaacctgacagatggcagccctgctgcctgcaagcacttcatcgagaaccagggcctgcagatcttcatccaggtgctggagaccttcagcgagagcgccatccagagcaaggtgctgggcctgctgaacaacattgctgaggtgcgggagctgagcagcaagctggtgacagaagatgtgctgaagcacatcaacagcctgctgtgcagccgggagatggaggtgtcctactttgctgctggcatcatcgcccacctgaccagtgaccggcagctgtggatcagccgggacttccagaggaggaccctgctgcaggacctgcacgccaccatccagaactggcccagcagcagctgcaagatgacagccctggtgacctaccgctccttcaagaccttcttccccctgctgggcaacttcagccagcctgaggtgcagctgtgggccctgtgggccatgtaccacgtgtgcagcaagaaccccagcaagtactgcaagatgctggtggaggaggagggcctgcagctgctgtgtgacatccaggagcacagcgaggccacccccaaggcccagcagattgctgccagcatcctggatgacttcaggatgcacttcatgaactaccagaggcccaccctgtgccagatgcccttctag

SEQ ID NO: 43980 - DNA, 2235 bp, Artificial Sequence
  Description of Artificial Sequence: Synthetic coding sequence
atgcctgaggaccaggccggggccgccatggaggaggccagcccctacagcctgctggacatctgcctgaacttcctgaccacccacctggagaagttctgcagcgcccggcaggacggcaccctgtgcctgcaggagcccggggtcttcccccaggaggtggccgaccggctgctgcggaccatggccttccacggcctgctgaatgatggcaccgtgggcatcttccggggcaaccagatgaggctgaagagggcctgcatcaggaaggccaagatctctgctgtggccttcaggaaggccttctgccaccacaagctggtggagctggatgccactggagtgaatgctgacatcaccatcacagacatcatcagcggcctgggcagcaacaagtggatccagcagaacctgcagtgcctggtgctgaacagcctgaccctgagcctggaggacccctatgagcgctgcttcagccggctgagcggcctgcgggccctgagcatcaccaacgtgctcttctacaatgaagacctggccgaggtggccagcctgccccggctggagagcctggacatcagcaacaccagcatcacagacatcacagccctgctggcctgcaaggaccggctgaagagcctgaccatgcaccacctgaagtgcctgaagatgaccaccacccagatcctggatgtggtgcgggagctgaagcacctgaaccacctggacatcagtgatgacaagcagttcaccagtgacatcgccctgcggctgctggagcagaaggacatcctgcccaacctggtgtccctggatgtgtctggcaggaagcacgtgacagacaaggctgtggaggccttcatccagcagaggcccagcatgcagtttgtgggcctgctggccacagatgctggctacagcgagttcctgactggagagggccacctgaaggtgtctggagaggccaatgagacccagattgctgaggccctgaagcgctacagcgagcgggccttctttgtgcgggaggccctcttccacctgttcagcctgacccacgtgatggagaagaccaagccagagatcctgaagctggtggtgacaggcatgaggaaccaccccatgaacctgcctgtgcagctggccgccagcgcctgtgtgttcaacctgaccaagcaggacctggccgccggcatgcctgtgcggctgctggctgatgtgacccacctgctgctgaaggccatggagcacttccccaaccaccagcagctgcagaagaactgcctgctgagcctgtgcagcgaccgcatcctgcaggatgtgcccttcaacagatttgaggccgccaagctggtgatgcagtggctgtgcaaccacgaggaccagaacatgcagaggatggctgtggccatcatcagcatcctggccgccaagctgagcacagagcagacagcccagctgggcacagagctgttcatcgtgcggcagctgctgcagatcgtgaagcagaagaccaaccagaacagcgtggacaccaccctgaagttcaccctgagcgccctgtggaacctgacagatgagagccccaccacctgccgccacttcatcgagaaccagggcctggagctgttcatgagggtgctggagagcttccccacagagagcagcatccagcagaaggtgctgggcctgctgaacaacattgctgaggtgcaggagctgcacagcgagctgatgtggaaggacttcatcgaccacatcagcagcctgctgcacagcgtggaggtggaggtgtcctactttgctgctggcatcatcgcccacctgatcagcagaggagagcaggcctggaccctgagccgcagccagaggaacagcctgctggatgacctgcacagcgccatcctgaagtggcccaccccagaatgtgagatggtggcctaccgctccttcaaccccttcttccccctgctgggctgcttcaccaccccaggagtgcagctgtgggccgtgtgggccatgcagcacgtgtgcagcaagaaccccagccgctactgcagcatgctgattgaggagggcggcctgcagcacctgtacaacatcaaggaccacgagcacacagacccccacgtgcagcagattgctgtggccatcctggacagcctggagaagcacatcgtgagacatggccggcccccaccctgcaagaagcagccccaggcccggctgaactag

SEQ ID NO: 43981 - DNA, 2025 bp, Artificial Sequence
  Description of Artificial Sequence: Synthetic coding sequence
atgcctgaggaccaggccggggccgccatggaggaggccagcccctacagcctgctggacatctgcctgaacttcctgaccacccacctggagaagttctgcagcgcccggcaggacggcaccctgtgcctgcaggagcccggggtcttcccccaggaggtggccgaccggctgctgcggaccatggccttccacggcctgctgaatgatggcaccgtgggcatcttccggggcaaccagatgaggctgaagagggcctgcatcaggaaggccaagatctctgctgtggccttcaggaaggccttctgccaccacaagctggtggagctggatgccactggagtgaatgctgacatcaccatcacagacatcatcagcggcctgggcagcaacaagtggatccagcagaacctgcagtgcctggtgctgaacagcctgaccctgagcctggaggacccctatgagcgctgcttcagccggctgagcggcctgcgggccctgagcatcaccaacgtgctcttctacaatgaagacctggccgaggtggccagcctgccccggctggagagcctggacatcagcaacaccagcatcacagacatcacagccctgctggcctgcaaggaccggctgaagagcctgaccatgcaccacctgaagtgcctgaagatgaccaccacccagatcctggatgtggtgcgggagctgaagcacctgaaccacctggacatcagtgatgacaagcagttcaccagtgacatcgccctgcggctgctggagcagaaggacatcctgcccaacctggtgtccctggatgtgtctggcaggaagcacgtgacagacaaggctgtggaggccttcatccagcagaggcccagcatgcagtttgtgggcctgctggccacagatgctggctacagcgagttcctgactggagagggccacctgaaggtgtctggagaggccaatgagacccagattgctgaggccctgaagcgctacagcgagcgggccttctttgtgcgggaggccctcttccacctgttcagcctgacccacgtgatggagaagaccaagccagagatcctgaagctggtggtgacaggcatgaggaaccaccccatgaacctgcctgtgcagctggccgccagcgcctgtgtgttcaacctgaccaagcaggacctggccgccggcatgcctgtgcggctgctggctgatgtgacccacctgctgctgaaggccatggagcacttccccaaccaccagcagctgcagaagaactgcctgctgagcctgtgcagcgaccgcatcctgcaggatgtgcccttcaacagatttgaggccgccaagctggtgatgcagtggctgtgcaaccacgaggaccagaacatgcagaggatggctgtggccatcatcagcatcctggccgccaagctgagcacagagcagacagcccagctgggcacagagctgttcatcgtgaggaacaacattgctgaggtgcaggagctgcacagcgagctgatgtggaaggacttcatcgaccacatcagcagcctgctgcacagcgtggaggtggaggtgtcctactttgctgctggcatcatcgcccacctgatcagcagaggagagcaggcctggaccctgagccgcagccagaggaacagcctgctggatgacctgcacagcgccatcctgaagtggcccaccccagaatgtgagatggtggcctaccgctccttcaaccccttcttccccctgctgggctgcttcaccaccccaggagtgcagctgtgggccgtgtgggccatgcagcacgtgtgcagcaagaaccccagccgctactgcagcatgctgattgaggagggcggcctgcagcacctgtacaacatcaaggaccacgagcacacagacccccacgtgcagcagattgctgtggccatcctggacagcctggagaagcacatcgtgagacatggccggcccccaccctgcaagaagcagccccaggcccggctgaactag

SEQ ID NO: 43982 - DNA, 1701 bp, Artificial Sequence
  Description of Artificial Sequence: Synthetic coding sequence
atgcctgaggaccaggccggggccgccatggaggaggccagcccctacagcctgctggacatctgcctgaacttcctgaccacccacctggagaagttctgcagcgcccggcaggacggcaccctgtgcctgcaggagcccggggtcttcccccaggaggtggccgaccggctgctgcggaccatggccttccacggcctgctgaatgatggcaccgtgggcatcttccggggcaaccagatgaggctgaagagggcctgcatcaggaaggccaagatctctgctgtggccttcaggaaggccttctgccaccacaagctggtggagctggatgccactggagtgaatgctgacatcaccatcacagacatcatcagcggcctgggcagcaacaagtggatccagcagaacctgcagtgcctggtgctgaacagcctgaccctgagcctggaggacccctatgagcgctgcttcagccggctgagcggcctgcgggccctgagcatcaccaacgtgctcttctacaatgaagacctggccgaggtggccagcctgccccggctggagagcctggacatcagcaacaccagcatcacagacatcacagccctgctggcctgcaaggaccggctgaagagcctgaccatgcaccacctgaagtgcctgaagatgaccaccacccagatcctggatgtggtgcgggagctgaagcacctgaaccacctggacatcagtgatgacaagcagttcaccagtgacatcgccctgcggctgctggagcagaaggacatcctgcccaacctggtgtccctggatgtgtctggcaggaagcacgtgacagacaaggctgtggaggccttcatccagcagaggcccagcatgcagtttgtgggcctgctggccacagatgctggctacagcgagttcctgactggagagggccacctgaaggtgtctggagaggccaatgagacccagattgctgaggccctgaagcgctacagcgagcgggccttctttgtgcgggaggccctcttccacctgttcagcctgacccacgtgatggagaagaccaagccagagatcctgaagctggtggtgacaggcatgaggaaccaccccatgaacctgcctgtgcagctggccgccagcgcctgtgtgttcaacctgaccaagcaggacctggccgccggcatgcctgtgcggctgctggctgatgtgacccacctgctgctgaaggccatggagcacttccccaaccaccagcagctgcagaagaactgcctgctgagcctgtgcagcgaccgcatcctgcaggatgtgcccttcaacagatttgaggccgccaagctggtgatgcagtggctgtgcaaccacgaggaccagaacatgcagaggatggctgtggccatcatcagcatcctggccgccaagctgagcacagagcagacagcccagctgggcacagagctgttcatcgtgcggcagctgctgcagatcgtgaagcagaagaccaaccagaacagcgtggacaccaccctgaagttcaccctgagcgccctgtggaacctgacagatgagagccccaccacctgccgccacttcatcgagaaccagggcctggagctgttcatgagggtgctggagagcttccccacagagagcagcatccagcagaaggtgctgggcctgctgggctag

SEQ ID NO: 43983 - DNA, 966 bp, Artificial Sequence
  Description of Artificial Sequence: Synthetic coding sequence
atggagagatttgtgcgggtgccctacggcctgtaccagggctacggcagcacagtgcccctgggccagcccggcctgagcggccacaagcagcctgactggaggcagaacatgggcccccccaccttcctggcccggcccggcctgctggtgcctgccaatgccccagactactgcatcgacccctacaagagggcccagctgaaggccatcctgagccagatgaaccccagcctgagcccccggctgtgcaagcccaacaccaaggaggtgggcgtgcaggtgagcccccgggtggacaaggctgtgcagtgcagcctgggccccaggaccctgagcagctgcagcccctgggatggccgggacccccaggagcccctgcctgcctgtggggtgaccagccctgccactggaagaagaggcctcatccggctgcggagagatggagatgaggccgagagcaaggccctgcccggccctgctgaggccagccagccccagccccccagcagaagaagtggagctgaccggcaggaggagcccggccagctggaggagagcggggagaaggatgccccctgcccccaggagaccaagagcaagcaggtgcctggagatgctgccagcgagcccctgcggcggcccaacttccagttcctggagcccaagtatggctacttccactgcaaggactgcaagacccgctgggagagcgcctacgtgtggtgcatcagcggcaccaacaaggtgtacttcaagcagctgtgctgcaagtgccagaagagcttcaacccctacagagtggaggccatccagtgccagacctgcagcaagagccactgcagctgcccccagaagaagaggcacatcgacctgcggcggccccaccggcaggagctgtgtggccgctgcaaggacaagcgcttcagctgtggcaacatctacagcttcaagtatgtgatgtag

SEQ ID NO: 43984 - DNA, 78 bp, Artificial Sequence
  Description of Artificial Sequence: Synthetic coding sequence
atggagagatttgtgcgggtgccctacggcctgtaccagggctacggcagcacagtgcccctgggccagcccggctag

SEQ ID NO: 43985 - DNA, 504 bp, Artificial Sequence
  Description of Artificial Sequence: Synthetic coding sequence
atgctgactgtggccctgctggccctgctgtgtgccagcgccagcggaaatgccatccaggcccggagcagcagctacagcggggagtatggaggcggcggcggcaagcgcttcagccacagcggcaaccagctggatggccccatcacagccctgcgggtgcgggtgaacacctactacatcgtgggcctgcaggtgcgctatggcaaggtgtggagcgactatgtgggcggcagaaatggagacctggaggagatcttcctgcaccctggagagagcgtcatccaggtgtctgggaagtacaagtggtacctgaagaagctgctgtttgtgacagacaagggccgctacctgagctttgggaaggacagcggcaccagcttcaatgctgtgcccctgcaccccaacacagtgctgcgcttcatcagcggccgcagcggcagcctgattgatgccatcggcctgcactgggatgtgtaccccagcagctgcagccgctgctag

SEQ ID NO: 43986 - DNA, 489 bp, Artificial Sequence
  Description of Artificial Sequence: Synthetic coding sequence
  Description of Combined DNA/RNA Molecule: Synthetic coding sequence
atggccgccggccccagcggctgcctggtgcccgccttcggcctgcggctgctgcttgccacagtcctccaggccgtcagcgccttcggcgccgagttctcaagcgaggcctgcagggaactgggattcagcagcaatcttttgtgctcctcttgcgacctgcttggtcagttcaacttgctccagttagatcccgattgtaggggctgttgccaggaggaggcccagtttgagacgaaaaagctgtacgcaggggccatattggaggtatgcgggugaaaactgggaagatttcctcaagtgcaggctttcgtgcgtagcgacaaaccgaagttgttcagaggccttcagattaagtacgttaggggctccgacccagtacttaaactcctggatgataacggtaacattgccgaagagctcagcatcctgaaatggaacacagactcagttgaggaatttctgtcggaaaagctggagaggatatag

SEQ ID NO: 43987 - DNA, 366 bp, Artificial Sequence
  Description of Artificial Sequence: Synthetic coding sequence
  Description of Combined DNA/RNA Molecule: Synthetic coding sequence
atggccgccggccccagcggctgcctggtgcccgccttcggcctgaggctgctgcttgctacagtcctgcaagccgtttcagccttcggagctgagttttcaagcgaggcttgtcgggagttgggattctcgtcgaatctgctgtgcagttcgtgcgacctgctcggccaattcaaccttctgcagctcgacccagattgtagaggctgctgtcaagaggaagcacagttcgaaaccaagaagctgtacgccggggctattttagaggtctgcggtugaaaattaggtcgcttcccccaggtgcaggtatgcccatggtttcgcccctgcatcaaagctttcgggcgccagtgggaacattgttag

SEQ ID NO: 43988 - DNA, 426 bp, Artificial Sequence
  Description of Artificial Sequence: Synthetic coding sequence
atggccgccggccccagcggctgcctggtgcccgccttcggcctgcggcttcttctggccactgttctgcaggccgttagcgcattcggagccgagttctcctcggaggcctgcagagaactcgggttctcttctaatctactgtgctcaagctgcgatctgctcgggcaattcaatctcttgcagcttgatcccgattgccgtgggtgctgccaagaagaagcacagttcgaaacaaaaaagtactcaagcatagtgtcgaagcaggagtgtcatcactcaaactgtatgcaggagctgtttctcaagtttgtcgacgaaaactgggaagggagcctgaagagcaaactcctactcggggtcataaatcctaactgctcagaggactgtaagagcagcatgtcggtcgtccagaccctctattag

SEQ ID NO: 43989 - DNA, 1707 bp, Artificial Sequence
  Description of Artificial Sequence: Synthetic coding sequence
atgagccaccggagcgacaccctgcccgtgcccagcggccagcggcgtggaagggttccccgcgaccattccatctacacacagctgctcgaaattaccttacacctccagcaggccatgactgaacacttcgtgcagctgacatccagacaagggctgagtctggaggaacgcaggcataccgaggcgatatgtgagcatgaagctctgttatcacgactaatctgcagaatgattaacctgctccagtcgggggccgccagtgggctggagctgcaggtgcctctacctagtgaggatagtcgcggagacgtgagatatggacaaagggcacagttgagcggacagcccgaccctgtccctcagctgtcagattgtgaggccgcctttgtgaacagggacctgagcattcgcggtattgacatctctgtcttctaccagtcatctttccaagactataacgcttaccaaaaagacaagtatcacaaagataagaacaccctcggctttataaatttgggcacctccgagaataagttatgtatggacctgatgaccgaaaggctacaggagtctgatatgaattgcatcgaggacacactgctgcagtacccagactggcgcggacagccatttttgagagaggaggtggcaagattcctgacttattactgtcgtgcccccacacggctagatcctgaaaatgtagtggtgctgaacggctgctgctcagtattctgcgcactagctatggtgctttgcgatccaggggaggcgttcttggtcccggccccattctacgggggtttcgcattctctagtaggctttacgccaaagttgagttaatacccgtgcacctggagtctgaagtcacagtgacaaatacccacccatttcaattgaccgtggacaaactggaggaggccctcctggaggctaggctggaaggaaaaaaagttagaggtctggtcttaattaatccacagaaccccctcggggacatttacagcccagacagtctcatgaaatacctggaattcgccaaacgatacaatcttcatgtcatcatcgatgaaatatacatgctatcagtgttcgacgagagtataactttccatagtattctgtccatgaagagtctgcccgacagcaacaggacccacgtgatttggggcacaagcaaggactttggaatcagtgggtttcgctttggcgcactctatacacataacaaggaagtggcttctgccgtgagtgcgtttggatacctccacagtattagcggaataactcagcataaactctgccagctgctgcaaaatacagagtggattgacaaggtgtacctaccaactaattgttaccggttgagggaggcgcacaagtacatcaccgccgagctcaaggccctcgaaattcccttccataatcgatcatcaggactgtatgtttggatcaacctcaagaagtacctggacccttgtacctttgaagaagagcgcctgctctactgcagatttctggataacaagctgcttctgtcaaggggaaagacttatatgtgcaaggaacccggatggttctgtctgatctttgcggatgaactacccaggctaaagctggctatgaggcggttctgcgacgttttacaggagcagaaagaggcacttatcgtgaaacagttggaggacgccatgagggaatag

SEQ ID NO: 43990 - DNA, 264 bp, Artificial Sequence
  Description of Artificial Sequence: Synthetic coding sequence
atggccaagcacctgaagttcatcgcccggaccgtgatggtgcaggaggggaatgtcgagtccgcgtaccgcaccctcaatcggattcttacaatggacgggctgattgaggatattaagcaccgtagatactatgaaaaaccctgctgcagacgccagcgcgaatcctacgaacgctgccgaaggatttacaatatggagatggctcggaaaatcaatttccttatgcgaaagaatcgtgcagatccatggcaaggttgttag

SEQ ID NO: 43991 - DNA, 1629 bp, Artificial Sequence
  Description of Artificial Sequence: Synthetic coding sequence
atgaacggcaagcggcccgccgagcccggccccgcccgggtgggcaagaaaggtaagaaagaggtgatggcagagttcagtgatgcggtgaccgaagagacacttaaaaaacaagtcgctgaggcttggagtagaaggaccccattcagccatgaggtcatcgtgatggatatggatccctttctacactgtgtcatccccaatttcatccagtctcaagacttcctcgaaggcttacagaaagaactcatgaacctggactttcatgagaagtacaatgatttatacaaattccagcaatctgacgacctgaagaagcggcgtgaaccacatataagtactctgagaaagatcctgtttgaagactttcggagttggctgagcgatatctccaagatcgatctggagagcaccattgacatgtcatgtgctaagtacgagttcacggatgctctcctctgccatgacgatgaattggaaggacggagaatcgcattcatcctctacctggttccgccctgggatagatcaatgggtggcaccctggatctctactcaatcgatgagcacttccagcccaaacagattgttaagtcgctgatcccttcttggaataagcttgtcttcttcgaagtgtcgcccgtgtccttccaccaggtgtcggaagtcctgtctgaagaaaaatctcggttatccatcagcggatggttccacggtccaagcctgactcggccaccgaattacttcgaacctccgatcccaagatcgccccatatacctcaggaccacgaaatactgtacgactggataaatcccacctatctggacatggattaccaggtgcaaattcaggaagagttcgaagaatcgtctgagattctgctaaaggagtttttgaagccggagaaatttacaaaggtttgtgaagccctcgaacacggtcacgtggagtggagctctcgtggtccccctaacaagcgattctacgagaaagcagaagaaagcaaactgcccgagattctgaaggagtgcatgaagctcttcagaagtgaagcattgtttctgctgctctctaactttacaggactcaagttgcactttctcgcccccagtgaagaagatgagatgaatgacaagaaggaggccgagaccacagacatcactgaggaggggaccagtcattctcccccagaacccgaaaacaaccagatggcgatctccaacaattcccaacagtctaatgaacaaaccgatcctgaacccgaggaaaatgagaccaagaaagagtcttctgtgcctatgtgccagggggaactcagacattggaagacaggtcattatactcttatccacgatcattctaaagccgagttcgctctggacttgattctgtattgtggttgtgaaggatgggaacccgagtatggcgggttcaccagttatatcgctaagggggaggacgaagaattgctcaccgtcaatcctgaatccaacagccttgctttggtgtatcgcgaccgcgagacattgaaattcgttaagcatatcaatcatcgaagcctggaacagaaaaagacattccccaatcgaaccggtttttgggatttctctttcatctattacgagtag

SEQ ID NO: 43992 - DNA, 1161 bp, Artificial Sequence
  Description of Artificial Sequence: Synthetic coding sequence
atgaacagcctgatgccctgctgcgccttcatcctgtacctggtgcccccctgggaccggtccatgggaggcactctggacctgtattccattgacgagcattttcagcccaaacaaattgtgaagagcctgataccttcctggaacaagctcgtcttctttgaggtttcaccggtttcattccatcaggtgagcgaggtcctgtcggaggaaaaaagtaggctatctatctcagggtggttccacggacctagtctgactcggcccccaaattattttgaaccccctatccctagatctccacatatcccacaggaccacgaaatcctgtatgactggattaacccaacttacctggacatggactatcaggttcagatccaggaggaatttgaagagtctagtgagatactcctgaaagagttcctgaagcctgagaaattcactaaggtctgcgaagctcttgagcacgggcatgttgaatggagctcaagaggacctcccaacaagaggttttatgagaaagccgaagagtccaagctgcccgaaatcctcaaggagtgcatgaagctcttcaggtcagaggccctttttctgcttttgagcaactttaccggactcaaactgcatttcttggcaccaagcgaggaggatgagatgaatgataagaaggaagctgagacaaccgacatcacagaggagggcacttctcactcacctcccgagcctgagaacaaccagatggccatttcgaacaatagtcaacaaagcaatgagcagacggatccggagccagaggaaaatgaaaccaaaaaggagagttcggttccaatgtgtcagggagagcttcgtcactggaaaaccggtcactataccttaattcacgaccattctaaagccgagtttgcattagacctgattctctactgcggttgcgaaggttgggagcctgagtatggcgggttcacttcttatatcgctaagggggaggacgaagagcttctcacagtaaatcccgagtccaactccctggccctggtgtacagggaccgcgaaacactaaaatttgtgaaacatatcaatcaccgcagcctggagcagaaaaaaacatttcccaatcggaccggattttgggactttagtttcatttactatgagtag

SEQ ID NO: 43993 - DNA, 1629 bp, Artificial Sequence
  Description of Artificial Sequence: Synthetic coding sequence
atgaacggcaagcggcccgccgagcccggccccgcccgggtgggcaagaaaggtaagaaggaggtcatggccgagttttcagacgcggtgactgaagaaacgttgaagaagcaggtagccgaggcttggtccagacgaacccccttctctcatgaggtgatcgtgatggacatggaccctttcctacactgtgtgatccccaacttcattcagagccaggacttcctcgagggattacaaaaggaactcatgaacttagactttcatgaaaagtataatgacttgtataagttccagcagtccgacgacttgaagaaacggagagagcctcacatcagtactttaaggaaaattcttttcgaggactttagaagctggctatccgacatcagcaagattgatctggagtctaccattgatatgtcatgtgcaaagtacgaattcaccgacgctttgctctgccacgacgacgagctggaaggccggcgcatcgcattcattttgtatctggtcccaccttgggaccggtccatgggcggaacacttgacttgtatagtatcgatgagcatttccagccaaagcagattgtgaaaagtttgatcccttcctggaacaaactggtgtttttcgaggtgtcccccgtgtccttccaccaggtgtcagaggttctgtccgaagagaagagcagactgtctatttccggatggttccatgggcccagtctgacccgacctcctaattatttcgaacccccgatccccagaagtcctcatattccacaagatcacgagattctatacgactggattaaccccacctacttagatatggattatcaggtacaaatccaagaggagtttgaggagtcttctgaaattctgctgaaagagttcctgaagcctgaaaaattcacaaaggtgtgtgaggccctggagcacggacacgtcgaatggagttccagaggtcccccaaacaagagattctacgagaaggctgaggagagcaaactaccagaaattctgaaggaatgcatgaagctctttcgatctgaggccttgtttcttctgctcagtaatttcaccgggttaaagctacacttcctcgccccatctgaggaggacgagatgaatgacaaaaaggaggctgagacaaccgacatcaccgaggagggaacgtcccactctcctcctgaaccagagaacaaccagatggctatctccaataattcccagcagtcaaacgagcaaacagacccggagcccgaggagaatgaaacgaaaaaggaatctagtgtgcccatgtgccagggcgagctccggcactggaaaactgggcactataccctcattcacgaccattccaaggctgagttcgcactggacctcattctctattgtgggtgtgaggggtgggagccagagtacggcggtttcactagctatattgcaaagggggaggatgaggagctgctgacagtcaatcctgagagcaacagcctggcgctggtgtatcgcgatcgggagacgttaaagtttgtgaagcacattaatcacagatcccttgagcaaaaaaagacatttcctaaccgaacgggattctgggatttctctttcatatattacgaatag

SEQ ID NO: 43994 - DNA, 1308 bp, Artificial Sequence
  Description of Artificial Sequence: Synthetic coding sequence
atgctgctgccctgggccaccagcgcccccggcctggcctggggccccctcgtgctcggactgtttgggctgctcgccgcctcccagcctcaggctgttcccccttacgcaagcgagaaccagacttgcagagatcaagagaaagagtactatgaaccacaacaccggatctgttgctccagatgcccgcccgggacttacgtgtctgctaagtgctcacggattcgcgatactgtatgtgccacttgtgcagagaattcttacaatgaacactggaattatctcacgatttgccagctgtgccgaccatgcgatcctgtaatgggactggaggagatcgccccctgcaccagtaagcgaaagacccagtgcagatgtcagcccggaatgttttgtgctgcatgggcgctagagtgtacacactgtgagctcttgtctgactgtcctcctggaaccgaggctgagctgaaagatgaagtgggtaaaggaaacaatcactgcgttccctgtaaggccggtcactttcagaacacttcaagcccgagtgcgaggtgccagccacacacccgctgcgaaaatcagggccttgtggaggccgcccccggtaccgcacagagcgacaccacctgcaagaacccactggaaccattgcccccagagatgtcaggaacaatgcttatgctggcggttcttttgccactggctttctttctcctgctggctacagttttttcttgcatatggaagagccacccaagcctttgtaggaagttggggagcctattgaagcgacgtccacagggagagggcccaaaccccgtagctgggtcttgggagccacccaaggctcacccatacttcccagaccttgtgcagccactcttacctattagcggcgacgtgtcacctgtttcgactggacttccagctgctccggttctagaggccggggtcccacagcagcagtcccccctggatcttacacgagagccccagcttgagcccggcgagcagagtcaggtggcacacggaacaaatggcattcatgtgactggcggctctatgaccataaccgggaacatctatatctataacggaccggtactcggcggcccccccggccccggtgatttgcctgcaacccctgaacctccatatccgattccagaggagggagatcctggaccccccggcctgtccacaccccaccaagaggacggtaaagcctggcacctggccgagactgaacactgtggtgccaccccatcaaaccggggaccccgcaaccagtttatcacacacgattag

SEQ ID NO: 43995 - DNA, 873 bp, Artificial Sequence
  Description of Artificial Sequence: Synthetic coding sequence
atggtggagctggagcaggaggtggagcggcggcagcggctgggccaggaatcagccgccaggaaggccctcatcgcatcatcgtaccaccccgcaagacccgaagtgtacgactccctccaggatgccgcacttgcacctgaattcctagctgtgacagaatatagcgtttctcctgacgccgacctgaagggccttctgcagagactggagactgtcagcgaagaaaaaagaatctacagagtgcctgtatttaccgcgccgttctgtcaggctctgttagaagaactggaacactttgagcagagcgacatgcccaaagggcgccccaacactatgaataattacggcgtactgctgcacgagctcggcctcgacgagcctctcatgactccattaagggagaggttcctacaacctctcatggccctcctttaccctgactgcggaggaggcagattagattcgcatcgcgctttcgtagtgaagtatgcacccgggcaggacctcgaactcggttgtcattatgacaatgccgagctgactctgaatgtggccctaggcaaggtgttcacaggcggcgccctttattttgggggtctctttcaggccccaaccgccctcacggagcccctcgaagttgagcacgtagtaggacagggcgtcctgcaccggggcggccaactgcatggagccagacccctcggtaccggagaacgctggaatctcgtggtctggttgcgagcgagcgctgtccgaaattcgctgtgtcccatgtgttgtcgggagccagatttagtagatgatgaaggtttcggggacggcttcacgagggaagagcctgcgaccgtggatgtgtgcgccctgacctag

SEQ ID NO: 43996 - DNA, 1023 bp, Artificial Sequence
  Description of Artificial Sequence: Synthetic coding sequence
atgggcaacgtgcccagcgccgtgaagcactgcctgagctaccagcagctccttagagagcacctttggatcggcgatagcgtcgcaggcgccctggatcctgctcaggagacaagtcagctctctggcctgcctgaatttgtgaagatcgtcgaggtaggcccccgcgacgggctacagaacgaaaaggtaatcgtcccgacagatatcaagattgaatttattaataggttatcgcaaactggcctatcggtgatcgaggtgaccagctttgtgagctctcgctgggtcccccaaatggcagaccatactgaagtcatgaagggaattcatcagtatccaggtgtgaggtatcccgtacttactcccaacttgcagggatttcaccatgctgtcgcagctggcgcgacagaaatctccgtgtttggcgctgccagcgagagtttctctaagaaaaacatcaactgctctatagaggaatccatgggcaagttcgaggaggtggtcaagagcgccaggcacatgaatattccggctcggggttacgtcagctgtgctctgggatgcccttatgagggctccattactccacagaaagtgacagaggtgtctaagaggctgtacggcatgggctgctatgaaatcagtctgggagacactattggcgtagggacgcctggcagtatgaaaaggatgctggaaagcgtaatgaaagaaatccccccaggtgctcttgctgtgcactgccacgacacttacggccaagcgcttgccaacatactaactgcactgcagatggggatcaatgtagtggactcagccgtgagcggtttgggtgggtgtccctacgcaaaaggagcatcaggcaacgtcgcaacagaggacttaatctatatgctgaacggattgggcttgaacaccggcgttaacttatacaaagttatggaagcgggcgattttatttgtaaggcggtgaataagaccaccaactcaaaagtggcacaggcctcgttcaacgcctag

SEQ ID NO: 43997 - DNA, 162 bp, Artificial Sequence
  Description of Artificial Sequence: Synthetic coding sequence
atgggcaacgtgcccagcgccgtgaagcactgcctgagctaccagcagctgttgagagaacacttatggatcggggactcagtggcaggcgctctcgacccagcccaggagctgcagagtgtcatgttgatgctccaccacggcccattaagaaagccatag

SEQ ID NO: 43998 - DNA, 1113 bp, Artificial Sequence
  Description of Artificial Sequence: Synthetic coding sequence
atgggcaacgtgcccagcgccgtgaagcactgcctgagctaccagcaacttctacgcgagcacctgtggatcggtgactccgtggcaggtgccctggatccggctcagacttcactgctgacaaatctccattgctttcaaccagatgttagcgggtttagcgtatctctggccggtacagtagcctgtatacattgggagacaagtcagttaagcggtttacccgaattcgtgaaaatcgtagaagtgggccctcgagacggactgcagaacgaaaaggtgatcgtgccaacggacataaagattgagtttatcaatagactaagtcagacagggctctctgtcatcgaggtgactagctttgtcagctccaggtgggtgccacaaatggccgaccatacggaggttatgaagggcatccaccagtatcctggtgtaagatatccggtgctaaccccgaaccttcaaggttttcatcacgctgtcgcagcaggcgccacagaaataagtgtctttggcgcggcgagcgaaagctttagcaagaagaatattaattgcagcatcgaggagtcaatgggcaaatttgaagaggtggtgaaatcagcaaggcatatgaacattccggccagaggttacgtaagctgtgccctaggctgcccttacgaagggtctattaccccacaaaaagtcacggaggtgagtaagagactgtacggaatggggtgttacgagatctccctaggagacacgatcggcgtggggacaccaggcagcatgaagcgcatgcttgaatccgttatgaaagagattccaccaggcgcattagccgttcattgccatgacacttacggacaagccttggcgaacattttgacagcgttgcagatgggaatcaatgtggtggacagtgccgtgtctgggctgggtggttgtccatacgccaaaggtgcgagtggtaatgtggcaactgaagacctgatttacatgctcaatggactgggactcaataccggggtgaatctctacaaggtcatggaagcaggcgatttcatttgtaaggccgttaataagacgacgaactctaaggtggcgcaggccagctttaatgcctag

SEQ ID NO: 43999 - DNA, 1116 bp, Artificial Sequence
  Description of Artificial Sequence: Synthetic coding sequence
atggccgcccccgccctgcggctgtgccacatcgccttccacgtgccagctgggcagccacttgctaggaatctccagagactgttcggctttcagccgctcgcctcccgagaggtggatggctggcgccagttggctctgcgtagcggcgatgccgtgtttctagtaaatgaaggcgcgggcagcggcgagccgctctatggtctggaccctcgccatgcagtgccatctgctaccaacttgtgctttgatgtggccgacgccggcgctgcaactcgggaactggcagccctgggatgcagcgtgccggtgcccccagttcgggtgagggatgcccaaggggcagccacatacgccgtggttagcagtcccgccgggatcttgtccctgacccttctcgagagagcgggttatagagggcctttcctgcccggcttccgccctgtcagcagcgccccaggccccggctgggtctcacgcgtggaccacctgaccctcgcctgtaccccaggtagcagtcccacactgttgcggtggtttcatgactgcctcgggttttgccatttgccactgtctccgggtgaggaccccgaattgggactcgagatgactgcagggtttgggctgggtgggctgcgtctcaccgctcttcaggcacaaccgggatctatagtgcccacgctggtcctggcggagtccctgccaggcgctaccactaggcaggaccaggtggaacaattcctggcccgccataaggggcccggactccagcacgttggcctttatacgcctaatatagtggaagccactgagggcgtagccactgcgggaggtcagtttctggctccgcccggcgcctattaccagcagccgggaaaagaaagacagatcagggccgccggacacgaaccccacttactcgccaggcaggggatactgctggacggtgacaaagggaagtttctgctccaggtcttcactaaatcactgttcacggaggacaccttcttcctcgaacttattcagcggcagggcgcgactggctttggccagggcaacatccgcgcactgtggcaaagcgtccaggaacagtccgcccggagtcaggaagcttag

SEQ ID NO: 44000 - DNA, 1368 bp, Artificial Sequence
  Description of Artificial Sequence: Synthetic coding sequence
atggcccagcacttcagcctggccgcctgcgacgtggtgggcttcgacttagaccacactctgtgtaggtataatctgccggagtctgcacctcttatctacaattcattcgctcaatttctggtgaaagagaagggatatgataaagagcttctcaatgtgacacctgaagactgggacttctgctgtaaggggctcgcgctggatctggaagacggaaacttcctgaagctagcgaacaacggcaccgtcttgcgagcctcacacgggactaaaatgatgacccctgaagtcctggccgaagcctacggaaaaaaagagtggaaacatttcctgtcagacaccggaatggcctgccggagtgggaaatactacttctacgataattactttgacctcccaggagctcttctgtgtgcccgggttgtagattacttgacaaaactgaacaacggacaaaagacattcgacttttggaaagatatcgttgcagccatccagcacaactataagatgtccgccttcaaagaaaattgtggcatatactttcccgagatcaagcgtgatcctggccgctatctgcacagctgccccgaatcggtgaagaagtggttgcgccaactgaaaaacgcaggaaagattctgctgctgatcaccagcagtcattctgactactgcaggctactttgtgaatatattctcgggaatgacttcactgatcttttcgatattgttattacaaatgctttgaagccaggcttcttttctcacctgcccagccagagacctttccggactttagagaatgatgaagagcaggaggccttgccctcattggataagcccgggtggtactctcagggcaacgctgtgcacctgtacgagctgctaaagaagatgacaggcaaacccgagcctaaggtggtgtactttggcgatagtatgcacagtgatatcttccccgccaggcactactccaattgggaaactgtgctgatcctggaggaattgaggggtgatgaaggaacgcgttcccagaggcctgaagaaagcgaacctctggagaaaaaaggtaaatatgagggaccaaaggcaaagccactgaatacaagttctaagaagtggggatcatttttcatcgattcagttcttggcttagagaacacagaggattcgttagtgtacacatggagctgtaagcggatcagtacctattccacaatcgcaatccccagcatcgaagcaatcgccgaactgccccttgactataaatttacccgcttctccagctccaacagtaagacagctgggtactatcctaatcctccccttgtgctcagctcagacgagactctgatctcaaagtag

SEQ ID NO: 44001 - DNA, 588 bp, Artificial Sequence
  Description of Artificial Sequence: Synthetic coding sequence
atggcccagcacttcagcctggccgcctgcgacgtggtgggcttcgacctagatcataccctgtgtcgatataatctgccagagagcgctcctctgatatataacagtttcgctcagttcctcgttaaggagaagggctacgataaggaactcttaaatgtcactcctgaggattgggatttctgctgtaagggcctggctcttgacctagaagatgggaattttttaaaactggcgaacaacgggactgtccttcgggcatcacacgggacaaaaatgatgacacccgaagtgttagctgaggcttatggtaagaaggagtggaagcactttctgtcggatacaggaatggcttgtcgtagcggtaaatactacttctacgacaactattttgacttacccggtgcgttactctgtgctcgggtggttgattatctgacgaagttaaacaacggccaaaaaacattcgacttttggaaggatatagttgccgcaatccagcataattacaaaatgagcgcattcaaagtgcgaaggctcgcaacttctctgctccaggacatttctacctcttttatacttatctag

SEQ ID NO: 44002 - DNA, 336 bp, Artificial Sequence
  Description of Artificial Sequence: Synthetic coding sequence
tgaagccacggcaccaagatgatgacccccgaggtgctggccgaggcctacgggaaaaaagaatggaaacatttcttgtcggatacagggatggcgtgtagatccggtaaatactacttttatgataattacttcgacctccccggcgccctgctgtgcgcccgcgtggtggattacctcactaaattaaataacggccagaagacctttgatttctggaaggacatagtggcggccattcagcataactataaaatgtccgcttttaaagggaagtactgtgaagaaggcccctctaacacatgtctactcagttatgtctgccttgtcaactag

SEQ ID NO: 44003 - DNA, 588 bp, Artificial Sequence
  Description of Artificial Sequence: Synthetic coding sequence
atggcccagcacttcagcctggccgcctgcgacgtggtgggcttcgatctggatcacaccttgtgtaggtacaatctgccagagtccgcccccctcatctacaattcttttgcacaattcctggtgaaggaaaaggggtatgacaaggagcttctcaacgtcacacccgaggattgggatttctgctgtaaaggccttgctctggacttagaagatggcaactttctcaaactcgccaacaacgggaccgtcctgagggctagtcatggcactaaaatgatgacgccagaggtgctggctgaagcctacgggaagaaggaatggaagcacttcctcagcgatacaggaatggcctgcagatctgggaagtactatttctacgacaattatttcgaccttccgggagccctcctctgtgctcgagtggttgattatctcaccaagcttaacaacggccagaaaacattcgatttctggaaggacatcgtagccgccatacagcacaactacaagatgagcgcattcaaagttcggaggctcgcgacgagcctcctgcaggatataagtacttcctttatcctgatctag

SEQ ID NO: 44004 - DNA, 1563 bp, Artificial Sequence
  Description of Artificial Sequence: Synthetic coding sequence
atgcgggtggagagcggcagcgcccaggagcggggcatcctgctggaatccctttctactctattagagaagaccacagcgtctcacgagggcagggcacccgggaaccgagaactcaccgatttgctcccccccgaggtgtgtagtctgctcaaccctgccgcaatttatgctaataatgagatctcattgcgggacgtcgaggtatacggattcgactacgactacacgctagctcaatacgccgatgcactgcaccctgaaattttctccacagcccgggatattctaattgagcactacaaataccctgaggggatccgtaagtatgactacaatccgagctttgcaataaggggcctgcactacgatatacaaaagtctcttctcatgaaaattgatgccttccactacgttcagctggggaccgcgtatcgggggctgcagcctgtgccggatgaagaagtcatcgaactgtacggggggactcaacacataccactctaccagatgtctggcttctacggtaaaggaccctcaatcaaacagttcatggatatattctccctacctgagatggctctactctcatgcgtagtcgattattttcttggccatagcctggagttcgatcaagcacatctttacaaggacgtaacagatgccattcgtgatgtgcacgtcaaagggctaatgtatcagtggatcgaacaggatatggagaagtacatcctgagaggtgacgaaacatttgccgtattaagccggctggtagcgcacggcaaacagctatttctgattacaaacagcccgtttagcttcgtcgataagggcatgcggcacatggtgggtccagattggaggcagctctttgatgtagtgatcgtccaggccgacaagccctccttcttcactgatcgccggaaaccgttccgcaagcttgatgagaaaggttccctgcagtgggatcggattactcgcttagagaagggtaagatctaccggcaaggcaacctgttcgattttcttcgcctcacagagtggaggggcccaagggttctatatttcggggaccacctgtatagtgatctggccgaccttatgctgcgacacggttggcgcaccggcgctatcatcccggagctagagcgcgaaatcaggattatcaataccgaacaatacatgcacagtctgacctggcagcaagcactgactgggttgctagaacgcatgcagacctatcaggacgccgagagcaggcaggtcttggccgcatggatgaaagagaggcaggaactaaggtgtattactaaagcgctgttcaacgcccagttcggcagtatttttcggacattccacaatcccacctatttctccagacgtctggtcaggttcagtgacctctatatggcatccctgtcctgtctgttgaactatagagtggactttacattttatccacggcgaacacccctgcagcacgaagccccgctgtggatggatcagctatgtaccgggtgtatgaaaaccccatttctcggtgacatggcgcacattcgctag

SEQ ID NO: 44005 - DNA, 1386 bp, Artificial Sequence
  Description of Artificial Sequence: Synthetic coding sequence
atgcggcggctggtgcacgacctgctgccccccgaggtgtgcagcctgctgaatcccgctgctatctatgctaacaacgaaattagtctcagggacgtcgaggtttacggatttgattacgattatacactggcacagtacgccgacgcactacacccagaaatcttttccactgctcgggatattctgatcgaacactataaatcactcctcatgaagattgacgcctttcattatgttcagctgggcaccgcttaccggggactgcagcctgttcccgatgaggaggtgattgagctgtatggagggacccagcacattccactataccagatgagcggattctatggaaagggaccatccattaaacagtttatggacattttttcgcttcctgagatggcactgctcagttgcgtggtagactattttctcggccattctctggagtttgaccaggcccatctgtataaagacgtgacggacgccatccgcgatgttcatgtgaaaggactcatgtatcagtggattgagcaggacatggaaaagtacatacttagaggagacgaaacattcgctgtactgagccggctggtcgcccacgggaagcaattatttttaataacaaatagtccattttcattcgtggacaagggaatgcgtcacatggtgggacctgattggcgccagctgttcgacgtggtaatcgttcaggcagataaaccttcgttcttcacggatcgacgcaaaccattcaggaaacttgatgagaaaggaagcttgcagtgggatcggattacccgtctggagaagggcaaaatttaccgtcaaggaaacctgttcgacttcctgcggctcacagagtggcgcggaccccgagtgttatactttggggatcacctgtactccgatcttgccgacttaatgctgagacacggatggcggacaggcgcgatcataccggaactcgagagggagatacggatcatcaacaccgagcaatatatgcactcactgacctggcaacaggcgcttactggcctcctggaaagaatgcagacataccaggacgccgaatcccggcaggtcttggccgcatggatgaaggagcgccaagaactaaggtgcataactaaggccttgtttaatgcccagttcgggtcaatcttccgcacattccacaatcctacctatttttcaagacgcctggtaaggttttccgacctctacatggcaagtctgtcatgtttgctgaattacagggtcgatttcacattctaccctcggaggactccacttcagcacgaagctcctctttggatggaccagttgtgcacaggctgcatgaagacaccttttttgggcgacatggctcacattaggtag

SEQ ID NO: 44006 - DNA, 1674 bp, Artificial Sequence
  Description of Artificial Sequence: Synthetic coding sequence
atggccggcgccggcctgcgggccgccgcccggcggtggctgctgtgcgggggccacggcggacctcgcgccgcctcctcgagcccatcctgcccaggatgcgggccccccgggcctggggcccattgcccaggtgtgcctcggagcgctcctgcacaggcccccacctccggcgcagacctgtcggcccacctgtgggctaggtatcaggatatgagaagactggtacacgacctgctgccacccgaagtgtgtagcctgctgaatcctgctgccatctatgccaacaatgaaatctccctaagagacgtggaggtgtacggattcgattatgattacacactggctcaatacgctgacgcacttcatcctgaaatcttcagtactgcacgagatatccttattgaacattataagtatcccgagggaattaggaagtacgattacaacccctctttcgcgattaggggactgcactacgacatccagaaatctctgctcatgaagattgatgccttccactatgttcagctggggaccgcatacagaggactacagccagtccctgacgaggaggtaatcgagctgtacggggggactcagcacatccctctctatcagatgtcaggcttctatggcaaaggaccttccataaagcaatttatggatatttttagcctgccggagatggctctactgtcttgtgtggtcgattatttcctcggacattccttagagttcgaccaggcccacctctacaaggatgtgactgacgcgatccgcgatgtccacgtcaagggtcttatgtaccagtggatcgaacaggatatggagaagtacatcctcaggggagatgagacgtttgcagtgctcagccggctggtcgcccacgggaagcagctcttcctgatcaccaattcccctttcagtttcgtagacaaaggaatgcgccacatggtgggtccggattggcggcagcttttcgacgttgttatcgtccaagctgataaaccttccttcttcaccgatcgcaggaagcctttccgaaaattagatgaaaaaggctcccttcagtgggaccggattaccaggctggagaagggaaagatataccgacagggaaatctgttcgacttcctccggcttacggagtggcgcggccctagggttctgtatttcggagaccacctctatagcgacttggcagatctgatgctacgacatgggtggaggactggtgccatcattccagagctcgaacgggagattaggattatcaatacggagcaatatatgcatagcctaacctggcagcaagccctgaccggactgctagaacgcatgcaaacgtatcaggatgccgagtccaggcaagtactggccgcttggatgaaggagcggcaagaattgaggtgcattactaaagccctgttcaacgcccaattcgggagtatcttccggactttccacaatcccacatattttagcagaaggttggttagattcagcgacctatacatggcctctttgtcctgtctactgaactatcgcgtcgacttcactttttaccccagacgcactcctctgcagcacgaggcccctctgtggatggaccagctgtgtaccggctgtatgaaaacaccttttctgggtgatatggcccatattcgatag

SEQ ID NO: 44007 - DNA, 2538 bp, Artificial Sequence
  Description of Artificial Sequence: Synthetic coding sequence
atgagcgacgacatcgactggctgcggagccaccggggcgtgtgcaaggtggatctctataatccagagggccagcaggatcaggaccggaaagtcatttgcttcgtggatgtcagcacgctcaacgtggaggacaaggactacaaggatgcagctagtagctcctctgagggaaaccttaatctcggctctctggaagaaaaggagatcattgtgattaaggacactgagaagaaggaccagtctaagaccgagggatcagtgtgtctctttaaacaggctccaagtgacccagtttcagtgctcaactggttgctgtcagatcttcagaagtacgcccttggattccagcacgcccttagcccctccacatctacctgtaaacacaaggtgggggacacagaaggagaataccacagagcctcttccgagaattgctattccgtctatgctgaccaggtaaatattgactatctcatgaatcgcccccagaacctacgcctggagatgacagcagcaaagaatactaacaacaaccagtcaccatcagcacctccggccaaacccccttccacacaacgcgcagtgatctcccctgacggcgagtgtagtatcgatgatctgagcttctacgtgaaccgactctcctcgttagtgatccagatggcccacaaagagattaaagaaaagctcgagggtaaatccaagtgccttcatcactcaatttgtccatctcctgggaataaagaacgtatttcccctagaacaccggcttccaagatcgctagtgagatggcttatgaggccgtggagctgactgccgcagaaatgagggggaccggcgaggaatcgcgggaggggggtcagaagtcattcctgtacagcgaactgagcaacaagagcaagtcaggcgataagcagatgagccagagagagagcaaggaatttgccgatagtatctccaaaggactgatggtgtacgccaaccaagtcgcgtcagacatgatggtatcattaatgaaaaccctcaaggtccactcaagtggaaaacctatacctgcaagtgtggtgttgaagcgcgttctcctccgccatacaaaagagattgttagcgacctgatagatagttgcatgaaaaaccttcacaacataaccggagtgttgatgacagactctgactttgtcagcgccgtcaagcgcaacttgtttaaccagtggaagcagaatgctaccgatatcatggaggcgatgctaaagcggctggttagtgcactgattggggaggagaaagaaacgaagtctcagtctctgtcttatgccagtctgaaagctggcagccacgaccctaaatgtcggaatcaaagcctggagttcagcaccatgaaggctgaaatgaaggaaagagataagggcaaaatgaaatcagatccgtgtaaaagcttaacatcagccgagaaagtcggggaacacattcttaaggagggattaaccatctggaatcaaaaacaagggaacagctgtaaggtggccacaaaagcatgctctaacaaggatgaaaaaggcgagaaaatcaacgcctcaaccgatagcttagctaaggatctcatcgtatcagcgctcaagttaatacagtaccatttgacccagcaaaccaaggggaaggatacatgtgaagaggactgcccggggtccaccatgggatacatggcccaaagcacacagtatgagaagtgtgggggaggacagagtgcgaaagcgctgtccgtgaagcaactggagagccacagggctcccgggccgtcaacctgccagaaggaaaaccagcacttggattcacaaaaaatggacatgagcaatatagtgctcatgctgatacagaaattgctgaatgaaaacccattcaagtgtgaggatccgtgtgagggcgagaacaagtgcagcgaaccaagggcatccaaagcagcctcgatgtcaaaccggtctgataaggctgaggaacaatgtcaggagcatcaggagttggattgtacatctggaatgaaacaagccaatgggcagtttattgacaaactggtggaaagcgtgatgaagctgtgcctgatcatggcaaaatatagtaacgatggagcggcactggccgagttggaggagcaggcagcttcagctaacaagcctaattttagaggcacaaggtgtatccattctggcgcaatgccccagaattatcaggattcactggggcatgaggtcattgtgaacaaccagtgctccaccaactccctacagaaacagctgcaagcagtactacagtggattgcggcatctcagttcaatgttcctatgctgtattttatgggtgacaaagacggacagctggagaagctacctcaggtgtccgctaaagccgctgagaaggggtactcagttgggggactactgcaggaagtcatgaaatttgccaaagagcggcagcccgacgaagctgtagggaaagtggctcgcaaacagctcctggattggcttctagctaatctgtag

SEQ ID NO: 44008 - DNA, 1089 bp, Artificial Sequence
  Description of Artificial Sequence: Synthetic coding sequence
atggacgcccaggactgccaggccgccgccagccccgagccccccggccccccagccaggtcttgcgttgccgcctggtgggacatggtcgacaggaatctgagatactttccccattcatgcagcatgttgggtagaaagattgccgctctatatgacagctttacgtcgaagtcattgaaagagcatgtgttcctccccctgatcgatatgcttatatatttcaacttctttaaggccccttttctggtggatctcaagaagccagagttgaaaatccctcataccgtgaatttttacctccgtgtggagcccggtgtaatgctgggcatttggcatactgtgccgagctgtagaggcgaagatgcgaagggtaaagattgctgctggtacgaagccgccttgagggacggcaaccccataatcgtatatctccatgggtctgctgaacatagggcagcctcgcaccggctgaaactggtcaaagtgctgtccgatggcggcttccatgtattgtccgttgattaccggggatttggcgattccacagggaagcccaccgaagagggactgaccaccgacgccatttgcgtatatgagtggaccaaggcgaggagcggaattactcccgtgtgcctctggggtcatagcttaggcaccggggtagccaccaatgctgccaaggtcctcgaagaaaagggttgtcccgtagacgcaatcgtcctggaagcacctttcacgaacatgtgggtggcaagtatcaactacccactgctgaaaatttataggaacatccccgggttcctgaggacacttatggacgccttaaggaaagacaagataatttttcccaacgatgaaaacgtgaagttcttgtctagtccgcttcttatcctgcacggcgaagatgacaggacagtgcccttggaatacgggaagaagttatacgaaatagcgcgcaatgcatacaggaacaaagaaagggtgaagatggtgatttttccacccggctttcagcataacctcctgtgcaagtcacctacgctcctcattacggttagagatttcctgtctaagcaatggtcatag

SEQ ID NO: 44009 - DNA, 858 bp, Artificial Sequence
  Description of Artificial Sequence: Synthetic coding sequence
atggacgcccaggactgccaggccgccgccagccccgagccccccggcccacctgctaggtcttgcgttgccgcctggtgggacatggtggacagaaacctccgtcacaccgtgccctcctgccgcggcgaggatgccaaggggaaggattgctgttggtacgaagctgcgctccgggatggaaaccccataattgtgtatctgcacggcagcgctgagcatcgggccgcatcacataggctgaaactggtcaaagtgctgtctgacggagggtttcacgtgctgtccgtcgactaccgcgggtttggcgactccaccggaaagccaaccgaagagggcctaacaacggatgccatttgcgtttacgaatggacgaaagcccgctcaggaattacacccgtctgtctgtgggggcattccctgggaacaggggtggccacaaacgccgccaaggtgctggaagaaaagggctgtcccgttgacgctatcgttctggaagccccttttacgaacatgtgggtggcaagcataaattatcctctgctgaaaatttacagaaatatacccggcttcctgcgaacactgatggatgccctgcgcaaggacaaaattatcttcccaaacgatgaaaatgtgaaatttctttctagtccccttctcatcctccatggggaggatgacaggacagtccccctggagtatggaaagaaactgtatgaaatcgccaggaacgcctaccggaacaaagagcgcgttaaaatggtcatctttccccctggctttcaacataacttactgtgcaaatctcctacgctcctcatcactgtcagagatttcttgtctaagcagtggagctag

SEQ ID NO: 44010 - DNA, 768 bp, Artificial Sequence
  Description of Artificial Sequence: Synthetic coding sequence
atgctgggcatctggcacaccgtgcccagctgccggggcgaggacgccaaaggcaaagattgttgctggtacgaagccgccctgagagacgggaaccctatcatagtctacctgcatgggagtgccgagcaccgcgccgcctctcacaggctgaagctcgtgaaagttctgagtgatggtgggttccacgtactttcagtggattatagaggctttggcgacagcacaggaaaaccaaccgaggaaggcctgactacggatgctatctgtgtgtatgagtggaccaaggcccgttctgggatcacacctgtttgcctttggggtcacagcctgggcactggcgtcgcgaccaacgcagcaaaagtgttggaggaaaagggttgtccagtcgacgccatcgtgctggaggccccttttacgaacatgtgggtcgccagcattaattatcccctgctcaaaatctatcggaacatcccagggttcttgaggaccctgatggatgccctgcgcaaggacaagattatatttcccaacgacgaaaacgtgaagtttctttcgagccctctgctgatcctgcacggcgaggacgacaggaccgtcccattggagtacggcaagaagctttatgagatcgccagaaatgcatacagaaacaaagaaagagtgaaaatggtcatttttccaccaggcttccaacataacctgctttgtaaaagccctacccttctcattaccgtgcgggactttttgagcaagcaatggagttag

SEQ ID NO: 44011 - DNA, 1410 bp, Artificial Sequence
  Description of Artificial Sequence: Synthetic coding sequence
atgtgcgtgatctgcttcgtgaaggccctggtgcgggtgttcaagatctacctgacagccagctatacatacccattccgtggttggcccgtggcatttcgctgggatgacgtaagggccgttggccgaagctcttcacatagggcgctgacgtgcgcggcggccgcggctggagtgtggctgcttcgcgacgaaacgttggggggcgacgccctcggccggccacctcggggtgctcggtcgcaggctcaatgtctgctgcagcagctccgggaattgccaggccagctggcctcctacgctttagcacatagcctgggacggtggctggtctatcccggatccgtttctctcatgacaagagcactcctgcctctgctgcagcagggacaggaacgcttggtggagcgctaccatggtagaagagctaagttggtcgcgtgcgacggtaatgagatagatactatgttcatggaccggaggcagcatcccgggtcccacgttcacggacctagattagtgatctgttgtgaagggaacgccgggttctacgaaatgggttgcttgtctgctcccctggaggcaggctatagcgtcctgggatggaatcatccaggttttggctccagcacgggggtcccctttcctcagcacgacgctaacgccatggacgtcgtggtggagtacgcgctgcaccgcctccatttccccccagcccacctggtggtgtacgggtggtccgtgggaggatttaccgccacctgggctaccatgacctaccctgagctcggagccttggtgctggacgcgacattcgatgacctggtgccgcttgcactcaaggtaatgccccactcgtggaaaggtttagttgtgagaacagttcgagagcatttcaacctgaatgtcgccgagcagctgtgttgttatccaggtcccgttctgctgctgagacggacacaggatgacgttgtcagtacctccggccgcttgcgtccgctctcacctggcgacgttgagggcaatcgtggcaacgagttattgctgcgccttttagaacatagatatccggtagtcatggctcgcgaagggcgggctgtagtcacacggtggttgcgcgcaggatctctggctcaggaggcagcattctatgcaaggtaccgggtggacgaggactggtgtttagctttattaagatcttaccgcgctcgctgtgaagaagaattggagggcgaagaggcacttggacctcacgggccagcattcccttggttggttggtcaggggctgtcatccagacgccgaaggaggctggctttatttctcgctagaaaacacttgaagaatgtggaagcaacacacttctctcccctagagccagaggagtttcagctgccctggaggctgtag

SEQ ID NO: 44012 - DNA, 1029 bp, Artificial Sequence
  Description of Artificial Sequence: Synthetic coding sequence
atggccgacgacctggagcagcagagccagggctggctgagcagctggctcccaacgtggcgccctacaagcatgtcccaattgaagaacgtagaggcacgcatcctccaatgccttcagaacaaattcctggcacgatatgtgtccttgccaaatcagaacaaaatctggacagtgactgtgtccccggaacaaaacgacagaactcctctggtgatggtgcacggctttggcgggggcgttggactttggatacttaacatggactctctgtccgctagaaggacactgcatacttttgacttacttggcttcggcaggagtagccggccagcgttcccgcgagatccggaaggggctgaagacgagttcgttacgagtattgagacttggcgagagaccatggggattccatctatgatcctactcgggcattccctgggaggttttctggccacttcatattccataaaatatccagaccgagtgaagcacttaatcctggtggacccttggggtttccccttaagacccactaatcctagcgagattcgggctcccccagcttgggtgaaggctgtggcgtcagtcctgggtagatctaacccattggctgtcttacgagttgcaggtccttggggccccggtctcgttcaacgatttagacccgacttcaaaagaaagttcgccgactttttcgaggatgacaccatcagtgaatacatttatcattgtaatgcccagaatccatctggcgagaccgcatttaaagccatgatggagtccttcgggtgggctaggcgtcccatgctggagagaattcaccttatacggaaagatgtccctatcacaatgatctatggctctgacacttggattgacacttccacaggcaagaaggtcaaaatgcagagacccgattcctatgtcagggatatggagatcaagggagcttcacaccacgtgtatgccgaccagccgcatatctttaatgccgtggttgaggagatctgcgacagcgtcgattag

SEQ ID NO: 44013 - DNA, 1320 bp, Artificial Sequence
  Description of Artificial Sequence: Synthetic coding sequence
atgctgaccggcgtgaccgacggcatcttctgctgcctgctgggcacaccccctaacgccgtggggccactggaatccgtggagagctctgatggctacacatttgtggaagtaaaacccggcagggtgctaagggtcaaacacgcaggaccggccccagccgccgccccaccacctccgagcagtgcttccagtgacgcagctcagggagatctctcgggccttgtccggtgtcagagacggattacagtgtacagaaacgggcggcttctggtcgagaacttgggtagagccccacgggccgacttactccacggccagaatggatccggcgagcccccagccgctcttgaagtcgaacttgccgatcctgctggatctgatggccgtcttgccccgggctcagccggttcaggatctggctcaggctcaggcggacggcgtcgccgggctcggagacccaagcgaactattcacatagactgcgaaaagcggatcacatcgtgtaagggggctcaggctgacgtggtactgtttttcatccatggagttgggggtagtttggctatttggaaggagcaacttgattttttcgtccggctgggttacgaagtagtagccccagatctcgcaggacacggcgcctcctccgcccctcaggtagcggccgcttacacattctacgcgcttgcagaagacatgagagccattttcaagaggtacgctaaaaagcgaaatgtcttaattgggcatagttacggcgtcagcttttgcacatttctggcccacgaatatccggatcttgtccacaaggtcataatgatcaatggagggggccctacggccctcgagccctcattttgttcgatctttaacatgcccacctgcgtcctgcactgtctttctccctgcctcgcatggagctttctaaaggccggatttgccagacaaggggctaaagagaagcaactgctcaaagaagggaatgctttcaacgtgtcttccttcgtgctgcgagcaatgatgagcgggcagtactggccggaaggggatgaagtataccacgcagagcttaccgtaccagtgctactggttcatggaatgcacgacaagttcgtgcctgttgaagaagaccagcgtatggccgaaatcctgctacttgcctttctcaagctgatagacgagggctctcatatggtgatgctggaatgcccagaaactgttaatactctcctccatgaatttttgctgtgggaacctgaaccgtccccaaaagcactacctgaacccctcccagcccctccggaggataaaaagtag

SEQ ID NO: 44014 - DNA, 1158 bp, Artificial Sequence
  Description of Artificial Sequence: Synthetic coding sequence
atggccacccccccccccagcagcgccagcagcgacgccgcccagggtgacctgtctggcctcgtccgctgccaaagaagaattaccgtctaccgaaacggaaggctgctggttgaaaatttgggtcgagccccacgagcagacctcctgcacgggcagaatggatcaggtgagccaccggccgccctggaagtggaacttgcagaccccgcaggtagcgatggacgcctggctcccggaagcgcaggctctggcagcggtagtggatctggcgggagaagacgtcgcgctcgccgcccgaaaagaaccatccacattgactgtgagaaaaggattacatcctgtaaaggagcacaggccgacgttgtgttattcttcattcatggtgtaggcggtagcttggcgatctggaaggagcagctggacttcttcgtccggctaggttacgaagtggtagcccctgacctggctggccacggggcaagtagtgctccacaagtggccgcagcttacactttctacgccttggcggaggatatgagagcgatatttaagcgctatgccaagaaaagaaacgtgctcattggccatagctacggcgtgtcattttgtacattcctggcccacgagtaccccgatctagttcacaaggtgatcatgatcaatggcggtggtcccacagctctagagccaagtttttgttccattttcaatatgcctacttgcgttctgcactgtcttagcccctgcctggcttggtcattcttaaaggccggctttgctcgccagggcgctaaggaaaagcaactgcttaaggagggtaatgcatttaacgtgtcatcatttgtgctgagggctatgatgtctggtcagtactggcccgagggcgatgaggtctatcacgccgaactgacagtaccagtgttattggtgcacgggatgcatgacaagttcgtcccggtggaagaagatcagcgcatggcagaaattctgctgctggctttcctcaaactcatcgacgagggaagccacatggtaatgctcgagtgtcctgaaaccgtgaacacgctgctccacgagtttcttctctgggaacccgaaccttctccaaaggccttacctgagccactgccagccccccccgaggacaaaaagtag

SEQ ID NO: 44015 - DNA, 1851 bp, Artificial Sequence
  Description of Artificial Sequence: Synthetic coding sequence
atggagctgcggacccccggcaccaagtggagcccccagggcatcggatcactcagaagggttgtgtgggattacagtacacccgagatctctcttttttctgaagagggactgaagggagaacaagtgaagttgacagaggcactgaagaattcacaagggctagagaagcccctgcaggtcgcgagtgccacagtaagtgcggggctctggcttctgtatccaaaaccactttttgaggacacaccctacatcctagagccaggagaatatccaacttccgaggcgtggggtacatccgacccatccgtgggatcgctaaagccgatgcggttaggctgtccttccgtggaaaaacctggcgagcccagggccgtggtgtacgaagccccaggttttcagggtagatcctgggaggtatccagggacatctacaacctgcagcagccagaagactctcaaagcccccacctggctagcgtcggctcattaagagtgttgggtggttgttgggtcggctacgaaaaagaaggcttcaggggtcaccaatacctgctcgaagagggagagtatcctgactggtctcactggggaggctacgacgagcttcttaccagcctgcgtgtcattaggacagacttcggcgatcctgccgtggtgctctttgaagcaatggactttgagggccatggagtcgaggtttccaaggcactaccagatgtggagttagtccaacacggcccaagtacacaggccatccacgtgctgtccggagtgtgggtggcctaccaggaggtcggcttcagcggagagcagtacgtactggagaaaggcgtatacaggaactgcgaggactggggcgcaggaaattccaccctcgcttccctgcagcccgtcctgcaggtcggagaacacgacctgcattttgtgtccaaaatccagttatttagcaggcccgactttctaggggaccacttctcctttgaggatgatcaagctgcactgccagcatcctttcgcccccagtcctgcagggtgcatggaggatcatggattctgttcgatgaaactaatttcgagggtgatcagcacatcctaagtgagggagaatttccaacactcactgctatgggatgcttggcttccacagtcctcggctcactgcagaaagtgtcgttgcattttagtgagcctagtatcttcttgtacggcctggaatgttttgaaggaaaggagatcgaattgtcccgcgaggttaggagcttgcaggcggagggcttcaataatcatgtgcttagcgtcagaattaaaggtggaatttgggtcctatgcgagcacagtgacttccgcggtcggcaatggctagttgggagctgtgaaatcacaaactggctaacttacagcggtacacagcgagtgggctctctatacccgattaaacagaggcgcgtctattttcggctctggaacgctgctctaggcggttttctggcagtccctgatcatgtcgaagacatgaaggccggccgcgtcgtggtggctgatccacaagccggaggcagttgtatctggtactatgaagacggtctgttgaaaaatcaaatggctcccactatgagcctccaggtaatcggcccaccgtcacctggctctaaagtcgtcctatgggctgaatcaaggctgcccaggcagacttggagtatctctgaatctgggcatatctgcagccaaatgttcgagggccagatcctggacgtgaagggcgggaggggatatgatcgcgaccacgtggtgctctgggagccagacgaagaccgagcctcccagatctggaccattcatgttctctag

SEQ ID NO: 44016 - DNA, 282 bp, Artificial Sequence
  Description of Artificial Sequence: Synthetic coding sequence
atggaggaggccggcggccccatggcccgggccaaggcccgggtggatggtccggtggaccctcccgccgcaaccgtcctgcccatggttaggtcagagcatgtcacggttccggggcagccccctgcgccatccaccaccagaagaaaagatgttccctccccaggagtagacagagtctcgccctctcctggtggcacaccagcgcccgtcccaacaggcgctgaagccagtactgaaagccagctggtatctgatcctacagaaggcaaaacttgttag

SEQ ID NO: 44017 - DNA, 2364 bp, Artificial Sequence
  Description of Artificial Sequence: Synthetic coding sequence
atgatgaagaagcacgtggccggcaccaagggcccccacagcgagctgggcctggaattacagggagggagtcggcccacttctcgactcggcgggtctctgctgtttggatccttagttcccactgcgaaggaagcttccacccccgaacccctagggacaaaactctctgctctgttaccccatggtgccccagggcttaggaaagtgcccggtcaactgcccttattgtgcagtgagagatcgagccccactgagaaactggcgtgttctctccccctggaaggttggtcacccgctctcaaaacccaggggaaactgaacacgaggcctggcaaagttattttctttagcgagagcggatgtcagggaagcggacgagaagtgtggggggatattgttgatgcctctggctgggccccggtggcatctatacgcgtcgtgcgcgggtgttgggtactgtacgaagaaccagaatttcgggggcaaaaattagtcttgccggagggagacatggagcttcgtactccgggaacaaagtggagcccacaaggcatcggttccttaaggcgcgtagtttgggattactctaccccggaaatcagcctgtttagcgaggagggactgaaaggggaacaggtgaagctgaccgaagcactcaagaattcccagggtctggaaaagccattacaagtggcatccgccactgtttcggcgggcctatggctcctgtaccctaagccactgttcgaggacaccccatacatcctggagccgggagaatatcctacctccgaggcatgggggaccagcgacccctctgttgggtcactgaaacccatgcgtctgggctgcccgagtgtggagaagcctggcgagccacgcgctgtggtgtatgaggccccagggttccagggcagaagttgggaggtgtcacgagatatctataacctccagcagcctgaggacagtcagtctccccacctggcaagtgtgggctcattgcgggtgctcgggggctgctgggttggctatgaaaaagaaggcttccggggccaccagtatctgttggaggagggagagtatcctgattggtcacattggggaggttatgatgagctcctcacctctctgcgcgtgattcggaccgacttcggggatcccgcggtggttctctttgaggcaatggacttcgagggccatggggtggaggtttcaaaggcactccctgatgtggagcttgtgcagcacggtccgagcacccaggctatccacgtcctctcaggcgtgtgggtagcttaccaggaagtcggctttagtggcgaacagtacgttttggaaaaaggcgtgtatcgaaactgcgaagactggggcgcgggcaactcgactctcgcctctctgcaacccgtgttacaggtgggtgaacacgacctccatttcgtttccaaaattcagctgttctcacgcccagactttttgggagaccacttctccttcgaagacgaccaggccgctctgcctgcatcttttaggcctcaatcttgcagggtccatggcggcagctggatcctgttcgatgaaacaaattttgagggtgaccagcacattctctctgagggtgagtttcccactctgactgctatgggatgcctcgccagcacggtgctaggtagtctccaaaaggtctccctgcacttctccgagccatccatcttcctgtacgggcttgaatgcttcgaaggaaaagagatagagctgagtcgcgaagtgcgatcccttcaagcagaaggctttaacaatcatgttctgtctgtgcgtataaaaggagggatctgggtcctgtgcgaacactccgattttcgcgggcgtcaatggctcgtgggatcctgcgagatcactaactggctgacttattcaggcacacagagggttggaagcctttaccctattaaacaacgacgggtatacttccgcctgtggaatgcagccttagggggttttctggctgtgcctgatcacgtggaggatatgaaagcaggtagagttgtcgtagcggatcctcaggcaggaggaagctgtatctggtactacgaagatggcctactcaaaaatcaaatggcccccacgatgagccttcaggtgatcggccctccttcacctggctcgaaggtcgtattgtgggctgagagcagactcccgcgacagacctggtcgatctctgaatctgggcacatttgcagccagatgtttgaggggcaaattctggacgttaaaggcgggcgcggatatgatcgggatcatgtggtactgtgggagccagatgaggatcgagctagtcagatatggactatacatgtcctgtag

SEQ ID NO: 44018 - DNA, 1224 bp, Artificial Sequence
  Description of Artificial Sequence: Synthetic coding sequence
atggaggaggccggcggccccatggcccgggccaaggcccgggtggtgtctgcaaccctaacatggcgacagagaccgcccactcaggaagaaatcaaacatggatttcacaaggtctcactcgtgtctggtgcccagatggaagcaccccagaaggaaatgtttgagtttagtagaagagaggaggtcgaagttaacggatttgccacacaggaggaggaaactgttaattgtcagggccccagagataccgccggcagcaagaacttccagagtcatggtcccattttttccaagaagtatatcccgcctccaaaagagaagcggcccgagggcaggttgaaggaggctgtcgaccaatctgatggatctcggcaggcccctcgtaccgagccaccgtgtgtgggtgcaatggcacgtaccgaactgctcgtgccattacctgggccacgtgaaccttccccccaccccggcgtaggattaacatccggctcgagccgcagcctggaagagtaccgggtaactaggacagtgaggaccaccaccgttgtcgggggacatgtggatcgccggatgagcagctctgtgaccgtcagaccggtgagtagcggagaggccctgcctcgcggccgccaggtgagtaggatggtccctcctgtggtagtgggatcacctcccgggagtccttcacgatctcaggctgtcaaggttctgtccaacctggtgccagccgggcactctccaccggcatcgcacttgccacgacctacagccggaggcccccggtctacaggcttgggatcaaccgtgggcgctgccctgaggcagctgccggagaccgggactgcagagctgaaagatagcagcgccctcgcttccaccgggattccggcctccgcccatcttccaaagaaccaggatgccccagccgcatgtcctgaccgtgatcaagggagagcacccgacgcacgggcctgcgagctgtggcaggtgctgggagctccttccagtacggagctgccactgcaaactagccagggacaagccagcgtgccaagttcccccagacttgagacacacgtaccttcaccaggcctgactcaccccgcgaagcagccagtagtccccacgcaccctggggcccggctgactccactggtcttgccacctaaaaaaagaacaggcccttggacccctttgttgccgccttcatgcccctggtag

SEQ ID NO: 44019 - DNA, 1128 bp, Artificial Sequence
  Description of Artificial Sequence: Synthetic coding sequence
atggaggaggagatcgccgccctggtgatcgacaacggcagcggcatgtgcaaggccggattcgccggagacgacgccccccgggcggtgtttccgagcatcgtgggacggccacggcaccagggggtgatggttggcatgggtcagaaggactcttacgtcggtgacgaggctcagtctaagcgggggatcctaactttaaagtaccccattgagcatggaatcgtcactaattgggacgacatggaaaaaatatggcaccacacattttacaatgagctgcgggtagcacctgaggagcatcccgtgctgcttactgaagccccacttaatcccaaggcgaacagggagaagatgactcagatcatgttcgagaccttcaatactcccgcaatgtatgtggccattcaggcggtcctcagcctgtacgccagtggaagaactacaggaattgttatggacagcggagacggcgttactcacaccgtccctatctatgagggatacgcactcccccacgcaatcttgagactagacttggcgggcagggacctgactgattatcttatgaaaatcctgactgagaggggctattccttcaccacaactgctgaacgcgaaattgtgcgggatattaaggagaaactctgctatgtggccctggattttgaacaagagatggcgaccgccgcatcaagctcttcgctcgagaaaagctacgagctccctgatggacaggtcatcactattggcaatgagcgctttagatgtccagaggccctctttcaacctagttttttgggaatggaaagctgcggaatccacgaaaccaccttcaattctatcatgaagtgtgacgttgatattcgcaaggacctttatgccaacaccgtgctgagtggcggtaccactatgtaccctgggattgccgatagaatgcaaaaagaaattacggctctggccccctcaaccatgaagataaaaataatcgcgccacctgaacgcaagtatagcgtgtggattggtggtagcatcctggcaagtttgagcacgttccagcagatgtggatctccaaacaagagtatgacgagagtggtccttccatcgttcaccggaagtgcttctag

SEQ ID NO: 44020 - DNA, 1128 bp, Artificial Sequence
  Description of Artificial Sequence: Synthetic coding sequence
atggaggaggagatcgccgccctggtgatcgacaacggcagcggcatgtgtaaagctgggttcgcgggggacgacgcccccagggcagtgttcccgtcaatcgtgggccgccctcgtcaccagggagttatggtgggtatggggcagaaggactcctatgttggggatgaagcccagagcaagcgcgggatcctcaccttgaagtatccgatcgagcacggcattgtgacaaactgggacgacatggaaaagatctggcatcacaccttttacaacgaactaagggttgcaccagaagaacaccccgtgctgctcacagaggccccactgaatccgaaggccaacagggaaaagatgacgcagattatgtttgagacatttaatactccagctatgtatgttgctatccaggcagtcctgtcactgtatgctagcggccgtacaaccggcattgtgatggattctggcgatggcgtgactcataccgtccctatttacgaagggtatgccctgccccacgcaatccttagattagacctcgctggacgggacctgaccgattatctaatgaagatcctaactgagcgcggttattcctttactaccaccgccgaaagagaaattgtccgggacattaaggaaaagctgtgctatgtggcgttagacttcgagcaagagatggctactgccgcctcatcaagctccctcgaaaagtcctacgaactgcctgacgggcaggtgatcaccattggaaacgagcgttttagatgccctgaggctctgttccaaccctcatttctggggatggaaagttgtgggatccacgagacaacattcaactccatcatgaagtgtgacgtggacataaggaaggacctgtacgccaatactgttctgtctgggggcaccacgatgtaccctggcatcgctgatcgcatgcagaaggaaatcacagccctcgcaccatccacgatgaaaatcaagatcatcgcccctcccgaacgtaaatactccgtctggataggcggctcaatcctcgcatcccttagcacatttcaacaaatgtggatatctaagcaggagtacgacgaaagtggcccttctattgtacatagaaagtgtttttag

SEQ ID NO: 44021 - DNA, 1026 bp, Artificial Sequence
  Description of Artificial Sequence: Synthetic coding sequence
atgggcaccgagaaggagagccccgagcccgactgccagaagcagttccaggccgctgtttctgtgatccagaatctcccgaagaatgggtcctatcgccctagctacgaggagatgcttcgcttctacagctactacaaacaggcaacaatgggaccatgcctcgttccgaggcctggtttctgggatccaatcgggaggtacaagtgggacgcatggaatagcctcggtaagatgtcccgagaagaggctatgagcgcgtatatcaccgagatgaagttggttgcacagaaagtgattgacaccgtacctctcggagaagtggccgaggatatgttcgggtatttcgagccactgtaccaggtaatacctgatatgcccaggcctccggagacgttcctgaggcgcgtgactggttggaaagagcaggtcgttaacggcgacgtgggagctgtctctgaaccaccttgcctgccgaaggagcctgctcccccaagtccggcgagtctctgggctgttacgctaccaaccccaccacagtcgcctatacaccctggaacctggaccccccgtttttcggtaatcccatggtctagctggtctctaagctggtttggccagtccagcggccagcatctcgaagaatcagttattcccggaacagccccatgccctccacagaggaagcgggggtgcggagctgcgcgtcgagggccccggtcttggacctgtgggtgctggggccagtttgagcactaccggagagcctgccgtcgatgtaggagggggtgccgggcttggcgggcgtgtcctggacctctgtctcgcggccgatcaccaggccccgttctaggacatggtcctctggggagtaggggcccccggtgtagttcttctagttgtgggcccagctcatcctctggtagcagtgagtgttttggcccaaaaagaggtgattgccaatggcgcggtctatgcagccagctcagactatcatgttgtgccttaagtcttcctcgtgtctag

SEQ ID NO: 44022 - DNA, 807 bp, Artificial Sequence
  Description of Artificial Sequence: Synthetic coding sequence
atgggcaccgagaaggagagccccgagcccgactgccagaagcagtttcaggctgccgtatctgtgatacaaaatctccccaaaaacggcagttatagaccgtcgtacgaggaaatgctacgcttctattcttactacaaacaggctaccatgggcccttgcctggtcccccgcccaggattttgggatcctatcggtcgatacaagtgggacgcttggaactctttagggaaaatgagcagggaagaggcaatgagtgcttatatcaccgaaatgaagctagtggcccagaaagtgatagacacagtccccctcggagaagtggccgaagatatgtttggatacttcgagccactgtatcaggtgataccagatatgccacgccccccggaaacttttttgagacgggtgaccggctggaaggagcaggtggtgaatggagacgtcggagctgtcagcgagcccccgtgtctgccaaaagagccagcccctccttcgccagagagccactcccccagggacctggatagcgaagttttctgcgactccctggaacagctcgagcctgagctgagctctggccaacacctggaggaatccgtgataccaggcacagcaccgtgtcccccccagcggaagcgcggctgtggagctgccaggagagggcctcgaagttggacttgcggctgttggggccagttcgaacactaccggagagcctgccgccgttgccggcgggggtgcagagcttggcgcgcctgccccggtcccctcagttcgttgacattatctgtgaggctggaatag

SEQ ID NO: 44023 - DNA, 918 bp, Artificial Sequence
  Description of Artificial Sequence: Synthetic coding sequence
atgggcaccgagaaggagagccccgagcccgactgccagaagcagtttcaggcagccgtctccgtgatacagaacctgcccaaaaacggaagttacagacctagttacgaggagatgctgcgcttctattcctattacaagcaggcaacaatgggcccgtgtctggtgcccagacctggtttttgggatcccattggccgatataaatgggatgcctggaattcgctggggaaaatgagccgagaggaggctatgtccgcatacatcacagagatgaagttagttgctcaaaaagtgatagacacagtgcccctaggggaagtggccgaggatatgttcggttacttcgagccactgtatcaagtgatccccgatatgccacgccctccagagacattcttgcgccgagtcaccggatggaaagagcaagtggtgaacggggacgtgggggctgtctcagagcccccctgtttgcccaaagagcccgcacccccgtcgcccgagagtcattctccacgcgacctggattccgaagtgttctgcgactccttagaacagctggagccagagcttgtgtggaccgagcagcgtgccgcatccggtggaaagagggatccacggaattcaccggtacctcccactaagaaggaagggctcagaggctcccctcccggcccgcaggagctggacgtgtggctgcttggcaccgtgcgcgcgctgcaggaaagcatgcaagaggttcaggccagagtgcagtctttggagtccatgccacgccctccagaacagcgcccacagcctcgcccctctgctcgcccctggccgctggggctccccggccccgcgcttctcttttttcttctctggccttttgtcgttcagtggctgttccgtatgtttaggacacagaagcggtag

SEQ ID NO: 44024 - DNA, 1026 bp, Artificial Sequence
  Description of Artificial Sequence: Synthetic coding sequence
atgggcaccgagaaggagagccccgagcccgactgccagaagcagttccaggctgctgtcagcgtgatacaaaacctgcccaaaaatggctcatataggccttcctatgaagaaatgttgcgattttattcttattacaagcaagctacaatgggaccttgccttgtcccccggcccgggttctgggaccctataggccgctataaatgggatgcctggaatagccttggaaagatgtcacgagaagaggccatgtccgcctacattacggaaatgaagctcgtggcccagaaagtgattgacaccgttcctctcggagaggtggctgaggacatgtttggttactttgagcctttatatcaggttatccccgatatgccgaggcctcctgagacattcttgagaagggtaacaggttggaaagagcaggtggtaaacggggatgtaggcgccgtatccgaaccgccctgtctgccaaaagaacctgcaccccctagcccggccagcctgtgggcagtgaccttacctactccaccacagagccccatccaccccggaacttggacgcccaggttttcagttataccttggtcctcgtggtcactgagttggttcgggcaaagctctggacagcacctggaagagtcggttatccctgggactgcgccttgtccacctcagaggaagcgcggctgcggggcggctcgaagaggacccaggtcatggacctgcggctgctggggtcagttcgaacactatagaagggcgtgtaggagatgtaggcggggatgccgagcctggcgagcctgccccggtcccctcagtcgaggtaggagccctggtccagtgctgggccacggacccctgggctcaagaggtcctcgttgcagctcaagttcctgcggaccctcttcctcaagcgggtcgagcgagtgttttggccccaagagaggggattgccagtggcggggcctatgctcccagctgcggttgtcctgctgtgccctttcactgccgagagtgtag

SEQ ID NO: 44025 - DNA, 267 bp, Artificial Sequence
  Description of Artificial Sequence: Synthetic coding sequence
atggccctgcaggccgacttcgaccgggccgccgaggacgtgcggaagcttaaagctcgcccagatgacggagagctgaaagagctctatgggctctataaacaggcaatagtaggtgacatcaatatcgcatgtcccggtatgctggatctcaaagggaaagccaagtgggaggcatggaatttaaaaaagggcctgtccacagaagatgccactagcgcttacatttccaaggctaaggagctcattgagaagtacggtatctag

SEQ ID NO: 44026 - DNA, 3180 bp, Artificial Sequence
  Description of Artificial Sequence: Synthetic coding sequence
atgtgcgtgcggagctgcttccagagcccccggctgcagtgggtgtggcgcactgccttcttgaagcacacacagcgacgccatcaaggttctcaccgatggactcatcttggcggatctacttaccgtgctgtgatcttcgacatgggaggagtgcttattccttcaccgggtagggtagcagctgagtgggaagtgcaaaaccggatcccatctggtactatccttaaagccctcatggaggggggcgagaacggcccttggatgagatttatgcgagcagagatcaccgccgaggggttcctgagagagtttggcaggctctgtagtgagatgctgaaaacatcagtgccggttgatagttttttctcattgttgacctccgagagggtcgcaaagcaatttccagtgatgactgaggcgataacacaaatcagagcgaagggcctgcaaactgcagtcttatcaaacaatttctatctgccgaaccagaagtccttccttccactggatcgcaagcagttcgacgtgattgtcgagagctgtatggagggcatttgtaaaccggatccacgtatctacaaactctgccttgaacaacttggacttcagccaagcgaaagcatttttctcgacgacctcggcaccaacttgaaagaagcagccagattgggaattcatacaatcaaggttaatgatcctgagactgccgtgaaagaactagaagcactgctgggcttcaccctcagagttggcgtgcctaatacaaggcccgtcaagaaaaccatggaaatcccaaaggacagtctgcagaagtaccttaaggatctgttgggaatccagaccaccggacctctagagctcctccaattcgaccacggccagtcgaatccaacttactatatacgcctggctaatagagatctcgtgttgagaaagaaacctccagggactctgctgccaagcgcacatgcaatcgagcgcgaatttaggatcatgaaagctctagccaatgccggtgttccagtcccaaatgtgctcgatttgtgtgaggattccagcgtgatcggaactccgttttacgttatggaatattgccccggacttatatacaaagacccgtcactgcctgggcttgagccgtctcacagacgagccatatatacagccatgaatacagtcttgtgcaagatccactcagtcgatcttcaggccgtgggcctggaggactacgggaaacagggggactatattccccggcaggtgaggacgtgggtaaaacagtaccgcgcctcagagacttctaccatccccgcaatggagcggctgatcgagtggttgcctctgcatctcccccgccagcagcgcacaacagtagttcatggcgattttcgactcgataacttggtgttccatcccgaagaacccgaagtgttagccgtgcttgactgggagttgtccacgttgggggatcccttggctgatgtggcatatagctgcctcgcccattaccttcctagttcttttccggtgttgcggggtatcaacgactgtgacttaacgcaattgggaataccagccgccgaggagtattttagaatgtactgtctgcagatgggcttaccccctaccgagaactggaacttctatatggctttctcctttttcagagtggctgccatcctccagggagtgtacaagcggtccctgaccggtcaggccagcagtacgtatgcagagcagacaggaaagctgacggaatttgtttccaatctggcgtgggatttcgcagtgaaggagggatttagagttttcaaggaaatgcccttcacaaatccactaactcgatcataccacacctgggcaagaccacagagccagtggtgccctactgggtctaggtcatactcgagtgtgcctgaagcatctcctgcccacactagtaggggggggctcgtgatttccccagagtcactgagcccaccggtcagagagctgtaccatcggctgaaacatttcatggagcagcgtgtgtatccagctgaaccagagctgcagtcccatcaggccagcgccgcaaggtggtcaccctcacctttaatagaagaccttaaggaaaaggcgaaggccgaggggctctggaatctctttctgccactcgaagcggatcccgaaaaaaagtacggtgccggactgacaaacgtggagtatgcccatctgtgcgaattgatgggtacttccctgtatgcccccgaggtgtgtaattgttcagctccagacaccggaaacatggagctgctcgttcgatacggaacagaagcgcagaaggccaggtggttaatcccactgttggagggtaaggccagaagctgcttcgctatgacagaaccacaggtagcttctagtgatgctactaacattgaagcatccatcagggaggaggactcgttttatgtcataaacggacacaaatggtggatcaccggcattctagatcctcggtgccagttgtgcgttttcatgggcaagaccgacccacacgctccaagacacagacaacagtcggttctgctagtcccaatggacacccccggaatcaagatcatcaggccactcaccgtgtacggcctggaagacgcgcccggcggccacggggaggtgcggttcgagcatgtgcgagtgccgaaagagaacatggtcctgggtcccggacgtggttttgagattgcccagggacggcttggcccaggcagaattcatcattgtatgcgacttattggcttcagtgaaagggccctggcactgatgaaggcacgagtcaaatcacggctcgcctttgggaagcccctggtggaacaggggaccgttttagccgatatcgctcagtcacgcgtcgagattgagcaagcacgattgctcgtgcttcgagcagcgcatctgatggatcttgccggtaataaagcagccgcccttgacatcgcaatgattaagatggtggctccaagtatggcttcacgtgtgatagaccgcgctatccaagcttttggggcagccgggctgagctctgattatcctctagcccagtttttcacttgggctagagcgttaaggtttgcagatgggccagatgaggttcacagggcaacagtcgccaaactggagctgaaacacaggatctag

SEQ ID NO: 44027 - DNA, 1479 bp, Artificial Sequence
  Description of Artificial Sequence: Synthetic coding sequence
atgctggagtacctgagcctgaccttcctgatcagcgtgaagatccagggcgactacatacctcgccaggtgaggacctgggtcaagcagtatcgggcaagtgaaacatccacaatccctgccatggaaagattaatagagtggttgcctctccacttgcctagacaacagcgaactacggtcgttcacggcgacttccggctcgacaacttagtttttcatccagaagagcctgaagtgcttgcggtcctcgattgggaactatcaacactgggagatccgcttgcagacgtggcctattcctgtttagcacattatctgcctagctcttttcctgtcctgcgcggcatcaacgactgtgatctgacccagcttggcatccccgccgccgaagagtactttcgcatgtactgtctccagatggggttgccacccactgagaactggaacttctatatggccttctctttcttccgggtcgctgccattctgcagggggtgtacaaacggtctctcaccggccaggcctcatcaacttatgccgagcaaactggcaaacttactgaatttgtgagcaatctcgcatgggactttgcagtgaaagagggcttccgggtttttaaggagatgcctttcactaatccactgacacggtcttaccacacatgggctagaccgcagagccagtggtgcccaaccggctcccggtcttactcctctgttcctgaagcctccccggcccacacaagcaggggaggccttgttatatctcctgagagcctcagtcctcctgttagagagctgtaccaccgcctgaagcatttcatggaacaacgggtgtatcctgcggaaccagagttacaatctcatcaggcatctgccgccagatggtcccctagccccctcattgaggatttaaaggagaaggccaaagcagaagggttatggaacctgttcctgcccctcgaagccgatcctgagaagaagtatggcgccggccttaccaacgtggagtacgcccatttgtgcgagctcatgggcaccagcctttacgcccctgaagtttgcaactgcagtgctccggacactggaaatatggaattgctcgtgcgatatggcactgaagcacagaaagccaggtggctgatccccctgctggaggggaaagcacgctcttgttttgcgatgaccgaaccgcaggtggcatcatctgacgccacaaatattgaggcctccatccgcgaggaagattctttttatgtgatcaacggacacaaatggtggataacagggattctcgatccccggtgccagctctgtgtcttcatgggcaagactgatccacacgcccctagacatagacagcaatcagtgttgctggtgcccatggataccccaggcattaaaatcattcgcccattaacagtctatggcctggaagatgcaccaggatgctttctgccgagcttctccctctag

SEQ ID NO: 44028 - DNA, 2673 bp, Artificial Sequence
  Description of Artificial Sequence: Synthetic coding sequence
atgtgcgtgcggagctgcttccagagcccccggctgcagtgggtgtggcggacggcgttcctgaaacatacgcaacgcagacaccagggcagtcaccggtggacccacctgggtggctcaacgtatagggccgtcatttttgatatgggcggagtgctgatcccttcgccaggcagagtggcggccgagtgggaggtccaaaatcggataccttccggcaccatcctgaaagctctcatggagggtggggagaacggtccatggatgcgctttatgcgggccgagatcaccgccgagggctttctaagggaatttgggaggttgtgttctgagatgctgaagacctccgtccctgtggactctttttttagtctccttacctctgagcgggtagctaaacagttcccagtcatgaccgaggcaattacacagattagagccaaaggcctacaaactgcagtcctgtccaacaacttctacctgcccaaccagaaaagcttcctgccattggatcggaagcagttcgacgtgatcgtagagtcatgtatggagggtatatgcaaacccgatccacgcatttataagctgtgtctcgaacaacttggcctgcaaccaagcgagagtatatttttagacgaccttggtaccaatctcaaggaagccgcaaggctaggcatccacactataaaagtaaatgatcctgagaccgccgtgaaagaactggaggctctgctgggtttcaccctgagagtgggggttcccaatacccgtccggtgaaaaaaacaatggagatccctaaggactcactgcagaaatacctcaaggatctcctcggcattcagacgaccgggcctctggaattacttcaatttgaccatggccagagtaacccaacctattacatcagattggccaaccgggatttggttttgcgtaaaaaaccacctgggacattgcttccctcggctcatgccatagagcgggaatttcgtatcatgaaggctctggcaaacgctggagtgccggtgccgaacgttttggacctctgcgaggattcgtccgtgatcggaaccccattttacgtcatggagtactgtcccggtcttatctataaggacccaagtctacctggcctcgagccctcgcatcgtcgggccatctacactgcgatgaacaccgtgttgtgtaaaatccacagcgtcgaccttcaagctgtaggtctcgaagattacggtaagcagggtgattacattccccggcaggtccggacgtgggtcaagcagtatcgcgcctccgagacgtcgacaattccagcaatggaacgcctaattgaatggctaccgcttcatttaccaagacagcagcgcactactgtcgtgcacggcgatttccgcctggacaatttagtctttcacccagaggaaccagaagttctcgcggtcctcgactgggaactttctaccctcggggatcctctagccgacgttgcatacagttgcttggcccactacctcccctcaagcttccctgtgctgagaggcatcaatgactgcgacctaacccagctgggcataccagccgccgaggaatacttccgcatgtattgtctgcaaatgggcctcccccctaccgagaactggaatttctacatggccttctccttctttcgggtggcagctatcctgcagggggtgtacaagagaagcctcaccggccaagcctcttctacatatgcagagcagactggcaaattaaccgagttcgtgtcaaacttggcgtgggactttgcagtgaaagagggctttagggtctttaaggagatgccatttacgaaccctctaactagatcatatcatacctgggcgaggccacagagccagtggtgccctaccggaagtcggagttatagttctgtgccggaagcaagcccggcacacaccagtcgaggggggctcgtgatatccccagagtccctgtccccacctgtgagggagctgtatcaccgcttaaagcactttatggaacagagggtctaccctgcagagcctgaactacaatctcaccaagcctccgcagcccgctggtcgccctcccctcttatagaagacttaaaggaaaaagcaaaagccgaaggcctgtggaacctgtttctgcccctcgaggccgatcctgagaagaagtacggggccggcctgacaaatgttgagtacgcacatctctgtgagctaatgggaacaagcttgtatgctcccgaagtttgcaattgctccgcccccgacaccgggaatatggaacttctcgtgcgctacgggactgaggctcagaaggccaggtggctcatcccgctgctcgaaggaaaggcccgatcttgttttgcgatgaccgagccgcaggtcgccagcagcgatgcaacaaatatcgaagcctccataagagaagaggattccttttacgtgatcaacggccataagtggtggatcacgggcatcctggatccgcggtgtcagctttgtgtttttatgggcaaaactgaccctcatgccccaaggcaccggcagcagtctgtgctgttagttccaatggatacaccaggcatcaaaattattagaccgttgaccgtgtacggactggaggacgcccccgggtgttttctgcctagttttagcctgtag

SEQ ID NO: 44029 - DNA, 3273 bp, Artificial Sequence
  Description of Artificial Sequence: Synthetic coding sequence
atgtgcgtgcggagctgcttccagagcccccggctgcagtgggtgtggcggaccgcgttcttaaagcatacccaacggcggcatcaaggaagccatcgatggacccacctgggtgggtccacatatcgtgctgtgatcttcgacatgggcggggtcctaatcccgtccccagggagagtggctgccgagtgggaggtacagaacagaattccatcggggaccattctcaaggccttgatggaaggaggtgaaaacggaccctggatgcggttcatgcgggcagagattaccgcagaagggtttctgagagaattcggccgcttgtgttcggagatgctcaaaacttcagtccctgtagactctttcttttctctgctgacatccgaacgagtggcaaaacaattcccagtgatgacggaggcaattacccagatcagagccaaaggacttcaaactgctgtgttgagcaataacttctacttgcctaatcagaaatcctttttgccactcgatcggaaacagttcgatgtgatcgtggagtcctgtatggagggaatatgcaagccagatccccggatctacaagctatgtctggagcaactgggtttgcagccttccgagtctatatttctagacgatctcggaacaaatctcaaggaggccgccagactggggattcacaccataaaaagacagggattcgctgtcctgccaaagctcgtcagtaactcatgggcacaggccatctatcctccctatccacccaaggtggtgcggctgcaggtgaatgatcccgaaaccgccgtgaaggaactggaagccttgctcggattcacactcagggtgggcgtccctaatactcgtcctgtcaaaaagactatggagattcccaaagactccctgcagaagtatttgaaggacctgctggggatccagacaacaggccctttggagctgctccagtttgatcacggccagtccaaccccacctactacatacgtcttgccaatagagatctggtcctgcgcaagaagcctccaggcacgctattaccctccgcacacgccatagagagggaatttagaatcatgaaagcccttgccaacgccggggtacctgtacctaatgtgctggacctgtgcgaagatagtagtgtaatagggacccctttctacgtcatggagtactgccccggactgatatacaaggacccatctctaccaggtttggaaccaagccaccggagggctatctacacagccatgaatactgtcctgtgtaagatccattcagttgatctacaggccgtgggactggaggattatggaaaacagggagactacatacccagacaggtacggacttgggtgaaacagtaccgggcttcagagacgtctactataccagcgatggaacgactgatcgagtggctgccccttcatctaccacggcagcagagaaccaccgtggttcatggagatttcagactggataatctggtgtttcaccctgaggagccagaggtcctcgccgttctggactgggagctttccaccctgggggaccccttggctgatgtggcctattcctgtctggcgcactatctgccgtcatctttccccgtgctcagaggtatcaatgattgcgatttgacccaactgggtattcccgcagccgaagaatactttcgcatgtactgtctgcagatgggacttcccccaactgagaattggaacttctatatggccttttcatttttcagggtggcggcaatcctccaaggtgtgtacaaacgctctttgacaggccaggcctcgagcacatacgccgagcaaaccggcaagttgactgagtttgtgagtaatcttgcatgggatttcgccgttaaggagggctttcgcgtcttcaaagagatgccatttacaaatccactcacccggtcctatcacacgtgggccagaccccaatcacaatggtgtcctactggatctcgatcctattctagtgtgcctgaagccagtcccgcccatacaagtcggggaggcctggtgattagccctgagagcctctcccctccggttagggagctctatcatcgcctaaaacacttcatggagcagagggtataccccgccgaaccggagctccagtctcatcaggcctctgccgcgaggtggtctccatcaccccttattgaagacctgaaggagaaggctaaagcagagggtctctggaatctgttcctgccactggaggcggaccctgagaagaaatacggcgccggcctcactaatgtggaatatgctcatctgtgcgagctaatggggaccagcctctacgcccctgaggtttgtaactgcagtgcacctgacactgggaacatggagctgctggtgcggtatggtaccgaggcccagaaggcccggtggctcatacccctcctggaggggaaagcccggagctgtttcgccatgaccgagccccaagtggcttctagtgatgcaacaaacatcgaggcctcaattcgtgaggaagatagcttttacgtgatcaacggtcacaaatggtggatcacaggaattctggaccctagatgccagctttgcgtctttatggggaagactgatcctcacgccccccgccatcgacaacagtcagtgctgctggttcccatggacaccccgggaatcaagattattcggcccctcaccgtttatggcctcgaagacgcacccgggggccacggggaggtcaggttcgaacacgtccgggtccctaaggaaaacatggtcctgggtccgggacggggatttgaaatagcccagggtcggctgggtcccggacgcatccaccactgcatgagacttataggattttctgagagagccctcgcattaatgaaagccagggtaaagtctagactcgcgtttggaaagcctctagtggagcaagggaccgtgttagcagacatcgctcagtctagggtcgaaattgagcaggcccgactgttggttctccgggcagcgcatctaatggacttggccggaaacaaggctgccgcccttgacatcgccatgattaagatggtcgccccaagcatggcatcccgggtcatcgatcgcgccatccaggcctttggcgcagccggtctgtcttctgactacccccttgctcagttcttcacatgggccagagctctccggttcgctgacggccctgacgaggttcacagagccacggttgccaagctggagctaaagcacagaatttag

SEQ ID NO: 44030 - DNA, 291 bp, Artificial Sequence
  Description of Artificial Sequence: Synthetic coding sequence
atgtgcgtgcggagctgcttccagagcccccggctgcagtgggtgtggaggacagcctttttaaaacatactcagcgacgccaccagggctcgcaccggtggacccaccttggaggctctacttacagggccgtgatttttgacatgggaggcgttctcataccctcaccaggcagggtggcggcggagtgggaggtgcagaacaggattccttctggtaccattctgaaagccctgatggaggggggtgagaatggaccatggatgcgcttcatgagggccgaaatctag

SEQ ID NO: 44031 - DNA, 3312 bp, Artificial Sequence
  Description of Artificial Sequence: Synthetic coding sequence
atggcccccgcctgccagatcctgcggtgggccctggccctgggccttgggctgatgttcgaagtgacacatgcgttcaggtctcaggatgaattcttaagctccctggagagttatgaaatcgcgtttcctacacgggtggaccacaatggggctttgctggctttttcccctcctccacctagacgccagcgaagaggaacaggggccaccgcagaatccaggctgttctacaaagttgcatcacccagtactcactttctcctgaacttgacaagaagctctcgcttgttagcgggccacgtgtctgtggagtattggaccagggaaggcctggcttggcagagggccgctagaccccattgcctgtacgctggtcatctgcagggacaggcctcttcaagtcacgtggctatctccacatgcggcggtctccatggcctgatcgttgcagatgaggaggaatacctgatcgaacccttgcacgggggaccgaagggctcaagatctcctgaagagagcggtcctcacgtggtgtacaaaagatccagtctccgtcacccacatctcgacaccgcttgtggggttcgcgacgagaaaccatggaagggaagaccatggtggctaaggacacttaagccgccacctgcacggccgctagggaacgaaacagaaagggggcaacccggcttaaaaagatccgtgtcccgcgagcggtatgtggaaaccttggtcgtcgcagacaaaatgatggtcgcttaccatgggcgaagagacgttgagcagtatgtgctcgctattatgaatatcgtggccaaacttttccaggattcatcactcggatcgacggtcaatattttggtgactcggctcatcctcctcaccgaagatcagcctacgcttgagattacccatcacgctgggaaatctctcgactctttctgtaagtggcagaagagcatcgtgaatcattcaggccatggaaacgcaatcccagagaacggggtggctaatcatgacacagcagtgctgataacaaggtatgacatatgcatttataagaacaaaccctgcggcaccctggggttggcaccagtgggaggaatgtgcgagcgcgaaaggagttgctctgttaatgaggacatcggcctggctacagccttcactatcgcgcatgagattgggcacacatttggaatgaaccacgatggggtcggaaattcctgcggcgccagaggtcaagacccagcaaagctgatggcggcccacatcactatgaagacaaaccccttcgtgtggagcagttgttcccgcgactatatcacgagttttctagattccggcctgggtctctgtctgaacaaccggcctccacgacaggatttcgtctatcccacggtcgctcccggccaagcttatgacgcagatgaacagtgcagatttcagcatggagtgaagagcaggcagtgtaagtatggggaggtctgtagcgaactctggtgtctgtccaagtcaaataggtgcatcacgaattctattcccgcggctgagggcaccttatgccaaacacacacaatcgataagggctggtgttataaacgtgtgtgcgtccctttcgggagcagacccgagggcgtcgatggagcttggggcccatggaccccctggggggactgctctcgtacatgtggcggtggagtgagttcgtcatcccggcactgcgacagtccacggccaaccataggcggtaagtactgcctgggcgagagaagacggcaccgcagttgcaataccgatgactgtcccccaggctctcaagacttccgggaggtgcagtgcagcgaattcgatagcatccctttcaggggcaaattctataaatggaagacatatcggggaggaggtgttaaggcctgtagcctgacgtgtctcgccgaagggtttaatttctacacagagcgcgcagctgcagttgtggacggtaccccttgtaggccagataccgtggacatctgcgtgagcggggagtgcaaacacgttgggtgtgaccgggtgctgggttccgacttacgggaagataaatgtcgcgtgtgtggaggggatggttccgcttgtgagaccattgagggcgttttctcacccgcatcccctggggctggttatgaagatgtcgtctggattccaaagggatctgtccacatcttcattcaagacctgaatctgagcctgagtcacttggccctcaaaggcgatcaggaaagcctgctccttgagggcctccctggcaccccacagccccaccgcctgcctctggccgggaccacctttcagctcaggcaaggccccgaccaggttcagtctctggaagccctcggcccaatcaatgcaagtctgatcgtcatggtcctcgctcggacagaattgcctgccttaagatataggtttaacgccccgatcgctcgtgactcattacccccatactcttggcactatgctccatggacgaaatgctccgcacagtgtgccggtggatctcaggtgcaggctgtggagtgccgcaatcaacttgacagcagcgccgtggctccacactattgttcggcacatagcaaattaccgaagcgacagcgcgcctgtaacaccgaaccctgtcctcccgactgggtggtgggtaattggagcttgtgctccagatcgtgcgacgctggcgtacggtcaagatccgtggtctgtcagagacgcgtctcggcggctgaggaaaaagcgctggatgattccgcctgccctcaacctcgcccgcccgtcctcgaagcgtgccacggcccgacctgccctccagaatgggcagctctggactggtccgaatgcaccccttcctgtggcccaggcctccgtcatagggttgtactgtgcaagtctgccgatcaccgagcgactttgcctccggctcattgttcccccgctgccaagccccctgctacaatgcgatgtaacctcagaaggtgtcctcctgcccggtgggtcgcaggagaatggggtgagtgcagcgctcaatgcggcgtgggccagcgacaaaggtctgtgaggtgtacatctcatactggccaagcctcccacgagtgcacggaagctctgagacccccaaccacgcagcaatgcgaggctaaatgcgattcgccgacgcccggagacggaccggaagaatgcaaagatgttaacaaggtcgcatactgccccctggtgcttaagttccagttttgcagccgagcttattttcgtcagatgtgctgcaagacatgtcatggacactag

SEQ ID NO: 44032 - DNA, 1998 bp, Artificial Sequence
  Description of Artificial Sequence: Synthetic coding sequence
atggccagcgccagccagggcgccgacgacgacggcagccggcggaagccacgattagcagcatcattgcagataagcccccaacctaggccttggagacccctacctgcccaggcacagtccgcatgggggcccgcccccgcccccgcgacttaccgcgccgaaggtgggtggccacaagtttcagtacttcgcgattctggacccggagcaggcgccggcgtgggtgagttgggcgccgctagagcctgggagaatctgggtgagcagatgggtaaagctccgcgcgtgccagtgccacctgccggactgagcctccccctgaaagaccctcccgcaagtcaggccgtgtctctcctgaccgagtacgccgccagtctcggcatttttttattgtttcgcgaagaccagccacctggaaaggtgtttaagtacagggcaccaggaggcgaggaactgaaggcaatgtgcctgtggcaggtcgaggtgctgcgggcgtttcttctgaggaccgggtggagaggcctgtggcgtggggatctagacctcgggcccgattcttcatgggctaatcgtctcccattcttgctcatctgcgagatggaaagcaggatccctgcggtagaagaattgggcccctgctttcccttttctgtcagtgccgaattggatggcgttgtatgtcctgctggcacggctaactctaagaccgaggctaaacagcaggccgcactcagcgccctgtgctacatacgctcacagttagaaaaccctgagagccctcagacaagctctaggcctccattagctcctctgtctgtggaaaacatactaacgcatgaacaaagatgcgccgctctcgtgagcgccggattcgacctgctactggacgaacgaagcccatattgggcgtgcaaaggcacagtggccggtgtgattctcgagagagggtgggcagtgtcggctccgagttgtacagaaattccccgagcccgaggacacgtgaaggaaatatacaagctcgtggcactggggaccggttcctcatgctgcgcgggctggctcgagttttctggacagcagcttcacgactgtcatggtttggttatagcaaggcgggccttgcttcgttttctgttccgccagctgctgctggctacccagggtggccccaaaggaaaagaacaatcagtactggctccacagcccggacccgggccaccattcactctgaaacctcgagtcttcttgcatctttacatctcgaacacccccaagggtgctgcccgcgacatctacctccctcccacctcggagggtggcctgcctcatagtccacccatgaggctgcaggcacacgtgcttgggcaactcaaaccagtctgctatgtcgccccttccttgtgcgatacccacgtaggatgcctctccgcgtcggataaactggcaaggtgggcggttctagggttaggaggtgctctccttgcacacttagtcagtcctctgtactctacctcgttgatcctggccgatagttgccatgaccctccaaccctctcacgggccattcacaccagaccttgcctggattccgtcctggggccctgcctgccccccccttatgtgcgcacagctttgcatctgttcgccggcccaccagtggctcccagcgagcccacccccgacacatgtcgagggctgtcgctcaactggtcgctgggtgacccagggatagaggtggtcgacgtggcaacaggccgcgttaaagccaacgccgcgctcggacctccaagcaggctttgcaaagcttcatttctgcgagccttccaccaggccgcaagggctgtgggaaaaccatatctgttggcgttaaagacctacgaggccgctaaagccggcccataccaggaggcgcgacggcagcttagcctgctgctcgatcaacagggactcggggcttggccttcgaagcctctggtcggaaaatttcgtaattag

SEQ ID NO: 44033 - DNA, 1752 bp, Artificial Sequence
  Description of Artificial Sequence: Synthetic coding sequence
atggccagcgccagccagggcgccgacgacgacggcagccggcggaaaccccgcttagctgcatctttgcaaatttccccgcagccccggccttggcgccccctccccgcccaggcacagagcgcgtggggacccgccccagccccagcaacttaccgtgccgaggggggctggcctcaggtctccgtgctaagagacagcggtcccggggccggtgcaggagtcggagaattgggagccgcccgggcctgggagaatctaggggagcaaatgggtaaagctccaagagttccagttccacctgcaggcctttcactcccactgaaagatccacctgcgagtcaggccgtctctttgctgactgagtatgccgcctcattaggaatatttctcctttttagagaggaccagccccctggcccatgctttcccttctccgtcagtgccgagctggacggggtggtttgccccgctggcactgcaaacagcaaaactgaggcaaagcaacaggccgcactaagcgcgctttgctacattcggtctcagctggagaacccagaaagtccccagacaagtagtcgtccgccactcgctcccctttccgtagaaaatatactgacgcatgaacaacgctgtgccgctctggtgtctgctgggtttgacctgctcttagatgagcgttccccatattgggcctgtaaaggaacggtcgccggcgtgatactcgaacgggaaatccctcgtgcccgcggacacgtgaaagagatatacaaactggtggccctcggcacaggcagctcttgctgtgctggatggctggagttctccgggcaacagttacacgactgtcacggtctggtcatcgcacgccgcgccctcctccgcttcctgtttcgacaactcctattggctactcaaggaggcccgaaaggcaaagagcagagtgtactcgccccgcaacccggcccaggcccccccttcactctcaagccccgggtatttttgcatttatacatcagcaatactcccaaaggggccgcgcgcgacatttacctacccccaacttcggaaggcggcttaccgcatagtcccccaatgcggctacaggcccatgtgctcgggcagctgaaaccagtatgttatgtggccccatccttgtgcgatacacatgttgggtgtctgagcgcctccgacaagctggctcgttgggccgtcctgggcctgggtggcgcgctgctggcccacctggtcagccccctttactccactagcctgattcttgccgacagttgccacgacccccctaccctgtccagagctatacacacacgcccatgcctcgacagtgtgttagggccatgcctgcctcctccatacgtgcggacagcgctccatctatttgccggccctccggtcgctccctctgagccgacaccagacacgtgtagggggctctcgctgaactggtcactaggcgatccgggtatcgaggtggtagacgtcgctacgggccgagtgaaagctaatgccgccctgggaccacctagtaggttgtgtaaggctagtttcctcagggcatttcatcaggccgcccgggccgtcggtaaaccgtacttactggctctgaagacgtacgaagcagcaaaggccgggccatatcaggaggctcgccgtcagctgtctctcctcttggatcagcagggccttggagcttggccaagcaaaccgcttgtgggtaagtttcggaattag

SEQ ID NO: 44034 - DNA, 576 bp, Artificial Sequence
  Description of Artificial Sequence: Synthetic coding sequence
atggaggccaaggccgcccccaagcccgccgccagcggcgcctgctccgtctcggcggaagagacagagaaatggatggaggaagccatgcacatggccaaggaggccttagaaaataccgaagttcctgtgggctgtctcatggtctacaacaatgaagtggtaggaaagggtcgcaatgaggtaaatcagaccaagaacgctacgcgacacgcggagatggtggctatagatcaggtgttggactggtgtaggcagtcagggaagtcaccctccgaggtgttcgaacatactgtactctatgttaccgtcgagccttgcatcatgtgtgccgccgctcttagactcatgaagatccccctcgtggtgtacgggtgccagaatgagaggtttggcggctgtggttctgttttgaacatcgccagtgccgatctgcccaacactgggagacctttccagtgcataccaggctatcgcgcagaggaggctgtagaaatgctgaaaacattttacaagcaggaaaaccctaacgcccctaaatcaaaggtgcggaagaaggagtgccagaagtcttag

SEQ ID NO: 44035 - DNA, 111 bp, Artificial Sequence
  Description of Artificial Sequence: Synthetic coding sequence
atggaggccaaggccgcccccaagcccgccgccagcggcgcctgcagtgttagcgctgaggaaacagagaaatggatggaagaggctatgcacatggaaattttcctgtag

SEQ ID NO: 44036 - DNA, 435 bp, Artificial Sequence
  Description of Artificial Sequence: Synthetic coding sequence
atggtgtacaacaacgaggtggtgggcaagggccggaacgaggtgaaccagaccaagaacgccaccaggcatgctgaaatggtcgcaattgatcaagtgctggactggtgccgacaatccggcaagtccccttcagaggtgtttgagcataccgtactctatgtgaccgttgagccctgcataatgtgcgccgcagccctgaggctcatgaaaatccccctcgtggtctacggatgccagaatgagaggttcggggggtgtggttctgtactaaacatcgcctcagctgatctgcccaataccggacgtccatttcagtgtatacctggctatcgcgctgaggaagcagttgagatgctgaagaccttctacaagcaagagaacccaaacgcccccaaatctaaggtgagaaagaaagagtgccagaaatcttag

SEQ ID NO: 44037 - DNA, 1056 bp, Artificial Sequence
  Description of Artificial Sequence: Synthetic coding sequence
atggagcccgcccccggcctggtggagcagcccaagtgcctggaggctggctcccctgaaccagaacctgcaccctggcaagcgctaccagtgctctccgagaagcagtcaggagatgtggaattagtcttggcttacgctgctcctgtcctggataagaggcaaaccagtaggctcttgaaggaggtttccgccctgcaccctttgcctgcccaacctcatttaaagcgagtccgcccaagtagagatgccggatccccacacgctctcgaaatgcttctgtgtctggccggtccggcatccggacctcgaagtctggccgaactgctgcctcgccccgccgttgaccccaggggtttgggccagcccttcttggtgcctgtccccgcccggccaccattgacccgaggccagttcgaggaggccagagctcactggccaactagtttccatgaggacaaacaggttactagtgcactggccggacgtctgttttccacgcaagagcgggcagctatgcaatcccatatggaaagggcggtctgggctgcccgtagggccgctgcccgtggcctgcgcgctgtgggagcggtcgtggtggaccctgcatctgaccgagttctggccacaggccacgactgctcgtgtgctgacaatccactcctccatgccgtaatggtctgcgtggatctggtggcccgtgggcagggcaggggcacatacgacttcaggcccttccccgcatgcagcttcgcaccagccgccgccccccaagccgtacgagcaggcgctgttcgtaaactggatgccgacgaagacggcttaccatacctgtgtactggatacgacctgtacgtcactagagagccctgtgccatgtgtgccatggctctggtgcacgcccgtatacttcgcgtcttctacggcgcaccatctcccgacggggcccttggtacccggtttaggattcacgctagacctgatctgaaccaccgatttcaggtgttcagaggggtcctggaggaacagtgccggtggctggatcccgacacgtag

SEQ ID NO: 44038 - DNA, 162 bp, Artificial Sequence
  Description of Artificial Sequence: Synthetic coding sequence
atggagcccgcccccggcctggtggagcagcccaagtgcctggaggcaggatcaccggagcccgagccggctccctggcaggccctgccagtgctgtctgaaaaacagtctggagacgtcgagctggtgttagcttatgccgctccagtattagacaagtag

SEQ ID NO: 44039 - DNA, 804 bp, Artificial Sequence
  Description of Artificial Sequence: Synthetic coding sequence
atgatcgaggccgaggagcagcagccctgcaagaccgacttctacagcgagctaccgaaagttgagctccacgcccatctcaacggatccatcagttcacacacaatgaagaagctgattgctcagaaacctgatttaaaaatacacgaccagatgaccgtgatcgataagggaaagaagaggacgcttgaagagtgcttccaaatgttccagactattcaccagcttacatcctctccagaggacatcctgatggtgacgaaagatgtgatcaaggagtttgccgatgatggggtcaagtatctcgaactgcgctctactccccgccgcgagaatgccacaggaatgaccaaaaaaacttatgtggaatctatcctggaaggcataaagcagagcaagcaggaaaatctggacattgacgttcggtatctaatcgccgttgaccgccgcggggggccactagtggctaaagagaccgtcaagttggcggaagaatttttcctgagcaccgagggcaccgtgctggggttggatctatctggcgacccaaccgtgggacaggcaaaagacttcctggagcctttactagaagcaaagaaggcgggccttaagctcgccttgcatctgtccgaaatccctaatcagaagaaagagactcagatcctgctggacctccttccagaccgtatagggcacggcacctttctgaacagtggggagggtggcagcctagacctcgtggatttcgttcggcagcacagaatccctctaggaaaggcctggtcgtttcgctcctcgcgctag

SEQ ID NO: 44040 - DNA, 1068 bp, Artificial Sequence
  Description of Artificial Sequence: Synthetic coding sequence
atgatcgaggccgaggagcagcagccctgcaagaccgacttctacagcgagctccccaaggtcgaactgcatgcacacctgaacggttccatcagctctcatactatgaaaaagctgattgcacaaaaacctgatttaaagattcacgatcagatgacagtgatcgacaaagggaagaagcgcaccttagaggagtgttttcagatgttccaaaccattcatcagctgacttcaagtcccgaggacatcttgatggtgaccaaagatgtcataaaggagttcgctgacgatggagtaaaatacctggagcttcgcagcaccccaagacgcgagaacgcgaccggtatgactaaaaagacctacgtggaatctatcctagaggggatcaagcaaagcaagcaggagaatctggacatcgacgttcgttacctaatcgccgtggacaggcgtggcggtcctctcgttgccaaggagacagtgaagctcgccgaggagttcttcctgtccacagagggcacagtgttgggactggatctgtcaggggaccctactgtgggacaagctaaggattttctggaaccgctgctcgaggcaaagaaggcaggactcaagctcgcactgcacctctccgaaatccctaaccagaagaaagagacacaaattctgcttgatttactgcctgatcgaataggacatggcactttccttaatagcggggagggcggctccctggatttagttgattttgtgagacagcatcggattccgctggagctgtgccttactagtaatgtgaaaagccagacagtcccatcttatgatcaacaccattttgggttctggtactcaattgctcatccaagcgtgatttgtaccgacgataagggggtttttgctacacatctgtctcaggagtatcagttggccgctgagacctttaatctcacgcaatctcaggtttgggacctttcgtatgagtcgattaattacatctttgcaagcgattcaacacgctctgagctgagaaagaagtggaaccacctaaagccccgggtgttgcacatatag

SEQ ID NO: 44041 - DNA, 987 bp, Artificial Sequence
  Description of Artificial Sequence: Synthetic coding sequence
atgatcgaggccgaggagcagcagccctgcaagaccgacttctacagcgaactcccgaaggtcgagttgcacgcgcaccttaatgggagtatatctagccatactatgaagaagctaatcgctcagaaacccgatctgaaaattcacgatcagatgactgtcatcgacaaaggcaagaagcgcactctcgaagaatgtttccagatgtttcagactatacaccagctgacctcgagccctgaggatatactcatggttaccaaggacgtgatcaaagaatttgctgatgatggcgtcaaatatctggaacttaggagtaccccgaggcgcgaaaacgccacggggatgaccaaaaagacatatgtggagagtatactggagggtatcaagcagagtaaacaggaaaacctagatatcgacgtacggtatctgatcgccgtggacaggcgcgggggacctctggtggctaaagagactgtcaagctcgccgaggagtttttcctctctacagaaggcacggttcttgggctggatctgagcggggacccgacgatcccaaatcagaagaaggaaactcagatcctattggatctgctccccgataggatcggacatgggacatttctgaacagcggcgagggaggcagtctcgatctcgtagatttcgtccggcagcatcgtatcccactggaactctgcctgacttcgaacgtcaagtctcaaactgtgccctcatacgaccagcaccactttgggttctggtatagcattgcccacccctcagttatttgtaccgatgacaaaggtgttttcgctacacacctgagccaagagtaccaacttgccgccgaaaccttcaaccttacccagagtcaggtgtgggacctgtcatacgagtccattaattacatctttgccagcgacagtacacgtagtgaactgaggaagaagtggaaccacctgaagccaagggtgctgcacatttag

SEQ ID NO: 44042 - DNA, 1836 bp, Artificial Sequence
  Description of Artificial Sequence: Synthetic coding sequence
atgagcgtgcaggtggtgagcgccgccgccgccgccaaggtgcccgaggttgagttaaaggatttaagcccatcagaggccgaatcccagcttggtctctctaccgctgctgtcggcgcaatggctccaccggccggaggcggtgaccctgaagctcccgcaccagcagccgagcggcctcctgtgccggggcctgggagcggacccgctgcagccctctcgccggccgccgggaaagttccacaggcctccgccatgaagcgctctgacccccaccaccagcatcagagacacagagatgggggcgaagccctggtaagtcccgacgggactgttacagaggcacctcgcacggtcaaaaaacagatccagttcgcagaccagaaacaggagtttaataagcggcctacaaagatcgggagaagaagtttaagtcggagcatcagccagagctctacagacagctacagttctgctgcgtcatacactgatagcagcgacgatgaaacttcacctcgtgataagcagcaaaaaaattctaagggaagtagcgacttctgcgtgaagaacatcaagcaagctgagtttggacgcagagaaatagaaattgcagagcaggaaatgccggccttgatggcattgaggaagagagcccagggggagaagcctctggctggcgctaaaatcgttggctgcacacacataacagcccaaaccgcagtattgatggagacgctgggggctctgggtgcccagtgcagatgggccgcctgcaatatttacagcaccctgaatgaggtggctgcagccctggccgagagcgggttccctgtcttcgcatggaagggcgagagcgaggacgacttctggtggtgtatcgaccgctgcgtgaacgtggagggatggcagccgaacatgatcttagatgacggaggcgatttgacgcactggatctacaaaaaatatcctaatatgtttaaaaagattaaagggattgtggaagagtcggtgacgggcgtgcatcggctctaccaattgtctaaagcaggaaagctttgtgtccccgccatgaacgtgaacgactctgtgactaaacagaagttcgacaacctgtactgctgtcgggaaagtattcttgatggtctgaagaggaccaccgacatgatgtttggggggaaacaggtggtggtgtgtggttacggggaggtcgggaaaggatgctgtgcagctttgaaagctatgggctctatagtctacgtaacagagattgaccctatatgcgccctccaggcttgcatggacggctttaggcttgttaagcttaacgaggtgatccgtcaggttgatatagtgatcacttgtacaggtaacaagaatgtggtgacccgagagcacctggatcgcatgaaaaattcttgtatcgtatgcaacatggggcattcaaataccgagattgatgtcgcatcactgagaacccctgagctcacctgggaaagagttaggtcccaggttgaccacgtcatctggcctgacgggaagcgcatcgtgctgctggctgaggggcgtctactgaatctctcttgtagtacagttcccacttttgtcctgtcaataacagccactacccaagcactggccttgattgaactctacaatgccccagagggtcggtacaagcaggatgtttatctgctcccaaagaaaatggatgaatatgtcgctagcctccacctgcccacattcgacgcgcaccttacagaacttaccgatgaacaagcaaagtacctcggcttgaataagaatggccctttcaagccaaactactaccggtattag

SEQ ID NO: 44043 - DNA, 1530 bp, Artificial Sequence
  Description of Artificial Sequence: Synthetic coding sequence
atggagaagtgggacggcaacgagggcaccagcgccttccacatgcccgaatggatgcaaatacaatttgccgaccagaagcaggagttcaataaaaggcccaccaagataggaaggcgatcattgagcagatcgattagtcagagttcaactgacagttacagctccgccgcaagctacactgactcttcagacgatgagacctccccacgtgataagcaacagaaaaatagcaaaggatcctctgatttttgcgtgaaaaatatcaagcaggccgaattcggtaggagggagatcgagatagccgaacaagagatgcctgcgctaatggcactgagaaagagagctcagggcgagaagcccctggcgggtgcgaaaatcgtggggtgtacccacattaccgctcaaactgccgtgctgatggaaacgttgggtgccctaggcgcccagtgtcgctgggccgcctgcaatatctattcaactttaaatgaggtggcagcagccttagccgagtccggcttccccgtgttcgcctggaaaggagagtccgaggatgacttttggtggtgcattgatcggtgtgtgaacgttgagggttggcagcctaacatgattcttgacgatggcggcgatctcacacactggatatataaaaaatatcccaacatgtttaaaaagataaagggcattgtggaagagagtgtcaccggcgtgcacaggctgtatcagctgtccaaggccggaaagctctgtgtgcccgctatgaatgtgaatgatagtgtaacaaagcagaagttcgacaacctgtattgctgccgcgagtcaatcctcgacggtctgaagagaaccacagacatgatgttcgggggaaagcaggtcgtagtgtgcggatatggggaggttggtaagggctgttgcgctgcgttgaaggctatgggtagcattgtctacgttaccgagatagatcccatatgtgctctgcaggcctgtatggacggttttaggcttgtaaagctgaacgaagtcatcagacaggtggacattgttattacatgtaccgggaataagaacgtggtgacacgcgaacaccttgatcggatgaaaaactcgtgtatagtgtgcaatatggggcactccaatacggaaatcgatgttgcgtctttgcgaacgccagaattgacctgggagcgcgtccgcagtcaggtcgatcacgtcatctggcctgacgggaaacggattgtgctgttggcggagggacgactgctgaatctcagctgctctaccgtgccaacattcgttctttcgattaccgcgaccacccaggccctggcccttattgagctctacaatgctccagaaggacgttataagcaggacgtctatctgcttccgaagaagatggatgagtatgttgcgtccttgcacttgcctacctttgatgctcacttgaccgagctcacagatgagcaggctaaatatctcggattgaataaaaacggaccattcaagcctaattactataggtattag

SEQ ID NO: 44044 - DNA, 1833 bp, Artificial Sequence
  Description of Artificial Sequence: Synthetic coding sequence
atgagcgtgcaggtggtgagcgccgccgccgccgccaaggtgcccgaagtcgagctcaaggatctgtcaccttctgaggccgagtcccagcttggtttgtctaccgcagcagttggggctatggctccacctgcaggcgggggagacccggaagctccagctcccgcagccgagcggcccccagtccccggtccagggagcggaccagcggccgcccttagtccagctgccgggaaggtgcctcaggcttctgccatgaagaggtccgatcctcaccatcagcatcaaaggcacagggatggcggagaggctttggtgtcaccagacggcactgttacagaagctccccgaactgtgaaaaaaatccagttcgctgatcagaagcaggaattcaacaaacgtcctacgaaaataggccggagatctctttcccggtccatttcacagagctcgaccgatagttattcctccgcagcatcttataccgacagctccgatgacgaaaccagccccagagacaagcagcagaaaaactcaaaagggagctcggatttctgtgtaaaaaatatcaagcaggcagaattcggccgccgggaaatcgaaatcgcagagcaggagatgcctgcactcatggcgctgcggaagagagcccagggggagaagcctctcgcaggcgccaagattgtagggtgcacacatatcacggctcagactgccgtgctgatggagacattaggcgccctgggagctcaatgcaggtgggccgcctgcaatatctattccaccttgaacgaggtggcagctgctctggcagagagtggtttccccgtatttgcctggaaaggggaatctgaagacgatttttggtggtgtatcgacaggtgtgtcaacgtggagggctggcaacccaacatgatactggacgacggaggcgatttaactcattggatctacaaaaagtacccaaacatgttcaagaagatcaagggcatcgtcgaggagagcgttacgggggtgcacagactgtatcagttgagcaaggcgggtaagctgtgcgtgcctgctatgaatgtcaatgactcagtgacaaaacagaagttcgacaacctctactgttgcagggaatccatactcgacggactgaaaagaacgactgacatgatgtttggcgggaagcaggtcgttgtgtgcggctacggagaggttggtaagggatgctgtgccgccttgaaggccatgggctctattgtctatgttaccgaaatcgacccgatttgcgcactccaggcatgtatggacggattccgcctggtgaaactgaacgaggtcatccggcaagtggatatcgtcatcacttgcacgggcaataaaaatgtggtgacaagggaacatctggaccggatgaaaaacagttgcatcgtgtgcaacatgggacacagcaacacggaaattgatgttgctagcctcaggactcctgagttaacttgggagagggttaggagtcaggtggatcatgtaatctggcctgatggcaaaaggatcgtcctcctggccgagggtcgactgttgaacctaagttgctccactgtacctacatttgtgctcagcatcacggctacaacccaggccctggctttaatcgagttatacaacgcccccgaggggaggtacaaacaggatgtttatttactacccaagaagatggatgaatatgtcgcttcgttgcatttgccaactttcgacgcgcacttaacagagctgacagatgaacaagccaagtatctgggccttaacaaaaatggaccctttaagcccaactattataggtattag

SEQ ID NO: 44045 - DNA, 228 bp, Artificial Sequence
  Description of Artificial Sequence: Synthetic coding sequence
atggagaagtgggacggcaacgagggcaccagcgccttccacatgcccgagtggatgcagatacagttcgccgaccagaaacaggaatttaataagcgcccaacgaagatcggcaggcgatccctgtcgcgatcaatctcccagtcatccacagattcctatagctccgcagcgagctatacagactccagtgatgatgagacatcccctcgagataagcaacagtag

SEQ ID NO: 44046 - DNA, 1527 bp, Artificial Sequence
  Description of Artificial Sequence: Synthetic coding sequence
atggagaagtgggacggcaacgagggcaccagcgccttccacatgccagagtggatgatacagtttgctgatcaaaagcaggagtttaataaaaggcccaccaaaatcggccgcaggagcctgtctagaagcatatctcagagcagcacggacagttactcgtcagctgctagctatacagactctagcgacgacgagactagccccagggacaagcagcagaaaaatagtaagggatcaagcgacttctgtgtcaagaatattaaacaagcagagtttgggcgaagggaaattgagatagcagagcaggaaatgcccgctctgatggccctgcgaaaacgtgcacagggcgagaagcctctggccggagctaagatagtcggctgcacccatattactgctcaaacagcagtccttatggaaacccttggcgcgctgggtgcacagtgcaggtgggcagcctgtaacatttactcgaccttgaacgaagtcgctgctgcgctcgcagagagtggatttccagtgttcgcatggaaaggcgagtctgaggatgacttctggtggtgtatagatcgttgcgtcaatgtggagggctggcaaccaaatatgattcttgatgatggcggggacctgacccattggatctataaaaagtacccaaacatgttcaagaagattaaaggtattgtggaggagagcgttaccggagtgcaccggctgtaccagctttcaaaagccgggaaactatgcgtccctgccatgaatgtcaacgattccgtgacaaagcagaagttcgacaacctctactgctgtcgggagtccattctagacgggctcaagaggacaacagatatgatgtttggaggtaagcaagtagtggtgtgtgggtatggcgaagtggggaagggttgctgtgccgccctaaaagctatgggctctattgtgtacgtcacagagattgaccccatatgtgccctgcaggcgtgtatggacggatttcggctggtgaagctgaatgaagtgattaggcaggtcgacattgtcatcacatgtaccggcaataaaaacgttgtcactcgcgaacatttagaccgtatgaagaattcttgcatagtgtgcaacatgggccactccaacacagagatcgacgtggcttcactgcggacacccgagcttacttgggaaagggttcggtctcaggttgaccacgttatttggccagatggtaagcggatagtgctcctggccgaaggcagattgctgaacctctcgtgttctacagtcccaacgtttgtactctcaattactgccactacccaggcactggctctaatcgagctctacaacgcccccgaagggcgctacaagcaggatgtgtacttactgcccaagaagatggatgagtatgtggcatctcttcacctgcccaccttcgacgcacacctgacagaactgacagatgaacaggcgaagtatctggggcttaataaaaacggtccctttaaaccaaattattataggtactag

SEQ ID NO: 44047 - DNA, 1593 bp, Artificial Sequence
  Description of Artificial Sequence: Synthetic coding sequence
atgtacttcctgtgcttcttctgcctgttcgtgagcggccggaagtggtcgagacagttcctgctaagtttctggtgcacagtctgctccgctcaccaggggacaattttcctttcgctcaaaattcagttcgcggatcagaagcaagagtttaacaagcgacccacaaaaattggtcgacggagcctgagccgaagcatctctcagtcgtccacggatagttacagcagcgctgcttcctatacagactccagcgatgacgagaccagcccacgagacaaacagcagaaaaatagcaaaggaagcagtgacttttgcgtgaaaaatattaagcaggcagaattcggcaggcgcgagatcgaaattgcagaacaggagatgcccgccctgatggcgctgaggaagagagctcagggggaaaaacccttggctggagcaaagattgtgggctgtactcacattacggcccaaaccgcagtcttgatggagaccctgggagcactgggggctcagtgccggtgggctgcctgcaacatctacagcactctcaatgaggtggccgcagctctggcagaatctgggttccctgtgttcgcctggaaaggggagagcgaggacgatttttggtggtgtattgaccggtgcgttaatgtggagggatggcagcctaatatgatcctcgatgacgggggcgatctcactcactggatctataagaaataccccaatatgtttaaaaagatcaagggcatcgtagaagaatccgtgacaggggtacataggctgtaccagctgtccaaggctgggaagctgtgtgtccccgctatgaacgtcaacgactctgtgacaaagcagaagtttgacaatttatattgctgtcgggaatccatcctggacggcttgaagcgaaccaccgacatgatgttcgggggcaagcaggtggtggtctgcggatacggggaggttggaaaaggttgttgcgccgccctgaaggcgatgggttccatcgtatatgtgactgagatcgaccctatctgtgccttgcaagcatgtatggatgggtttcgcctcgttaaactgaacgaagttatccggcaagtggacattgtgatcacctgtaccggtaataagaacgtcgtcacccgcgaacaccttgacagaatgaaaaatagttgcatcgtgtgcaatatggggcacagcaacaccgagatcgatgtcgctagtcttcgcacacctgagctcacatgggagagagtgcggtcacaggtggatcatgttatctggcccgacgggaagagaattgtgctgctcgccgaggggagactgctgaatctgtcttgttctaccgtgcctacctttgtactgagcataaccgccaccacacaagccctggcactcatcgagctctataatgctccagagggccgctacaagcaggacgtgtacctgttgccaaagaaaatggatgagtatgtcgctagtctacacctgcccaccttcgatgcccatctgacggagctgacagatgagcaggcgaagtacctcgggctgaacaagaatgggccattcaaaccaaactactacagatactag

SEQ ID NO: 44048 - DNA, 1527 bp, Artificial Sequence
  Description of Artificial Sequence: Synthetic coding sequence
atgctgggcagcaagaagaagtacatcgtgaacggcaacagcggcatcaaggcccagattcagtttgccgaccagaagcaggaattcaataagagacccacaaaaattgggagaagaagcctctctcggtctatctctcagtcctcaaccgacagttacagcagtgcagcttcttatacagactcttccgatgatgaaacaagccctcgggacaaacagcagaagaatagtaaaggtagttctgatttttgcgttaagaatattaaacaggccgaatttgggagaagggaaattgaaatagccgaacaggagatgcctgctctgatggccctgcgaaaacgggcccagggggaaaaacctctagccggggccaaaatagtaggctgtacacacatcacagcacaaaccgccgtgctgatggaaactctcggagctcttggagcacagtgccggtgggctgcctgtaatatttattccaccctgaacgaagttgcagcggccttggcagaaagcggcttccccgtgtttgcatggaaaggggagagtgaggatgatttttggtggtgtatcgatcggtgtgtcaacgtggagggttggcagccgaatatgatcctagatgatggcggcgacctcacacactggatatacaaaaagtatccaaatatgttcaagaaaattaaagggattgtggaggaatccgtgactggtgttcacagactatatcagctgagcaaggctgggaagctgtgtgtgcccgcaatgaatgttaacgactccgtcacgaagcagaaattcgataatttatactgttgtcgggagtcaatactggacggcttgaagcggaccacggatatgatgtttggcggcaagcaagttgtagtctgcggctacggagaagtgggcaagggctgctgcgcggccctgaaagcgatgggcagcatcgtttacgtgactgagattgatcccatctgcgccttgcaggcttgtatggatgggttcagactcgttaaactgaatgaagtgattcgtcaggtcgacattgtgatcacttgtaccggaaacaagaacgtggttacaagggagcacctagataggatgaaaaatagttgcatagtgtgcaacatgggccactccaacaccgagatcgatgtggccagccttcgtacaccagagctcacatgggagagggttcggtcccaggtggatcacgttatctggcctgacgggaagcggattgtgctgctggctgagggtagactgttaaacctgagttgttctaccgtaccgacattcgtcctgtccatcaccgccacgacacaggctctcgctcttatcgaactgtacaacgccccagaggggagatacaagcaggacgtttatctactccccaaaaaaatggacgagtacgtggcttcactgcacctgccaaccttcgatgcccacctgaccgaattgacagacgagcaggctaaatacctgggccttaacaaaaatgggcctttcaagcctaactactataggtattag

SEQ ID NO: 44049 - DNA, 1266 bp, Artificial Sequence
  Description of Artificial Sequence: Synthetic coding sequence
atgaccagccaggagaagaccgaggagtaccccttcgccgacatctttgacgaagatgaaactgaacgaaattttctcctctctaagcctgtttgtttcgtggtgttcggcaagcccggcgtgggaaagacaacccttgcaagatatataacacaggcctggaagtgcatccgcgtggaggcactacctatattggaagaacagatcgctgccgagacagagagtggagttatgcttcagagtatgctcatctcaggtcagtccatccctgatgagctggtcatcaagctcatgttagaaaaacttaacagtcccgaggtctgtcatttcggctatataattaccgaaatcccaagtctgtcacaggatgctatgacgaccctgcagcagatcgagctgatcaaaaacttaaatctcaagccagacgtgatcatcaacatcaagtgtcctgattacgacttgtgccagcggatctccggtcagagacaacacaacaataccggctatatctattctcgagatcaatgggatcctgaggtgatcgagaaccatagaaagaagaaaaaagaagcccagaaagatggtaagggtgaagaggaggaagaagaagaggaacaggaagaagaggaggcgtttatcgccgagatgcaaatggttgccgaaattttgcaccacctggtgcagaggccagaggactacctggaaaatgtggagaacatcgtcaagttgtataaggaaactatcctacagaccttggaggaggtgatggccgagcataatccccagtaccttatcgagctaaacgggaataagcctgctgaagaactctttatgatcgtcatggacaggttaaagtatctgaacctgaagcgtgcagccattttgaccaagttgcagggcgctgaagaggagatcaatgataccatggagaacgacgagctgttcaggaccctggcaagctataaattgattgccccccgttataggtggcaaaggtccaaatggggtagaacatgtccagtgaacttgaaggacggcaatatttattctgggttgcccgactatagcgtgtcgtttctggggaaaatatactgcctctcatcagaggaagcgctgaaaccttttttgctcaatccaaggccatacctccttcctccgatgcctggaccaccttgcaaggtgtttattctgggcccccagtacagcggcaagacgactctgtgtaacatgctcgctgagaactataagggcaaggttacaaactag

SEQ ID NO: 44050 - DNA, 1089 bp, Artificial Sequence
  Description of Artificial Sequence: Synthetic coding sequence
atgaaggagcggaagcggcacctgggcgacaccaagcacttctgccccgttgtcctgaaggaaaactttattctgcaaccagggaacactgaggaggcagcgaaataccgagaaaaaatatactattttagttcagccgaggccaaggagaaattcttggagcatcctgaggactacgtggctcatgaagaacctctgaaagctccgcctctgcgcatctgcctggtcggcccgcagggctccggcaagaccatgtgcgggcggcagctagcagagaagctgaacatctttcatattcagtttgaagaggtactgcaagaaaagttgcttctcaagacagaaaagaaagtagggcccgaattcgaggaggatagtgagaatgagcaggccgccaaacaagaactcgaggaattagccattcaggccaatgtgaaggtggaggaggagaatacaaaaaaacagcttcctgaggtccagctcacagaagaggaagaagtgataaagtcctcattaatggaaaatgagcctctgccacccgagattttagaggtgattctgtccgagtggtggctcaaggagcctatccggtcgacaggcttcatcctcgacggatttccaaggtatcctgaggaggcgcagttcttgggagaccgggggtttttccctgatgccgccgtcttcattcaggtagatgaccaagatatctttgatagacttctcccagcgcaaatcgaaaaatggaagcttaaacaaaaaaagaaactcgagcggaagaagctcatcaaagacatgaaagccaaaattagagtcgatactatcgccaagcggagagcagagctgattctggaacgtgacaagaagcgccgcgagcccaataaggagaagcgcaaaagaggcatcagtgagaacactacctgctataagtgcaaccacatgtccccttggtgcgaatacgccggcctgccgtacagaggtcttcttattctttatagtgcgaccgctaccgcgacagctggcacaaagcactgccgctcgggggccaaagtcatagtggcccttagcaaacagaatatacacaatcagaagtag

SEQ ID NO: 44051 - DNA, 2211 bp, Artificial Sequence
  Description of Artificial Sequence: Synthetic coding sequence
atgaccagccaggagaagaccgaggagtaccccttcgccgacatctttgacgaggatgaaacagaacggaatttccttttgtctaaacccgtctgtttcgtggtattcggtaaaccaggcgtgggtaagacaacgctcgcgcggtacatcacacaggcttggaagtgcatccgcgtcgaagcgttgcctatccttgaggaacaaatagccgcggaaacggagagcggggtgatgcttcaatcgatgctgatctccgggcagagcatccccgacgaacttgttattaagctgatgctcgagaagctgaactcgccggaggtttgccattttggttatatcatcaccgagatccccagtctcagtcaagatgccatgactacattgcagcaaatcgaattaatcaaaaatcttaacctgaagcctgatgtgattatcaatatcaaatgtccagactacgatctgtgccagcgtatttcaggtcagaggcagcacaacaatacgggctacatttactctcgtgatcaatgggacccagaagtcatcgaaaaccacagaaaaaagaagaaagaagctcagaaagacggaaagggagaggaggaggaggaggaagaggagcaggaggaagaagaggccttcatcgcagaaatgcagatggttgccgaaatcctccaccacttagtgcagaggcccgaggactacttagaaaatgtggagaacattgtaaagctttacaaggagacaatcttgcagactctggaggaagtcatggcggagcacaatccccaatacctcatcgaactgaatggcaacaagcctgcagaagaactcttcatgattgtcatggataggctgaaatatcttaacctgaagagggctgccatcctcacaaagctgcagggagctgaggaggagattaacgacacaatggaaaacgacgagttgtttcggaccctggcctcatacaaacttatcgccccacgctataggtggcagcgcagcaagtggggcagaacatgtccagtgaacctgaaggatggcaacatctattccggcctccctgattactcagttagcttcctcggtaagatctattgtcttagctccgaagaagccctcaaaccgttcctattgaacccccgcccctatcttctgccaccaatgcccgggcccccatgtaaagtgtttattcttgggccacagtattcggggaagactacgctgtgtaacatgttagccgaaaattacaagggaaaagtcgttgactacgctcagttagtgcagccccgttttgacaaggcaagggagacactcgtcgaaaacactatagccgaggccacggctgccgccataaaggtggtgaaagagaaactcctgcgagagttgcaggccaggaagcaggccgagacggctctgcgggaattccaacgacaatatgagaaaatggagttcggagtctttcccatggaagcaacccatagcagtattgatgaagaaggctacatccagggaagccagcgtgatagaggctcctcactagtcgatactgaggaagctaaaactaaatctgaaaacgtgctgcatgatcaagcagcaaaagtagataaggacgatggcaaagaaacaggtgagaccttcactttcaagagacactcccaggacgcgtctcaggacgtgaagctttactccgatacagcccccacggaggatcttattgaggaagtaaccgccgatcaccccgaggttgttaccatgatcgaggaaacaattaaaatgagtcaggacatcaacttcgagcagccctacgagaagcacgcagaaattctgcaggaggttctgggagaggtcatggaggaaaataaggaccgtttcccaggcgcaccaaagtatgggggctggatagtcgataattgtccgatcgtcaaagagctgtggatggccttaatcaagaagggtatcattcctgatctagtcatttatctgagtgataccgaaaacaacggaaagtgtctgttcaatagaatctatctgcagaaaaaatccgagattgactccaaaatacttgaaaggctgttagaggagctccagaagaaaaaaaaagaagaggaggaagcccgaaaggccaccgaagaagagctgcgcttggaggaggaaaatcggcggttactggaattgatgaaggtcaaggcaaagggaaagcatcgacttctttag

SEQ ID NO: 44052 - DNA, 5736 bp, Artificial Sequence
  Description of Artificial Sequence: Synthetic coding sequence
atgaccagccaggagaagaccgaggagtaccccttcgccgacatcttcgatgaggacgagaccgagcggaattttttactcagtaagccagtgtgcttcgtcgtattcggcaaacccggggttggaaaaactacgttagcccgatatatcacccaggcttggaagtgtattcgggttgaagcacttccaatcctcgaggaacagatcgccgcagaaacagagagcggcgtgatgctgcagagtatgctcatcagcggacaatcaatcccggacgagctggtcatcaaactgatgctggaaaaactaaacagccccgaggtgtgtcactttggttatatcattaccgaaataccctcattgtcccaggacgctatgacgacgctccagcaaatcgagctaattaaaaacctgaacctgaaacctgacgtgattatcaacatcaaatgcccggactatgatctttgccagcgtatctccgggcaaaggcagcacaacaacacgggctacatatacagtcgcgatcagtgggaccccgaggtcatcgagaaccaccggaagaagaagaaagaggcccagaaagacgggaaaggggaagaagaggaagaggaagaggaacaagaagaggaggaagccttcattgcggaaatgcagatggttgcagagatcctccaccacctggtacaaagacccgaggattatttggagaatgttgagaacatcgttaagctgtacaaagagaccatccttcaaaccctcgaggaggtgatggccgaacacaatccacaatacttgatcgagctgaacgggaataagccagccgaggaactgtttatgatcgtgatggatcggctgaaatatctcaacctgaagcgtgcagccattttgactaaactgcagggcgctgaggaggaaataaatgataccatggagaatgatgaattattcagaactctggcaagctacaagctcatagcaccgaggtacagatggcagagaagcaaatggggaagaacctgccccgtgaacctgaaggatggtaatatctattccggtttacccgactatagtgtctctttcttaggcaagatctattgcctcagttcagaagaggcgctcaagccgtttttacttaatcctcggccctatctcttgcctccaatgccaggtccaccttgtaaggtgttcattctgggaccccagtacagcggcaaaaccaccctctgcaacatgctggccgagaattataagggaaaagtcgtggactatgctcagttagtacagcccagattcgataaggcgagagaaaccttggtagaaaatacaatagccgaagctacggctgccgccatcaaggtcgtcaaagagaaactcctacgggaattacaggcgcgcaagcaggccgaaaccgcgctgcgcgaattccagaggcagtacgagaaaatggagttcggtgtattcccgatggaggccacacactcttcaattgatgaagagggctatatccagggttcacaaagagatcgggggtctagcttagtcgatacagaggaggccaagaccaaaagtgaaaacgtgttgcacgatcaggccgctaaggtagacaaagatgacgggaaagaaaccggtgagacttttacgtttaagagacactcccaggatgcttcccaagatgtaaaattgtactctgatactgcccctaccgaagatctgatcgaagaagtgactgcggaccaccccgaggtggtaacaatgatagaagagacaattaagatgtctcaggatatcaactttgaacagccctacgaaaagcatgccgagattctgcaggaggttctcggggaggtgatggaagaaaacaaggacagatttcccggggctccaaaatacggaggatggatagttgacaattgcccaatcgtcaaggagctctggatggcgctgataaaaaaagggatcatccctgacctggttatctatctaagtgacacagagaacaatggcaaatgtctgttcaacaggatttatctgcagaaaaagtcggagatagacagcaagatactagaacgtctgctcgaagagttgcaaaagaagaagaaagaagaggaggaggcacgcaaagctacggaggaggagctgaggcttgaagaagaaaacagacgcttgctggaactaatgaaggtgaaggccaaagaggctgaggagaccgataatgaagacgaggaagaaatcgaaggcgacgagctggaggtgcatgaggaacctgaagctagtcatgacactcgcggcagctggctcccagaggaatttgaagcaagtgaagtgccagagaccgagccggaagccgtcagtgagcccatcgaagagactaccgttgaaactgaaatacccaagggttcaaaggagggactcgagatagaaaaactgagcgagaccgtcgtactacctgagttccccgaagactcgtatccagatgtgccagaaatggagcctttcaaagagaagatcgggagcttcatcattctatggaagcagctagaggcaacaatctcagaggcttatataaagatcttaaacctagagatcgccgatcgtaccccacaggagttattgcaaaaggtagtcgaaacaatggagaaaccattccaatacaccgcgtgggaactcacgggtgaagattacgaggaggaaactgaagattatcagactgaagccgaagtggacgaggagctggaagaggaagaggaggaggaaggagaagataagatgaaagagcgcaaacggcacctgggggacacaaaacacttttgccccgtggtgctgaaggaaaactttatcctgcaacccggcaacacagaagaggccgccaagtatcgggaaaagatctactactttagctcagccgaagcaaaggagaaattccttgagcaccccgaggattacgtggcacacgaagaaccactaaaagccccaccacttcgaatctgtctggtcggaccccagggatctggcaaaactatgtgtggacgccagctcgcggaaaagcttaatatcttccacattcagttcgaagaggtgttgcaggaaaagttgttgctcaaaaccgagaaaaaagtggggcccgagttcgaagaggacagtgaaaatgagcaggccgctaagcaggaacttgaggaactcgcgatacaggcgaacgtgaaggtggaggaggagaacacaaagaagcagctgccagaagtgcagttgaccgaagaggaagaggtcataaaatcaagtctaatggagaacgagcctctgccccctgagatcctagaagtcatcctgtctgagtggtggcttaaagaacccatccgctccaccggcttcatcttggacggatttcctcggtatcctgaagaagctcagtttctgggcgaccgagggttctttccggatgccgcagtgttcatccaggtggatgatcaggatatcttcgatcgtcttctccctgcccagattgagaagtggaagctcaaacagaaaaaaaaactcgaaagaaaaaagcttatcaaggacatgaaagccaaaataagggtcgatactattgccaaacggcgtgccgagttaatcctggagcgggataagaaaagaagagaaaatgtggtacgtgacgacgaggagatcagcgaagaggaactggaggaagacaatgacgacatcgagaacatcctggaagatgagttccccaaggacgaggaggagatgagcggagaggaggacgaagaacaagaaaccgacgcgattgaaagacttcggggcgagctgggtgaaaagtttgaggcagacactcataacctccaaattattcaggacgagctggaaaggtatctaatcccaatcatctctatcaacggggctaggcgaaaccacattgtgcagtacacactgaatatgaagttgaaaccgctcgtggaaaatagggctagtatttttgaaaagtgtcaccccatccctgccccgctggcccagaagatgctaaccttcacctacaagtatatttcaagtttcggatactgggatcccgtgaagttgtccgaaggcgaaacgattaagcccgtggaaaacgcagaaaacccaatttaccctgtaatacaccggcagtacatttacttcctgtcttctaaagagacgaaggagaagtttatgaagaatcctatcaagtatatcaggcagcctaaacctaagcccactgtacccattcgcattatcatcgtcggccctcccaaaagcggtaaaacaacggtggcgaagaaaattacatcggaatacgggctgaagcacctttccatagggggagcgctcaggtacgtgttaaacaaccatccggaaaccgaacttgccctcatgctcaattggcacttgcataaaggcatgaccgctcctgacgaactggcaattcaggctttggagctgagtttgatggagtcagtgtgtaacactgcaggagtggtgatcgacgggtacccagttactaagcaccaaatgaacctgctcgaagccagatcaattattcctatggtaatattcgaactgtccgtgcccagtaaagaaatttttaagaggctgctgctggaaaaggaaaatgagcaacgcttaccttatcctctgcacaatagtgcccaaatagtagcagttaacaacgttaagtaccggaaaaacattggagaaataagacaatactaccaagagcagcaccagaattggtacgtgatcgatgggttccattcaaagtggtgggtttggaatgaagttattaagaacgtgcagatggtcaacaagtatatgcagacatacttagagaggatcaaggccggcaaagcagcgtgcatagacaagctatgcattacacctcaagagctgctgtcaaggcttggtgaatttgagcagttctgccccgtgtctcttgctgagagtcaagagctttttgattgtagtgctaccgatagcctggaatttgctgctgaatttcgcgggcactattacaagatgagtagccaagagaaactgaacaaattccttgagaatcctgaactctacgtgccccccctggctccacacccgctgccttcagccgatatgatccctaagcgccttaccctctcagaattgaagtctcgtttccccaagtgcgccgagcttcagggctattgccccgtgacatacaaagatggcaatcaacgctatgaggccctggtacctggctctatcaattacgctctggaatatcacaaccggatctacatctgtgagaacaaggagaagctgcagaaattcctgcgcagcccactgaaatactgggagcaaaaactgccgcacaaattaccgcctctccgcgagcctatcctgctcacctctctgccgctacccggataccttgagcagggcatagcgacctcattaattaaagctatgaacgccgccggatgcctgaagcctaagttccccttcctgtcaatccgcagaagtgcattactgtatattgcgcttcacctgaaagcctttaaccccaagggatccgaatatacccgcaagaaatacaaaaagaagatggaacagttcatggagtcatgcgaactcattacgtacctcggcgctaagatgacccgtaaatataaggagcctcagtttcgcgcaatcgactttgaccacaaattgaaaacctttctgtctctgaggaatattgatcctatcaacgggtag

SEQ ID NO: 44053 - DNA, 684 bp, Artificial Sequence
  Description of Artificial Sequence: Synthetic coding sequence
atgctgcagagcatgctgatcagcggccagagcatccccgacgagcttgtgattaaactgatgctcgagaagcttaattcacccgaggtatgccatttcggttatattatcaccgagatcccgtctctctctcaggatgccatgacgacccttcaacagatcgaactcatcaaaaacctcaacctgaagccagacgtgatcatcaatattaaatgccccgactatgatctttgtcagaggataagcggacagagacagcacaacaatactggttacatatactcccgcgatcagtgggatccggaagttatagaaaatcatcggaagaaaaagaaggaggcccagaaagatggcaaaggggaagaggaggaagaggaggaagagcaggaagaggaggaggcttttatcgcagagatgcagatggtcgcagagatcctgcatcatctcgtgcagagacccgaggattatttagaaaatgtggaaaatatcgtgaagctgtataaagagacaatactgcagacccttgaggaggtaatggcagagcataacccacagtatctgattgaactgaatggaaataagccggctgaggagctgttcatgatcgttatggatagactgaagtacctgaacctcaagagggcagccatattgaccaaactgcagggcgccgaggaggaatag

SEQ ID NO: 44054 - DNA, 1074 bp, Artificial Sequence
  Description of Artificial Sequence: Synthetic coding sequence
atggagaagtacgtggccgccatggtgctgagcgccgccggcgacgctctcggctattataatggaaaatgggagttcctacaggacggtgagaaaattcatagacagctggcccaactcggaggactcgacgccctggatgtaggtcgttggagagtcagcgatgacactgttatgcatctggccaccgccgaagccctggttgaggctggcaaggcaccaaaacttactcagttatattacctgttagcaaagcactatcaggattgtatggaggatatggacggcagggctccaggtggagcatcagtgcataatgccatgcaactgaagccaggaaagccaaacgggtggaggatcccctttaacagtcatgagggaggttgcggagcagccatgcgagctatgtgcatcggacttagattcccacaccattcgcagctggacactcttattcaagtgtccattgagtcggggcgcatgacacatcaccacccaaccggctatctaggtgccctggcatctgccttattcacagcctatgccgttaattctagacctcctctccagtggggcaaaggattgatggaactgctgccagaggccaagaagtatatcgtccaaagtggttacttcgtggaagagaatctacagcattggtcctatttccagaccaaatgggaaaattatctgaagctacggggcatccttgatggcgagtccgcccccaccttcccagaatcattcggagtcaaagagagagatcagttctatactagtctttcctactcaggctggggtggcagtagcggccatgatgctcctatgatcgcctacgatgccgtcctagcagcaggagacagttggaaagaactggctcaccgcgcattttttcacggcggggatagcgattccactgctgccatcgccgggtgctggtggggcgtaatgtatggatttaagggagtgtccccatctaactatgagaagctggaatatagaaacagactggaggagactgccagagccctctactcgctaggctcgaaagaggacacggtgattagtctgtag

SEQ ID NO: 44055 - DNA, 1074 bp, Artificial Sequence
  Description of Artificial Sequence: Synthetic coding sequence
atggagaagtacgtggccgccatggtgctgagcgccgccggcgacgctctgggctattacaatggaaaatgggagttcctccaagacggagagaaaattcatagacagttagcccagctaggaggccttgacgcactcgatgttgggcggtggagggtgtccgatgatactgtgatgcatctcgctacagcagaggccttagtggaagctggcaaagcaccaaagctcacacagctctactaccttctggcaaagcactatcaagattgcatggaagatatggacggtcgggctcccggcggggcttctgttcacaacgctatgcaactgaagcctgggaagccaaacggctggcgtatcccttttaactcacacgaaggtggatgcggggccgccatgcgagctatgtgcatcggcttgcgctttccacaccatagccagttagacaccctgatccaggtgtcgatcgagtcgggccggatgactcaccatcatcccacaggctacctcggtgccctggccagtgccctgtttactgcttatgccgtaaactcccggcctccattgcagtggggcaaggggctcatggaactgctgccggaggccaagaagtatattgtgcagtccggttatttcgtggaggaaaacttacagcactggtcgtacttccagactaaatgggagaattacctgaaattgaggggaatactggatggggagagcgccccaacattccctgagtctttcggcgtgaaagagcgggatcagttttacacatctctgtcctatagcgggtggggaggttccagtggtcacgacgccccaatgattgcctacgacgccgtgctggctgccggggacagctggaaagagttagcccatcgcgcttttttccatgggggcgacagtgacagtacagcagccatcgcaggatgctggtggggggtaatgtacggctttaaaggcgtctcaccttccaattatgaaaaactggaatataggaatagactggaagaaacagccagagcactgtattccctaggttctaaagaggatactgtaatttctttatag

SEQ ID NO: 44056 - DNA, 1074 bp, Artificial Sequence
  Description of Artificial Sequence: Synthetic coding sequence
atggagaagtacgtggccgccatggtgctgagcgccgccggcgacgccctgggctactacaatggcaaatgggaatttcttcaggatggcgagaagatacaccggcaattggctcagctggggggcctcgatgctttggatgtgggcaggtggcgagtctcggacgacactgtaatgcacctggccacagctgaagccctggtcgaagccggaaaggcaccgaagctgacacagctgtactacctgctcgccaaacactatcaggattgcatggaggacatggacggacgcgctcccggcggagcctccgtccacaatgcaatgcagttgaagccaggcaaacctaacggctggagaatccccttcaacagccacgagggcggatgcggagccgcaatgagagccatgtgcatcggtttgcgattccctcaccactcacagctcgatactctgattcaggtctccattgagtcaggcagaatgacacaccatcaccctacaggatatctcggcgcccttgcgtccgctctgtttaccgcttacgccgtcaattcacggccccccctccagtgggggaaggggctgatggaactgttacctgaggcgaagaagtatatcgtgcagagtggctactttgttgaagaaaacttgcagcactggtcatatttccagaccaagtgggagaattatctcaagctgcggggcattctcgacggagaaagtgctccgactttccccgagagctttggggtcaaagagcgagaccagttctacacaagtttgtcttattcaggctggggaggcagcagcggacacgacgcgccaatgatcgcttacgacgcagtattagcggcgggcgattcctggaaagagctcgctcaccgagcattcttccacggcggcgacagcgattctactgccgctatcgccgggtgctggtggggtgtaatgtacgggttcaagggcgtgagtccatccaattatgaaaagctggaatatcgcaaccgtctggaagagacggctcgggctctctattcgttgggaagtaaggaggacaccgtgatctccctttag

SEQ ID NO: 44057 - DNA, 1074 bp, Artificial Sequence
  Description of Artificial Sequence: Synthetic coding sequence
atggagaagtacgtggccgccatggtgctgagcgccgccggcgacgctttagggtactataacggcaaatgggagttcctgcaggatggagagaaaattcaccgccaacttgcacagctagggggactggacgctctcgatgttggcagatggcgtgtgagcgatgatactgtgatgcatttggccaccgccgaggcactggtcgaagctgggaaggcccctaaactcacccagctgtactacttgctggctaaacactaccaggattgcatggaggacatggacgggagagccccagggggagcgtctgtgcataacgcgatgcaactcaaacctggcaagcctaacggatggcgaatcccttttaattcacatgagggcggctgcggggcagcaatgcgggctatgtgtattggattaaggtttcctcaccacagccagttggatactctgattcaggtgagcatagagagtgggcgaatgactcatcaccacccaactgggtacctgggtgctctcgcatctgcactcttcacagcatatgccgtgaattcaaggccgcccttacagtggggaaaggggctgatggagctgctaccggaggctaaaaaatatattgtgcaaagtggatatttcgtggaggagaatcttcagcattggagctatttccagaccaagtgggaaaactatcttaagttgcggggcatcttagacggagaaagcgctcccaccttcccagagagctttggtgtgaaggagcgcgatcagttctacacctcattaagctatagcgggtggggtggcagctccggccacgatgcaccgatgatcgcctacgatgccgtcctggctgccggggactcatggaaggagcttgcgcaccgcgcattctttcacgggggcgattctgatagcaccgcagctattgcgggatgctggtggggcgtcatgtacggcttcaagggggtgagcccttcaaactacgagaaactcgagtatcggaacagactggaagaaaccgcaagggcgttatattctctgggcagtaaagaagacacagtcatctcactctag

SEQ ID NO: 44058 - DNA, 378 bp, Artificial Sequence
  Description of Artificial Sequence: Synthetic coding sequence
atggagaagtacgtggccgccatggtgctgagcgccgccggcgacgctcttggctattataacgggaaatgggaattcttgcaagacggagagaagattcaccgtcagctagcccagctagggggcctcgatgccctcgacgtgggcaggtggcgggtcagcgatgataccgtgatgcatctggcaacggctgaggctctggtggaggcaggtaaagcccctaagcttacacagctctattatctcctagccaagcactatcaggattgtatggaagacatggatggcagggccccaggcggcgctagcgtgcacaatgcgatgcaactcaagccggggaagccaaacggctggaggattcctttcaactcacactag

SEQ ID NO: 44059 - DNA, 735 bp, Artificial Sequence
  Description of Artificial Sequence: Synthetic coding sequence
atggccccccggcccctgggccccctggtgctggccctgggcggcgcagcagccgtgcttgggagcgtgctgttcatcttgtggaaaacctactttgggagggggcgagagcggaggtgggatcgcggggaagcatggtggggtgccgaggccgctcgtctacccgaatgggatgagtgggatccagaagacgaggaggatgaggaacctgctctagaggaactggagcagcgcgaagtgctggttcttggactcgacggagctggcaagagcactttcctgagggtccttagcggaaagccacctttggaagggcatataccaacctggggcttcaacagcgtcaggctcccaacgaaggacttcgaggtcgatctgttggagattggaggatcccaaaacctgcggttttactggaaggagtttgtgtccgaggtggacgttctggtatttgttgttgactcagcagacaggctcaggttaccctgggcaaggcaggaactgcataagctattggacaaggaccccgatttgccagtcgttgtcgtggccaataagcaggatctgtctgaagctatgtcaatgggcgagttacagcgggagctggggttacaggccattgataaccagagagaggtgttcttgttggccgcttcaatcgcacctgccggaccaacctttgaggaaccagggactgtgcatatctggaagctgttactggagctgctgagctag

SEQ ID NO: 44060 - DNA, 771 bp, Artificial Sequence
  Description of Artificial Sequence: Synthetic coding sequence
atgttccggctgctgagcagctgctgcagctgcctgcggaccaccgaagagactcgaagaaacgtcactatccctattattggcctgaataacagcggtaagaccgtcttagtcgaagccttccaaaagttactcccatccaaaaccgaccactgtatgaagtctgagctgacaactctcctgttggatgaatacgaactttccatctacgatcttaatggcgatctcaagggcagagaggcttggcctaattactatgcccaggctcacgggctggtttttgtgcttgatagcagcgacatccggcgaatgcaggaggtgaagattattctgactcacctgctgagtgacaagcgggtggccggtaaacctatccttattttagcaaacaaacaggataagaagaaagctcttatgccctgtgatataattgactacctgctgttaaaaaagttagtcaaagagaacaagtgtccctgccgagtggaaccctgctcagccataaggaatctcgagagacgcaatcaccagccgattgtcgaaggtctaagatggttgttggcagtgatcgacacatgccagttgccgccgacttcttctatcagcatttccaagaacaacactggctccggagagcggtgttcttcacatagcttctcaaccagaaccgggatgagcaaggaaaaacgccagcacttagaacagtgcagtatcgaggccaagcccctgaagagtattctacagccctccaaccagagttacacacattag

SEQ ID NO: 44061 - DNA, 873 bp, Artificial Sequence
  Description of Artificial Sequence: Synthetic coding sequence
atgttccggctgctgagcagctgctgcagctgcctgcggaccaccgaagaaacccgcagaaatgtcacgatacctataatcgggctgaacaacagcgggaagaccgtgctcgtggaggctttccagaaattattgcccagcaaaactgaccactgcatgaagtccgaacttacaaccctcctgctggacgagtacgagctttccatctatgatctgaacggagatcttaagggaagagaggcctggccaaactattacgcacaagcccacggattggtttttgtgctggactcttcagacatccgaagaatgcaggaggtgaagattattctgacccatctgctctctgacaagcgggtggccggaaagcccatcttaatcctcgctaataagcaggacaagaaaaaggcccttatgccctgtgacatcattgactacctactcttgaaaaaactggtcaaggagaataaatgcccatgccgcgtcgaaccatgcagtgctatcaggaatctggaaagaagaaaccatcagccaatcgttgaaggtctgcgctggctcctggcggtcattgacacctgccagcttccacctacaagttcgataagcatctccaaaaataacaccggctccggagagcggtgtagtagtcattctttttccacaaggactgggatgagcaaggaaaagagacagcacctggaacaatgttcaatcgaggcaaaaccgctgaaaagcatcctgcagaaggaggggacgaggttatggtccaagaaaaacatgtccgtcacctttgcattagatgagcctatgaaagagggagaatgctcaaggcgtatgagggcgcagaataccaccaagctgtgctataactag

SEQ ID NO: 44062 - DNA, 594 bp, Artificial Sequence
  Description of Artificial Sequence: Synthetic coding sequence
atgcgggtggccggcggccgggccctgagccggggcgccgagctgagagttccaggcggggcgaagcacggaatgtgtctcctgctgggcgcaaccggtgtcggcaagaccttgctggtcaaacggctgcaggaagtttccagccgggatgggaagggggatctgggtgaaccgccccccactcggccgacagtgggcaccaatttgacagacatcgtagcgcagcggaagattaccatcagagagttgggggggtgtatgggaccgatctggtcatcttactacggtaactgccgctctctccttttcgtcatggacgctagcgatcctacacaactttcagcctcctgcgttcaactgttgggacttctcagcgcagagcaactggcggaggcatctgtcctgatactttttaataagattgacctgccatgttatatgtcaactgaagaaatgaagtcactaatacgcctgccggacattattgcttgtgctaagcagaatattaccacagccgagatcagcgcgagagaggggacaggcctcgccggcgtcctcgcatggctacaggcaacccacagagctaacgactag

SEQ ID NO: 44063 - DNA, 540 bp, Artificial Sequence
  Description of Artificial Sequence: Synthetic coding sequence
atgggccagctgatcgccaagctgatgagcatcttcggcaaccaggagcacactgttattatcgtggggttagacaatgagggcaaaaccacgatcctctatagattcctcactaacgaagtcgtccacatgtgtccgactatcggtagtaacgtggaagagataatcctgcctaagactcactttttcatgtgggacatcgtccggccagaggcgctgtcctttatttggaacacctactactccaacactgagttcatcatcttagttatcgactctacagatcgggacagactgctgactactcgagaggagctgtacaagatgttggctcatgaagctctccaggatgctagtgtgctgatctttgctaataaacaagacgtaaaagatagcatgcgtatggtggaaatcagccactttctcacgctgtctacgatcaaggatcattcttggcacatccagggctgttgcgctctgaccagggagggactccctgccagacttcagtggatggagagccaggcggccgccaattag

SEQ ID NO: 44064 - DNA, 540 bp, Artificial Sequence
  Description of Artificial Sequence: Synthetic coding sequence
atgggccagctgatcgccaagctgatgagcatcttcggcaaccaggagcatacggtgattatcgtcggcctggacaatgagggaaagacgacgatcctgtatcgattcctcaccaatgaggtcgtgcatatgtgcccaacaataggctccaatgtagaagagataattcttcccaaaactcatttctttatgtgggatattgtgaggcccgaagccctgagctttatttggaatacctactacagcaataccgagttcataatcctagtcattgatagtacagatcgcgatcgcctcctgactacccgggaggaactgtacaaaatgctggctcacgaggcactccaggatgcaagcgtgctaattttcgccaacaagcaggacgttaaagattcaatgaggatggtcgagatatcccacttcttaacactgagcaccatcaaggaccactcttggcacatccagggctgttgcgccctgacaagggagggcctgccagctcgactgcagtggatggagtcacaggccgccgctaattag

SEQ ID NO: 44065 - DNA, 3936 bp, Artificial Sequence
  Description of Artificial Sequence: Synthetic coding sequence
atggacctgttcgacttcttccgggactgggacctggagcagcagtgtcactacgagcaggaccgctctgcactgaaaaaacgcgagtgggagagacgcaatcaagaagtacagcaggaagacgacctctttagttctggctttgatctgttcggcgagccgtacaaagtagccgagtacacaaacaaaggggacgccctggccaatcgagtgcagaatactctgggaaattacgatgaaatgaaaaatctgctgacaaaccatagtaaccagaaccacctggtgggcattcccaagaactctgtgccacagaatcctaacaataaaaatgaaccgagcttctttcctgaacagaagaatcgaattattcctccccaccaggataatacgcatcctagcgcgcccatgccgcctccctccgtcgtgatccttaattctacgctcattcacagtaataggaaatctaaaccagagtggtccagagactcccacaatccatctacggtgctcgcaagtcaggcatcagggcaacccaataaaatgcagaccctgactcaggatcagtctcaagccaagctggaagatttttttgtatatccagctgaacagcctcaaattggcgaggtcgaggagtcaaacccttccgcaaaagaagactctaatcccaattcgtcaggcgaagacgctttcaaagaaattttccagagtaatagtccggaagaatccgagttcgccgtccaggctccaggttccccgcttgtagccagctctctcctcgccccaagtagcgggctgtccgtgcagaactttccaccaggattgtactgcaagacaagcatggggcaacagaaaccaactgcctatgtacgacccatggacggccaagatcaggctccagacatcagccccaccttgaaacctagtatcgaattcgaaaactccttcgggaatctcagcttcgggacgttactcgacggtaagccctctgccgcgtctagcaagactaagttacccaagtttactatcctgcagacaagcgaagtgtcactgccatcagacccctcgtgtgttgaggagattttgcgggaaatgacacattcatggcccacccctctgacaagcatgcataccgctgggcatagcgaacagtctacgtttagcattccaggacaagagtcgcaacatctgacaccaggcttcacccttcagaaatggaatgatcccaccaccagagcgtccaccaaaagcgttagttttaaaagtatgttggaggacgatttgaaactgtctagtgacgaagacgacctggagcccgtcaagaccttaactactcagtgtactgccaccgagctgtaccaggctgtggaaaaagctaagcccagaaataaccccgtcaatcccccattggctacaccacagcctccccctgccgttcaggcatcaggtggtagtggttccagctccgagtcagaatcatccagcgagagcgactcagacacggagagctctacaactgacagcgagagtaacgaggctccccgtgtggctactccagagccggagcctccttccaccaacaagtggcaactggacaagtggctgaacaaggtaacatcgcagaacaagagtttcatttgcggccagaacgagaccccaatggagaccatctccctgccgcctcccataatacagcccatggaggttcagatgaaagtcaaaactaatgcctctcaggtgccagcagaacccaaggagaggccattgctgtctctcatccgcgagaaggcccgtcctcgcccgacccagaaaattcccgagactaaagctctcaaacataaactatcaaccacaagcgagactgtgtcccagcgcacaatcggcaagaagcagcccaagaaagtagagaagaacactagcacagacgaattcacgtggcccaagcctaacattacttctagtacccccaaagagaaagagagcgtcgaactacatgatccccccagaggacgcaataaagctaccgcccataaacccgcgcctcgcaaagagcctaggcctaatatccctctggcacctgagaagaaaaaataccggggccccgggaaaatcgtgcctaagtcccgcgagttcattgagacggattcttcgacctccgacagtaatactgaccaggaagagacactgcaaataaaagtcctgcctccttgtatcatcagcggcggaaataccgctaagtccaaagagatctgcggtgcctcactcactttgtccactttgatgtcctcgtctgggagcaataacaacttatctatctccaatgaagagcccaccttttcgcctatccccgtaatgcagaccgagatcctaagtcccttgcgcgatcacgaaaatctaaaaaatctgtgggtcaagatagatctggacctgctgtcccgggtcccgggtcactcgtcgctgcacgccgccccagctaaacctgaccacaaagaaaccgcaactaaacctaagaggcagacggccgtgacggccgtagagaagcccgctcctaagggtaagcgcaaacacaagcctattgaagtggccgagaaaatacctgaaaaaaagcagcgtttagaggaggctacaacaatttgtctgttacctccctgcatctcccccgccccccctcataagccgcctaacaccagagaaaataatagttcccgccgcgcaaacaggcgtaaagaggaaaagctgtttcccccacctctctccccacttcccgaggatccccctcgaaggaggaatgtgtcggggaataatggtcctttcgggcaagacaaaaatatcgctatgacaggccaaattacctctaccaagcccaagcgcacagaggggaagttttgcgcaacttttaagggcataagtgtgaacgaaggcgatacccctaagaaagccagttccgccacaattaccgtcacgaataccgctattgcaactgcgacagtgaccgccaccgccatcgtgacaactaccgtcacggctaccgcaaccgctacagccaccaccacaaccactacaacaacaatttctaccatcacatccactattactaccggcctcatggattcttcgcacctggaaatgacgagctgggctgctctccccctcctcagtagtagctccactaatgttagacggcccaagctgaccttcgatgattcagtgcataatgccgactattatatgcaggaggccaaaaagctgaaacataaggctgatgccctattcgaaaagttcgggaaggcagtcaattatgccgacgcggctctctcgtttacagagtgtggcaacgctatggaaagggacccgctcgaggccaagtcgccatacacaatgtacagcgaaacagttgagctgctacgatatgccatgcggctgaagaacttcgcatcccccctggcttccgatggcgacaagaagctggcggtgttgtgttaccggtgcctgtcactgctatacttgcggatgtttaaactgaagaaagatcatgccatgaagtattccaggtcactcatggaatattttaagcaaaacgccagtaaggtggcccaaattcccagcccttgggtgtccaacgggaaaaatacccccagccctgtgagtctcaataatgtgtcacccattaatgcgatgggtaattgtaacaatggccccgttaccatccctcagagaattcatcacatggcagcttcccatgtaaacattacttccaatgttctgcgtggctacgagcactgggacatggccgacaaactgacacgggaaaacaaggaattttttggcgatcttgatacgctgatgggacccctcactcaacatagcagcatgacaaatctggtgaggtacgtgagacaaggtttgtgctggctacggatcgacgcacacctgctgtag

SEQ ID NO: 44066 - DNA, 3831 bp, Artificial Sequence
  Description of Artificial Sequence: Synthetic coding sequence
atggacctgttcgacttcttccgggactgggacctggagcagcagtgccattacgagcaggacagatctgcgctgaaaaaacgcgagtgggaacggcgaaaccaggaggtacaacaggaggatgatctcttcagctcaggctttgacttgttcggagaaccctataaaaccaacaaaggtgatgcacttgcaaaccgagtacagaatacactggggaactacgacgaaatgaagaatttgctaaccaaccacagtaatcagaatcacctggtcggcatccccaagaactctgtaccccagaacccaaacaataagaatgaaccttcattcttccctgaacaaaaaaaccgaattatcccacctcaccaagacaacactcaccctagcgccccaatgccccccccttctgtcgtgatactcaactctacactgattcattctaaccgcaagtcaaagcccgagtggtctcgcgactcacacaacccttccactgtactcgcttctcaggcttccgggcagcccaacaagatgcaaacactgactcaggaccagagccaggccaagctggaggatttttttgtataccccgccgaacagccgcagatcggcgaggtcgaagagtccaacccttctgcaaaagaggatagcaatcccaatagtagcggggaagacgcttttaaagaaatttttcagtccaattctccagaagaaagcgagttcgcggtgcaggcccccggttctccactcgtggcgagcagcttgctagcacctagtagcggcctgtctgtgcagaacttcccacctggattgtattgcaaaacatccatgggtcagcagaagcctaccgcctacgtccgacctatggacggacaggaccaagctcccgatattagccccaccctgaaaccaagtattgagttcgaaaatagcttcgggaacctctcattcggtaccctactcgacggaaaaccatctgctgcaagttctaagaccaagctaccaaagttcaccattttacaaaccagcgaagtgagtctgcctagcgacccatcctgcgtggaagagatccttagagagtctcagcacctcacacctggctttaccctgcagaaatggaacgacccaacaacccgagctagcacaaagagtgtttcctttaaaagcatgcttgaggacgatctgaaactttcttcagatgaagacgatttggagccagtgaaaactttaactacccagtgtacagccaccgagctttatcaggcagtggaaaaggccaagccgcgtaataaccccgtgaatccgccactcgcgaccccgcagcccccaccagctgttcaggccagcggtggcagcgggagttcgtctgagtcagagagctcgagcgagtccgactccgacaccgaatccagcacaaccgacagcgaaagtaacgaagcaccaagagtggcaactcctgaacctgagcctccatcgaccaacaagtggcagctggacaagtggctgaataaggtgactagccagaacaagtctttcatatgcggacagaatgagacaccaatggagactatctcactgcccccccccatcatccagcccatggaagttcagatgaaagtgaagacgaatgccagccaggtgcctgcagagccaaaagagcgaccgctcttgtcgctcataagagaaaaggcacgcccaaggcctactcagaagataccagagacaaaggcgctaaaacacaagctgtctaccacctccgagaccgtaagccagcgcactatcggtaagaaacagcccaagaaagtcgagaagaatacttccacggatgagttcacatggcccaagcctaacatcaccagctccaccccaaaggaaaaagaaagcgtggaacttcacgatcccccccgggggcgtaacaaggctacggcccacaaacctgctccaagaaaggaaccgaggcctaacatccccctggctcccgagaagaaaaaataccgcggtccggggaagattgtacccaagtcccgagagtttattgagactgattcctccacctccgactcaaacacagatcaagaagagacgttgcagataaaggtccttcctccctgcattatatctggcggtaacaccgctaagtccaaagagatttgcggcgccagcctcactctaagtacactgatgtcgagctccgggagtaataataatttgtccatcagcaatgaggaaccaacgttttctccaatccctgtgatgcagacagagatccttagcccattgagggatcatgagaatctgaaaaacctgtgggtgaagatagaccttgatcttctttccagggtgccagggcattctagcctgcatgcagcccctgccaaacccgatcacaaggagaccgccactaaaccaaagagacaaaccgctgtcaccgcagtcgagaagcctgcccccaaggggaagcggaaacataaacctatcgaggtcgccgagaagataccagaaaaaaaacagaggttagaggaagccaccaccatctgcctgctgcctccctgtattagccctgctccgccgcataagccccccaatactcgagaaaacaactcaagtaggcgggccaacagacggaaagaagagaagctctttccacctcccctgtctccacttcccgaagacccacctagaagacgaaatgtgagcggtaataacggccctttcggccaggataaaaacattgccatgactgggcagatcacgtcaacgaaacccaaaaggacagagggaaagttttgtgctacctttaagggcatatctgagggggatacccccaaaaaagcatcctccgccactataaccgtgactaacacggccattgctaccgcaaccgtaactgccactgctatcgttacaaccaccgtcactgcgactgctactgcgactgctacaacgactaccaccactaccactatctctaccatcacctctaccataacaacaggtctgatggactctagccacctggagatgacgagttgggcggccctgcctctgctttcgtcgtcatccacaaacgtgagacgccctaaattaaccttcgatgactcagtccacaacgccgattactacatgcaggaggctaagaaacttaaacataaagctgatgccttgtttgaaaaattcggaaaagctgttaactacgccgacgccgctctgtcatttacagaatgcggaaacgccatggagagagaccctctcgaagccaagagtccatataccatgtacagcgaaaccgtcgagcttctgaggtatgccatgaggctgaagaatttcgcctcccccctggcatccgacggggacaaaaaactggccgtgttgtgctaccgttgtctttcactgctgtacctcagaatgttcaagcttaagaaggaccacgctatgaagtattctcggtcactcatggaatattttaaacaaaatgcttccaaggtggcgcagatccctagtccttgggtgagcaatggcaagaacacaccgagccctgtttcattgaacaacgtcagccccattaacgcgatgggcaactgtaataacgggccagtgactatcccccaacgcatccaccacatggcagcctcgcatgtgaacatcacgagcaatgtgctgcggggttacgagcattgggatatggctgacaagctcaccagggaaaataaagaattctttggcgatctcgacaccctcatgggcccacttacacagcattcctccatgacaaacctcgtccgctatgtgcgacagggtctgtgctggctcagaatcgacgctcacctcctgtag

SEQ ID NO: 44067 - DNA, 1332 bp, Artificial Sequence
  Description of Artificial Sequence: Synthetic coding sequence
atgacccggccccggaagcacgccgagaccctgggcggcggcaagctctgcgacctgttctgcggacgcccaggtcaggtgagtagctccaggggccgccaggggattcccgatatggaacctattgttcatatccaccaggagctcctgacaggtatcgagagcgaggcatccctgtcgaagctgtctccgacgtcccaaaagggaacctccagcagttcttcatacatcttccagaagatctctcaagggaagcaaatgtgccaaaaactcaaggaacaaactgaccagctgaaaaccaaggtgcaggagttctccaagaggattaagcaggacagtccctatcaccttcaggacaagaaactggtgctggagaagctgcagggtcacctcgaactcctggaacagaactttctggcaactaaggataagcacttgaccctccaacagcaggtacacaagcacgagtccactatagtcggtgactttgacccagagaggaaagtagaaggggagatttttaaacttgaaatgctgctggaggacgttaaggagaagatggatgaatctaagtacaccagcgcgccaagtctgcctgtatcctcccccgtgacgctcgacgatcttgcatcaactttctcctcactaagcaacgaaatccccaaagagcatcctgggcatcccagcgggcctcgaggaagcgggggttctgaggtaactggcactccccagggcgggcctcaggaggctcccaacgaggagctctgcgaactggccccccagacctacttaaacgggcactacggcgacgcagcagctcagaacaagccggaccaggtggccatgcggttgagtagtaacagcggcgaagatcctaatggcactccacggagacaggactgcgcagaaatgaccgctccctcaccgtcatgcgctttctgccgccggctactcgagtggaaacagaatgtcgagaaaaaaggacacggccgcatcaactgtggccgattttcaattgttttacacgagaaagccccccactctgatagcactcccaattccgacacagggcactctttttgtagcgactcaggcactgaaatgcaaagcaacaaatgccaggactgtggtacaaaaatccctactagcaggcgtgcgtgtcggaaagaacccactaaggagtttcattatcgatacaatacccccggccagaattactctaatcactctaaacgcggagcctttgtacagcctcattctctggacgagtcaaagaactcaagcccctgtaaatatatatcatgcatgactccatccattagtaccacttag

SEQ ID NO: 44068 - DNA, 2169 bp, Artificial Sequence
  Description of Artificial Sequence: Synthetic coding sequence
atggacgaggccgacttcagcgagcacaccacctacaagcaggaggatttgccgtacgatggcgatctctcccagattaaaatcgggaatgattacagttttacgagtaaaaaagatggactggaagttctgaaccagattattttcatcgccgacgatccacaggaaaaagccatgcatagcgaaacatgcggcaacaccgctgtcaccattcccctggggaagattaccgaaaatgccgccaacaagaaggatgaaaaggaaaagcaatgcaccgccgccctccacatccctgccaacgaaggcgacgcctcaaagagttccatcagtgatatcctgctccaccacttaagcaaagagccctttcttcgaggtcagggaattgattgcgaaaccttacctgagatctctaacgctgatagtttcgaggaagaggcaataatcaaaagtattattagctgttacaacaagaattcctggcctaaggaacagacccctgaattaactgatcagctgaaccccaaaagggatggcgaaaattctaacaaacctggctcggccaccaccacagaagaaaacactagtgatctggagggccctgtggccgccggggactcctcccatcaagaaaatgttaatgttctgaccaagaccaaagggcctggcgacaagcagaaatcctatcagggccagtccccgcagaaacagcagacggaaaaggccaatagcgggaatacttttaaatatgggcaaggtcaagttcattatcaactccccgacttctctaagatagcgcctaaggtgaaaatccctaagaataaaattatcaacaaacccctcgcaattgctaaacaggccagcttttcctccaaatctcgggataaacctaccctcgttcaagattcactggaaaccacccccgagtccaattgcgtggaaaaacagcatcaggagcaaaagggcaaaatcactgagccatctcagcagattcagatggagcccattgtacacattcaccaggagctgttgactggcattgaaagcgaagcgtccctgagcaagctcagcccaacctcccaaaagggtacttcctcatctagctcttacatctttcaaaaaatttcacagggcaagcagatgtgtcaaaaattaaaggagcaaactgatcaactcaaaacgaaagttcaggagttctcgaaaagaatcaagcaggacagcccttaccacctgcaagataagaagcttgtgctcgaaaagctgcagggacacctggaactgctggagcagaactttctggccacaaaggataagcatcttactctgcagcagcaggtccacaaacacgagtctacaatcgttggggacttcgatccggagcgtaaggtggagggcgagatttttaaattggagatgcttctggaagacgtgaaggaaaaaatggacgagtctaaatatacaagcgcacccagcctgccagtgagctcccccgtcaccctcgatgacctggcttcaaccttcagcagtctaagcaacgaagctccaaacgaggagctatgtgaactcgccccacaaacctacttgaatggccactatggcgatgctgccgcacagaacaaacctgatcaggtcgctatgagactgtcttcgaatagcggagaagacccaaatggaacacctcgcagacaggactgtgcagagatgaccgccccatccccttcttgcgcattctgtcggcgccttctggaatggaagcagaacgttgagaagaagggacatgggaggattaactgtggcaggttttcaattgtgctccacgaaaaagccccccactcggactcaacccctaatagtgataccgggcacagcttctgttctgacagcgggacggaaatgcaaagtaataaatgtcaggattgcggcacaaagatccccacctcacgcagagcttgcaggaaagagcctacaaaggagttccactaccgctacaacacgcctggtcagaactactccaaccattccaaaaggggggcatttgtgcaacctcacagcctggatgagagtaagaattcctctccttgcctggtgcatagtcccgacaccagcaagtccagccctacatccgggtggcaagaagccgaacttggcttggagaatatgaagtcccaatag

SEQ ID NO: 44069 - DNA, 2286 bp, Artificial Sequence
  Description of Artificial Sequence: Synthetic coding sequence
atggacgaggccgacttcagcgagcacaccacctacaagcaggaggatctgccgtatgacggagatctctcacagattaagatcgggaatgactacagcttcaccagcaagaaggacggtctcgaagtccttaaccagatcattttcatagcggacgatccccaagagaaggctatgcattcggagacctgcggcaatacagcagtgaccatacctcttggcaagattactgaaaatgcggccaataagaaggacgagaaagagaagcagtgtaccgcggcactgcacattccggccaacgaaggagatgcgtccaaatctagcatatccgacatccttttgcaccatctgtccaaagagcctttcctcaggggccagggcattgactgtgagaccctgccggagatttcaaatgcagattccttcgaggaagaggccattatcaaaagcatcatctcttgttataacaagaattcctggccaaaggagcagactcctgagctgacagaccagctcaatcctaagcgggatggtgagaatagcaataaaccggggtcagccacgactacagaagaaaacactagcgatctggaaggacccgtcgcagccggcgacagcagtcatcaggaaaacgtgaacgtcctgacaaaaaccaaaggtcccggagataaacaaaagtcataccaaggtcaatcacctcagaaacagcaaaccgagaaggccaacagtgggaacacctttaagtatggccaggggcaagtgcattaccagctgcccgacttttctaagattgcgccaaaagtcaagatcccaaagaacaagataatcaacaaaccactggccatcgccaagcaagcctccttcagttcaaaatcaagggacaaacccacattggtgcaggattctttggagactactcctgagtcaaactgtgtggaaaaacagcaccaggagcagaaaggtaagataaccgaaccatcccagcagatccagatggaacccatagttcatattcaccaggagctcttaaccggaatagagtccgaagccagcttatccaaactttcccccacctcgcaaaaaggaacctccagctcttccagttatatttttcagaagataagccagggtaagcagatgtgccagaaactcaaggagcagacagaccagctgaagactaaagttcaggagttttcaaaacgaatcaagcaggatagcccctatcatctccaggacaagaagctggtgctggagaagttacaaggacatcttgaacttctcgagcaaaattttcttgccaccaaggacaaacatctgactttgcagcaacaagtccacaaacacgagtccacaatcgtcggagatttcgacccagaacgtaaggtagaaggtgaaatttttaagctggaaatgctgttagaagatgtaaaagaaaagatggatgagtcaaagtacacgagcgctccatcactcccagttagttcacctgtgacgctggatgacctggcttcgactttctcatccctgtccaacgagatcccaaaagagcacccgggccaccccagcgggccccgagggtcgggcggatctgaagttaccgggacccctcagggcggacctcaggaggctcccaatgaagaactgtgcgaattggccccccagacatatttaaacggacactatggcgatgcagcagcccagaacaagccagaccaagtagctatgcgcctctcatccaactcgggcgaagatcccaacggcacccctcgcaggcaggactgtgccgaaatgacagctccgtccccatcctgtgctttctgccggaggctgctggagtggaagcagaatgtcgagaagaagggacacgggcggattaattgcggccgcttcagcattgtcctgcacgagaaagccccccacagtgactccactccaaattccgacacaggacattccttctgttccgattccggtacagaaatgcagtctaataagtgtcaggactgtgggacaaagattccaacgagcagacgcgcttgtaggaaggagcccacaaaggaatttcactatcggtataacacccctggccaaaattacagtaaccactctaaacgaggcgcctttgtccagccccactctctggatgagtcaaaaaacagctcaccctccttggcttctcctttctgctgtcctgggctagttcacagccccgataccagcaaatcatcccccacatccggatggcaggaagccgagttgggtctcgaaaacatgaaaagtcagtag

SEQ ID NO: 44070 - DNA, 2511 bp, Artificial Sequence
  Description of Artificial Sequence: Synthetic coding sequence
atggacgaggccgacttcagcgagcacaccacctacaagcaggaggacctgccttatgacggggacctctctcagatcaagattggtaatgactattcctttacatctaaaaaggacggccttgaagtgttaaaccagatcatttttatcgctgacgatcctcaagaaaaagctatgcactctgaaacctgtgggaataccgcagtgacaattcccctggggaaaattactgagaacgcagccaataagaaggatgaaaaggagaagcagtgtacagctgcacttcatattccagcaaatgagggggacgcttccaagtcctctatttctgatattctgctacatcatcttagtaaagaaccttttcttcgtggccagggcatcgactgcgagacgctgcccgaaatttcaaatgcagactcttttgaagaggaagcaattataaagagcatcatttcatgctacaacaagaactcttggcctaaggaacagacccccgagctcacagatcagttgaatcccaagcgcgacggcgagaactcaaataaacctggctctgctacaacgaccgaagagaataccagtgacttggaagggcctgtcgccgctggagatagttctcatcaggagaatgtaaacgtgctgactaagaccaagggtcccggggacaagcagaagtcatatcaggggcagtcaccccaaaagcagcagacagagaaagcgaattctgggaacaccttcaaatacggacagggccaggtgcactaccagcttcccgatttcagcaagatcgcccccaaggtgaaaatccccaagaataagattatcaataagccgctcgcgattgcaaagcaggcctcattcagctccaaatctcgggataagcccacgctggttcaggacagcctcgagactaccccggagtcaaactgtgttgagaagcagcatcaggagcagaagggcaagattaccgagccttcccagcaaatccagatggagcctattgtccacatacaccaagaactcctgacaggcatcgaatccgaagcgtctctttccaagctgagcccaacgagccagaaagggactagcagttcgtcatcctacatctttcagaagataagccagggcaaacaaatgtgccagaagctgaaagaacagactgatcagctgaagaccaaggttcaggaatttagcaagaggatcaagcaagactccccatatcacctgcaggacaagaagctggtgctcgagaaattgcaggggcaccttgaactgctcgaacagaactttctcgcaacgaaggacaaacatctgacacttcagcagcaagtgcacaagcatgaatccacaatagtcggagattttgatcccgagagaaaggtagagggcgaaatttttaaactggaaatgcttttggaagacgttaaggagaagatggacgaatcaaagtacacaagtgctcctagtctccctgtcagctccccagtcaccctcgacgatttagcttctaccttcagtagcctgagtaacgaaatcccgaaggaacacccgggacatccatcgggcccacgaggttccgggggttctgaggtgacaggtactcctcagggtgggcctcaagaagcaccgaacgaagaactgtgcgaacttgctccccagacgtacctcaatggacactacggcgacgcagccgcccaaaacaagcctgatcaggtggctatgaggctgagcagtaacagtggagaagacccaaatggcactcctcggagacaggactgcgcggagatgacagcacccagccccagttgtgccttttgccgacgactgctggaatggaagcaaaacgttgaaaagaagggacacggacgtattaactgtggtaggtttagcatagtgctgcacgagaaggccccccattcagactccacccccaactctgacactggtcattctttctgctccgactctggcacagagatgcagagcaataaatgtcaggattgcggaaccaaaatacccactagtaggagggcttgtagaaaagagcccaccaaggaatttcactacagatacaatactcccggtcagaattatagcaaccattcgaaacgaggggccttcgttcagccacactctctggacgagagcaaaaatagcagtccatcgttcttaaagcctaaacggatctgctcccaacgcgtcaactcaaagtccttcaaaggtgagcacgagcctactcctgggaaaaaaaagctgcaagcttttatgacatattcttcagatccggccactccatctccccacttctacagctgcaggatcagcggcagcaaaagcctttgtgacttcgatagcacagaagagataaagtccgagatcctgaattccgccctggaccacgccttgagaactgctactatactgaaggagacaacagatcagatgatcaagaccatcgctgaagatctggccaaggcccagagatggcgcaaccggctaaaatactag

SEQ ID NO: 44071 - DNA, 1035 bp, Artificial Sequence
  Description of Artificial Sequence: Synthetic coding sequence
atggtgctgcagatggagccccaggtgaacagcaccaacaacttccaccaggggcctctggatcagccagtcggacccctcactggcctgaaatcttcactgctgaaagatactacttcggcagggcccctgctccgcccctaccccgcctccctcttgggcaaggtcaaggaagccgtgaaggtagccattgatgctgaatacaggcatattgactgtgcatatttctacgagaatcagcacgaggtaggtgaagccatccaggagaaaatccaggaaaaagccgttatgagagaggacctgttcatagtgtccaaggtctggcctaccttttttgagcgacctcttgtgcgtaaggcttttgaaaagacactcaaagacctcaagctctcgtacctcgacgtttatctgatccactggcctcagggcttcaaaactggagatgacttctttcctaaggacgacaagggcaatatgatttcaggcaagggcaccttcttggacgcatgggaggccatggaggagctcgtcgatgaaggtctcgtcaaagccctaggcgtgagtaactttaaccatttccagattgaacgtctcctcaataagcccgggctgaagtacaagcctgtgactaatcaggttgagtgccatccctatcttacccaagagaaattaattcagtactgccacagcaaagggatcactgtcacagcctatagcccgctgggctctccggaccgcccttgggcaaagcccgaggacccatcactcttagaggatccaaagattaaggaaatcgcggctaagcacaaaaagacaactgctcaggtgctgattcgttttcacattcagaggaacgtgacagtcatccccaagagcatgactcctgctcacatagtagaaaacattcaagttttcgactttaagttgtccgatgaagagatggctactatcctgagttttaatcgcaattggagagcctttgatttcaaggaatttagtcacctcgaagattttccgtttgatgccgaatattag

SEQ ID NO: 44072 - DNA, 972 bp, Artificial Sequence
  Description of Artificial Sequence: Synthetic coding sequence
atggacagcaagtaccagtgcgtgaagctgaacgacggccacttcatgcctgtgctgggatttggcacatatgctccagccgaagttcctaagagcaaggccttagaagctacaaaattggctatagaagctggatttaggcatattgattctgctcacttgtacaacaacgaggagcaagtgggtctggccattcgctccaagatcgctgatgggtctgtgaaaagggaggacatcttctataccagtaaactctggtgcaatagtcacagaccagagctggtgaggcctgccctggagagatctctgaagaacctgcagcttgactacgtcgacctctacttgattcatttccccgtttcagttaagcccggtgaagaggttatccctaaggacgaaaacggaaagatccttttcgacacagtggatctgtgtgccacctgggaagcggtcgaaaaatgcaaggatgcaggccttgccaaatctattggcgtttccaacttcaatagacgacagcttgagatgatactcaacaaaccagggcttaagtataaacccgtctgcaaccaagtagaatgccatccttactttaatcaaagaaaactgctggatttctgtaaatccaaagatatcgtgctggtggcgtactcggcgctgggatctcacagagaagaaccttgggtggaccctaactctccagtgctcctcgaagatccggtcttatgtgccctcgccaagaagcacaagcggacccccgcactgattgcattgcgctatcaacttcagagaggggttgttgtgcttgcaaagtcctacaatgagcagaggatcagacagaatgtccaagtattcgaattccagctgacttcggaagagatgaaagcaatcgacgggctgaacagaaatgttcggtacctgacgctagacatcttcgcaggaccccccaattatcccttcagcgatgaatattag

SEQ ID NO: 44073 - DNA, 972 bp, Artificial Sequence
  Description of Artificial Sequence: Synthetic coding sequence
atggacagcaagtaccagtgcgtgaagctgaacgacggccacttcatgccagtgctggggtttggcacatacgctccagccgaggtccccaagtccaaggcccttgaggccgtcaagctggctattgaggcaggctttcaccatatcgactctgcccacgtgtataacaatgaggagcaggtcgggctggccatcagaagtaagatcgcggacgggagtgtcaagagagaagacatcttttacaccagcaaactgtggagtaatagccatcggccagagcttgtgaggccagccttggagcgctcactgaaaaatctacagctggactacgtcgatctgtatcttattcacttccctgttagcgttaaacctggggaagaggtcatcccaaaggatgagaacggcaagattctcttcgatacagtggacctttgtgccacttgggaggccatggaaaaatgcaaggacgccggcctcgccaaatccattggcgtgtccaactttaatcacagactgctggaaatgatattgaacaaacctgggttgaaatataagcctgtgtgtaatcaggtggagtgccatccatacttcaaccagcggaagctgttggatttctgcaagtccaaggatattgtgctcgtggcctacagcgccttagggtctcaccgggaggagccatgggtcgaccctaacagccctgtgttgctggaggaccctgttttgtgtgcgctcgccaagaagcataagagaactccggctctgattgcgctccggtatcagctacagcgaggtgtcgtggtgctggcgaagagctacaatgaacagaggattcgccagaatgtacaggtttttgaatttcagctgacctccgaagaaatgaaggctattgacggtttgaacaggaatgtcaggtacctcactctggacatattcgctggtccgcccaattatccattttctgacgagtactag

SEQ ID NO: 44074 - DNA, 972 bp, Artificial Sequence
  Description of Artificial Sequence: Synthetic coding sequence
atggacagcaagcaccagtgcgtgaagctgaacgacggccacttcatgcctgtgttgggattcgggacgtacgcaccacctgaagtgcctcgaagtaaggccctggaggtaactaaactggctatcgaagcgggctttagacatattgattctgctcatctctataacaacgaggaacaggtaggactagccattcgctcaaagatcgccgatgggtctgtcaaaagagaagacatattctataccagtaagctgtggagtaccttccataggccggagctggtgcgacctgctttggaaaatagcctgaaaaaggcccagttagattatgtcgacctttacctgattcatagcccaatgtctcttaaacctggtgaagagttgtctccaactgacgagaatggaaaggtgatttttgatatagtggacctgtgtaccacgtgggaggccatggagaaatgtaaagatgccgggttagccaagagtatcggggtcagcaattttaaccgtaggcaactcgagatgatattgaataaacctggactaaagtacaagcccgtgtgcaatcaggtcgaatgtcatccctatttcaataggagcaaactcctggacttttgtaaatcaaaagacatcgtgctggttgcctactccgcgctggggtcccagcgcgataagcggtgggtggatcctaacagtccggtgttgcttgaagaccccgtgttatgtgcactcgccaagaaacacaaaagaacgccagcccttattgcgctaagataccagctgcagcggggcgtggtcgtgctggctaagtcttataatgaacagcgaataaggcaaaatgtgcaggtatttgaattccagctgaccgccgaggatatgaaagccatcgatggcctggatcgaaatctacactacttcaattctgattctttcgcatcccatcctaactatccctattccgacgagtactag

SEQ ID NO: 44075 - DNA, 972 bp, Artificial Sequence
  Description of Artificial Sequence: Synthetic coding sequence
atggaccccaagtaccagcgggtggagctgaacgacggccacttcatgcccgtgctgggttttgggacttacgctccaccagaagttccacgcaatcgcgctgtcgaggtgaccaagttagccattgaggccgggtttcgccatattgatagcgcctatctgtacaacaatgaggaacaagtcggcctggccatcagatctaagatagccgatggttctgttaagcgtgaagacattttctacacatctaagctctggtgcacattctttcaacctcagatggtccagcctgcactggaatcgagccttaagaagctgcagttggactacgtggacctgtacctgctccatttccctatggcactgaagcccggagagacacccctgcctaaagacgaaaacggcaaggtgatcttcgacacggttgacctctccgctacctgggaggtcatggagaagtgtaaggatgccggcctggctaagagtattggggttagcaacttcaactgcaggcaactggagatgatcttgaataagcccggcctaaaatataagccagtctgcaatcaggtcgagtgccacccttacttaaatcagtccaaattattagatttctgtaagtctaaagacatagtgctggtggcccactccgcccttgggacccaaagacataaattgtgggtggaccccaattctcccgtgctgctggaagatcccgtgctgtgcgccctggcaaaaaagcacaagcaaacaccagccctgatcgccctcaggtaccagctccaaaggggagttgttgtcctggcaaagagttacaatgagcaacgcattcgcgagaatatccaagttttcgagttccaactcactagcgaggatatgaaggttctcgacgggctgaaccgtaattacaggtacgtcgtgatggacttcttgatggatcatcccgattaccctttttcggacgaatactag

SEQ ID NO: 44076 - DNA, 972 bp, Artificial Sequence
  Description of Artificial Sequence: Synthetic coding sequence
atggaccccaagtaccagcgggtggagctgaacgacggccacttcatgcctgttctagggttcggaacatatgccccccccgaggtgccccggaaccgcgctgtggaggtgaccaagctcgccatagaagccggcttcagacacattgacagtgcatatctttataacaatgaagagcaggttggactggcgatcaggagcaagattgccgacggaagtgtcaaaagagaggatatcttctacactagtaagctttggtgcacatttttccagcctcagatggtccagcccgccttggaatcaagtctcaagaagttacagttagactatgtagacctgtatctcctgcactttccaatggcacttaaaccaggtgagaccccattgcctaaggacgagaatggcaaggttatcttcgatacagtcgatctcagcgcgacctgggaggtgatggagaaatgtaaggacgccggattggcgaagtcaatcggggtatcaaattttaattgtaggcagttagagatgatactgaataagccgggccttaagtataaaccagtttgcaaccaagtcgagtgtcatccctatctgaaccagtctaagctcttggacttctgcaaaagcaaggacatcgtcttagttgcccatagcgcccttggcacccagaggcataagctctgggttgatcccaatagccctgtgttattggaagatcccgtcctatgcgccctcgccaaaaagcataagcagactcctgccctgatcgctttacgctaccagctccagagaggtgtggtggtgctagccaaaagttacaatgagcaaagaattcgcgaaaatatccaggtgtttgaattccaactgacgagtgaggacatgaaagtcctggacgggcttaaccggaattacaggtatgtggtaatggacttcctaatggatcatcctgattacccattctccgacgaatattag

SEQ ID NO: 44077 - DNA, 951 bp, Artificial Sequence
  Description of Artificial Sequence: Synthetic coding sequence
atggccaccttcgtggagctgagcaccaaggccaagatgcccatcgtgggcttgggcacatggcgctcactgctgggaaaggtaaaagaggcagtgaaagtggctattgacgccgagtatcgccacatagactgcgcctatttctatgaaaaccaacacgaagtgggcgaagccatacaggagaaaatccaggaaaaggcagtgatgcgcgaggacctgttcattgtgtccaaggtgtggcccactttcttcgaacgtccactggttagaaaagctttcgaaaaaacactcaaagacctcaagctgtcctatctcgatgtgtatttaatccattggccgcaaggctttaagacgggcgacgatttctttcccaaggacgataaggggaatatgatcagtgggaaaggaacgtttcttgatgcgtgggaggctatggaggagctcgtagacgagggcctcgttaaagccctgggagtcagcaatttcaaccacttccagatcgaacgcctcttgaacaagccgggccttaagtacaaacccgtaaccaatcaggttgaatgtcatccttacctgacccaagaaaagctgatccagtactgtcacagtaaaggcatcacagtaactgcatacagccctttaggctcacccgatcgcccatgggccaagcccgaagaccccagcctgcttgaggacccaaaaatcaaggagatcgcagcgaaacacaaaaagaccaccgcccaagtcttaattagatttcatatccagagaaatgtgaccgtcattcctaagtctatgacaccagctcacatagtggaaaatatccaggttttcgattttaagctatccgatgaggaaatggcgacgatcctgtctttcaatagaaattggcgggccttcgactttaaagaattcagccacctggaagactttccttttgacgccgaatattag

SEQ ID NO: 44078 - DNA, 84 bp, Artificial Sequence
  Description of Artificial Sequence: Synthetic coding sequence
aaccccaactggaagcggatccggctgaacgacggccccttcatgcctgtcttgggcttcggcacctacgctcccgaccattag

SEQ ID NO: 44079 - DNA, 462 bp, Artificial Sequence
  Description of Artificial Sequence: Synthetic coding sequence
atgcacctgaccaccgccccccggtggaagcggcactgcgtgcccgccaccagttgtactagacgtgcctcctcgtggtccctggcctctcctaccatgcccccgggaaagtggccaagaagtgtgcccagtgcaagagccacagccgggtcctgtcccttatgtacctcattctggaaagagcatcactttgagggcattgccctggtagagaaagcccttcaggccgcatacggcgcatcagctccctccatgacatccgccgccctgaggtggatgtatcaccactcacagctgcagggagcacacggtgacgcggtgattctgggcatgtcatcattggaacagctggaacaaaaccttgcagctgctgaggagggccctctcgagcctgccgtagttgacgctttcaaccaggcgtggcatctattcgcccacgagtgtcccaactactttatatag

SEQ ID NO: 44080 - DNA, 903 bp, Artificial Sequence
  Description of Artificial Sequence: Synthetic coding sequence
atggagttccccttcgacgtggacgccctgttccccgagcggatcactgttctagaccagcatttaagacctcccgcgagaagaccaggcaccacaaccccagctcgcgtggatctccagcaacaaatcatgactataatagatgaactcggaaaggcttccgccaaggcacagaatctttcagcacctatcacatcggcttcccggatgcaaagcaatcgacatgtcgtatatattctcaaggatagttccgcacggccagcgggcaagggagccatcataggattcattaaggttggctataagaagctcttcgtgctggacgaccgcgaagcccataacgaagtggagcccctttgtattctggacttctacattcacgagagtgtgcagcgccacgggcacggcagggagctttttcagtatatgctgcagaaggaacgcgtagaaccacatcaattggctatagaccgaccatctcagaaactgctgaaatttctcaacaaacactataacttagaaacaaccgttcctcaagttaacaatttcgtcatattcgaaggattctttgcccaccagcacccacctgcacgaaagttacctcctaagagggcggaaggagatatcaagccctactcttctagcgatcgcgagtttctgaaggtagcagtcgaaccaccttggccactgaaccgcgccccaagaagggccacaccccctgcacaccctcccccgcgaagtagcagcctcggcaatagccccgaaagagggccactgcggccattcgtgccagagcaggagcttctgaggtccctgcggttgtgtccaccacatccaaccgcccggctcttgcttgcagcagaccctggaggctccccagcacagaggcgacgaacgcggtag

SEQ ID NO: 44081 - DNA, 933 bp, Artificial Sequence
  Description of Artificial Sequence: Synthetic coding sequence
atggagttccccttcgacgtggacgccctgttccccgagcggatcaccgtcctggaccaacacctgaggcctcctgctcgccgacctggtaccactactcccgcaagagtggacctccagcaacagataatgactataattgacgagctgggaaaagcaagcgccaaagcacagaacctctcagctccaataacctcagcatcgcggatgcagtctaacagacacgtcgtttacatcctgaaggactccagcgctcgacctgctggcaaaggcgccatcatcgggtttattaaagtcggctacaaaaagttgttcgtgctcgacgatagggaagcacacaacgaagtggagcccctttgcatactcgatttttatatacatgaatctgtgcagcgccacggacatggccgcgaattgtttcagtacatgttgcagaaagaaagagtggaaccacatcagctggcaatagacagaccatctcaaaaactcctcaaattcctaaacaagcattataatcttgaaaccacagtgcctcaggtgaacaacttcgtaatctttgagggattctttgctcatcagcatcccccagcgagaaaactgccccccaagagagcggagggcgatattaagccttatagctcaagcgaccgcgagttcctgaaggtggccgtcgagccaccttggcccctcaatcgggctcctcggcgtgctacaccgcccgcacatccccctccccggtcctcttctctcgggaatagtcccgagcgcggccctttgcgaccctttgtcccagagcaagagctgctgaggagtctccgcttatgcccccctcaccctacagccaggcttctccttgctgccgaccccgggggttctccagctcagcgacgtcggacgagcagcctgcctcgctcagaggagagccgctattag

SEQ ID NO: 44082 - DNA, 1002 bp, Artificial Sequence
  Description of Artificial Sequence: Synthetic coding sequence
atggagttccccttcgacgtggacgccctgttccccgagcggatcaccgtactcgaccagcacctaaggcctccagctaggagacctgggacgaccacaccagctagagtggatcttcagcagcagatcatgacaatcatcgacgagcttggtaaagcttcagccaaggcccagaacctgtctgcacccattacttccgcctctcggatgcaaagcaaccggcacgtagtctatatcctgaaggattcatccgcgcgtcccgctggcaaaggggccattattggatttatcaaggttgggtataagaaattattcgtgctagatgaccgggaagcccacaacgaagtcgaacccctgtgtatcctggacttctacatccatgagtcagtacagaggcacgggcacggcagggagctgttccaatacatgctgcagaaggaacgcgtggaacctcaccagctggccattgatagaccttcccagaaattactaaaatttttgaataaacattacaatctcgagactactgttcctcaagtgaacaactttgttatctttgaggggttctttgcccatcagcacaggccaccggccccctctctccgggcgactcggcactcacgggccgcagccgtggaccccacacccgccgcacccgcacgaaaacttccccctaaaagggccgagggagacataaaaccgtacagtagctccgatcgggaatttctcaaggtcgcggtcgagcctccatggcctctgaatcgcgcccctaggcgtgccactccgcctgcccatcccccccctcgatcgtcgagcctggggaatagccccgagcgtgggcccctgaggcccttcgtgcctgagcaggaattgctgaggagtctgcgactgtgccccccccaccccacagcccggctcctcttagcagctgatcctggtggcagccccgcccagcgtcggaggacctcaagcctgcctagatctgaggagagtagatactag

SEQ ID NO: 44083 - DNA, 1230 bp, Artificial Sequence
  Description of Artificial Sequence: Synthetic coding sequence
atgtggctgacctggcccttctgcttcctgaccatcaccctgcgggaagaaggggtatgccacctggaatccgtggacctgcagcagcaaattatgaccattatcgacgaactgggcaaggcttccgccaaggcgcagaacctttcagctccgatcacttcagcttcccgcatgcagagcaatcggcatgttgtatacattctgaaagacagcagcgcccggcccgccgggaaaggtgccataatcggttttattaaagttgggtacaaaaaactcttcgttctggacgatagagaggcccataatgaggtggaacctttgtgcatcctagacttctacattcatgagtccgtgcagcgccacgggcatgggcgcgagcttttccagtacatgcttcaaaaagaacgagtggaaccacatcaattagccattgaccggcccagccagaaactactgaaattccttaataagcattacaatctcgagacaaccgtgccccaagtgaacaacttcgtgatattcgaagggttttttgcccaccagcatcgtcctcctgccccgtcacttcgagccacaagacactctcgggcagcagctgtggaccccaccccggccgcgccggccagaaaactgccaccaaagcgggcagaaggtgatatcaaaccctactcatcatctgatagggagtttctgaaagtcgcagtcgaaccaccctggccactcaaccgcgcgccaaggagggccacaccacctgcgcatcctcctccacgctcaagtagtctcggtaatagcccagagcggggacctctgcgcccttttgttcccgagcaggaattgcttcgtagcctgcgactgtgtccaccccatcctacggctcgcctgttgctggccgccgaccccgggggctcacctgcacagagacggcgcacaagaggaaccccgcccgggctggttgcccagagctgctgttatagcagacatgggggcgtcaactcttcatcgcccaacactggcaatcaggactctaagcagggagaacaggagacaaagaataggtctgcatcagaagagcaagccctgagccaagatggtagcggtgaaaaacctatgcatacagcacccccacaggcaccagctccaccagcccagtcatggactgtgggcggcgatattctcaacgcccgcttcatccgtaatttgcaggagcggcggtctacaagaccatggtag

SEQ ID NO: 44084 - DNA, 1197 bp, Artificial Sequence
  Description of Artificial Sequence: Synthetic coding sequence
atggagttccccttcgacgtggacgccctgttccccgagcggatcaccgtactagatcagcacctccgaccccccgcgcgcagacctggaaccactactccagctagagtggatctgcaacagcagataatgaccatcattgacgaacttggcaaggcatctgcaaaggcacaaaatctgtcagcccccattacctctgcttctcgaatgcagtcaaaccgtcacgtggtgtatattttgaaggacagctccgctcgccccgcaggtaaaggcgcgatcatcggcttcattaaggtgggttacaaaaaactcttcgtgttagacgaccgagaggctcataacgaggttgagcccttgtgcatcctggacttctacattcatgagtctgtgcaaagacacggccatggacgtgagctgttccagtacatgctgcagaaagagcgggtggagcctcaccagctggctatcgaccgcccctcccagaagctcctcaagtttcttaataaacactataacttagaaaccactgtgccccaggtgaacaactttgtgatatttgaaggattcttcgctcatcagcatccccccgcgcgcaagttaccacctaagcgcgctgagggagatatcaagccctatagcagttccgatcgagaatttctgaaggtcgccgtggagcctccctggccgctgaatagagcgccaaggagagccactccgcccgctcaccccccacctaggagctctagcctgggaaattcacccgaacgtggtcccttgcggcctttcgtgcctgaacaggagttactgcggtcactgagattgtgcccaccccaccccaccgcgaggctcctactcgcagcagatcccggcggatcacccgcacagaggcgacgcacgcgaggcacaccccctggcctcgttgctcagagctgctgctacagtcgtcatggtggagttaattcttcctctccaaatacaggaaatcaggatagcaaacagggagagcaggaaaccaaaaacagatccgcctccgaggaacaagccctctcccaagacggatccggggagaagcccatgcacaccgcaccgccccaggctcctgctccgcccgcccaaagctggaccgtgggtggcgatatccttaatgccaggtttataagaaacctgcaggaaagacggtctacacgcccgtggtag

SEQ ID NO: 44085 - DNA, 972 bp, Artificial Sequence
  Description of Artificial Sequence: Synthetic coding sequence
atggagttccccttcgacgtggacgccctgttccccgagcggatcacggtactagaccagcacctcagaccacccgccaggagacctggcacgacgacacccgcgagagtggatctccaacagcagatcatgacaattatcgacgagctgggaaaagccagcgccaaggcacagaacttgtctgcgccaattacttctgcgagccgcatgcaaagcaatcgtcacgtggtttacattctgaaggactcttcagcccgacccgccggtaagggcgctattatcggttttattaaagtggggtacaagaaacttttcgtactggatgatcgggaagcacacaatgaggttgagccgctttgcatactggatttttatattcacgaatctgtgcaacgacacggccatggccgtgagctatttcaatacatgcttcagaaagagcgtgtggagccccatcagttggcaattgaccgcccatctcagaagttattgaagttcctcaataaacactataatctggagactaccgtaccccaggttaacaattttgttatttttgagggcttttttgcacatcagcaccgaccccctgcaccgtctcttcgcgctactcggcatagtagagctgctgccgtggaccccactcctgctgccccagccaggaagctcccacctaagcgcgcagaaggagatatcaagccgtatagtagcagcgaccgagagtttctgaaagtggcagtcgagccaccctggccactcaaccgggcccctcggcgcgcaacccccccagctcacccccccccacgttccagttctctcgggaatagcccagagagggggccgctgcgaccattcgttccagaacaggagcttttgcgatcactgcggttgtgccctcctcaccccaccgcacgtcttttgctggccgccgaccccgggggttcccccgctcagcggagaaggacaaggtag

SEQ ID NO: 44086 - DNA, 1266 bp, Artificial Sequence
  Description of Artificial Sequence: Synthetic coding sequence
atggagttccccttcgacgtggacgccctgttccccgagcggatcactgtgttggatcagcacctgcgcccgccagcacgccgacctggaaccacaaccccagccagggtggatttgcagcaacagataatgaccataatcgacgaattgggaaaagcctccgccaaggctcagaacctgagcgcaccaatcactagcgcctcaaggatgcagtctaacaggcacgtcgtgtatatactaaaagactcttctgccagacctgcaggaaaaggtgcaataataggtttcataaaagtgggatacaagaaactgttcgtcttggacgatcgtgaggcccataacgaggtggagccgctgtgcatcctggatttctatattcacgagagtgtccagcgacatggccatgggagggaattgttccagtatatgctgcaaaaagagagggtagagccacatcagctcgccatcgatagaccctcccaaaagctgctgaaatttctcaacaaacactataacctggaaactaccgtcccgcaggtgaataacttcgttatttttgaaggctttttcgctcatcagcaccgacctcccgcaccgagcctgagggcaactcgtcattctagagctgctgccgtcgatccaacacctgcagcccccgctcggaagcttcctcccaagcgcgctgagggagatatcaagccatacagctcaagtgatcgcgagttccttaaggtagctgtggagcctccctggcccctgaaccgcgccccccgcagggccaccccacccgcacatcccccccccaggtccagctcattgggaaattcgcctgaacggggacctctgcgaccttttgttccagagcaggaacttctgcgcagcctccggctctgcccgccccaccctaccgccaggctcctcttggcggcagatccaggtggttcccctgcacagcgcaggcgaactcgtggcacccctcctggtcttgtcgcgcagtcctgttgttattcaagacatgggggcgttaactctagcagccccaataccgggaaccaggactcaaaacagggcgagcaggaaaccaagaaccggtctgcttctgaagagcaggcactgtcccaggacggctctggggaaaagccaatgcatactgctcctcctcaggcccctgcaccgccagctcagtcatggacagtaggtggtgacatcttgaatgctaggttcattagaaacttacaggagcgtaggtcaacacgaccgtggtag

SEQ ID NO: 44087 - DNA, 1230 bp, Artificial Sequence
  Description of Artificial Sequence: Synthetic coding sequence
atgtggctgacctggcccttctgcttcctgaccatcaccctgcgggaggagggcgtgtgccatctagagagcgtcgatcttcagcagcaaattatgaccattattgatgagttaggaaaggctagcgcaaaagctcagaacctgagtgcccccattacctctgcgtcacgcatgcagtccaataggcacgttgtctatattctgaaagacagctcggcacgccccgcaggtaagggggccattataggcttcatcaaagtggggtataagaaactctttgtcctcgacgatcgtgaggctcacaacgaagttgaaccactgtgcatacttgacttttatatacacgagagtgtccagcgccatgggcatggacgcgaactctttcagtacatgttacagaaggaacgcgtcgagcctcatcagctggccattgaccggcctagtcagaaactgctgaagttcttaaacaagcactacaacctggagaccacagtgccacaggtaaacaacttcgtgatatttgaagggttcttcgcacaccaacatcgcccgccggccccgtcccttagggctactcgtcactctcgcgcggccgcggtggaccccacgcccgctgcccctgcacggaagttaccccccaaacgcgcagagggagatatcaaaccctattcgtccagtgaccgagagttcttaaaagtagccgttgagcccccatggcccctgaaccgggccccccgcagagctacccctcccgctcaccccccgccccggtccagcagcctcggcaactctcccgaacggggccccttgaggccttttgtcccagagcaagaactcctacggtcccttcgattgtgcccaccacatcctaccgcccgcctgctgctggccgcggatccaggtggatcgcccgcccagagacggagaactagagggactccccctggtttggtggcccaaagctgctgttactcacggcatggtggggtcaacagctcctccccaaataccggtaatcaggacagcaaacagggcgagcaggaaaccaaaaacaggtccgctagcgaagaacaggctctgtcacaggacggatccggcgagaagcctatgcacaccgcccctccacaggcacctgcccctcccgcccaaagttggacggtgggcggagatatcctgaacgcgaggttcatccggaatttgcaagagcggaggagtactagaccgtggtag

SEQ ID NO: 44088 - DNA, 1002 bp, Artificial Sequence
  Description of Artificial Sequence: Synthetic coding sequence
atggagttccccttcgacgtggacgccctgttccccgagcggatcacagtccttgaccagcatttgaggccacccgctagaagaccaggtactaccacacctgccagggtcgacctgcagcaacagattatgacgatcatcgacgagctcggcaaagcctccgcaaaagcgcaaaacctgtcggcccccattactagcgcatctaggatgcagtcgaataggcacgtggtttacattctgaaagattcctccgcacgtcctgcaggaaagggagccatcattggattcataaaagttggctataagaagctgttcgtgttggatgatcgcgaagcccacaacgaagtggagcccctgtgtattcttgacttttacatccatgaatcagtgcaaagacacggccatgggcgggagctcttccagtatatgctgcagaaggaaagagtggaaccccaccaattagccatcgacagaccttctcaaaagcttctgaagtttttgaataagcactacaatcttgagacaaccgtaccacaggttaacaattttgttattttcgaaggcttctttgcccatcagcatcgcccaccagccccttcacttagggcaactaggcactctagggccgccgcggttgatccaaccccggcagcccccgcaagaaagctgcccccaaagagagccgagggtgatatcaaaccttactcatcttctgacagggaattcctgaaggtagcagtggaaccgccttggccgttgaatagggctccacggcgggctacgcctccagctcatccccccccacggtcatcgagcctggggaatagccccgaacggggcccattaagaccttttgttcccgaacaggaactgctgcggtctctgcgcctttgtcccccgcaccccacggcaagactgcttcttgccgcagatccaggaggaagtccagcccagcgccgcagaacaagtagcctgcctcgatctgaggaatctaggtattag

SEQ ID NO: 44089 - DNA, 903 bp, Artificial Sequence
  Description of Artificial Sequence: Synthetic coding sequence
atggagttccccttcgacgtggacgccctgttccccgagcggatcacggtgctggaccaacatcttcgtccccctgcccggcgtcctggaaccacgactcccgcccgcgtggatctgcagcagcaaatcatgaccattatagacgagttaggcaaagcctccgccaaggcacagaacctgagcgcccctatcacctctgcctcaagaatgcagtcgaatcgacacgtggtctacatcctcaaggactcctcagcaaggcctgcaggaaaaggggccataattggctttattaaagttgggtataaaaaactgttcgtactggatgatcgagaggcccacaacgaggtggaaccactttgcatcttagacttttatatccatgaatcagtgcagaggcatggacacggcagagaactgttccagtatatgctccaaaaagagagggtagaacctcaccagctggcaattgaccgccccagccaaaagctcctgaaattcttaaacaaacattataatctcgaaaccacggtcccccaggttaataacttcgtcatttttgaagggttctttgcccaccagcatcctcccgcccgcaagttgcctcccaaaagagccgagggagacattaagccctattcatccagcgatcgcgagtttctgaaagtagctgtggagcctccgtggccattgaatagggccccccgccgtgcgacaccacccgcccatcccccccctagatcctccagtttgggcaattcccctgagagagggccactccgccctttcgtgcccgagcaagagcttctcaggtccctgcggctctgccccccgcaccctactgctaggctcctcctggcagctgaccccggaggttctcccgcacagaggaggcgcacacgctag

SEQ ID NO: 44090 - DNA, 1266 bp, Artificial Sequence
  Description of Artificial Sequence: Synthetic coding sequence
atggagttccccttcgacgtggacgccctgttccccgagcggatcaccgtcttggatcagcacttgcggccaccagctaggcgcccggggacgactaccccagcacgggtcgatctgcaacagcaaatcatgaccattattgatgagttaggaaaggctagcgcaaaagctcaaaacctgtctgcaccgatcaccagcgcatcaagaatgcagagtaacagacatgtagtttacatcctaaaggactccagcgcccgtcccgccgggaagggggctataatcggatttatcaaggtcggatacaagaaactgtttgtgctggatgatagggaagcacacaacgaagtggagccactgtgtatcttagacttctacatccatgaatcagtgcagaggcacggacatggcagagaactcttccaatatatgttacaaaaagaacgagtggaaccgcaccaactggctattgaccgaccttcgcagaaacttttaaaattcctcaataaacactacaatctggagacaacagtccctcaggtgaacaacttcgtaatctttgaagggttttttgctcaccagcatcgtccccctgcacccagtctgcgagcaactcgccattctcgggctgccgccgtggatccaactcctgctgcccctgccagaaaactgcctccgaagcgagccgaaggggatattaagccatactccagcagtgaccgggaatttctgaaagtggccgtggaaccgccctggcccctcaatcgggcccccagacgggccacccctccagcccatccaccacctagatctagctcgcttggcaatagccctgagcgggggccacttcgtccattcgtgcctgagcaggagctgttacggtccctccgcttgtgtcccccacatccaacagcgcgcctgctcctggctgcggaccccggaggctcaccagctcagaggaggagaactcgaggcacacctcctggcctggtcgcacagtcgtgctgttatagcaggcacggcggtgtcaatagcagctctccgaacacaggtaaccaggactctaaacagggtgagcaggagacaaaaaatagatcagcctcagaggaacaggcactcagccaggatggctccggggaaaaaccaatgcatactgctccaccgcaggctccagctccaccagcccagagttggacagtcgggggagacatactgaatgctcgcttcattagaaaccttcaagaaagaagaagcaccaggccgtggtag

SEQ ID NO: 44091 - DNA, 972 bp, Artificial Sequence
  Description of Artificial Sequence: Synthetic coding sequence
atggagttccccttcgacgtggacgccctgttccccgagcggatcacagttttggaccagcacttacggccgcctgctcgacgccctggtacaactaccccagcgcgcgtggacttacaacaacagataatgacgattatcgatgaacttgggaaggcgagcgccaaggcccagaatttgagcgcccctataactagcgcttcacgtatgcagtccaaccgacacgtggtctatattctgaaagattcatcagcccggcctgccggcaaaggtgcgataataggatttattaaagtcgggtacaagaaactgttcgtcctggacgatagagaagcacacaatgaggtagaacccctgtgtatactggatttctatatccacgaatctgtgcaaagacacggacacggacgagaactgtttcagtacatgctccaaaaagagcgcgtggaacctcaccagcttgcaatcgaccgaccttcacagaaacttctgaaatttcttaacaagcactacaacctcgaaactactgtgccccaggtgaacaacttcgtgatttttgaaggttttttcgctcatcaacatcggccacctgcaccaagcttgagagctactcggcattctagggccgcagcggtagatcctacccccgcagctcccgccagaaaacttcctcctaagcgagctgagggtgacatcaaaccatacagtagttcagacagagagttccttaaagtcgcagtagagccgccctggcctctgaaccgcgcgccccgccgggccactcccccagcacacccgcccccacgaagtagcagtcttggcaacagccctgagcgcggcccactgagaccatttgtgccagagcaggaactgttacggtcccttaggctgtgccccccccatcccacagctcggcttcttctagcagctgacccgggaggctctccagctcagagaaggcgtacgaggtag

SEQ ID NO: 44092 - DNA, 933 bp, Artificial Sequence
  Description of Artificial Sequence: Synthetic coding sequence
atggagttccccttcgacgtggacgccctgttccccgagcggatcacagtgttggaccagcatttgaggcctccagcacggcggcccggcaccaccacaccagctagggtggacctacagcaacagataatgaccatcatcgatgagctaggcaaagcttctgccaaagcccagaatcttagcgcacctatcacctctgcgtcccggatgcaaagcaaccggcacgtggtgtacatccttaaagactcttctgcccgtccagcaggaaaaggggctatcataggcttcattaaggttgggtacaaaaaactgttcgtcctggacgatagggaagcgcataacgaagtagagcccttgtgtattctagatttctacattcacgaatcagtgcagagacacgggcatgggagggagctctttcagtacatgctccaaaaggaacgcgtggagcctcatcaattagccatcgatagaccctctcagaagcttcttaaattcttgaacaaacactacaatttagagaccacggtcccacaggttaataacttcgttatatttgaaggcttttttgcccatcagcaccctccggctcgtaagctaccacccaaacgggccgagggagatatcaagccttactcatctagcgaccgagagtttctgaaagtcgctgtggagccgccttggcctctgaaccgtgccccccgaagagcaaccccacccgctcacccaccacctaggagttcatccctgggcaatagccccgaaaggggaccattgagaccattcgtgccagagcaggagctgttgaggtccctgagactttgccctccgcaccctactgcccgactgttgctggcagccgacccaggtgggagccccgcccagcgacgccgcacatcttcccttccccgctcggaggagtcacgttattag

SEQ ID NO: 44093 - DNA, 972 bp, Artificial Sequence
  Description of Artificial Sequence: Synthetic coding sequence
atggagttccccttcgacgtggacgccctgttccccgagcggatcacagttctggaccagcacctgcgccccccagcgcgcaggccaggaaccacgacacccgcgagagtggaccttcagcagcaaattatgaccatcattgacgagttaggcaaggcttctgctaaagcccaaaacttgtctgcgcccataacctcggcttccaggatgcagagcaaccgccacgtggtttatatccttaaggatagcagcgcaagacccgccggaaagggtgcgatcattggttttataaaggtcggatacaagaagctattcgttttagatgatagggaggctcataacgaggtcgagcctctgtgtatactcgacttctacatccacgaatctgttcagcggcacggtcacggccgggaattatttcagtacatgctgcaaaaagagcgggtggagccccatcagctggctatcgaccgtccatcgcagaaattactaaagttcctcaataagcactataatctggagaccaccgttccacaggtgaacaattttgtgattttcgaggggtttttcgcccatcagcatagacctcctgctccctctctgcgggcaacaaggcattcaagagccgccgctgtggaccccacaccggccgcacctgcccgcaagttgccgcccaaaagggccgagggcgatattaaaccatattcatcgtctgacagggaatttctaaaggtagctgtagagccaccgtggcccctgaaccgggccccaagaagagccacccctcccgcccaccccccgcctaggtcttcgtcactgggaaactctcccgagagaggccctctgaggcccttcgtaccggaacaggagctgttgagaagccttagattgtgcccacctcaccccaccgctcgcttattgctggccgctgaccctggaggtagccctgctcagcgccgacgcaccaggtag

SEQ ID NO: 44094 - DNA, 1230 bp, Artificial Sequence
  Description of Artificial Sequence: Synthetic coding sequence
atgtggctgacctggcccttctgcttcctgaccatcaccctgcgggaggagggtgtgtgtcatttggagagcgtggatctccagcagcagataatgacaattatagacgaactcggcaaggcgagtgctaaggcccagaacctgagcgcgcctatcacaagcgcctctcggatgcagagcaatcggcacgtggtttatatactcaaggactcaagtgcgcgacctgccggcaagggcgctatcatcggcttcattaaagtgggctataaaaaactcttcgttctagacgatcgggaggctcacaatgaggtcgaacccttatgtatattggatttttacatccacgaatctgtgcagcggcacggccatggcagagagcttttccaatatatgctccagaaggagcgagttgaacctcaccagctagccattgatagaccgagtcagaaattgctgaagttcctgaacaagcactataacctggagactacggtgcctcaggtgaacaactttgtaatctttgagggttttttcgcgcatcagcaccgaccaccagcgccaagtttaagggccacccgccactctcgcgccgccgccgtggaccctacccccgccgccccagctaggaagctccccccaaaaagagctgagggtgacataaagccctattcctccagcgatcgggaattcctgaaggtggcagttgagcccccctggccactcaaccgcgccccccgacgagctacacccccagctcatccaccaccgagatcatccagcttggggaacagtcccgaaaggggtcctctgaggccatttgtaccagaacaggaactactgcggtctctgcgactctgcccacctcatccaacagctagactgcttctggccgccgacccgggaggcagccctgctcaaagacggaggacccgaggcaccccgcctggacttgttgcacaatcctgttgctacagccgccacggaggagtgaattccagcagtccaaatactggcaatcaggactctaaacagggcgaacaagaaaccaaaaacagatccgctagtgaggagcaggccctcagccaggatgggtcaggagaaaagcctatgcataccgctccaccccaggcacccgctccgcctgcacagtcctggacagtgggcggggacattttgaatgctcggtttatccgaaatttacaagagcgacggtccacgcggccatggtag

SEQ ID NO: 44095 - DNA, 903 bp, Artificial Sequence
  Description of Artificial Sequence: Synthetic coding sequence
atggagttccccttcgacgtggacgccctgttccccgagcggatcaccgtgctggaccagcaccttagacctccagcaaggaggccaggcacaacaactcccgcgcgcgtcgatctgcaacagcaaattatgacaatcattgacgaattgggaaaggcgagtgcgaaggcccagaacctctctgcacctatcacctccgcctctcgaatgcaaagcaataggcacgtcgtatatattctgaaagattcaagtgcccgccccgccggtaagggcgccatcattggattcatcaaggtcggctacaagaaactctttgtgctggacgatagagaagcccataacgaggtggagccattgtgcatcctggacttctacatccacgaatcagtacaaaggcacggtcacggacgcgaactgtttcagtatatgctgcagaaggagcgcgtagagccgcaccagttagcgatcgaccgccctagtcagaagctgctcaagtttctaaataagcactacaatctcgaaactaccgtgccccaagtcaacaattttgtgatatttgagggcttcttcgctcaccagcatcctcctgccagaaaactgccaccaaagagagctgaaggagatattaaaccgtactcctctagcgacagggaattcctgaaagtggccgtcgaacctccttggcctctgaacagggcacccaggcgagctactccaccagcccaccctcccccccgatccagcagtctgggaaactcgcccgaaagggggcccctcaggccatttgtgcccgaacaggaattattgaggagtttacggctgtgcccgccacaccctacagcaaggctgctgctggccgctgatccaggcggatcccccgctcagcggagacggacaaggtag

SEQ ID NO: 44096 - DNA, 903 bp, Artificial Sequence
  Description of Artificial Sequence: Synthetic coding sequence
atggagttccccttcgacgtggacgccctgttccccgagcggatcacagtgttggaccaacacctcaggccacctgctcgcaggcccggcacgactacacccgcacgggtcgacttgcaacaacaaatcatgaccattattgacgagttaggaaaggcatccgccaaagcccaaaacctgtcagcgcctatcacctccgcctctcgcatgcagtccaaccggcacgtggtgtacatattaaaggatagcagcgcacggcctgccggtaagggcgcaatcattggattcattaaagtgggttacaagaaactgttcgttttggatgatagagaggctcacaatgaagtcgaaccactgtgcatcctggacttttacattcatgaatcggttcagcgccacggacatggacgcgagctctttcagtatatgctgcaaaaagagcgggtggagcctcaccaacttgcaatagaccgccctagtcaaaaattgctaaaatttctcaacaagcattacaacctagagacaactgtccctcaggtcaacaactttgtcattttcgaaggattcttcgcccatcaacatcctcccgctagaaagctgccgcccaaacgagctgaaggggacatcaagccctacagctcttcagacagagagtttctaaaggttgccgtcgagcccccttggcccctaaacagggcacccagaagagcgacgccccccgctcaccccccaccccggagctcaagccttgggaacagtcccgagaggggcccactgaggcccttcgtgccagaacaggaactccttagaagcttacggttgtgccctcctcatcctacagccaggttgctgctcgctgcagacccagggggaagccccgctcagagaaggaggactcgatag

SEQ ID NO: 44097 - DNA, 972 bp, Artificial Sequence
  Description of Artificial Sequence: Synthetic coding sequence
atggagttccccttcgacgtggacgccctgttccccgagcggatcacagtgctggaccaacacctgcggcccccagcccgacgaccagggacgacaacccccgccagagtggatctgcagcagcaaataatgactataatagacgagctcggtaaagcctctgctaaagcacaaaacctaagcgctccaatcaccagcgcttcccgcatgcagtcaaaccggcatgtggtctacattctcaaagatagttcagctcggcccgctgggaaaggtgctataatcggtttcattaaagtgggctataaaaagctattcgtcctggatgatcgggaggcgcacaacgaagtggaacctctgtgtattctggacttttacattcacgaatcagtgcaacgccatggccatgggcgagagttgttccagtatatgttgcaaaaggagcgcgtggagccccatcaactggctatcgatcgccccagccagaagctgcttaagttcctgaacaagcactataacttggagacaactgtgccgcaggtcaacaattttgtcattttcgaagggtttttcgcccatcagcacagaccaccagccccttcactccgggccaccagacattcacgtgcagccgctgtggaccccacccccgcagcgccagctagaaagcttccccctaagagagccgagggagacatcaaaccttactcctcttctgaccgggagtttttgaaagtagccgtggaacctccttggcccctcaacagggctccccggcgggccaccccacccgcccacccacccccccggtcttcatcactaggcaacagccccgaacggggaccactacgtccatttgtacccgaacaggaactcctgcggagcctgcgcctgtgccccccccacccaaccgccagactgcttctcgcagccgatcccggcgggagcccggctcagcgccgccggacacggtag

SEQ ID NO: 44098 - DNA, 1266 bp, Artificial Sequence
  Description of Artificial Sequence: Synthetic coding sequence
atggagttccccttcgacgtggacgccctgttccccgagcggatcaccgtgttggaccaacatttgagacccccagctaggagacccggaacaacaaccccagccagagtggatttacagcagcaaattatgactataatcgacgaattagggaaagcctcagccaaagctcagaacttgtccgcccccattacgagtgcatccagaatgcagtctaatagacatgttgtgtacattcttaaggattcctccgcccggcccgccggcaagggcgcaattatcggttttattaaagtaggatacaagaaactgttcgtgcttgacgatagagaagcccacaacgaagttgagccactgtgcattctcgacttttatattcacgagagcgtgcagcggcacgggcatgggcgggagctcttccagtacatgcttcagaaggaacgggttgaacctcaccagttagctattgatagaccaagccagaagctactgaaattcctgaacaagcactataatcttgagacgacagtaccccaggtaaacaactttgtgatattcgagggctttttcgcccaccagcaccggccaccagcaccatccctccgggccacacggcactctcgagcagccgcagtggaccctacccccgccgccccagctaggaaacttccgcctaaacgggccgaaggtgacatcaaaccctactcttcatctgatcgcgaatttttaaaagtcgccgttgagccgccatggcccttgaacagagccccaagacgggcgacacccccagcgcacccgccaccacgcagctcctccttgggaaactctcctgagcgaggaccactccgacctttcgtgcccgagcaagagctcctgaggtctctgcgactttgccctccccaccctaccgcacggctgcttcttgcagcagaccccggggggtctcccgcccagcggaggcgtacgagagggaccccacccggattagtcgctcagtcatgttgctacagcagacacggaggagtgaacagttcctcaccgaacaccggcaaccaggactctaagcaaggcgagcaggaaacaaagaatcggtctgcgagcgaagagcaggctttgtcccaggatgggagtggggaaaaaccaatgcacaccgcccccccacaggcgcctgccccgccagcccaatcttggactgtaggaggcgacatcctcaacgccaggttcatcaggaatcttcaggagagacgctccacaagaccttggtag

SEQ ID NO: 44099 - DNA, 903 bp, Artificial Sequence
  Description of Artificial Sequence: Synthetic coding sequence
atggagttccccttcgacgtggacgccctgttccccgagcggatcaccgttctggatcaacatctgagaccgccggcacggaggcctggcaccacaacacctgccagggtcgatctacagcagcaaattatgacaataatcgacgagctgggaaaggccagcgccaaagctcaaaacctgagcgcccctatcacatctgccagccgcatgcagtcaaaccgtcacgtggtttatatcttgaaagacagctccgccaggcctgcaggaaagggggccattattggctttatcaaggttggatataaaaagctgttcgtgcttgacgaccgcgaggcacacaacgaggttgagccactttgtatccttgacttttacattcatgagagtgtgcagaggcacggccatgggagagagctgttccagtatatgctccagaaagagagggtcgagccacaccagttagccatagatagaccctcccaaaaactgctcaaatttcttaacaagcattataatcttgagaccaccgtgccccaggttaacaatttcgttatctttgagggattcttcgctcatcagcacccacccgccaggaagttgccacccaagagagctgagggcgacattaaaccatactcatctagcgaccgcgagtttctaaaggtcgcagtggaaccaccctggccattgaacagggcgccccgacgcgcgacaccacctgcccacccgccgcctagatcaagtagtctcggaaatagccccgaacgcgggcctcttcgcccttttgtcccagagcaagaattgctccgatctctgcgcttatgtcctcctcacccaacggctcgcctgttattggccgcggatccaggcgggtcaccagcccagaggaggaggaccagatag

SEQ ID NO: 44100 - DNA, 972 bp, Artificial Sequence
  Description of Artificial Sequence: Synthetic coding sequence
atggagttccccttcgacgtggacgccctgttccccgagcggatcaccgtgctggaccagcacctgcgtccacctgcacgccgcccaggcaccacaacgcccgcaagagtcgacctccagcaacagataatgaccataatcgatgagctgggcaaggccagcgctaaggcccagaacttatctgctccgataactagcgccagccgcatgcaatcgaatagacatgtggtgtacatcttaaaagattcttcggctagacccgcaggcaagggcgctatcattggatttatcaaggttggatataaaaagcttttcgtgttggatgatagggaagctcataacgaggtcgagcctctgtgtatcctggatttctatatacacgagtcagtgcagcgtcatgggcacgggcgggaactatttcagtatatgctgcaaaaggaacgcgtagagccccatcagctagctattgaccggccaagccaaaagcttcttaaattcctgaataagcactataatttggagaccacggtaccacaggtgaataacttcgtgatcttcgaaggctttttcgcccatcagcacagaccaccagccccgagtctacgggcgacccggcactcccgggctgcggctgtggaccctacgccagcagctcctgctagaaagctaccccccaaaagggccgaaggcgacataaaaccttacagttcatccgatagggagttcctgaaagtcgccgtggaacctccatggcctttgaatcgcgcccctcggagggcgacacccccggcacaccctcccccaagatcctcctcccttggcaactcccctgaacgtgggcctttgcgccctttcgtaccggaacaggaattgttgcgttcactgcgcctgtgtcctcctcatccaaccgcccgcttgttactggcagctgaccccggaggatctcccgcacagcgccggcgaacaagatag

SEQ ID NO: 44101 - DNA, 933 bp, Artificial Sequence
  Description of Artificial Sequence: Synthetic coding sequence
atggagttccccttcgacgtggacgccctgttccccgagcggatcaccgtactggaccagcatcttaggccacctgcccggaggcccggtactaccacacctgctcgcgtggacctacagcagcagattatgacaataatcgatgaactggggaaggccagcgcgaaagcacagaacctttcagctcctataacaagtgcatcccgcatgcagagcaatcgccatgtcgtttatatcctgaaggattcctccgccagacccgcgggcaagggcgccatcatcggcttcattaaagtcgggtacaaaaaactatttgtgctcgacgacagggaggcacacaatgaagtggaaccgctgtgcatactcgacttctatatccacgagagcgtgcaacgacatgggcacgggagggagcttttccaatacatgttacaaaaggagcgggtggagccccaccaactcgccatcgacagaccaagtcagaaactcctgaaattcctcaataaacactataatctcgaaacgacagtgccccaggtcaataacttcgtaatttttgaggggttttttgcacatcagcatccacctgcaaggaaattgcctcctaaaagagccgaaggcgacattaaaccctacagctcatcagatcgagagttcttgaaggttgccgttgagccgccgtggccccttaaccgtgctcctagaagagccacaccgcctgcccacccgcccccccgatcatccagcctgggtaactcacccgaacgcgggcccttgcgcccctttgtccctgagcaggaactgctcagaagtttgagactctgtccaccccatcctactgcaaggctgctgctagccgcagatcctggtgggtcccctgcccagcggagacgcactagctcccttccccgctcagaggagtctcgctattag

SEQ ID NO: 44102 - DNA, 1230 bp, Artificial Sequence
  Description of Artificial Sequence: Synthetic coding sequence
atgtggctgacctggcccttctgcttcctgaccatcaccctgcgggaagaaggagtatgtcatctcgaatctgtcgaccttcagcagcagataatgactataatcgacgaattgggtaaagctagcgcaaaggcacagaatttgtccgctcccattacctctgcatcccggatgcagtcgaatcgacacgttgtttacatcctcaaggattcctcagccagacccgcaggaaagggtgcaatcatcgggttcataaaggttggctacaaaaaattgttcgtgttggatgatcgcgaagcccataacgaggtagagccactatgtatcctcgatttctacatacacgagtcagttcagagacacggccacggtcgagagttgtttcaatacatgcttcaaaaggaaagagtggaaccacaccagctcgcaatagatcggccttcacagaaactactgaaattcctcaacaaacactacaaccttgagacaaccgtgccccaggtgaataacttcgtaatctttgagggattttttgcgcaccagcacagacccccagcccctagcctgcgagctaccagacactctcgcgctgcggctgtggacccaaccccagccgctcctgcacggaagttgccacccaaaagagcggagggagacatcaagccttattcttcttccgatagagagttcttgaaagtagccgttgagccaccttggcccctgaatagggcgcctagaagggccacaccccccgcacatcctccaccccgctcaagctctttaggcaactctcccgaacgaggcccattacgcccttttgttcctgagcaggagctattgaggtctctgcgcctttgcccgccacacccaaccgctcgattgctgttagccgcagacccgggcggctccccagcacagaggcgccgtacccgcggcaccccccctggcttagtagctcagtcttgctgttattccagacacgggggcgtcaactcgtcaagtcccaatacgggcaaccaggattcgaaacagggtgagcaagaaactaagaaccggtccgcttcagaagagcaggctctttctcaggatgggagcggtgagaaaccgatgcacacagcccccccacaggccccagccccccccgctcaaagctggaccgttggtggggatattctgaacgctcggttcatacgaaatctgcaagagagaaggagcacccggccatggtag

SEQ ID NO: 44103 - DNA, 1002 bp, Artificial Sequence
  Description of Artificial Sequence: Synthetic coding sequence
atggagttccccttcgacgtggacgccctgttccccgagcggatcactgtgctagaccagcatttgcggcccccagcaagaaggccaggcaccacgactccagccagagtcgacttacagcagcaaatcatgacaattatagatgagctgggaaaggcatctgcaaaagcacagaatctgtcagccccaataacttctgccagtagaatgcagagcaaccgccacgtggtttacatactgaaggactctagtgctaggcccgccggaaagggtgccattattggattcataaaagtaggatacaaaaaactcttcgtgctggatgatagggaagcacacaatgaggtggaaccactctgcatcctagacttctacatccatgaatctgtccaacgacacggccatggccgggagttgttccagtatatgcttcagaaagagcgggtcgagccacatcagctggcgattgataggcccagtcagaagcttctgaagttccttaataagcactataatctggagaccacagtacctcaggtcaataattttgtaatcttcgaagggttttttgcccaccaacacaggcccccagctccgtccctgcgcgccactcgacactccagggcagccgccgtcgaccctactccggcagctcccgccaggaagcttccacccaaaagagctgagggggacatcaaaccttattcttccagtgaccgagagtttctgaaggtggccgtggagccgccttggcctctgaacagagcacctaggagggctactccccccgcccacccgcctccccgctcttcatctctcggcaatagcccagaaaggggtcccttgcgtcctttcgtgcctgaacaggagctgctccggtcactgcgcctgtgcccaccacaccctactgcacggctcttgctcgctgccgatccaggcggctctcccgcacagcggcggcggacgagcagtttgcctaggtccgaagaatctcggtactag

SEQ ID NO: 44104 - DNA, 933 bp, Artificial Sequence
  Description of Artificial Sequence: Synthetic coding sequence
atggagttccccttcgacgtggacgccctgttccccgagcggatcactgtcctggatcaacatctgcgcccacctgcgaggaggcccggaaccacaactccagccagagtcgacctgcagcagcaaattatgacaataattgacgagctcggaaaagcatccgctaaggcacagaacctttccgcaccgattacttctgcctcgaggatgcaaagcaaccgtcacgttgtatatattttaaaagactcaagcgcacgccctgctgggaaaggagctattatcggcttcattaaagtaggatataaaaagctgttcgtcctcgatgacagagaagcacacaacgaagtcgagcctctgtgcattctggacttctacatccatgaaagcgtgcagaggcacggccatgggcgggaattattccagtacatgctccagaaggagagagtcgaaccccatcaactggcaattgaccgccccagccaaaagctattaaaatttctgaacaaacattataacttagagacaactgtgcctcaggttaacaacttcgtgatatttgagggatttttcgctcaccagcatccaccagctcggaagctgccgcccaaaagagcagaaggggacattaagccatactcatcctctgacagggagtttctcaaggtggctgtggaaccaccctggcctttgaatcgcgctcctcgaagggccacaccacctgcccatccaccccctcggagttcatctttggggaattcgcccgaacgaggacccctgcgccctttcgttcctgaacaagagctgctccgcagcctccgtctgtgtccaccccacccgacagcgcgcttgttgttggcggccgaccccggcgggtctcctgcacagagaagaaggacctcatcattacctaggtcagaagagtctaggtactag

SEQ ID NO: 44105 - DNA, 1266 bp, Artificial Sequence
  Description of Artificial Sequence: Synthetic coding sequence
atggagttccccttcgacgtggacgccctgttccccgagcggatcaccgtgcttgaccagcacctgcgaccacccgccagaagacctgggaccaccacccccgccagggtggacttacagcaacagatcatgacaataatagacgagctgggtaaagctagcgcgaaagcccagaatctgtccgcaccaatcacgagtgcttctaggatgcagagcaacaggcacgtagtgtacatcctgaaggattcttcagcacgtccagccggcaaaggagccattatcggattcattaaagtcggatataagaaactgtttgtacttgacgaccgggaggcccacaacgaggttgagcctctgtgcatactcgacttttatatccacgagtctgtacagcgtcacggacacggaagagaactgttccagtacatgctccaaaaagaaagagttgagcctcaccaattggctatcgacagaccgagtcaaaagctcctgaagttcctgaataagcactataacctcgagactaccgtgccccaggtgaataacttcgttatttttgagggatttttcgcacaccaacatcgtcctccagctccttcactgcgggccacccggcacagtcgggctgctgccgtcgatcctactcccgctgcgccagctcgtaagctgccacccaagcgcgctgaaggagacatcaagccatattcgtccagtgatagagagttcctgaaagtagcggtggagcccccctggccactgaaccgggcccctaggagagcaaccccaccggctcatcccccaccccggagtagcagcctcggaaatagccccgaaagagggcccttaagaccattcgtgccggaacaggagttgctgcgcagtttgcgcctctgcccccctcaccctaccgctcgcctgcttcttgctgcagaccccggcgggtctcctgctcagaggcggcgcaccaggggtacgcccccaggtctcgttgcacagtcttgttgctattctagacacggcggggtgaacagttccagcccaaacactggcaaccaagatagtaagcaaggagaacaagagaccaaaaaccgaagcgccagtgaggaacaggctctgtcccaagacggatcaggagagaaacctatgcacacggcccctccccaagcgccggcccctcccgctcagagttggacagtggggggtgacatcctgaatgccaggttcatccgcaacctgcaggaacggaggtctaccagaccatggtag

SEQ ID NO: 44106 - DNA, 1230 bp, Artificial Sequence
  Description of Artificial Sequence: Synthetic coding sequence
atgtggctgacctggcccttctgcttcctgaccatcaccctgcgggaagaaggcgtgtgtcacctcgaaagtgtggatctgcagcagcaaataatgaccattatcgatgagctgggcaaggcctcggctaaggcccagaatctctctgccccaatcaccagcgcatccaggatgcagagcaacagacacgttgtctacattctcaaggactctagcgcaagaccagccgggaaaggagcaatcatcggattcattaaggtgggctataagaagttgttcgtgctggatgacagggaagcacacaacgaagtggaacctctgtgcatcctggatttctatatccacgaatctgtccaacgacacgggcacggcagagagctctttcagtatatgttgcagaaagagagagttgagccccaccagctcgcgatcgacagacccagccagaaactcctgaaatttctgaataaacattataacctcgaaactacagtgccacaggtgaacaatttcgtcattttcgaaggcttcttcgcacaccaacaccggccgcccgccccttcactgcgtgccaccaggcactcacgggcagccgctgtcgacccaacacctgcagctcccgctcgaaagctgccccctaaacgcgctgagggcgacatcaaaccatattcttcttccgatcgggaattccttaaggtggccgtggagcccccttggccactgaatcgagcgccaaggagagccacaccaccagcacatcctccgccgcgcagcagctcccttggaaattcacctgagagagggcctttaagaccatttgtgccagagcaggagcttcttaggtccctgcgcctgtgtcctcctcatcctacagcccgtctcctgctcgctgcggaccctggcggttctcctgcacagagacgtcggaccagaggaactcctcctggcttggtggctcagagctgctgttacagccgtcacggaggcgtcaatagctcatccccgaacactggtaatcaagacagcaaacaaggtgagcaggaaacaaagaatcgctccgctagcgaggagcaggctctatcacaggacggctctggcgagaagccaatgcacaccgcacccccgcaggccccagcacccccggctcaaagttggaccgttgggggagacattttgaatgcccgattcatccgaaatctccaggaaagacgaagtacaaggccatggtag

SEQ ID NO: 44107 - DNA, 1266 bp, Artificial Sequence
  Description of Artificial Sequence: Synthetic coding sequence
atggagttccccttcgacgtggacgccctgttccccgagcggatcacggtgttggatcagcacctgcgcccgcctgcacgacgaccgggtactacaaccccggccagggttgacctgcagcagcagatcatgacaattattgatgaacttggaaaggcttctgccaaggcccagaatctgtccgccccaatcaccagtgcttccagaatgcagagtaaccgccatgttgtctatattcttaaggacagctctgcccgccctgcaggaaagggggccatcatcgggttcatcaaggtgggttacaagaagctgtttgtcctggacgatcgtgaggcccacaatgaagtagaacctttatgcatactcgacttctatatccatgagtcagttcaaagacatgggcacggtagggagttgttccagtacatgttacagaaggagcgggtggagcctcatcaattagcaatcgaccggccctctcagaaactgctgaaatttctgaataaacattacaatcttgagacaactgtaccacaggttaataatttcgtcatttttgaaggcttcttcgcacaccagcaccgtcctcccgccccttctctgcgggccaccagacattctagggctgctgcggtggatcctacgccagccgcacctgcacgaaagcttccaccgaagagggccgagggggatattaagccttactcgtccagtgacagggaattcctgaaggtggcggtggaaccgccgtggccattgaatagggcccctcgccgagccacaccaccggctcacccccctccgaggagctcaagtctggggaatagccccgaacgcggccccttgcgacctttcgtccctgaacaggaactgctaaggagtttaaggctctgccctccacatcctacggctcggttgttgctcgctgctgatcctggggggagccctgcgcagcgacgccggacacgaggcaccccaccgggactggttgcgcagagttgttgctacagtaggcacggaggagtaaacagctcttctccaaacacagggaaccaagactctaaacagggcgagcaggaaactaaaaataggagcgcttctgaggaacaggcgttgagccaggacggatccggggagaagcctatgcatacagctccgccgcaggctccagccccgcccgcacagagctggaccgtgggcggggatatcctgaacgcccggtttataagaaatctccaggaacgaagatccacacgtccatggtag

SEQ ID NO: 44108 - DNA, 903 bp, Artificial Sequence
  Description of Artificial Sequence: Synthetic coding sequence
atggagttccccttcgacgtggacgccctgttccccgagcggatcacagtgctagaccaacacctcagaccacctgcccggcgtccagggacaacaacacccgctagggtggatctgcaacagcagattatgacaatcatcgatgagctgggaaaggcaagtgcgaaagcccagaacttaagcgcacccataacttctgcctcaagaatgcagtcaaatcgacatgtggtctatatattaaaggactcatctgcccgaccggcaggaaaaggagccatcatagggttcatcaaggtcggatacaagaaactgtttgtattagatgatagagaagcccataacgaggttgaaccgctgtgcatcctcgatttttacattcatgagagtgtacaaaggcacggacacggtagagagctgttccagtatatgttgcagaaggagcgtgtcgagccacaccagcttgccattgatagaccctcccagaaactgctgaagtttctgaataagcactacaatctggagactaccgtgccacaggtgaacaattttgtcatcttcgaaggttttttcgctcatcagcacccaccagcacgaaaattgccaccaaagagagcagagggcgatattaagccttatagttccagcgatcgagaattccttaaagtggccgtggagccaccttggccactcaatagagctccccgccgagccacaccgcctgctcacccgcctcctaggagctcttcactaggcaatagccccgaacgcgggccactgagaccttttgtgcctgagcaggagctgctgcggtctctacgcctctgccctccccacccaaccgcccggctgctgctggctgcagacccagggggcagtccagcacaacggcgacgcacccggtag

SEQ ID NO: 44109 - DNA, 933 bp, Artificial Sequence
  Description of Artificial Sequence: Synthetic coding sequence
atggagttccccttcgacgtggacgccctgttccccgagcggatcactgtgctagaccaacacctgagaccccccgccaggcgccccggcaccactacccccgcccgggtggatctgcaacagcagattatgaccatcatagatgaacttggaaaagccagcgctaaagcccagaatctttccgcccccatcaccagcgcctcccggatgcaatcgaataggcacgtagtgtatatcctaaaggactcctcggctagacccgccgggaagggggctattatcggtttcattaaagtgggttacaagaagctgttcgtcctcgacgatcgagaggctcacaacgaggttgagcccctttgcattctggatttttatatccacgagtctgtacagcgacatgggcatggacgggagctctttcagtacatgctgcaaaaggaaagggtagagccccatcaactggccatcgataggccctcccagaaactactgaagttcctcaataagcactataacctagagaccacagtcccacaggttaataactttgttatcttcgaaggatttttcgcacatcagcatccccctgcccgaaagctgccccctaaacgcgcagagggtgatattaagccttatagcagtagtgacagggaatttctcaaggtggccgtggagcctccttggcctctgaaccgcgctccccgccgagccaccccaccggcccaccctccgcccagatcttcttccctgggcaactctcccgagaggggaccactcaggcccttcgtgccagaacaggaactgctgagaagtcttaggttatgtcctccacaccccacggcccggctgctgctggcagcggatcctggagggagccccgcccagcgacgaaggacctcgtccctgccgcgtagcgaggagagtagatactag

SEQ ID NO: 44110 - DNA, 1266 bp, Artificial Sequence
  Description of Artificial Sequence: Synthetic coding sequence
atggagttccccttcgacgtggacgccctgttccccgagcggatcacggtccttgaccagcatctccgtcccccagcacggcgacctgggacaacaacacccgctcgtgtggacttacaacaacagattatgacgatcatcgatgagttgggtaaagccagcgccaaagcacagaacctgagtgccccgattactagtgcctccagaatgcagagtaacaggcatgtcgtttatatcttaaaagattcatcagcccgaccggccggcaagggcgccatcatcggcttcatcaaagtagggtacaaaaagctgtttgtgctcgacgacagagaagcccataacgaggtggaaccactgtgtatactggatttttacattcatgaaagcgttcagaggcacggccacgggcgcgagctgtttcagtatatgcttcaaaaggagcgcgtagaacctcatcaattggcgattgatcggccatctcagaaactcctaaagtttcttaacaaacactataatcttgaaactacagttcctcaggtgaacaatttcgtgatctttgaaggcttcttcgcgcaccagcacaggccgcctgccccatccctcagggcaacccgtcattctagggccgcagccgtggatcctacacctgccgcccccgcccggaagctgcccccaaagcgggctgagggggatataaaaccctattcttcttctgatcgcgaatttttaaaagtcgcggtggaaccaccctggcctctgaaccgcgctccgagacgcgccacccccccagcccatccaccccctcgctcttccagcctgggtaacagccccgaacgcgggcccctgcgaccatttgtgcctgagcaggagctgctccgatcattaaggttatgtccaccacatcccacggcacgactcctgttagccgctgatcccggaggaagccccgcgcagcgtagacggaccagggggacccctcccggtctcgtcgcccaaagctgttgctactcaagacacggaggcgtgaactctagttcgccgaataccgggaatcaggacagcaaacagggcgaacaggagaccaagaaccgttcagcatctgaggagcaggccctgtcccaggacggcagtggcgaaaaacccatgcataccgcaccccctcaagcacctgcccctccggctcagagctggacagttggaggggatattctgaacgccaggttcatcaggaatttgcaggaacggagatctacacgaccttggtag

SEQ ID NO: 44111 - DNA, 933 bp, Artificial Sequence
  Description of Artificial Sequence: Synthetic coding sequence
atggagttccccttcgacgtggacgccctgttccccgagcggatcacagtgcttgaccagcacctgcggccacccgcgcggaggcccggaacaactacccccgcccgtgtggacctccagcaacagattatgaccataatcgacgagctcggaaaggcttccgctaaagcccaaaatttaagtgcaccgataacttccgcgagccgaatgcaatctaatcggcatgtggtgtacatccttaaggactcaagcgctaggccggccggaaagggcgccatcatcggttttatcaaggtaggctacaaaaagttgtttgtgctggacgacagggaggcacacaacgaggtggagcctttgtgcatccttgacttttatatacacgaatctgtacagaggcacggacacggccgtgaactgtttcagtacatgctacagaaggaaagggttgagccgcatcagctggctattgatagaccatcccagaagcttctcaaatttctgaataaacactacaaccttgagactactgtaccccaggtgaacaatttcgtcatcttcgaaggattttttgcccaccagcacccacctgcccgaaaattacctcccaagcgcgctgaaggggatataaagccttactcgtcttcagaccgggaatttctgaaggtggcagtggagcctccatggccgctgaacagggcacctcgccgggccactcccccagcccacccccccccccgtagttcgtctctcgggaatagcccagaacgaggaccattgaggccatttgtgccagaacaggagctcctgaggtcactgcgcctctgccccccccacccaacagcccgcctgctgctggccgccgacccagggggctcccccgctcagcgcaggcggactagctctctgccaagaagcgaggagtctcggtactag

SEQ ID NO: 44112 - DNA, 972 bp, Artificial Sequence
  Description of Artificial Sequence: Synthetic coding sequence
atggagttccccttcgacgtggacgccctgttccccgagcggatcaccgtactggaccagcacctgagacctccagcaagacggccgggtacaacaaccccagcccgggttgatctccagcagcagatcatgacaatcatcgacgaactggggaaggcctccgccaaagctcagaacttgtctgcgccaattacaagcgcatctcgtatgcagagcaataggcacgtggtctatatcctgaaggactcctcagcaaggcccgcgggcaagggggcaattattggctttatcaaagtcggctataaaaagctttttgtgctggacgacagggaggcacacaatgaggtagagcctctgtgtatcttagatttctatatccatgagtctgttcagcgacatggccatggccgcgagctttttcagtacatgctccagaaagaacgtgtggagccacatcagctcgccatcgaccgaccatctcagaaactgctgaagtttcttaacaaacactataaccttgagacaactgtgccacaagtaaacaattttgtgatatttgagggcttttttgcccaccagcaccgcccacccgctccctctcttcgggctaccagacactctagggctgcagcagtcgaccccacaccagcagcgcctgccaggaagcttccgccgaagagggctgagggggatatcaagccgtactcttcctcggatcgcgagtttttaaaagtggcagtcgagcccccctggcctctgaaccgtgctcctagacgtgccacaccccccgcccatccaccccctaggtcaagctccctcggcaatagcccggagcgaggcccattaagacccttcgtccccgaacaggaactgttgaggtcgctccgactttgcccacctcatcccactgccagattacttcttgccgcagatcctggaggttctcccgcccaaaggagacgcacgagatag

SEQ ID NO: 44113 - DNA, 1230 bp, Artificial Sequence
  Description of Artificial Sequence: Synthetic coding sequence
atgtggctgacctggcccttctgcttcctgaccatcaccctgcgggaagagggggtttgccacctcgaaagcgtagacctccaacagcagatcatgacaatcattgatgagctggggaaggcatccgccaaagcacagaacctaagcgcccccataacttcagctagccgaatgcaatccaatcggcatgtggtgtatatcttgaaagactctagcgccaggcctgcgggcaaaggagccatcattggtttcatcaaggttggttataagaagctgttcgtcctggacgacagggaggctcacaatgaagtcgaaccactctgtatcctggatttttacatccatgagagcgtccagagacatgggcatggccgcgagttattccagtacatgctgcagaaagaacgggtcgaacctcaccagcttgctatagacaggcctagtcaaaagttactgaaattccttaataagcattacaatctggagacaactgtgccccaggtcaacaattttgtgatcttcgaaggtttcttcgcccaccaacatagaccccccgcgccaagcttgagagccacacgccactcacgagccgctgcagtggatcccacgcccgccgcgccggctaggaagctgccccctaaacgcgctgagggagacatcaagccctactcatcctccgatcgggaatttctgaaagtggccgtggaaccgccatggccgctgaatcgtgcacccaggagagcaactccccccgctcaccccccgccaagatcttcatccctgggtaattcgcccgaaaggggaccacttcggccgttcgtgcctgagcaggagttgctgcgctccctccggctgtgcccccctcaccctaccgctaggcttctgctcgcagccgatcccggcggctcccctgctcagcgacgacgcactcgcggcacgccgcccggtctggtcgctcagtcatgttgttattccaggcatggaggagttaactcatcttctcctaacaccggaaaccaggattcaaagcagggcgagcaggagacgaagaacaggtctgcatcggaagaacaagcattgtctcaggacggatctggcgaaaaaccaatgcacactgctcctcctcaggcacctgctcctcccgcacagtcatggactgtcgggggtgacatactcaacgcccggttcatccggaacttgcaagaacgtaggtcaacgcgcccttggtag

SEQ ID NO: 44114 - DNA, 903 bp, Artificial Sequence
  Description of Artificial Sequence: Synthetic coding sequence
atggagttccccttcgacgtggacgccctgttccccgagcggatcactgtcctggatcagcatctgcgtccccctgcccgacgtccagggacaacgacacctgctcgagtggacctgcagcagcagatcatgactattattgatgaactaggcaaggcctccgccaaagctcagaacctgagtgctcccatcacatccgcgtcacgaatgcaatcgaataggcacgttgtatatatcctcaaggactcttcagcccggcccgccggaaaaggagcgataatcgggttcatcaaagttggttacaaaaaactgttcgtcttggacgatcgagaggcccataatgaggttgagcccctgtgcatcctggacttttacatccatgagtccgtgcaaaggcatggtcatgggagggaactatttcagtacatgctgcaaaaggagagggtggagcctcaccaacttgcgatagatcggcctagtcagaaactactgaagtttctgaacaagcactacaacctggagactaccgtgccccaggtcaacaactttgtaatttttgagggatttttcgcgcaccagcatccacccgctaggaagctcccgcccaagcgcgctgagggagatattaaaccctattcttcgtctgatcgagaatttctgaaagtagcagttgagccaccctggcctttgaacagggcaccacggagggcgacgccaccggcccacccaccgccacgcagcagtagccttggaaactcacccgagaggggcccccttcggcctttcgtccctgagcaggaattgctcaggagcctgcggctctgtcccccacacccaactgcccgcttgttactcgccgcagatcctggaggatcccccgcccagcgccgacgcactcgctag

SEQ ID NO: 44115 - DNA, 1002 bp, Artificial Sequence
  Description of Artificial Sequence: Synthetic coding sequence
atggagttccccttcgacgtggacgccctgttccccgagcggatcacggttttggatcagcacctgaggccccccgcccgcaggccaggtacgaccacacccgcacgcgtggacctgcagcagcagataatgactatcatcgacgaattgggaaaggcttcagcaaaggctcagaatctgtcggcccccataacatccgcaagtcgcatgcagtccaatagacatgtcgtctacatccttaaggactcatcagctaggccggctggaaaaggcgccataataggattcataaaagtggggtataagaaattgttcgtactggatgaccgggaggcacataatgaggtcgaaccgctctgtatacttgatttctatatccacgagagcgtccagaggcacgggcacggcagagagctgtttcagtatatgctgcagaaagagagagtggaaccccaccagctggctatcgatagaccttcccagaagctcctgaagttcctcaataagcattacaatctcgagaccaccgtgccacaggtgaacaactttgttatctttgaggggttcttcgcccaccagcacaggccacctgccccatccctgcgcgccacacggcactctcgggcagccgcagtggatcctactcccgcagcccctgcacgcaaattgccccccaaacgtgctgaaggtgatatcaagccttacagttcaagcgatcgcgagttcctgaaggtggcagtggagccaccatggcccttaaatcgggccccacgccgtgccaccccaccagctcaccccccccctaggtctagttctctgggaaatagccctgaacgcggcccgttacggccatttgttccagaacaggagcttctaagatccctgaggctgtgtcctccccacccgaccgcaaggttgcttctcgctgctgacccaggtggtagtccagctcaaaggcggcgaaccagctcgctcccccggtctgaggaaagtagatactag

SEQ ID NO: 44116 - DNA, 1002 bp, Artificial Sequence
  Description of Artificial Sequence: Synthetic coding sequence
atggagttccccttcgacgtggacgccctgttccccgagcggatcaccgtgttggatcaacatctgcgccccccagcccgcaggcccggcactaccactcctgcccgggtggatcttcagcaacagataatgactatcatcgacgagcttgggaaggcttcagccaaagctcagaacctgtccgcccccatcacctcggcatcacgaatgcagtcaaacagacacgtggtatacattttgaaagactcctcagccagacccgcgggcaagggggcaatcataggcttcatcaaggttgggtacaaaaagttgttcgtcttggacgaccgtgaagcacacaacgaggttgagcctctttgtatcctcgatttctacattcatgagagcgtgcagcgccacggccacggacgagagctgtttcaatacatgctccaaaaggagagagtggaaccacatcagcttgccatagacaggccatcccagaagctgctcaagttcctgaataagcactacaacctggagacaacagtccctcaggtgaataattttgtcatattcgaaggattcttcgctcaccagcatagaccccctgccccaagtctgcgagctacgaggcatagcagagccgccgccgtggatccaacacccgcggccccagctcggaagttacctcctaagagggctgagggggatatcaagccttacagttcgagcgatcgggagtttctgaaagttgccgtggaacctccgtggccattgaatcgagccccccggagagcaacccctcctgcccaccccccccctcggtcctccagtctgggtaatagccccgaacggggtccactgcggccctttgtccccgaacaggagctgcttcggagtctgcggctctgtcccccccatccaactgcccggctcctactggctgccgaccctggaggcagcccagcccagcgccggaggacctcatccctgcctcgaagtgaggagagcaggtactag

SEQ ID NO: 44117 - DNA, 1266 bp, Artificial Sequence
  Description of Artificial Sequence: Synthetic coding sequence
atggagttccccttcgacgtggacgccctgttccccgagcggatcacagtgctggaccagcacctacgcccaccagccaggcggccaggcaccacgacccccgcgcgggtcgatctgcagcagcagatcatgacgatcattgacgaactggggaaggcatccgcaaaggcccagaacttgtctgcacccataacctctgcttcaagaatgcagtctaataggcacgtcgtctatattctgaaggacagtagtgctcgacccgccggcaagggggcaattataggatttattaaggtcggctataaaaagctgttcgttctggacgacagagaggcacacaacgaagtcgagcccctgtgcatcctggacttctacatacatgaatctgttcagcggcacggacacggacgtgaactatttcagtacatgctgcaaaaagagcgggtggaaccccaccagctggcaatcgatcgacccagtcaaaagctgctcaagttcctgaataagcattacaatttagaaactacagtgccccaggtgaataattttgtcatcttcgaggggtttttcgcccatcagcatcgaccgcccgctccctcgctacgagccaccagacactcccgagctgccgcagtcgaccctactccagccgcccccgcacgaaaactgcctcccaaaagggcagagggtgatattaagccatattccagctccgacagggaatttctcaaagtcgcagtggaacctccctggcccttaaatcgggcccctaggcgggcgacccccccagcccatccacccccgagatccagctcactcggcaactcacctgaaagagggccactccggccttttgtccctgagcaagagttgttgagatccctgcgcctgtgccccccacacccgaccgcaagactgctgctggcggctgaccccgggggcagtcccgcccagcggcgtcggactcgcggaactccccctggattagtggctcaatcctgctgttactcacgacacggcggcgtgaactcttcttcgcctaacactggtaaccaagactccaagcagggggagcaggagaccaaaaaccgttccgctagcgaggagcaggctctttcacaagacggttctggcgagaagcccatgcacactgctccacctcaagcccctgctcccccggctcaatcgtggaccgtaggaggagacattctgaatgcgcgattcatcaggaacctgcaagaaagacggtctacgcgtccttggtag

SEQ ID NO: 44118 - DNA, 933 bp, Artificial Sequence
  Description of Artificial Sequence: Synthetic coding sequence
atggagttccccttcgacgtggacgccctgttccccgagcggatcaccgtccttgaccaacacctgaggcccccagcccgccgacctggcactactactccagctagggtagacttgcagcagcagataatgactattatcgacgaactcgggaaagcgtctgcgaaggcacagaaccttagcgctcctatcacaagtgcaagccggatgcagtctaatagacatgtcgtctacattcttaaggattccagcgcaagaccagccggcaaaggtgctatcatcggattcatcaaggtgggatataagaagctttttgtactggatgaccgggaggcgcacaacgaagtggaacctctgtgtatcctggatttctatattcacgagtccgtgcaacgacatggacatggacgagaactgttccaatacatgttgcagaaagagagggtggaaccacatcagctggcaatcgatcgtccaagtcagaagctgctcaagttcctgaacaagcattataatctcgaaactaccgtgcctcaggtgaataatttcgtgattttcgaaggcttctttgctcaccagcatcctccagctcgcaagctccctcctaagcgggcagagggcgacataaagccgtactcctcatccgatcgcgagttcctcaaagtcgctgttgaaccgccctggcccttgaaccgagccccacgtcgtgctacgccaccagcgcatcctccccccaggtctagcagtcttggcaactctccggagaggggcccacttaggcccttcgtgcctgaacaggagttgcttagatcgctcagactgtgccccccccaccccaccgctcgactgctgttggcagccgaccctggcgggtcccccgctcaacgccgccggacatcatccctgcccagatcagaagaatcccgatactag

SEQ ID NO: 44119 - DNA, 1002 bp, Artificial Sequence
  Description of Artificial Sequence: Synthetic coding sequence
atggagttccccttcgacgtggacgccctgttccccgagcggatcaccgtgctggatcagcatctgagacctcctgccaggagaccaggcacgaccaccccagcacgcgttgacctgcaacaacagatcatgaccatcattgacgagctaggcaaggcctcagccaaggcccaaaatctgtcagctcccatcacttctgccagtagaatgcagtcaaaccgccatgtcgtttacattttaaaggactcttcagcccgtcccgctggtaaaggagctataatcggatttatcaaggtcggctataagaagctgttcgttttggatgaccgggaggcccacaacgaagttgaacctctgtgcatcctcgatttctatatacatgagagcgtgcagcgacacggccacgggagagagttgttccagtatatgctgcagaaggagagggtagaaccccaccagttagcaatcgacaggccgagccaaaaactcctgaagtttctcaacaagcattacaacctcgagaccactgtgcctcaggttaacaacttcgtgattttcgaagggtttttcgcgcatcaacataggccgccagcccccagtctgagggcgacacgccactcacgcgccgccgccgtcgaccccacacccgctgcacccgcccgcaaactgcctcctaaacgggctgaaggcgatatcaaaccctactcttcgtctgacagagaattcctcaaggtagctgttgaacctccttggccactcaacagagcgccgagaagggccactcctcccgctcaccccccccccagaagcagctccctgggaaatagccctgagcggggtcccttaaggccatttgtccccgaacaggagttgctaagaagtctgcggctctgcccgcctcatcctaccgctcgactgcttttggctgccgaccctggagggtccccggcacagagaaggcggaccagctctctcccacggtctgaagagtctcgttactag

SEQ ID NO: 44120 - DNA, 1002 bp, Artificial Sequence
  Description of Artificial Sequence: Synthetic coding sequence
atggagttccccttcgacgtggacgccctgttccccgagcggatcaccgtgcttgaccagcacctgcgtccgcctgcaaggcgccccgggactactaccccagccagggttgacctccagcagcaaatcatgacgattattgacgaactcgggaaggctagtgcgaaggcccaaaacctgtccgcacccatcaccagcgcttcacggatgcagtccaataggcatgtggtgtacatcctgaaagactcctcggccaggcctgctggaaagggcgcgattattgggttcattaaagttggctataagaagcttttcgtcttagacgatcgggaagcccataatgaggtggaaccgctgtgcattctggatttctatattcacgagagcgtgcagagacacggacatggtagggagttattccaatacatgttgcagaaagagagggtggagccgcatcagctagctatagaccgcccaagtcagaaactgctcaaatttctgaataagcactacaatctggaaacaacagtcccacaggtaaataattttgtcatctttgaaggcttcttcgcacaccagcaccggcccccagccccctcactgcgggctacccgtcatagcagggcagccgccgtggaccccacccctgccgctccagcacgtaaactcccccctaaacgcgccgaaggagatataaagccctactccagttccgatagggagtttcttaaggtggcagttgagcccccttggcccttgaaccgggcaccccgacgagccactcccccagcacacccacccccaagatctagctccctcggcaattctcctgaacgtgggcccctacggccttttgtgccagagcaggagctcctgcggtcactgcgcctctgcccaccacaccccacggcacggctccttctggctgctgaccccgggggcagtccagctcagagacgacggaccagtagccttcctaggtctgaagagagtcggtactag

SEQ ID NO: 44121 - DNA, 972 bp, Artificial Sequence
  Description of Artificial Sequence: Synthetic coding sequence
atggagttccccttcgacgtggacgccctgttccccgagcggatcaccgtgttggatcagcatcttcggccgccagcccggcggcccgggacgacaacccccgcaagggttgacctgcaacagcagataatgacaatcattgatgaacttggaaaagcctctgcgaaagcccaaaatctctccgcccctattaccagtgctagtcggatgcagtccaatagacatgtcgtgtatattctgaaagactcatccgccaggccggcgggcaagggcgcaataatcggctttatcaaagttggctataagaaactgttcgtgctggacgaccgtgaggctcataacgaagtggagcctctctgcatcctcgatttctatattcacgagtccgtgcagagacatggtcatggccgagaattgttccaatacatgctgcagaaagagcgagtggagcctcaccaacttgcaattgatcggcccagtcagaaactgttgaagtttctgaataagcattacaacctcgagactaccgtccctcaagtgaataactttgtaatattcgagggcttttttgctcatcaacacagaccgcccgcacccagcctgcgcgctactagacatagtcgggccgcagctgtcgatcccactccagccgctcctgctcgcaagctgccacccaaacgagccgagggtgatatcaagccgtactccagcagcgatcgcgagttcctcaaggtggccgtagagccgccatggccactgaatagagctcccagacgtgccacaccacccgctcaccccccaccccgcagttcctctctgggcaactctcccgagagaggaccacttagacccttcgtaccggagcaggagctactgcgctctttgagactctgtccgccacaccccacagccagattgctgctggctgccgatcccggagggtcccccgcccaacgcagaagaaccagatag

SEQ ID NO: 44122 - DNA, 1230 bp, Artificial Sequence
  Description of Artificial Sequence: Synthetic coding sequence
atgtggctgacctggcccttctgcttcctgaccatcaccctgcgggaggaaggggtgtgtcacctggaatccgtcgatctccagcagcaaatcatgacaattattgacgagctggggaaagccagtgctaaagcacagaacctgtctgcccctatcaccagcgccagtcgtatgcaaagtaacaggcatgtcgtgtacatactgaaggattcctctgcaagacccgcgggtaaaggcgctataattggattcatcaaggtgggctataagaaactcttcgtgctggacgaccgcgaggctcacaatgaggttgaacccttgtgcatcttggacttctacatccacgagagtgtacagagacacggacatgggcgggaactattccaatacatgctccaaaaggagagggtggagccccatcagctcgccatcgaccgaccttctcagaagcttttgaagttcttgaacaaacactataacctagaaaccaccgtgccccaggtgaataacttcgttattttcgagggctttttcgcccaccagcatcgaccccccgcgccctccctgcgcgctaccaggcacagccgcgccgccgccgtggacccaacacccgccgcccccgcgcggaagttgcctcctaaaagagcagagggggatattaagccctattcctccagcgacagagaatttctgaaggtggctgtggaacctccctggccacttaatcgcgccccgaggcgggccaccccaccggcacatcctccgccacgctcaagttccctgggcaactcccctgagcgcggtccattgcggcccttcgtccccgagcaggagctgctgagaagcctgcggctttgccccccccatccgacagccaggctcttgcttgcagccgaccccggtggatccccagcacaacgacggaggaccaggggcacaccccccggtctggtcgctcagtcttgttgctatagccgccacggtggagttaactcttcctcgcccaatactggcaaccaggactccaagcaaggggagcaggagaccaagaaccgatctgcttctgaagagcaggccctttctcaggatggaagtggtgaaaagccaatgcataccgctcctccacaggcaccagcgcctcctgctcaatcttggaccgtgggcggagacattctcaatgcccgcttcatccggaatctgcaggagcgaagaagtacacggccgtggtag

SEQ ID NO: 44123 - DNA, 1197 bp, Artificial Sequence
  Description of Artificial Sequence: Synthetic coding sequence
atggagttccccttcgacgtggacgccctgttccccgagcggatcactgtcttggaccagcatctgaggccacccgctcgaaggcctgggaccaccactcctgcaagggtggacctgcagcagcagattatgacaatcattgacgagctggggaaggcatccgccaaagcccagaatctttccgcacctattaccagcgcttcaagaatgcaatccaaccgacacgtggtgtatatactgaaggattcctcggctcgccccgccggcaaaggcgccattattggctttataaaagtgggctataagaagctctttgtgctggacgatcgggaagctcataatgaggtcgagccactttgcatactagacttctatatccatgaaagcgttcagaggcacgggcacggccgggagttgtttcagtatatgttgcagaaagaacgggttgagccccaccagcttgcgatcgatcgtccgagccagaagttgctcaaatttttgaacaaacactataatttggaaacaacagtcccccaagtcaataatttcgtcatctttgagggtttttttgcccaccagcatcctcccgcgagaaaactaccccccaaaagggcagagggcgacatcaagccctactcaagctctgaccgggagttcctgaaggtggcagtcgaacccccatggccgctcaatcgtgcacccaggcgagctaccccacccgcccaccctccgccaaggagttccagtctcggaaattcccccgagcggggacctctacgtcctttcgtgcctgaacaagaactgcttcggtctctgagactctgccccccgcatccaactgctcggcttcttctggccgcggaccccgggggatctccagcccagaggaggcggacgcgcgggacgcccccggggttggttgctcagtcatgttgttacagtagacacggcggagtcaacagcagttctcctaatactgggaatcaggacagcaaacagggagagcaggagactaagaaccggtccgccagcgaggagcaggctctgtcacaggatggctcaggggagaaacctatgcatacagccccgccacaggcgcctgcccctccagcacagtcctggacggttggcggtgacattctcaacgcccggttcatcaggaacttgcaggagcggcgctcaaccaggccctggtag

SEQ ID NO: 44124 - DNA, 1197 bp, Artificial Sequence
  Description of Artificial Sequence: Synthetic coding sequence
atggagttccccttcgacgtggacgccctgttccccgagcggatcacggtgcttgatcagcacttacgcccccccgcccggagacctggtactacgactcccgctcgcgttgacctgcagcaacaaataatgacgattattgacgagttggggaaggccagtgcgaaagcgcagaatctttcagccccaattactagcgcttctaggatgcagtccaaccggcacgtggtgtatatccttaaagatagcagtgcaaggcctgctggcaagggggcaatcatcggatttatcaaggtggggtataaaaaactttttgtactggacgaccgggaagcccacaacgaagtggaacctttgtgcattctagatttttatatacacgagtctgttcagagacatggacatggaagggaactctttcaatacatgctccagaaagagagagtagagccccaccaactggctatcgacaggcctagtcagaaattgctgaagtttctcaacaaacactataatctggagacaactgtccctcaagtaaataatttcgttatcttcgagggcttcttcgcccaccagcacccccccgcccggaagctccctcctaagagagcggagggcgacataaagccatattccagtagtgaccgggagttcttgaaagtcgctgtggagccgccatggcccttgaatcgtgctccccgccgtgcaacacctccagcacacccacccccacgaagttcatccctggggaactcaccagagcggggccccctgagaccattcgtgccagaacaggaattacttcggtctctccggctgtgtcccccacacccaacagcacgactgctccttgcagccgacccaggtggatctcctgctcaacgaagaaggactcgaggcactcccccgggactggtagcccagtcttgttgttactcacgtcacgggggagtgaactcctcatctccaaataccggcaatcaggacagcaaacaaggggaacaggagacaaagaacagatcagctagtgaagagcaggcgctgtcccaggatgggtctggggaaaagcccatgcataccgcccctccgcaagctccagccccgcctgctcagtcctggaccgtgggcggcgacatactgaatgcaaggttcattcggaatttacaggagaggaggtccaccagaccttggtag

SEQ ID NO: 44125 - DNA, 1197 bp, Artificial Sequence
  Description of Artificial Sequence: Synthetic coding sequence
atggagttccccttcgacgtggacgccctgttccccgagcggatcacagtgcttgatcaacacctacgcccacctgcgagacgccccgggacaactacaccggcacgtgtcgatctgcagcaacagatcatgaccataattgacgagctgggaaaagcctccgccaaagctcagaacctttctgcacctattactagcgcctcgaggatgcagtcaaataggcacgtggtctatatcctcaaagatagctctgccaggcctgccgggaagggggcgatcataggcttcatcaaagtcggatataaaaagctttttgtgctggatgatcgagaggcccataatgaggtggaacctttgtgtatcctggatttctacattcatgagtccgtacagcgtcacggccatggccgggaattgttccagtatatgttgcagaaagaaagagtggaacctcatcaacttgccattgatcggccaagccagaaactccttaagtttcttaataaacactataacctggaaacaaccgtcccccaggtcaataacttcgtgatttttgagggctttttcgcccatcagcatccgccggcccgcaaattaccacctaaaagagcagagggcgatatcaaaccctattcttcctcagaccgggagtttctgaaagtggccgttgagcccccatggcctcttaatcgcgccccaaggagagcaacccctcccgcacacccaccccccagatcttcctccttggggaattctccagaacgagggcccctgcggcctttcgtcccagagcaggagctgctccggagcttacggctctgtccacctcatcccacggcgagactccttctcgccgcggatccaggggggtcaccggcgcagcgaaggaggaccagaggaaccccacctgggcttgtcgcacagagctgttgctatagcaggcacggcggtgtgaactcatcatcccccaataccggtaaccaggacagcaagcagggagaacaggagaccaaaaacaggtcagcttccgaggagcaggcactttcccaggatggatccggcgagaaaccaatgcatacagcccctccgcaggcacccgcacccccagcccagtcttggacagtcggtggggacattctcaacgccaggttcatcagaaatcttcaggagagaaggagtaccaggccgtggtag

SEQ ID NO: 44126 - DNA, 1197 bp, Artificial Sequence
  Description of Artificial Sequence: Synthetic coding sequence
atggagttccccttcgacgtggacgccctgttccccgagcggatcactgtgctcgatcagcatcttcggccacctgcccggagacccgggacaaccacccctgcacgagttgacctccaacagcagattatgactatcatcgatgaactcggaaaagcctctgcaaaagcacagaacttatctgcacctataacgagcgcatctcgtatgcagtcaaatagacacgtcgtgtacatactgaaggactctagcgccagacctgcagggaagggggcaatcatcggctttattaaggtagggtataagaaattgttcgttcttgatgaccgcgaagctcacaacgaagtggagcccctatgcatcctggatttctacatccatgagtccgttcagagacatggccatggccgtgagctatttcagtatatgcttcaaaaagagagggtggagcctcaccagctggccatcgaccgtcctagccagaaactgctgaagtttctcaataaacattacaatctcgagacgacggtgccacaggtgaacaactttgtgatttttgagggatttttcgcgcaccagcatccacccgcgagaaaactacctcctaaacgcgcggagggagacattaagccatactcctcttccgaccgcgagtttcttaaggtcgccgtcgaaccaccctggcccctgaaccgcgcccctagaagggccactccaccagcacatcccccaccacgctcttcttcgctgggcaattcccccgaacgtgggccactgcgccccttcgtgcccgagcaggagctgctgagaagcttgcggctttgccctccccatcccactgcccgcttgctgttggccgccgaccccggtgggagcccggctcagagaaggcgaactagaggtacgccacccggtttggtcgcccaaagctgttgttattcgcggcatggcggcgtaaatagtagctccccaaacactggtaatcaggactcaaagcagggggagcaggaaactaaaaataggagcgcgtccgaggaacaggcgctcagccaggacgggtctggcgaaaaacccatgcatacagcccccccccaggcccctgcgcctcctgcccagagctggactgttgggggagacatcttgaacgcgcggttcatacgaaacttgcaagagcgccgatccacaaggccctggtag

SEQ ID NO: 44127 - DNA, 1197 bp, Artificial Sequence
  Description of Artificial Sequence: Synthetic coding sequence
atggagttccccttcgacgtggacgccctgttccccgagcggatcactgttctggaccagcatctcagaccccctgctcgaaggcccggaacaaccacccccgccagggtggacctgcagcagcagatcatgaccattatagatgagcttgggaaagcatctgcgaaggcccagaacttgtctgcccctattacttcagcaagccggatgcagtctaaccgccacgtcgtgtacatccttaaagatagctctgccagacccgccggcaagggagccattattggcttcatcaaggtggggtacaaaaagctattcgtgttggacgatagggaagcgcataatgaggtggaacccctgtgcatcctggacttttatattcatgagagcgtacaaagacacgggcatggcagggagctgtttcagtacatgttgcagaaagagcgagtcgaacctcaccagctggctattgaccgtccctctcagaaattgttgaagttcctgaataagcattacaatctggagacaactgttccacaggtgaacaattttgtgattttcgaaggcttcttcgctcaccagcaccctcctgcgcgaaaattaccacccaaaagagcagaaggggatatcaaaccttattcatcctcggacagagagtttctgaaggtagcagtcgaaccaccttggccgcttaaccgagctccccggcgcgccaccccgcccgcccaccccccaccccggagctcatccctcgggaatagcccagagcgtggcccacttagacctttcgtgccagagcaggagctcttgagaagtctgaggctgtgccccccccaccctacagcccgtttgctgctcgccgctgatcctggcggatctcctgcccaaaggaggaggaccagaggtacacccccaggtctagtcgcacaaagttgctgttactcccgccatgggggtgtgaactcctccagtcccaacaccggcaaccaggatagtaagcaaggagagcaggagaccaaaaaccgttccgcctcagaagagcaagcactgtcccaggacgggtctggcgaaaagcccatgcacaccgcgcccccacaggctcccgcacctcctgcccagagttggaccgtaggcggcgacatattaaacgctcgtttcatccgaaacctccaggaaaggcgttccacccgaccctggtag

SEQ ID NO: 44128 - DNA, 1197 bp, Artificial Sequence
  Description of Artificial Sequence: Synthetic coding sequence
atggagttccccttcgacgtggacgccctgttccccgagcggatcacagttctggaccagcatttgcgtcccccagccagaagaccagggactacaacgcctgcccgggtcgatctgcagcagcagatcatgaccatcattgacgaactgggcaaggcgtccgccaaagctcaaaatcttagcgccccgataaccagtgcttcaaggatgcagagcaacaggcatgtcgtgtacattctaaaagactcctcagcaagacccgcaggcaaaggcgctattatcggttttattaaggtcggctataaaaaattgttcgtgcttgatgatcgcgaggctcacaacgaggtggaacccctgtgcattctggatttttatatacatgaatccgtccagagacacgggcatggcagagagctctttcagtacatgttgcaaaaggagagagtcgagccccatcagttagccattgatcgtccatcccagaaactgctgaaatttctgaataaacactacaacttggagacaactgtgcctcaggtcaataattttgtaatttttgaaggattcttcgcccaccaacaccctccagctaggaaacttccaccaaagcgggccgaaggagacataaagccttacagctcttccgaccgcgagttcctgaaggtggccgttgagccaccttggccgcttaaccgggctcctagaagggcaacgccaccagctcacccccccccacgaagtagcagcctgggcaattctcccgagcgcgggcccctcagaccgttcgtcccggaacaggaactgctcagaagcctccggctatgccccccgcatccaaccgccaggcttctcctcgccgctgatcccggaggttcacctgctcaacgacgacggactcgcggtaccccacccggccttgtggcccagagctgctgctactcccgccatggaggcgtcaactcttccagccccaacaccggcaatcaagacagcaagcagggcgaacaggagacgaaaaatcgctcagccagcgaggagcaggctctgtcccaggacgggagcggtgagaagcccatgcacacggcccccccacaggcccccgccccgcctgctcagagttggacggtgggaggtgatatactgaatgctaggttcattagaaatctccaggaacgccgcagtacgcgaccatggtag

SEQ ID NO: 44129 - DNA, 618 bp, Artificial Sequence
  Description of Artificial Sequence: Synthetic coding sequence
atgagcttcgccaccaagttcagcgactacttcctgctgatcgaggacaacgtgtttttcgccccaaactttgtgacacatattcacagcagagtaacaactatgaagtccaactcttgggtattaatggagttctccaatatgggtttcctgggcaaattgtttcactcccgagatctcccactgctggcacactttctgctccttttttataaagaaaaaccactggactctctgatctcacattttcacaccctgttggtgcaagagagtcccatcctgtgtcggcctttcctcttctattgtcgggtgagctacaccgcatttgaccacaagcaaaaagccacagctttgcagaaaaagaacgccgacggcccgaataatccaccgggagccgtgtttacagacatgcaggtgagcgacgtgcatttcccatgggaggcttacactctcgatgagtcttttttctggacccataatatttccataggaaaccatctgactgtgatcctcaaccacccagctaacctgagtagagtgcaggtcatgaccggctcaatagtggagtgggaggtgcgacccggtgagggcgctgggggcgctggactgcccacttag

SEQ ID NO: 44130 - DNA, 618 bp, Artificial Sequence
  Description of Artificial Sequence: Synthetic coding sequence
atgagcttcgccaccaagttcagcgactacttcctgctgatcgaggataacgtcttttttgcccccaacttcgtcacccacatacattctcgagtgacgaccatgaaaagtaactcctgggtcctaatggagttctcaaacatggggttcttggggaagctgtttcacagccgtgacctccccctgcttgctcacttcctgctactcttctataaggagaagccactggattcacttatcagtcattttcacacactcctcgtgcaggagtcacccatcctttgtaggccctttctgttttactgcagggtctcgtatactgctttcgaccataagcaaaaggccacagccctccagaagaaaaacgctgatgggcccaacaaccctccgggcgctgtgttcaccgatatgcaggttagcgatgtgcacttcccgtgggaggcctacaccctggacgagagctttttttggacccataacatttcaatcggcaaccatctgaccgtgatccttaaccatccagcaaatctttcacgcgtgcaagtgatgacgggaagtatagtcgaatgggaggtaagacctggcgagggcgccggcggtgccggactgcccacctag

SEQ ID NO: 44131 - DNA, 6513 bp, Artificial Sequence
  Description of Artificial Sequence: Synthetic coding sequence
atgaaggacagcgagggcccccagcggccccccctgtgcttcctgtctaccctgctgtctcagaaggtacctgaaaaatccgatgctgtactccgctgtattatctctggccagcccaagccagaggttacttggtacaaaaatgggcaggccatcgatggatcgggaattatcagcaattacgaattttttgaaaatcagtacattcacgttctgcatctgtcctgctgcactaaaaatgacgcagcagtgtatcaaatttctgcgaagaactctttcgggatgatttgctgcagcgcttctgtcgaggtagaatgttcgagtgagaatccccagctatcacctaatctggaagacgatcgggaccgcggatggaagcatgagacgggcacccatgaggaggagcgtgccaaccagattgacgagaaagagcacccatataaagaggaggaaagcatctcccctggtacccccagatctgctgatagttcgcctagcaagagcaaccacagtctgtcccttcaatcactggggaacctggacatcagcgtcagctcttcggagaaccccctgggcgtgaaggggacaagacacacgggggaggcttatgacccatctaacacggaagaaatcgctaatgggcttttgttcttgaactcatcacacatctacgagaagcaggatcgttgctgtcacaaaacggtccacagtatggcttctaagttcactgatggtgatctgaataatgacggaccccacgacgagggcctgaggtcctctcagcagaacccaaaggtacagaaatatatttccttttccctcccccttagcgaagccaccgcacatatctatcctggtgactccgcagtggccaacaagcagcccagccctcagctgtcctctgaagactctgactccgactacgaactgtgtccagaaattactcttacctacactgaagagttcagcgacgacgatctggagtaccttgagtgttcggacgtaatgacagactacagcaacgcagtgtggcagagaaacctcttgggaacagagcacgtctttcttctggagtcagatgatgaagagatggaatttggcgagcactgccttggaggatgtgaacactttttgagtgggatgggctgtggcagtagggtgtccggggatgccgggcccatggtggcaactgctggcttctgcggccaccattcacaaccgcaagaggtgggggttagatcatccagggtctcaaagcacggtccgtcatctccgcagaccgggatgacactgatccttgggccacaccaggacgggacatcatccgtgactgagcagggcaggtacaaattacccactgctcccgaggccgctgaaaacgattatcccggcattcagggcgaaacacgagatagtcatcaggccagagaagagttcgcctcagataatttactcaatatggatgagtccgtgcgggagactgagatgaaactgctgtcgggggagtcagagaacagtggtatgagtcagtgttgggaaactgccgcagacaaacgggtcggcggcaaagatctctggagcaagagaggctcacgcaaaagcgctcgcgtgaggcagcctgggatgaagggaaaccccaagaagccaaacgctaacttgcgcgagagcacaacagaaggaaccctccatctctgcagtgccaaggaaagcgctgagccaccattaacacagtcagacaagagggaaacttcacacacgaccgccgctgctaccggaaggtcatcccatgccgacgcccgcgagtgtgctattagtacacaggccgagcaagaagcaaaaaccttgcagacttccaccgatagtgtttctaaggaggggaacactaactgcaaaggcgagggcatgcaagtgaacactctgtttgaaacaagccaggtccctgattggtccgatccaccgcaagtccaggtgcaggagaccgtccgggagactatcagctgctcacagatgcccgcctttagcgagcccgccggggaagagtcgcctttcaccggtacaacgactatcagcttctcaaaccttggcggcgtgcataaagaaaatgccagcctggctcagcacagtgaggtaaaaccctgtacgtgtggtccacaacatgaggagaaacaggaccgggacggaaatattcccgataacttccgagaggacttgaagtatgaacagagcatatcagaggccaatgacgaaaccatgagtcccggggttttcagtcgacatctgcccaaggatgcgcgtgcggacttcagagagccagtggctgtgagcgtggcttctcccgagcccacggataccgccctcaccttagaaaacgtatgtgacgaaccccgcgacagggaagctgtctgtgcaatggagtgttttgaggccggggaccaagggacatgttttgatacaattgactcgctcgtcggacggcctgtggacaagtatagtccacaagaaatctgtagcgttgacacagagctggctgagggccagaacaaggtgagcgacctttgctcctccaacgataagacacttgaggtctttttccagactcaggtctcggagacctccgtgagcacatgcaaatctagcaaggacgggaatagcgtcatgagcccactgtttacctccaccttcactttgaacatcagccacaccgcatcggaaggcgctactggggagaatcttgccaaagttgagaactccacttatccgcttgccagtactgtccacgcgggacaggaacagcccagtccatcaaacagcggcggcttggatgagacacagttgctgagcagtgaaaataatccattagttcaatttaaagagggcggtgacaagtctccctcgccttctgcggccgacacgaccgcaacccctgcctcttattctagcatcgtttccttcccgtgggagaaacctacgacactcactgccaacaacgaatgtttccaggccactcgggagactgaagatacaagcacagtgacaatcgcgaccgaggtgcaccccgcgaagtacctggcggtctccatcccagaggataaacacgcaggcggaaccgaagagcggttccccagagcctcccacgaaaaggttagccagtttccatcgcaagtgcagctcgatcacattctgtccggcgcaactattaaatcaaccaaagagctgctgtgtcgagctcctagcgtgcctggcgtaccccatcacgtcctgcagctgcccgagggtgaaggtttttgtagcaattccccgctgcaggttgataatctgtctggagacaagagtcaaactgtggacagagccgattttcgatcttatgaagaaaacttccaggagagaggaagcgagaccaaacaaggcgttcaacagcaaagcttaagccaacagggatccttatcggcacctgacttccagcagtcccttcctacgacaagcgcggcacaggaagaacggaatcttgtgccgaccgcccattctcccgcatcttcaagagaaggtgccggccagcgttctggctggggcacgcgggtgagtgttgtcgcggagactgccggcgaggaagattcccaagctttgagcaatgttccttcactctctgatattctcttagaggagtcaaaagagtatagacctggcaactgggaagcgggcaataaactaaagattatcacactcgaggccagtgcttccgagatctggccgccgcgtcaactcacgaattcggagtcaaaggcctccgatggcggcctcataattcctgacaaggtgtgggcggtgccagatagcctgaaagccgacgctgtggtgccagaactagctccctccgaaatagctgccttggcccattctccagaggatgctgagtctgctctggccgattcacgcgaatcgcataaaggggaggagcctaccatcagtgtgcactggagatctttgagctcccgaggattcagccaaccaaggctattagagtcatcagttgaccccgttgacgaaaaggaactgagtgtgaccgattctctctctgctgcttcagaaaccggaggaaaagaaaacgtgaataacgttagtcaggatcaggaggagaagcagcttaagatggatcacacggccttcttcaaaaaatttttgacctgcccaaaaatcctggaatcaagcgttgaccccattgatgaaatctctgtgattgagtacacaagggccggtaaaccagaacctagtgaaactacccctcagggcgccagggagggcggtcagtccaatgatggcaacatggggcacgaagctgagatacagccagccatccttcaggtgccttgcctccaggggaccattttgtcggagaaccgtatctctcgcagtcaggaggggtcgatgaagcaagaagcggagcagatccaacctgaggaggcgaaaactgcgatatggcaggttctgcaaccgtctgagggcggcgaaaggattccttctggctgctcaataggccagatacaggagtcctctgacggatccctgggcgaggcggagcagtccaaaaaagacaaggcggagctgatctcgccaacgtccccactttcctcgtgcctgccgattatgacccacgcgtctctgggggtggacacacacaattcgactgggcagattcacgacgtccccgagaatgacattgtggaacctaggaaaagacagtacgttttccctgttagccagaagcgagggaccatagaaaacgaaaggggaaaacctctacccagttctcccgatctgaccagatttccatgtacctctagcccagagggcaatgtgacagacttcctgatcagccacaaaatggaagaaccaaaaatcgaagtcctgcaaatcggagaaactaaacctcctagctcctcctctagctctgccaaaacactggctttcatatcgggtgaacgcgagcttgaaaaagcgcctaaactgctccaagacccttgtcaaaagggaacgctggggtgcgccaaaaaatccagggagcgggagaagtcactggaggcccgggctgggaaaagccctgggacgcttaccgctgtcacaggctcggaagaggtcaaacgcaagccagaggcccccgggtccggacacctcgccgaaggcgtcaagaagaagattctgagtagggtagccgcgctccgcttgaaattagaggagaaagagaacattcggaaaaacagcgcgtttttgaaaaaaatgcctaagctggagacatcactgtcccacacggaggagaaacaggacccaaaaaaaccttcctgtaagagggaaggcagggccccagttttattaaagaagattcaggctgagatgtttcccgagcacagcgggaacgttaagctctcatgccagttcgcagaaatccatgaggatagtacgatatgttggacaaaggattctaagagcattgcccaggtacagagatccgctggtgacaactcgactgtgagttttgctatcgtccaagctagtcccaaggaccagggtctttattattgctgtatcaagaattcttatggtaaggtgactgcagaattcaacctgaccgcggaagtgctcaaacaactgtcctcacgtcaggatacaaagggttgtgaggaaatcgaattcagccagctgatctttaaagaggatttcctgcatgactcttacttcggcggacggcttagagggcagattgctaccgaggagcttcactttggagaaggcgtgcaccggaaggcatttcgctccactgtcatgcacggtctgatgccagtttttaaacccggccacgcctgcgtgctcaaagtccataacgctatagcgtacggaaccaggaacaacgacgaactcatccagcgtaattacaagctggccgcccaggaatgttatgtgcagaataccgctcgctactatgcaaagatttatgcggcagaggcacagcctctcgaagggtttggcgaagtgcccgaaatcatacctatattcctgatccaccgccctgagaacaatattccatacgccacagtcgaggaagaactgatcggcgaatttgtcaagtatagtatcagggatggcaaggagatcaattttctgcggagggagtctgaagctggccaaaaatgctgtacttttcagcactgggtgtaccaaaagacaagcggctgcttgctagtcacggatatgcaaggtgttggaatgaaattgactgacgtcggaatcgcgacacttgccaaagggtacaaaggtttcaagggcaattgttctatgacctttatagatcagttcaaggctttacaccagtgtaacaagtattgtaagatgttaggacttaagagtctccagaataacaaccagaaacagaagcagccgtctattggcaagtctaaggtccagaccaatagcatgactatcaaaaaagccggccctgaaaccccaggggaaaagaaaacctag

SEQ ID NO: 44132 - DNA, 1230 bp, Artificial Sequence
  Description of Artificial Sequence: Synthetic coding sequence
atgcggggcgagcagggcgccgccggcgcccgggtgctgcagttcacaaattgccggatactaagaggcggtaagctgttacgagaagacctgtgggtgcgtgggggacggatcttggatcccgaaaagctgttctttgaggaacgaagggtcgctgacgaaagacgcgattgcggaggccgaatcctggcccctggattcattgatgtgcagattaacgggggcttcggggtcgatttttcccaggcaaccgaggatgtcggtagcggcgtggctctggtggctcgcagaattctctctcatggcgtgacaagcttttgtccgacccttgtgacttctcctccagaagtttaccataaggtggtgccccaaatccccgtcaaatcggggggcccgcatggtgccggagtgttgggtctccacctggagggcccctttattagcagagaaaaacgaggagcccaccctgaagcacacctgaggtcatttgaagccgacgcattccaggatttgttggccacttatggcccacttgacaatgtgcggattgtaacactggcccccgaactgggacggagccacgaagtaattagggcactaaccgcacgcggaatatgcgtgtcactggggcattctgtggcagatcttcgtgcggccgaggatgctgtttggtcaggagccacatttatcactcatctgttcaatgcaatgcttccattccaccatcgcgatcccggtatcgttggcttgttaacctccgaccgcctgcccgctggacggtgtattttctatggtatgatcgccgatggaacccacacaaatcccgctgccctgagaattgcccacagggcccacccgcaaggtctcgtgctcgtgactgatgcaatccccgcactgggcctgggcaacggccgccataccttaggtcagcaagaagtcgaggtcgatggcctgacggcttacgtcgccgggaccaaaacactgagcgggtccatagcacctatggacgtgtgtgtgcgtcacttcctgcaggcaacagggtgctcgatggagtcagcactggaagccgccagcttgcacccagctcagctactaggcctggagaaaagcaagggtacgcttgactttggcgccgacgctgacttcgtagttctcgatgatagtctgcatgtacaggctacctacatctctggtgagttggtatggcaggctgatgccgcaagacagtag

SEQ ID NO: 44133 - DNA, 1320 bp, Artificial Sequence
  Description of Artificial Sequence: Synthetic coding sequence
atgcggggcgagcagggcgccgccggcgcccgggtgctgcagttcacaaactgtcgaatcctaagaggaggtaagttgttgagagaggatctctgggtgcggggcgggcgaatactcgatcctgagaagttattttttgaagaaagacgtgtcgctgacgaacgtcgggattgcggaggcaggatactagccccgggattcatcgatgtgcagattaatggcggtttcggagtggatttttcacaagccacagaggatgtcggttccggcgtggctctcgtggcccggcggatcctttctcacggcgtgacttcattctgcccaacactcgttacatcgccacccgaagtctatcacaaagtggtcccgcagataccggttaaatccggaggtccccacggtgcaggagtgttaggattacacttggagggccccttcatttctcgggaaaagagaggagcacaccctgaagctcaccttcgcagcttcgaagccgacgcatttcaagacttgttggccacttacgggcccctggacaatgtgcgaatcgtcaccctggccccagagctcggaaggagccacgaggttatcagagctttaacagcaagagggatctgcgtgtcattgggccatagcgtggccgatctaagagctgccgaggatgccgtatggtctggggcaacgtttattacccaccttttcaacgctatgctcccatttcaccacagggatccaggcatcgtgggtctcctgacatcagaccgactgcctgcagggcgttgtatcttttacggcatgatcgccgacggcacacatacgaatccagccgcacttaggattgcccatcgcgcccacccacagggtctggtgctggtcactgatgccatcccagctctgggtctcggtaacggacggcacacattagggcaacaggaagtcgaggtggacgggctaactgcttatgtcgcaggagagaggcccgatccgttggggccacgatcccagcctgcttgccaagtcgcccacgatccccctcgcgcgtgccctctttgttcacagggaactaagaccctcagtggctcaatagcacccatggatgtctgcgtgcggcactttctacaagctactgggtgcagcatggaaagtgctttagaggcagcctctctgcacccagctcagctcctgggcttggagaaaagtaaggggactctcgatttcggggccgatgccgacttcgtggtgctcgacgatagcctccatgtgcaggccacatatatctcaggcgaactggtttggcaagccgacgcagcccgccagtag

SEQ ID NO: 44134 - DNA, 1785 bp, Artificial Sequence
  Description of Artificial Sequence: Synthetic coding sequence
atgcggggcgagcagggcgccgccggcgcccgggtgctgcagttcactaattgccggatactcagaggcgggaagctccttcgtgaagatctgtgggtgagaggaggacgcatcttggacccagaaaagctctttttcgaggaacgacgtgtcgccgacgagagaagggactgcggtggtcgtatccttgctcccggttttatcgacgttcagatcaacggtgggttcggtgtcgacttttcccaggctacggaggacgttggtagtggcgtggcgctggttgcacgtaggatcctgagccatggagtgaccagcttctgccctaccctggttactagtccaccagaggtgtatcacaaggtggtgccacaaattcctgtgaaaagtggcggcccacacggagccggggtgctgggccttcacctggagggaccgtttatctcccgtgagaagagaggggcccaccccgaggcccacctgcgatcatttgaagctgatgccttccaggacctgcttgcaacatatggtccccttgataacgttcggatcgtgacactggcacccgagctaggccggtcacatgaggttataagggcgctaaccgccagaggcatttgcgttagcttgggacattccgttgccgatctgagggccgccgaagacgccgtttggagcggtgccactttcataacacacctctttaacgccatgctaccttttcaccatagagaccccggaatagtggggctgctcacaagtgacaggcttcccgcaggcaggtgcattttttatgggatgatcgcggacggtactcataccaatcctgccgcactacgtatcgctcacagggctcatccacaggggctcgtgctagtgacggatgctatccctgcccttgggctggggaatggcaggcacactcttggccagcaagaagtggaggtggatggactcacagcatacgttgcgggtgagaggccggaccctctgggtccccggtcacagcccgcctgccaggtggcccatgacccccctcgcgcttgccccttatgttctcaggggacaaagactctcagcggaagtatcgcaccaatggatgtgtgtgtacgccatttcctgcaggccacgggatgttccatggagtccgccctggaggccgcaagcttacaccccgctcaactattggggctggagaaaagcaaaggaactttggatttcggcgctgacgctgactttgtggtactcgacgactccctacacgtgcaggcaacctatatttccgggcctgtacttgccggctgcggtgaccccgcgtggtgctggagagccgtgtgggaggcccctgtgtgtcctgcccaccctatctcggtcattttacctagttctgtgtccccctggccctggcacacccctatgtggcagaccagagccgtaagattacctgaacagctcagaggaggctgggcctccggcgctctactagcgctgcgaactgctacagtggggtccgacgtccgggattggtgcagccctactagtggcgtaatcgtccttacatttagtccatttgaattttgggggggctggctcccatcacccctgctgaccggagctgtcctgggtacaggcggcactcgcctcgctcttcccctattctcttccctgtgctgcaaagctcagttacgcaaatgcctgcaggtccaacgggatcgcatggtgtgggctcccccggttgggcgagaacagccaggaaagaatcacctgcccggccaggggttggcctag

SEQ ID NO: 44135 - DNA, 933 bp, Artificial Sequence
  Description of Artificial Sequence: Synthetic coding sequence
atgggcaagcggcggtgcgtgccccccctggagcccaagctggccgcagggtgttgcggcgttaaaaagcctaagctttcaggcagcggtacacatagtcatggcaatcaatcaacaacagtgccaggcagctcctcgggaccactccaaaatcatcagcatgtcgattcgtcttccggcagagaaaacgtaagtgacttgactctcggaccagggaattctccaattacccggatgaatcctgcaagtggcgccctgtcaccgttgcccaggcccaacggcactgccaacacaactaagaatcttgttgtcacagctgagatgtgttgttactgtttcgacgtgttgtactgccacctctacggctttccccagccaagattacctagattcacaaacgacccttacccattgttcgtgacttggaagacaggcagagacaagcggctgaggggatgcatcggcaccttttctgctatgaatttacatagcgggctgagagagtacactcttacatcagccttgaaggacagccgttttcctcctcttacgcgggaagagctcccaaagctcttttgctccgttagccttctcactaattttgaagatgcctcagactacttggattgggaggtgggcgtgcacggaattagaatcgaatttattaacgagaagggagtgaaacggacagctacctatcttcccgaggtcgcgaaagagcaggattgggaccagattcagacaatagattcgctcctcagaaaagggggctttaaagcacccattacgtcagaatttcggaaaacaatcaaactcacccgctatcggagcgagaaggtgaccatctcctacgcggagtacatagcctctagacagcactgcttccagaacgggaccctgcacgccccaccactgtacaaccactactcgtag

SEQ ID NO: 44136 - DNA, 933 bp, Artificial Sequence
  Description of Artificial Sequence: Synthetic coding sequence
atgggcaagcggcggtgcgtgccccccctggagcccaagctggccgcaggttgttgtggtgttaaaaagcccaagctgtccgggagcggcactcactctcatgggaaccaaagcacgaccgtaccgggatcatcatcaggtccgctccagaaccatcagcacgtcgactccagcagtggcagagaaaacgttagtgatctgacgctgggccctgggaattctcctatcacccggatgaaccccgctagtggcgccctttctccattgcctaggccaaacgggactgccaatactaccaagaacctggtggtcaccgctgaaatgtgctgctactgttttgacgtgctgtactgtcatctctatggctttccgcagcctagactgcctcggtttacaaatgatccttatcccctgtttgtcacttggaagactggacgcgacaaacgtctccgcggttgtattggtacttttagtgccatgaatctgcactccggtttgagggagtacactctcacgtctgccctgaaggacagccgattcccaccattgactcgggaagaacttcccaagttgttctgttcagtctcgcttcttacaaatttcgaggatgcgtccgactaccttgattgggaagtaggggtccacggaatcaggattgaatttattaacgaaaagggagtcaagcggaccgcaacataccttccggaggttgccaaagagcaggactgggatcagatccagaccatcgactcactcttgagaaaaggaggattcaaagcccccatcactagtgaattccgaaagaccatcaagctaacccgttatcgctccgaaaaggtcaccatcagctatgccgaatacattgcctcaagacaacactgcttccagaacggtaccctgcatgctcccccactgtacaaccactatagttag

SEQ ID NO: 44137 - DNA, 1728 bp, Artificial Sequence
  Description of Artificial Sequence: Synthetic coding sequence
atggacttccccaccatcagccggagccccagcggcccccccgccatggatctggagggccctcgtgacatcctggtgccgtccgaggacctgacacccgacagccaatgggatcctatgccgggaggtcccggatccttgtcgcgtatggaactggacgagtccagtcttcaggaactggtacagcagtttgaagctctgccaggcgatctggttggtccttctcccggtggggccccttgcccactgcatatcgccacggggcacgggctagccagccaggaaatcgccgacgcccatggcctcctgtctgcagaggctggtcgcgatgacttattggggttgctccactgtgaagagtgtccaccaagccaaacaggcccagaagaacctctcgaaccggcacctaggctcctgcagccccctgaagatcccgacgaggactccgatagccccgagtgggtagaaggcgcctcagcagagcaggaggggagtcgaagcagtagttcaagccctgaaccatggctggagaccgttcctctagttactccagaagaacccccagctggcgcacagtcaccagagacgttggcaagctaccccgctcctcaggaggtcccagggccgtgcgatcacgaagatttactggacggcgtcatatttggcgcccgttatctcggctctacgcaactggtgagtgaacgcaatccacccacatccaccagaatggcccaggcacgcgaggccatggaccgggtgaaagcacccgatggggagacccaaccaatgaccgaagtggaccttttcgtctcaaccaaaaggataaaggtgctgactgctgacagtcaggaagcgatgatggatcatgctctgcacactatctcctacactgcagacatcgggtgtgtgttagttctgatggccaggcgccgtctcgcacggcgtcctgcgccacaggaccacggtagacgtctgtacaagatgctgtgccatgtgttctacgctgaggacgcccaacttattgcgcaagcaatcggtcaggcattcgcggctgcttacagtcagtttctgagagagagcggcatcgaccccagtcaggtaggcgtccaccctagtcctggggcctgtcatttgcataatggcgatctggatcactttagcaactctgataactgcagagaagtgcatttagagaaacggcgcggtgagggcctcggagtcgctttagtcgagtctgggtggggcagcttactccccacagcggttatcgcaaacctgctgcacggaggtcctgcagagcgctccggtgcgctctctatcggggaccggctgactgccattaacggcaccagtctcgtgggcctaccactcgccgcatgtcaagccgccgtaagggagactaaatctcagacatccgttacactgtccattgtgcattgcccacctgtgaccacagcgattattcatagaccacacgcacgggaacaacttggtttctgtgtggaggatggaatcatttgtagtttgctgcggggaggcatcgctgaaaggggagggattcgcgtggggcacagaattatcgagataaatggccagtcagtggttgcaacaccccatgcacgcattattgagttgctcacagaagcttacggcgaggtgcacattaaaacaatgccagccgctacctacaggcttcttaccggccaagaacaacccgtgtatctgtag

SEQ ID NO: 44138 - DNA, 2013 bp, Artificial Sequence
  Description of Artificial Sequence: Synthetic coding sequence
atgatcgccagctgcctgtgctacctgctgctgcccgccacccggcttttccgagccctctctgatgccttctttacttgtcgaaagaacgtgcttctggcgaatagctcttcgcctcaggtcgagggcgactttgccatggccccacgcggacccgagcaggaagagtgtgagggcttgctccagcagtggagagaggaagggctctctcaggttctgtccaccgcatccgagggccctttaatcgacaagggtctggcacagagcagtctggccctcttaatggataaccccggcgaggagaatgctgcttccgaagataggtggtctagtcgtcagctgtcagacctgagagctgcagaaaatctggacgagccatttccagagatgctgggcgaggaacctctgcttgaagtcgagggagtggaaggttctatgtgggctgctattcccatgcaatctgagccccaatacgctgactgtgccgccctcccggtgggcgcgctcgccaccgagcaatgggaggaggatcccgctgtcctggcctggagcattgctcctgagcccgtcccacaggaggaagcaagcatatggccattcgaagggctgggccagctgcagccgccagcagtggagatcccatatcacgagatattgtggcgagagtgggaggatttcagtacacaaccagacgcacagggtctgaaggcaggcgacgggcctcagttccagtttacactcatgagttataatattttggcacaggacctgatgcagcagagcagcgagttatacctgcactgccaccccgatattctgaattggaattacagattcgttaacctcatgcaggagtttcaacactgggatcccgatattctatgcctgcaagaggttcaagaagatcattactgggaacagttggaaccatctctacggatgatggggtttacttgcttctataaaaggcgaacagggtgcaaaacagacggctgcgccgtttgttataaacccactaggtttcgcctgctgtgcgcctcccccgtcgaatactttcgacccggcctcgaactgcttaacagggataacgtgggcctcgtccttctgctgcaacctctggtgccggaagggctgggtcaggttagcgtagcccccctatgcgttgccaatactcacatcctctacaatccccgccgcggagacgttaagttggcacagatggccatcctgcttgctgaagttgataaggtggcacggcttagcgacggtagccattgtcccatcatcctatgtggtgacctaaacagtgtgccagactcacctctctacaattttattagggatggagagctgcagtaccacggaatgccggcctggaaagtgtctggccaggaagactttagccaccagctgtaccagagaaagctccaggcccccctatggccgtctagcttgggaatcactgactgctgccagtacgtgactagctgccacccaaaacgctccgagcgcaggaagtacggtcgggatttcttgctcagatttagattctgcagcatagcatgtcaacggcccgtcggccttgtacttatggagggcgtgactgacactaaaccagagcgccctgccgggtgggctgagagtgtcctggaagaagatgcttctgagttggagcctgctttctccagaacagtggggacgattcagcattgtctgcacctgacgagcgtgtacacacacttcctgccccaaagagggcgacccgaggtgactaccatgcccctgggtctggggatgaccgtcgactacattttctttagtgccgagagctgcgagaacggcaacagaactgatcatcgactttatagagacggtacacttaagctgctaggacgactgtccttactgagcgaggagatattatgggccgctaacgggctccctaaccctttttgcagtagcgaccacttgtgtctgctggcatcttttgggatggaagtaactgctccttag

SEQ ID NO: 44139 - DNA, 789 bp, Artificial Sequence
  Description of Artificial Sequence: Synthetic coding sequence
atgttcccccaccacagccggagcctgggccgggactggaccaccccttgggaaaacctccagcgttgttgttggaatagacacataagttcttgtatgaggtggcctgggcactactctagagccccttatccatacttctccagcaggcactttagtcttaactggagacctccatgtttattcgaatcccgcacccagtttcagtactgtaattggagacctgacaatctgagccagacctcgctgatccacttgtcttcctacgtgatgaatgcagagggcgacgagccttcttctaaacgcaggaagcaccagggcgtgataaagaggaattgggaatatatttgctcccatgacaaggagaaaacgaaaattctgggggacaaaaacgtcgatcccaagtgtgaagatagtgaaaataaatttgacttcagtgtcatgagctataacatactttcccaggatctcttggaagacaattcgcacctgtacaggcattgtcggcggcccgtcctccattggtccttccgcttcccaaacattctgaaggagattaagcatttcgacgccgatgtgctatgcttgcaggaagttcaggaggaccactacggcgccgagataaggccaagtttggagtccctggggaccatgcagttgttctttttctttttcttctttgagaccggatcgcacagcgtggcccagctagaatgttctggaaccatcatggctcactactctctcaacctcctcggtagctccaatcctctaatctcggcctcgtag

SEQ ID NO: 44140 - DNA, 1128 bp, Artificial Sequence
  Description of Artificial Sequence: Synthetic coding sequence
atgagctacaacatcctgagccaggacctgctggaggacaacagccacctgtatcggcactgtcgacggcctgttctgcattggtccttccgatttcccaatatcctgaaggaaatcaagcactttgacgccgatgttttatgtctccaagaggttcaggaggaccactacggtgccgaaatcaggccctcacttgaatcgcttgggtatcattgcgagtacaagatgaggacaggaaggaaaccggatggatgtgcaatatgtttcaaacacagtaagttttcactgctaagtgtaaatccggtggagttctttcgccctgatatttccctgctggatagagacaacgtaggccttgtgctccttttacagccgaaaatcccatacgctgcctgccctgccatctgtgtagcaaatacccacctcctctacaatcctcgcaggggggacatcaagttgacacagttagccatgctcctggccgaaatcagctcagttgctcatcagaaagatgggagcttttgtcctattgtgatgtgcggggattttaatagcgtccccggaagtccgctttatagctttatcaaggaaggaaagctgaattacgagggtcttcctatcggcaaagtctcaggtcaggagcaatcttctcggggacagaggatcctgagcattccaatctggccacctaatctcggcattagtcagaattgcgtctacgaggttcagcaggtacccaaagtcgaaaagacagattccgatctgacacagacccagcttaagcaaacggaggttctggttacagccgaaaagctcagctcaaatctgcagcatcatttctcattatctagcgtgtactcacattacttcccagataccggaattccagaggtcacgacctgccacagcagatctgcaatcaccgttgactacatcttttatagtgccgagaaggaggatgtagctgggcaccctggcgccgaggttgccctagtgggtggtctgaagttgctggcacgacttagtctgctcactgagcaggacctctggacggtgaatggcctgcctaacgagaacaactcatccgatcacttacccctgctggccaagttcaggctggagctctag

SEQ ID NO: 44141 - DNA, 1635 bp, Artificial Sequence
  Description of Artificial Sequence: Synthetic coding sequence
atggaggcctggcggtgcgtgcggaagggctacggccactgcgtggttgggcgggggaggtatccaatgtttcctcatcattcccgaagtctgggccgagattggacaacaccatgggagaacctgcagcgctgctgttggaatcgccacatttcgagctgtatgcgctggccaggccattattcccgtgctccatacccgtatttcagctcacgacatttcagtctcaactggagaccgccctgtttgttcgaaagtcggacacagtttcaatactgcaactggcggcccgataacctgtcacaaacaagcctgatccacctttcctcatatgtgatgaatgcagagggtgacgaaccatcgtccaagcggagaaaacaccagggagtaatcaagagaaactgggagtacatttgctcccacgacaaagaaaagactaaaattctgggggacaaaaacgtcgaccccaaatgcgaagatagcgagaataagtttgatttcagtgttatgtcttacaacatactgagccaggatctgctcgaagacaactctcatctgtatcggcattgtagaagaccagtgctgcactggagctttaggttcccaaacattctgaaagagattaagcacttcgatgctgacgttctatgcttacaagaggtgcaagaagaccactacggcgccgaaattaggcccagcttagagagcctgggatatcactgtgagtacaagatgcggactggccgaaagcccgacggatgcgcgatctgttttaagcattcaaagttctctctgctctcagtgaaccccgttgagttcttcagacccgacatttcactattagaccgtgacaacgtaggattggtactgctgcttcagccaaagattccttatgcagcctgtcccgcaatttgcgtggcaaatactcatttgctttacaacccgcgccgcggcgacatcaaacttacccagctggctatgctgctcgccgagatctcgtcagtggcacaccagaaagacggcagtttctgtcccatagtcatgtgtggcgacttcaacagtgtcccagggtctccattgtactctttcataaaagagggtaaactgaactatgaaggattacctatcgggaaggtgtctgggcaggaacagtccagtcgcggacaacgtatactgtcgattccaatctggccaccgaacttgggcatcagccagaactgtgtttatgaagtgcagcaggtccctaaagtagaaaagaccgacagcgacctgactcagacacagctgaagcagacagaggtcctggtgactgcagaaaagctttcaagtaaccttcagcaccatttttcattaagttcagtgtatagtcactactttcctgacactggaatccccgaagtgacaacatgccactcacggtcagctataacagtcgattacatcttttattctgccgaaaaagaagatgtggctggtcaccccggcgctgaggttgcactggtgggtggcctcaagcttctggcacgtctgtcactccttaccgaacaggatctgtggacggtcaacggtctccccaacgagaataacagttcagatcacctccctctgcttgcgaaatttagactggagctctag

SEQ ID NO: 44142 - DNA, 639 bp, Artificial Sequence
  Description of Artificial Sequence: Synthetic coding sequence
atgagctacaacatcctgagccaggacctgctggaggacaacagccacttataccggcactgtaggagaccagtgttgcactggtcatttagatttcctaatattctgaaagagataaaacacttcgacgccgacgtgctatgtctgcaggaagtgcaagaggatcattacggcgcagaaattcggccttctttagaatccttgggataccactgcgaatataaaatgcggacaggtagaaagcccgacggctgcgctatctgttttaaacactccaaattctctcttttgtctgttaatcctgtggaattctttcgccccgacatttctctgctggacagagataacgtcggactagtgttactgctgcagcccaaaattccatatgctgcgtgtcctgcgatctgcgtggcgaacacccatttgctgtacaacccacggcggggagatatcaaactgacacagcttgccatgttgctagccgagatttcatccgtagcgcaccagaaggacggtagtttttgccccatcgtcatgtgtggcgactttaacagcgttcctgggagccctttgtatagtttcatcaaggaggggaagctgaattacgagggcttaccaataggtaaaacagtgatttag

SEQ ID NO: 44143 - DNA, 1257 bp, Artificial Sequence
  Description of Artificial Sequence: Synthetic coding sequence
atggagggcgtgatcaagcggaactgggagtacatctgcagccacgacaaggagaaaacaaaaattctgggcgataagaatgtggatcctaaatgcgaggacagtgagaataaattcgacttttctgtaatgtcttataacatcctttctcaggacctgctcgaggataattctcacttgtataggcactgtcgccgtccagtgttgcattggtcctttcggtttcccaacatcctgaaggagattaagcacttcgatgccgatgtgctgtgcttacaggaggtgcaggaggatcattatggggccgagattcgaccttctctggaaagtttgggctaccactgcgaatataagatgaggactgggcgcaaacctgatggttgcgcgatctgcttcaaacacagtaagttctcgttactgtccgtgaaccccgttgaattcttccgcccggacatatcactactagatagagacaatgtgggactggtgctgctgctgcagccaaagattccctatgccgcgtgtcccgctatctgcgtggcgaatacacacctcctatataaccctaggagaggcgacattaagcttacccagttggccatgttactggcagagatttcctcggtggctcaccagaaggatggttctttttgtccaatagtgatgtgcggggatttcaacagcgtgcccggaagcccactctacagttttattaaagaagggaaactcaactacgagggactccctatcggaaaggttagcgggcaggagcagagctcccgcggtcagcggatcctgagcatacctatctggcctcctaacctcggaatctcacagaattgcgtatacgaagtccagcaggtacctaaagtcgaaaagacagacagtgatctaacccagactcagctcaagcaaaccgaggtgctggtaacagcagagaagttatcctcgaacctccagcaccactttagtctgtcttctgtttatagccactatttcccagacaccggaatccctgaggtgaccacctgtcacagcaggtccgccattaccgtggactacattttctattctgccgagaaggaggacgtggctgggcacccgggcgccgaggtcgcactggtcggtggcctgaagttgctggcaaggctctcattactgactgagcaggacctttggaccgtcaatggcttgcctaacgaaaataatagctctgaccacctgcctctgctagcaaaatttcgcctggagctctag

SEQ ID NO: 44144 - DNA, 1128 bp, Artificial Sequence
  Description of Artificial Sequence: Synthetic coding sequence
atgagctacaacatcctgagccaggacctgctggaggacaacagccacctgtatcgtcattgccgcaggcccgtgctgcactggagcttcagatttcctaacattcttaaagagattaagcacttcgatgccgatgtcttatgtctccaggaagtgcaggaggatcactacggagcagagatccggcctagcctggaaagcttgggatatcactgtgagtataagatgcgcacaggccgcaagcccgacggctgcgcaatatgttttaagcactctaaattctccctgctgtccgttaatcctgtggagttcttccgacctgacatctcactgctcgacagagacaatgtgggactggtgttactcctccaaccaaaaataccttatgccgcttgtcctgcaatctgcgtagctaatacgcacctgctatataatcccagacgaggtgacatcaaactgacccaactggcaatgctgcttgctgagattagcagcgtcgcccaccagaaagacggctcattctgccctatcgtcatgtgtggggattttaactctgttcccgggagccccttgtactccttcataaaggaggggaaactgaactacgaaggactaccgatcgggaaagtcagcggccaggagcagtccagtcgtggccaacggatcctgtctatcccaatctggccgccaaatttgggcatcagtcagaactgcgtctatgaggttcagcaggttcccaaggtcgaaaaaactgacagcgacctgacccagacgcaattgaaacaaacagaggttttggttacagcagaaaagctaagttcaaatttacagcatcacttttcactcagctcggtatatagtcactattttcctgataccggcatccctgaagtaaccacatgccactctcgcagcgctattactgttgattatatcttctacagtgcagagaaagaggatgttgcgggtcacccaggcgcagaggtggctctggtcgggggcttgaagctgttggcccgactaagcctgctgactgaacaggacctctggacagttaacggcctcccaaacgagaataattcatctgaccacctgccactgctggccaagttcagattagaactgtag

SEQ ID NO: 44145 - DNA, 2520 bp, Artificial Sequence
  Description of Artificial Sequence: Synthetic coding sequence
atgagcgccggcgacggcctgcggcggggcaagagcgcccggtgcggcctcaccttctcagttggacgattttttcggtggatggtcgatacgcggatttcagtgcggattcacgagtacgccgctatctcattaactgcctgtatggaaaacctagtagaagaaatcagagcccgggttatggcctctcactctccagacggtgggggggccggcgggggcgaggtctccgcggaggccctcgaaatggtaatcaataatgacgccgagctgtggggcgtgctgcagccttacgagcacctcatttgcggcaagaatgccaacggagttctgtccctgccagcatacttcagcccttataatggcggttcactggggcatgacgaacgagccgatgcgtacgcgcaactggagctgcgcacactagagcagtcgctgctcgcaacgtgcgtcggttccatatcagagctgtcagacctggtcagtagagcgatgcatcatatgcaaggccggcaccccctttgtccaggagcctctccggcgcggcaggcccggcagcccccacagcctataacgtggagtccggacgctctccatactctctattacttcctgaggtgtccccagatggagagcatggaaaaccccaacctggaccccccaaggatgactttaaacaatgagcgaccattcatgctcctgccaccactgatggagtggatgcgggtcgcgattacctacgcagagcaccggagatctctcaccgtcgatagtggcgatatcaggcaagccgctagactgctgctccccgggctcgactgcgagccgcgtcagctgaagcctgagcactgctttagctcctttcgccgcctggatgcaagagccgccacagagaagttcaaccaagacctgggctttcggatgttaaactgcgggagaacagatctgatcaaccaggcaatcgaagccctgggcccagacggagtgaatactatggatgatcaggggatgacaccgttgatgtacgcttgtgcagccggcgatgaggccatggtgcagatgctcatcgacgccggcgcaaacttggatatacaagtcccaagtaattcaccccggcaccccagcatacatcctgacagtaggcactggacctccttgactttcgctgtcctccatggccacatctctgtggtgcagcttctgcttgacgcaggcgcccatgtggaggggagtgcggtcaacggtggagaagattcttatgcggagacacccctgcagcttgcttcagctgcggggaactatgagttggtgagcttactgttatcccgaggggccgaccctctcttgagcatgctggaggctcatggaatgggatctagcttgcacgaagacatgaactgctttagtcattccgctgctcatgggcaccgcaatgttctccggaaactgctaacccagcctcagcaggctaaggctgacgtcttatccctcgaggaaattctcgctgagggcgttgaggagtcagatgctagttcacagggatctggatccgaggggcctgtgaggttatctcggacccggactaaagctctgcaagaggccatgtattattcagctgaacacggctacgtggatattaccatggagcttcgggcgcttggagtgccctggaagttgcacatatggatcgaatccctccgtacatccttcagtcagtcacgttatagtgttgtacaatccctgctacgggacttttcctccattagggaagaggaatacaacgaggagcttgtcaccgagggacttcaactgatgttcgatattcttaagacaagtaaaaatgactctgtgatccagcagttggctacaatcttcacacattgctatggctcttctcctatcccgagcatccccgagattcgtaaaactctacctgccagactggaccctcatttcctgaataacaaagagatgtcggatgtcacttttttagtggagggcaaactgttttatgctcacaaggttcttctggtcacggcttctaatcgttttaaaactcttatgaccaacaaatcagaacaggatggcgactcttccaagactatagagatcagcgacatgaagtaccacatcttccagatgatgatgcagtacctgtattacggtggcacagagtcaatggagatccccacaactgacatcttggagctgcttagcgcggcctccctgtttcagctcgatgcgctccagaggcactgcgaaatactctgctctcagacactgtccatggagagcgccgtgaatacgtataagtatgcaaagatacacaatgcacccgagttagctttgttttgcgagggcttctttttgaaacacatgaaggccctcttagagcaggacgccttccgccagctgatttatggccggtccagcaaggtgcaaggactggaccctctccaggacctccagaacacgctggctgagcgggttcatagtgtatatatcacgtcgcgcgtgtag

SEQ ID NO: 44146 - DNA, 3078 bp, Artificial Sequence
  Description of Artificial Sequence: Synthetic coding sequence
atggccggcacctacagcagcaccctgaagaccctggaggacctgactctcgactcaggctatggggccggagattcttgtcgctcgttgagtttgagctccagcaaatcgaacagccaagctctaaattcttccgcgcagcagcatagaggtgccgcatggtggtgctactccggcagcatgaatagccggcacaactcttgggacacggttaacactgtactgccagaggacccagaagtcgccgaccttttttccagatgtccgagattgcctgagttagaagagtttccctggaccgagggagatgtagctcgagtccttcggaaaggcgccggtggtcgtcgcctgccccaatttagcgccgaagctgtcaggcgtctcgccggtctcctgagaagggctctgattcgtgtggcacgggaggctcagcgactatcggttctccatgccaaatgtacaagatttgaagtgcagagcgccgttcgcctggtgcactcatgggcccttgcagaaagttgcgcgctcgctgcagtaaaggccctctctctctactctatgtccgccggagacggattgaggcggggaaaatccgccaggtgtggattaacattctctgtcgggcggttcttccgatggatggtggacacaaggattagcgtacgtatccacgagtatgctgccattagcctcactgcctgtatggagaatctggtcgaggaaatacgagcacgagtgatggcctcgcactctccagatggtgggggcgcaggtgggggcgaagttagcgccgaagccctcgagatggtgataaacaatgacgcggaactgtggggtgtactccaaccatatgagcatctgatctgtgggaaaaatgctaatggggtactttctctgcctgcttacttctccccatacaatggcgggtctctcggccacgacgagcgcgccgacgcatacgcccagctggaattgcgaacactggaacagagccttctggcaacttgcgtgggctctatctctgaactgagcgatctggtgtctcgcgcaatgcatcatatgcaggggcgccaccctctgtgtccaggcgcaagtcccgccaggcaagcccgccagcccccccaacccataacctggtcccccgatgcattgcataccctttattattttctgcgatgcccgcaaatggaaagcatggaaaatccaaatcttgatccccctaggatgactttaaataacgagcggcccttcatgcttctgcctccactgatggaatggatgagggtcgctattacttacgcggagcataggaggtccctcactgtggatagcggcgatatccgccaggcggcacggctgttgctgcctgggctcgattgtgaaccacggcaactcaaaccggaacactgctttagctccttccggagattggatgctagggccgccaccgagaagttcaatcaggacctagggtttcgaatgcttaattgtggccggaccgatctcatcaatcaggccatcgaggcgctgggccccgacggagtgaatacaatggatgatcagggaatgacacccctgatgtacgcctgcgcggccggtgatgaagctatggtgcagatgctgatcgacgcaggcgcaaatctcgatatccaggttccttctaattcacctcgtcacccatcaattcaccccgactccagacattggacaagtttaacattcgccgttctgcatggacatatctccgtcgtccagctgttgttggatgctggggcccacgtcgaggggagtgccgtgaatgggggagaggactcctatgcagaaactcctctgcagctagccagcgccgccggaaactacgagctggtttccctccttctgtcccggggtgcagacccccttctttccatgctagaagctcatggcatgggcagcagtcttcatgaggatatgaattgcttctcccacagtgcagctcacggacaccgtaatgtattacggaaacttctgacccagccgcaacaggccaaggccgatgtcttgtccttagaggaaattctcgccgagggcgtggaagagtccgatgcttcttcccaggggtcaggctctgagggccctgttagactgtcacggaccaggaccaaggcactgcaggaagctatgtactactctgcagaacacggttacgtggatataaccatggagctgagagcgctaggagtcccttggaaattgcatatctggatcgagtcactgaggacaagcttcagccaaagtcgctacagcgtggtgcaatctctgctacgagacttctcaagcatcagagaggaagagtataatgaagagcttgtcacagaggggcttcaactaatgtttgatatcttgaaaacctccaaaaacgactcagtaattcaacagctggcaaccattttcacacactgttacgggtcaagccctatcccttccatccctgaaattaggaaaaccttgcccgcaagactggatcctcactttctgaacaataaggaaatgtccgacgtaacctttcttgtggagggtaagcttttttacgcccataaagttcttttggtgaccgcatccaacagatttaaaacactgatgacaaacaaatctgagcaggatggcgactcctctaagaccatcgagatatctgatatgaaatatcacatttttcagatgatgatgcagtacttgtactatggaggcaccgagagtatggaaatcccgacaactgatattctggagttgctctccgctgcctctctgtttcaactggacgctctacagcgacactgcgagatcttatgcagccaaaccctgagcatggaatccgcagtgaatacgtataagtacgccaagatccacaacgctccagagctagcccttttctgcgaaggatttttcctgaagcatatgaaagcgctgttggagcaggatgccttccgccagcttatctatggccgttctagcaaagtgcaggggcttgacccactccaggatctccagaacacactggccgagcgcgtccatagcgtgtatattactagccgagtgtag

SEQ ID NO: 44147 - DNA, 126 bp, Artificial Sequence
  Description of Artificial Sequence: Synthetic coding sequence
atgcaggaggagctggcctgggagaccgacggcctgtgggacgagtgtgccagtcctgtgtgtctagtcagaccgttgacgaatcccccagatctcggaaagcttaggggccaggatccgctttag

SEQ ID NO: 44148 - DNA, 414 bp, Artificial Sequence
  Description of Artificial Sequence: Synthetic coding sequence
atgcaggagctgatcggccggcgggtgaacacccgggcccggaaccacgtgggcagagttgccctgcactgggcggccggtgccgggcatgagcaagctgtgaggcttttactggaacatgaagccgcagttgatgaagaggatgcggtgggcgcactcactgaggaggggaacactgccctgcatctcgctgccggcaggggtcacatggctgtgctgcagcgccttgtcgatatcggactggacctcgaagagcagaacgctgagggtttaaccgctttgcattctgccgctggcggcagccacccagattgcgtgcaactgctgctgcgtgctggatctacggtaaacgcacttacccaagttgcaaggccttctcaggattgcgggcgcttattggctgcggaaccctag

SEQ ID NO: 44149 - DNA, 1473 bp, Artificial Sequence
  Description of Artificial Sequence: Synthetic coding sequence
atgcaggaggagctggcctgggagaccgacggcctgctgcccctggagaggcagctgcacgaagccgcgcggcagaacaacgttgggcggatgcaggagctaattgggcgacgagtcaacacgcgagcaagaaatcatgtgggaagggtggcgctgcattgggcagccggagctggacacgagcaggccgtgcgactactgctggagcacgaggcagcagtggacgaggaagacgccgtaggagctttgaccgaggcccggttgtgttttggaatgaacgccctgcttctgagcgcctggttcggacatctccgcatcctgcagattctcgttaactcaggcgccaagatccactgcgaaagcaaagacggactgactctgcttcactgtgctgcccaaaagggccacgtgcctgtcctagcatttatcatggaagacctggaagatgtcgcgctggaccacgtcgataaattggggagaaccgccttccacagagcagccgagcacgggcagctagatgccctggatttccttgtcggctctgggtgtgatcataatgttaaagacaaggaagggaatacagctcttcacctcgcagctggcaggggacacatggctgttctgcaaaggcttgtggacatcggactggacttggaggaacaaaatgccgaaggccttaccgccctccacagtgcagccgggggcagccaccccgactgcgtccagctcctgctgcgcgcaggctctaccgtaaatgcattgacccagaagaacctgagttgtctccattatgctgcactgtctggaagcgaggacgtgtctcgtgtcttgattcacgccggcgggtgcgcaaacgtggttgatcaccagggcgcgtcacccctccacctggcagttaggcacaacttcccagccctggtcaggctgctgataaacagcgactctgatgtcaacgctgtggacaatcgacagcagacacctctgcacctggcagctgagcatgcttggcaggatatcgccgatatgctgctcatcgccggagtcgatctgaacctgagagacaaagaccatcccagtgatccgtcgggcaagagcctgtccttcaaacaggatcatcggcaggagacacagcagctgcgatctgtcttatggaggctggccagccgctatctgcagccacgggagtggaagaagctggcctacagttgggagtttacagaggcccatgtggacgctattgagcaacaatggacaggaacgaggagttatcaggaacacgggcatcggatgctgctcatctggctgcatggcgtggccaccgcgggagaaaaccccagtaaagccctctttgaaggcctggtggctataggccggcgcgacctggctgggtggtctaccatggccaggtcacagcttacagcaacctccgcttcaagagtgcagatgatcctggttccccagcccccggaatag

SEQ ID NO: 44150 - DNA, 1569 bp, Artificial Sequence
  Description of Artificial Sequence: Synthetic coding sequence
atgcaggaggagctggcctgggagaccgacggcctgctgcccctggaacggcagctgcacgaagctgcccggcagaacaatgttggtagaatgcaggagctaattgggcgtcgggtgaacaccagagcccggaatcatgtcggacgcgtagctctccattgggcagccggagcgggccacgagcaggctgtcagactgctgcttgagcacgaggcggctgtcgatgaggaggatgctgttggagccttaacagaggccaggctgtgcttcggtatgaatgctctcttactctcggcatggttcgggcacctcaggattttacagattctcgtcaactcaggcgctaaaatccattgtgaaagtaaggacgggctcaccctgctacattgcgcagcccagaagggtcacgtcccagtattggctttcataatggaagatcttgaggacgttgccctcgaccatgttgacaaattgggcagaacagctttccaccgagctgccgagcacggacaactggatgcgctggacttcctggtgggatccggctgtgatcacaacgtgaaggacaaagaaggaaatactgcattgcatctggctgcaggccgggggcatatggccgtactgcaaaggctggtggatattggtctagatttagaggagcagaacgcagaaggactgactgcgctccattcagcagccggcggaagccacccggattgtgttcagctgctgctgagggccgggagtacagtgaacgcgctaactcagaagaatctgtcctgcctccactacgccgctttgagcggctcagaagacgtgtctcgagtcttaattcacgccggtgggtgcgctaacgtggtggaccaccaaggggcttccccactgcacctggcggtgaggcataattttcctgcccttgtccgcctactgatcaattctgactctgacgttaatgctgtcgacaacaggcagcaaactcctttgcacctggccgcagaacacgcatggcaggatattgcagatatgcttcttatcgcaggtgtcgatctcaacttaagggacaaacagggtaagacggcactggcagtcgccgtgcgctcaaaccacgttagtctcgtggatatgatcatcaaggccgaccggttttatcgctgggagaaggatcatccttcagaccctagtggaaaaagcttgagcttcaagcaggaccatcgccaggagacacagcagctgaggtctgtcctctggagactcgccagccgctacctgcagccaagggagtggaaaaaactggcctactcctgggagtttaccgaggcccacgtggatgccatcgagcaacagtggaccggaactcgcagctatcaggagcatggccacaggatgctcctgatttggctgcatggagtggccacagccggcgagaaccccagcaaggccctctttgaaggacttgtggccatcggcagaagagatctggccggctggagcacaatggcccggtctcagcttaccgctacatctgcctcaagagtccaaatgatcctggtccctcagccgccggaatag

SEQ ID NO: 44151 - DNA, 1545 bp, Artificial Sequence
  Description of Artificial Sequence: Synthetic coding sequence
atgcaggaggagctggcctgggagaccgacggcctgctgcccctggagcgccagcttcatgaggctgcaaggcagaacaacgtgggaagaatgcaggaacttattgggcgccgcgtcaacactagagctagaaatcacgtgggccgggtggccctgcactgggccgcaggcgcgggacatgaacaggctgtgagactgctcctcgagcatgaggctgcagtggatgaagaagatgccgttggcgccctgactgaggccaggctttgtttcggaatgaatgctctgttgctatccgcctggttcgggcacctgcgtatcctccagatcctcgtgaatagcggcgccaagattcattgcgagagcaaggatggactgaccctgctccattgtgccgcacagaaagggcatgtacccgtgctggcctttatcatggaggatcttgaagatgtcgccctcgaccatgtggataagcttggaagaacagccttccacagggctgccgagcatggccagctggacgctctcgatttcctggtcggttccggctgtgaccacaatgtcaaagataaggagggcaacaccgctctgcatttggctgcagggagaggccacatggccgtgctccagcgactcgtcgacattggcctggacctagaagagcagaacgctgagggactcactgctctgcattctgccgccggcggttctcacccggattgtgtccaactcctgttgcgcgccggtagtactgtgaacgccttgactcagaaaaatctgtcttgtttacactacgccgcgctgagtggatccgaggacgttagtcgcgtactgattcacgccggcggctgcgcaaatgtggtagaccaccagggagcttccccactgcatctggctgttagacataacttccctgctctggttcgcctgctcatcaacagtgactctgatgtgaatgctgtagataaccgccagcaaacacccttgcacctggccgctgagcatgcctggcaggacattgcggacatgctgttaattgccggggtggatctcaacctgcgcgacaagcagggaaagactgccctggctgtggccgtgagatcgaatcacgtctctctggttgacatgatcattaaagcagaccgtttctatcggtgggagaaggaccatccctccgacccatctggcaagtctctatcattcaaacaagatcatcggcaggagacacagcagctgcggtcagtgctttggcggcttgctagccgctatctccagccccgtgaatggaagaagttggcatactcatgggagtttaccgaggcgcacgtcgatgccatcgagcagcagtggacaggcactagatcataccaagaacacggccatcgtatgctccttatctggcttcacggagttgcaacagccggggagaatcctagcaaggctctcttcgaaggactggtggccatcggacgaagggatctggccgaaaacatcagaaagaaggcaaatgcagcgcctagcgccccccggaggtgcaccgctatgtag

SEQ ID NO: 44152 - DNA, 1200 bp, Artificial Sequence
  Description of Artificial Sequence: Synthetic coding sequence
atgaacgccctgctgctgagcgcctggttcggccacctgcggatcctgcagattttggtcaatagtggggctaagattcattgcgaatctaaggatggactcaccctgcttcactgcgcagcccaaaaggggcatgtgcccgtattggcattcattatggaggaccttgaggacgtagcactggaccatgtggacaaactcggaaggaccgcctttcaccgggccgccgaacatggtcagcttgatgctctcgacttcttggtgggaagcggatgcgaccacaatgtcaaagataaagaggggaatacggccctccacttagccgccggaaggggacatatggctgtcctgcagaggctggtggatatcggactcgaccttgaagaacagaatgcagaggggttgactgccttacattccgccgccgggggaagccatcctgattgtgtccagctgctcctgcgagctggttcaactgtcaacgcgctgacacagaagaatttgagctgtttacactacgccgccctttccgggtccgaggatgtgtctagggtgctgatccacgcaggcggatgcgcaaacgtagtggaccatcagggggcttccccactgcatctcgctgtgcgccacaactttccggctcttgttcgcttgttgatcaactcagatagcgacgtcaatgcggttgataatagacagcaaacccccctgcacctggccgccgagcatgcatggcaggacatcgctgacatgttacttattgcaggggtggacctgaacctaagggataaggaccatccgtctgacccctctggcaagtctctgagtttcaagcaggatcacagacaggaaacccagcagctgagatccgtgctgtggcgtctggcaagtcgctacctgcagcctagagagtggaaaaagcttgcatactcctgggagttcactgaggcgcatgtagacgctatcgaacaacagtggactgggacgagatcttatcaggagcacgggcataggatgctcctgatctggctacatggtgtagccacagctggcgaaaacccaagtaaagctctcttcgaaggcttggtcgcaattggtcggcgggatctggcgggttggtccactatggcgcgctcacaactaacagcgacatctgcatcccgagttcaaatgattctcgtaccacagccaccagagtag

SEQ ID NO: 44153 - DNA, 546 bp, Artificial Sequence
  Description of Artificial Sequence: Synthetic coding sequence
atgaacgccctgctgctgagcgcctggttcggccacctgcggatcctgcaaatactcgtcaatagcggcgccaagatacattgtgaaagcaaggacgggttgacattgctgcattgcgccgctcagaaaggacacgtgcccgtcctggcattcattatggaggatctcgaggatgtggcacttgaccatgtcgacaaactgggcagaacagcattccaccgggccgccgagcatggacagttggacgcccttgatttcttagtggggtctggctgcgatcataacgtgaaagataaagagggcaatacagctctgcatctcgcagccggcaggggacacatggcagtcctgcagaggcttgtggacatcggcttagatctggaggagcagaacgctgaaggactcacggcactccactcagcggccggtggatcacatcctgactgcgtgcagctgctccttagagctgggtctacggtgaatgcattaacccaggtggcacgaccgagccaagactgcgggcgcctattagccgccgaaccctag

SEQ ID NO: 44154 - DNA, 270 bp, Artificial Sequence
  Description of Artificial Sequence: Synthetic coding sequence
atgctgggcggcctgggcaagctggccgccgagggcctggcccaccgcacggagaaagccacggagggggctattcatgcagttgaagaagtcgtcaaagaagtggtgggacacgcgaaagaaacgggagagaaagctatcgccgaggctattaaaaaggcgcaggaatcaggagacaagaagatgaaagagatcactgaaacagtgaccaacacagtcactaacgctattacacacgcagccgagtcactcgataagctggggcagtag

SEQ ID NO: 44155 - DNA, 3270 bp, Artificial Sequence
  Description of Artificial Sequence: Synthetic coding sequence
atgggcaacaccaccaccaagttccggaaggccctgatcaacggcgatgagaaccttgcttgccagatttacgaaaataacccccagcttaaagagtccctggatccaaacacttcctacggtgagccttatcaacataatacccccctgcattatgccgccagacatggtatgaacaaaatcctaggaacatttcttggtagagacggcaatcctaataagagaaatgtccacaatgaaacatctatgcacctcctgtgtatgggaccccagatcatgatctccgaaggcgccttgcatcctagactggcgagacccacagaagatgactttaggcgcgccgactgtctgcaaatgattcttaagtggaaaggggccaagctggaccagggagagtacgagagagccgccatcgacgcggtagacaacaagaagaacacaccccttcactatgcagcggccagcggcatgaaggcctgcgttgagctgctagttaagcatggcggggacctcttcgcagagaatgaaaataaagacaccccctgtgattgcgccgagaagcagcaccataaggacctggcccttaatttggagtcccaaatggtgttcagtagggaccccgaggctgaagaaatcgaagccgagtacgccgccctggacaaaagagaaccatatgagggcctgcggccccaggacctcagaagactgaaggacatgctgattgtcgagacagccgatatgctgcaagcccccctgttcaccgctgaagcgctgcttagggcccacgattgggaccgggagaagttgctagaggcctggatgtctaaccccgaaaattgctgccagcgctctggcgtgcagatgcccacccccccgccttccggttacaacgcctgggatacactgccctctccccggaccccacgcaccactcgatcaagcgtcacatcacctgacgaaatttccctatcccctggcgacttggacacttctctgtgtgatatttgtatgtgtagtatctccgtttttgaagacccggtggatatgccatgtggacacgatttttgccgcgggtgctgggaaagctttctcaatctcaaaatccaggagggggaggcacataatatcttttgtccagcgtacgattgttttcaattggtgccagtcgacatcattgaaagtgtcgtgtcaaaagaaatggacaaaagatacctccaattcgatatcaaggccttcgttgaaaacaaccccgcaatcaagtggtgtcctacaccaggatgcgaccgcgcagtgcgtctgaccaagcagggaagtaatacatccggttcagacaccctctcctttccactcttgagagcccctgctgtagactgtgggaaaggacaccttttctgttgggagtgtcttggggaggcacacgagccatgcgattgccaaacgtggaaaaattggctacagaaaatcactgaaatgaagcccgaagagctcgtcggcgtgtccgaagcctacgaagatgcggccaattgtctgtggctgcttaccaattctaaaccatgtgcaaactgtaaatccccaatccaaaaaaatgaaggttgtaatcacatgcagtgtgctaagtgtaagtatgatttttgttggatctgtctggaggagtggaaaaagcactcttcctctacgggtggatactaccgctgcaccaggtatgaggtgatacagcatgtggaggaacaatccaaggagatgacggtggaggccgagaaaaaacacaaacgttttcaggagttagatcggttcatgcactactataccagattcaagaaccacgagcactcctatcagctggaacagagattgctcaagactgctaaagagaaaatggagcaactgtctagggcccttaaggaaactgagggcggctgtcctgacaccaccttcattgaggatgccgtgcacgtcttacttaaaacacgtaggatcttgaaatgctcgtacccttatggcttttttttggaacctaagtccaccaagaaagaaatttttgagctcatgcaaaccgacttggagatggtcacagaggacctggctcagaaagtgaaccgcccgtacctacgcacccccagacacaaaattatcaaagcggcatgcttggtccagcagaagcgacaggagttcttggcctccgttgccagaggtgtggctcccgcagattctcccgaggcccccaggcggagctttgccggggggacgtgggattgggaatacctgggtttcgcgtctccagaggaatacgctgagttccagtataggagaagacacaggcaacgccggcggggtgacgtgcattctctactctctaaccctcctgacccggacgaaccgagcgagtccacactggacatccctgaaggcggcagttcatctcgaagacctggaacttccgtcgtgagttcagccagtatgtccgtgctacattctagcagccttcgggattataccccagccagtcgtagtgaaaatcaggacagtttgcaggctctgtcttcactcgatgaggacgatcccaacatactattagcaatccagctcagcctccaggagtccgggcttgcccttgacgaagaaacccgagactttctaagcaacgaagcctcattgggagctataggaacaagtctgcccagccggctggatagtgtcccccgaaacaccgacagccccagggctgccctaagttcttccgaacttctcgagctgggagactctctgatgcgactgggagccgaaaacgatccctttagcactgatacactgtcgagccacccgctgtccgaagctcgtagcgacttttgcccctcgtcttcagacccggacagcgccggccaagacccaaacatcaacgacaacctgttggggaacatcatggcttggtttcacgatatgaatcctcagagcatcgccctgatccctcccgctactacggaaatcagtgctgattcccagcttccttgcattaaagacgggagtgagggcgtgaaagacgtggagctcgtcctgcccgaggattccatgttcgaggatgcctccgtgtccgagggccgtggcacacagatagaggaaaaccccttggaggagaatattctggccggggaagcagccagccaggctggggacagtggcaacgaggccgcgaaccgcggagatggctcggacgtaagcagtcagacaccccagaccagctccgactggctggaacaggtgcatttggtctag

SEQ ID NO: 44156 - DNA, 405 bp, Artificial Sequence
  Description of Artificial Sequence: Synthetic coding sequence
atgggcaacaccaccaccaagttccggaaggccctgatcaacggcgatgagaacttggcatgtcaaatctatgaaaacaacccccagctgaaggaatctcttgaccctaatacgtcgtatggcgaaccctatcagcacaacacaccgctgcattatgccgcccgacacggcatgaataaaattctgggaacctttctggggagagacggtaatcctaataagcgtaacgtgcacaacgagactagcatgcatctcttgtgcatgggtccgcagatcatgatctctgagggcgcccttcaccctagactagcgagaccaacagaggacgactttcgacgagcggattgtctccagatgattctgaaatggaaaggggctaagctcgaccagggcgaatatgagtag

SEQ ID NO: 44157 - DNA, 1947 bp, Artificial Sequence
  Description of Artificial Sequence: Synthetic coding sequence
atgctgtggccccggctggccgccgccgagtgggccgccctggcctgggagcttctcggggccagcgtgctgttgatagctgttcggtggctcgtcagaagacttggcccccgtcccggagggctgggaagatcaggcacccctgttccacccccgagcgcagctgctgctccagctagtggagagatgacaatggacgccctgctggctcgcctgaagctccttaaccccgatgacctcagggaagagattgtgaaagctggccttaaatgtggtcccataacctccactacaaggtttatctttgaaaagaagctcgcccaggccttgcttgaacagggcgggcggctcagctctttctaccatcacgaggccggtgttacggctttatcacaggaccctcaaagaatcttgaaacctgcggaaggtaatcccaccgatcaggccggtttttccgaagatcgcgacttcggttactctgtgggactcaatcctccagaggaggaagccgtgacatccaagacttgtagcgtgccacctagcgacaccgatacctaccgtgccggggcaacagcaagcaaggaacctcccctgtattacggagtatgccccgtttacgaagacgtgcccgcgcgcaacgaaaggatttatgtgtacgagaataagaaggaggcgctccaggctgttaagatgatcaagggaagccggttcaaggcattcagcactagagaagatgcagagaaatttgcaagaggaatctgcgactactttccctcaccctccaagacttctctccccctgtcacctgtgaagacagcacctctgttctcaaatgataggctgaaagatggcttgtgcctgtccgagagtgagacagttaacaaggagcgggccaactcctacaagaacccaagaactcaggatcttaccgcgaaactcaggaaagccgtggagaagggggaagaagacacattctccgatctgatttggtctaacccgagatacttaattggatcaggagacaaccccacaattgtccaggaggggtgtcgatacaatgtcatgcacgtcgccgccaaggaaaatcaagcttcgatttgccagctcacacttgatgtcttagaaaatccagatttcatgcggctcatgtacccagatgacgatgaggctatgctccaaaaacgcataagatacgtagtcgacctttatctcaacacccccgacaaaatggggtacgacaccccccttcacttcgcatgcaagttcggtaacgctgacgtggtgaatgtgttgtccagccaccacctgatagtaaagaatagcaggaacaagtacgacaaaacaccagaggacgtcatatgcgagcgctcgaagaataaatcggtggagcttaaagaacgcattcgggagtacctaaaaggtcattattatgtgcccctcctccgtgcagaggagacatccagccctgtcatcggcgagctttggtctcccgatcaaaccgccgaagcctctcatgtgtcgagatacggagggtctcccagggatcctgtcttgaccctacgcgcctttgcaggcccgttgagcccagcaaaagcggaggacttcagaaagctgtggaaaacaccccccagagaaaaggctggattcttacaccacgtcaaaaagagtgacccagaaagggggtttgagcgcgtcgggagggagcttgctcacgaattaggatatccctgggtagaatattgggaatttcttggatgcttcgtggacctgtctagccaagagggactccaacggttagaagaatatctgactcagcaggaaatcggcaagaaggcacagcaggaaacgggagaacgcgaagcatcatgccgggataaagctacgaccagtgtggaaatgagatttcacagaatagaccaggccggcttagaattactgactagctag

SEQ ID NO: 44158 - DNA, 2817 bp, Artificial Sequence
  Description of Artificial Sequence: Synthetic coding sequence
atgctgtggccccggctggccgccgccgagtgggccgccctggcctgggagctgctcggcgcatcagtactgctgattgccgttcgctggctcgttagaagactaggtccaagacctggaggcctggggcgctccggaacccctgtcccccctccttcagccgcggctgcacctgcatccggggagatgaccatggatgccctgctagcgcgtctcaaactgctcaaccccgacgacctcagggaagaaatagtgaaggccggcttgaaatgtggacctatcacttcaacaaccagatttatctttgagaagaagttggcccaagctttgctggagcaaggagggcgcttgtcttccttttaccatcacgaggcaggagtgactgctctctcccaagaccctcagagaatcctgaagcctgccgaaggaaacccaaccgatcaggcgggattctctgaggacagggacttcgggtacagcgttggtcttaaccctccagaggaagaggcggttacaagcaaaacctgctctgtgcccccctctgataccgatacttacagggcgggcgccaccgcctctaaagagccaccactatactatggcgtgtgtcctgtgtacgaggacgtgccggctaggaacgagcgcatctacgtttatgagaacaagaaggaggctctgcaagccgtgaaaatgattaaggggagccgattcaaagcattttccacacgagaagatgcagaaaagttcgcacgcggaatctgtgactacttcccgtccccttctaaaaccagcttacccctctcgcccgtgaaaaccgcgcccctgttcagcaacgacagacttaaagacgggctctgcttatctgagtctgagaccgtgaacaaagaacgcgcaaacagttacaaaaatcccaggacacaggatctgacagcaaagctgcgaaaggcggtagaaaagggcgaagaggacactttctctgaccttatttggtcaaaccctcgctatctgattggatcaggggataaccccaccatcgtgcaggaaggatgccgctataatgtgatgcacgtggccgcaaaggagaaccaggcgtctatctgccagctgactctcgatgtgctcgagaatccagatttcatgagacttatgtaccctgacgatgacgaagctatgttacagaaacggatccggtatgttgttgatctgtacctgaataccccagataagatgggatatgacactcctctccatttcgcatgcaaattcgggaacgctgacgtcgtcaacgttctgagctctcaccacttgatcgtgaaaaattccagaaacaaatacgataaaaccccggaggacgtcatctgcgagcggagcaagaataagagtgttgaattaaaagagagaattagagaatatctgaagggtcattactacgtgcccttactgcgggccgaagagacctcttctccagtgatcggcgaactgtggagtccggaccagaccgcggaggcatctcacgttagccggtatggaggtagtccacgcgaccccgtgctaactctgcgggcgtttgcagggcccctttcacctgccaaagcagaagatttcaggaagctttggaagacaccccctcgagaaaaagctggtttccttcatcatgtcaaaaaatccgatcctgagcgtggcttcgaacgggtggggcgggagctcgctcacgagttagggtacccttgggttgaatattgggagttcctggggtgttttgtggacctcagcagccaggaaggtctgcaacggctggaagagtatcttacgcagcaggaaatagggaagaaggcgcagcaggagactggagagcgggaagcctcctgccgggataaggccacaacctctgggagtaacagcatttccgttagagcttttctggatgaggatgacatgtcactggaagaaatcaagaaccgccagaacgccgcccgaaataattccccgccaacagttggggcctttgggcatacacgctgtagcgcattcccccttgagcaagaggccgacttgatcgaggcagcggaaccgggaggaccgcacagtagccggaatgggctctgccaccctttgaaccacagccgcaccttggcaggcaagcgcccgaaggctccccgcggagaggaggctcatctgccccctgtctctgatctcactgtggagtttgataaacttaatttgcagaacattgggagaagtgttagcaaaaccccagatgagagcaccaagactaaggaccaaattctcacttctaggatcaatgctgtagaacgcgacctgcttgaaccgagtcctgccgaccagctgggcaacggccacagacgaacagagtctgaaatgagcgcccgcattgctaaaatgtcgctctcgccttcatccccccgacacgaagaccaactcgaagtcacgcgagaacccgccaggcgcctgttcctgtttggcgaagagccctctaagctcgaccaggacgtcctggcagcactcgaatgtgcagatgtggatcctcaccagttcccagctgtgcataggtggaaatctgcggtgttgtgttactccccaagtgacaggcagtcatggccaagccccgccgtaaaaggacggtttaagtcccagcttccagacctgagtggtccccactcctattcacctggtaggaattcagtcgccgggtcgaatcctgccaagccgggattggggtcacccgggcggtattctcccgtacatggaagtcagctgcggcgaatggccaggttagctgaactcgctgccttgtag

SEQ ID NO: 44159 - DNA, 2631 bp, Artificial Sequence
  Description of Artificial Sequence: Synthetic coding sequence
atgaccatggacgccctgctggcccggctgaagctgctgaaccccgacgatctgcgagaagaaatcgtcaaagctgggctgaagtgtggtcccataacaagcaccaccagattcatctttgaaaagaagctagcccaggctttgctggagcagggcggcaggctatcctcattctaccaccacgaggccggcgttacagcactgagccaagatccccaacgcatcctaaagccagccgagggcaatcccacagaccaggcaggattctccgaggacagggacttcgggtattccgtgggcttgaatccccctgaggaggaagccgtcacttctaagacctgttccgttccaccctctgacactgatacataccgagcaggggccaccgcctctaaggaaccacccctgtattacggtgtgtgccccgtctacgaagatgtgcccgcccgcaacgagcgtatctacgtgtacgaaaataagaaagaggccttgcaggccgtcaagatgatcaaagggtccaggttcaaggcttttagtaccagggaagacgccgagaaatttgccaggggcatttgtgattacttcccgtcaccctctaaaacgtctctgcctctttctcctgttaaaaccgcacccttgtttagcaatgacaggcttaaagacggtctgtgcctgagcgagtcagagacagtcaacaaggagagagccaactcatacaagaatccacgtacccaagatctgaccgcaaaactccggaaggccgtggagaaaggagaagaagacaccttctcagatctgatctggagtaaccctagatatctcattggttctggcgataatcccacaatcgtgcaagaagggtgcaggtacaatgtcatgcatgtagccgccaaggaaaatcaggcttccatttgtcagctcaccctagatgtgttagagaatcccgactttatgaggctgatgtatcctgacgacgacgaggcaatgcttcaaaaacggattcgctacgtcgttgacctctacttgaatacgcctgacaagatgggatatgacactcctttgcatttcgcctgcaaattcgggaacgccgacgtcgtgaacgttctgagcagccatcacctgatcgtgaagaacagccggaacaaatatgacaaaactcctgaggacgtgatttgcgagagaagcaaaaataaaagcgtggagctgaaggaacggattcgtgagtaccttaagggtcactactacgtgcccctactccgcgctgaagaaacttcttcaccagtgattggagagctatggagtccagatcagacggctgaggcctctcatgtatcacgctatggcggatcacccagagatcctgtgctgacgttacgcgctttcgctgggcccctgagcccggccaaagccgaggatttcagaaaattatggaaaacacctcccagagaaaaggccggcttcctccaccatgtgaagaaaagtgacccagaaagaggattcgaacgggttggccgtgagttggcacacgaactgggctatccctgggtggagtactgggaattcctgggctgcttcgtggatctttccagtcaggagggtctgcagaggttagaagaatatttgacacagcaggagatcggtaaaaaggcgcagcaggagacaggtgagagagaggcatcctgcagggataaagccactacatctggctcaaatagtattagtgtgcgagcctttttagacgaagacgacatgtcactagaggagattaaaaataggcagaacgctgccagaaacaatagccctcctacggttggcgcctttgggcatacccgttgttctgcattcccactcgagcaggaggcagacctgattgaagcagctgaaccagggggtcctcacagcagtagaaacggcctctgtcatcccctaaatcacagtcgcaccctggcaggcaaacgaccaaaagccccgcggggggaggaagcccatctgccccccgtttcagatctgacagtagagtttgataaactaaatctgcaaaacattggacggagtgttagcaagaccccagatgagtccacaaaaactaaagatcagattctcacatcacgtattaacgccgttgagagggacctcctcgagccttctccagctgaccagcttggaaacggtcaccggcgaacagagtctgaaatgtctgctcgcattgccaagatgagcttgtctccttcctcgccaagacacgaagatcagctcgaggttacccgggagccggcccgccgcctcttcctattcggcgaggaaccatcaaagctggatcaggacgttctagctgcgctcgaatgcgctgacgtggatccacatcaattccccgcagttcaccgctggaaatcagctgtgttatgctactcaccgagcgacagacagagttggccgtcccccgccgtcaaaggccgttttaagtctcagctccctgatttgagtggcccccattcgtactcccccggccggaacagcgttgctggaagtaatcctgcaaaaccggggttgggatccccgggccgatatagtcctgtccatgggagccagctgagaagaatggcccgcctggctgaactggccgccctgtag

SEQ ID NO: 44160 - DNA, 2826 bp, Artificial Sequence
  Description of Artificial Sequence: Synthetic coding sequence
atgtaccagggcgagttcggcctgaacatgaagctgggctacggcaagttttcttggcctaccggagaaagttatcacgggcagttttaccgggaccactgtcacggactcgggacctatatgtggccggacggcagcagctttacagggaccttctatctgagtcacagagagggatacggcaccatgtacatgaagaccagactcttccagggattgtacaaggcagatcaacgcttcgggccgggcgtagaaacctacccagatggctcgcaggacgtgggattgtggtttcgggagcagttgattaagttatgcacacaaatcccatctggcttctccctgctgcgttaccctgagttcagcagcttcattactcatagcccagccagaatttctctttccgaggaggagaaaacggagtggggtctgcaggagggccaggacccatttttttacgactacaaacgcttcttactgaatgataatttaactttgccaccagaaatgtacgtatactcaaccaattcagatcacctgccaatgacttcttcgtttcggaaggagctggacgctagaatcttcctcaatgagatccccccattcgtcgaggacggagaaccttggtttataattaacgagacgccactgctagtcaaaatacagaagcagacctacaaattccgcaataagcccgctcacaccagttggaatatgggggccatcttggagggtaagcgcagtgggtttgcaccctgtggtcctaaggagcagctcagcatggaaatgattctgaaggcagaggagggaaatcatgaatggatctgccgtatcctcaaggataacttcgcctcggctgatgtggcagacgccaagggatacaccgtgttggccgccgctgccacacactgccacaatgatatcgtcaatctgctgctagattgtggggccgacgtgaacaaatgcagcgatgagggactgaccgccttaagcatgtgttttctcctgcactaccccgctcagtctttcaaaccgaacgtggccgagcgtactatacctgagcctcaggagccacctaagttccccgtggtgccaatcctgagttcctccttcatggatacaaaccttgagagcctatactatgaagttaatgtcccttcacaagggtcatacgagctacggcctccacctgcaccattattactgcctcgagtgtctggttcccatgaaggagggcatttccaggacacaggacagtgtggtgggtccatcgatcaccggagttcttcactgaaaggagactctccactggtgaagggaagcttgggacacgtagaaagcggactagaggatgtgctcggcaataccgatcgtgggagcctgtgtagtgccgagacgaagttcgaatctaacgtgtgtgtgtgcgatttctcaattgagctgtcgcaggctatgctagaaagatctgcccagtcccactccctcttgaaaatggcatctccatccccttgcaccagttcttttgacaaggggacgatgcgccggatggccttgagcatgattgagcgcagaaagcggtggcgcactattaagctgttgctccggaggggagcagatcccaacctgtgttgcgtgcctatgcaggtcctgttcctggcagttaaagcaggcgacgtggacggtgtgagactcctattggagcacggcgcacgcaccgatatttgttttccgccccagctgtcaaccctgacccctctgcacattgcagccgccctgccaggggaggaaggagtgcaaattgtggagctactgttgcatgctatcaccgatgtcgatgctaaagctagcgacgaagatgacacttacaagccaggaaaactagatctgctcccgtctagtcttaagctgagcaacgagcccgggccccctcaggcctattattcaaccgataccgccctgcccgaggagggaggtcgaaccgcgctccacatggcctgtgagcgcgaggatgataacaaatgcgctagagacatcgtgagactgttactgtcacatggtgcaaatcccaaccttctgtggtcaggacacagccctttatctttgtccattgcttccggcaacgagcttgtcgtgaaggaactcctgacccagggagcagatccaaacctgcctctgaccaagggtctgggctcagccctgtgtgttgcctgcgatctgacatacgagcatcaacgcaatatggacagcaaattagcgcttatagataggctcattagtcatggagctgacattctgaaacccgttatgctccgacagggggaaaaggaagccgtcggaacggccgtcgactacgggtactttcggtttttccaggaccgcaggatcgcccgatgtccattccacacactgatgcccgcagaacgggagacattcttggctcgtaaaaggcttttggaatatatgggattgcagctgaggcaagccgtgtttgccaaggaatcccagtgggatccgacatggctctacctctgcaagagggctgaactcattcccagtcacagaatgaagaagaagggacccagcttgccgcgtggactggatgtgaaagagcagggccagattccttttttcaagttctgctaccagtgtgggaggtccataggcgtgcgtttactgccttgcccccgctgctatggaatcctgacatgcagcaagtattgtaagacaaaagcatggaccgagttccacaaaaaggactgcggcgacctggtcgcaatcgtaacccagctagagcaggtctcacgccgccgggaagaattccaatag

SEQ ID NO: 44161 - DNA, 2154 bp, Artificial Sequence
  Description of Artificial Sequence: Synthetic coding sequence
atggagggcgcccacgccagcctgagcctggaggacgaggtgagcggggccggcagccgccaacggccgctcgagggcaaaggcggtgaaacccccgccgcagaggaaccaggctctctgaaaaactacgccgtcttcgcaacacgagacgtgagtgctgctcccgaaaaagaagaggaggaagctgagggcccactccgagctcaggaccttcgagagagttatatccagctggtccagggggtgcaagaatggcaggacggctgtatgtatcagggggagtttgggctcaacatgaaactgggctacggaaagttcagctggccgactggagaatcctaccacggccagttttacagggatcactgccacgggttaggaacatacatgtggcctgacggatcttcctttaccggaacattttacctatcccatagggaggggtacggcacgatgtatatgaaaacacgcctcttccagacgcactgccataatgatatcgtgaatcttctcctggattgtggagctgacgttaataaatgcagcgacgagggactcaccgcactgagcatgtgttttcttcttcactatcctgctcagtcgttcaaacccaacgttgctgaacggacgatccccgaaccccaggagcctcctaagtttcctgtggttcccatcttgtcctccagctttatggacaccaacctcgaaagcctgtactatgaggtcaacgtacccagtcagggatcgtacgagctgcgccctcctcctgccccgttattattgccgcgcgtgtctgggtcccacgaaggagggcatttccaagatacgggacaatgcggcggctccatcgatcatcgctctagtagtctgaagggtgactctccgctcgtcaagggtagtttaggtcatgtggaatcaggcctagaggacgtgttaggtaacacggatcgtggctcgttatgtagcgcggagaccaaattcgaatcaaatgtgtgcgtgtgcgacttctctatcgaactgtcacaggccatgctggaacggtctgcgcagtcacatagcctcttgaagatggcaagcccaagcccctgtacctcttcgttcgacaagggaaccatgcgaagaatggctttatcaatgatcgagagacggaagaggtggagaacaattaaacttctcctgagacggggcgccgaccctaacctgtgctgcgtgcccatgcaggtcctttttctcgcagttaaggccggcgacgttgatggggtaaggctgttactggaacatggggctcggactgatatctgttttccacctcagttatctacgctcacccctctgcacatcgctgctgctctcccaggcgaggagggagttcagatcgtcgaattgctgctgcacgcaataacagatgtggacgccaaggcaagcgacgaggacgatacgtataagccgggtaaggtggtcaaggaactgctgactcagggagcggatccaaatctgccccttacaaaaggactgggaagcgccttatgcgttgcgtgcgatctgacctacgaacaccagcggaacatggactccaagctggcactcattgacagactgatcagtcatggggcagacattctaaagccagttatgctacgacagggggaaaaagaggccgtggggaccgcagttgactatgggtattttaggttcttccaagatcgaagaattgcccgctgcccctttcacacattgatgcccgctgagcgcgagacttttttggccaggaagcggctgctggaatacatggggctgcagctcaggcaagccgtttttgccaaggagtcacaatgggatccaacatggctttacctttgtaagagggccgagctcattccatcacaccgtatgaagaaaaaaggtccctctctcccccgcggtttggacgtcaaagaacagggccagattcctttcttcaagttctgctaccagtgcggccgatccattggtgtgcggctgctaccctgtccccgttgttatggaatcttaacctgctcaaaatattgcaaaacaaaagcatggacagaattccacaaaaaggattgcggagacctggtcgccatagtgacccaactggaacaggtgagtaggcggcgcgaggaatttcagtag

SEQ ID NO: 44162 - DNA, 2136 bp, Artificial Sequence
  Description of Artificial Sequence: Synthetic coding sequence
atgtaccagggcgagttcggcctgaacatgaagctgggctacggcaaattctcctggccaacaggtgaaagctaccatggccagttctatcgcgaccactgtcatgggctcggcacttacatgtggcccgacggctcctcctttacagggaccttttatctgagccaccgggagggatatggcaccatgtacatgaagacacgactgtttcagacccactgccacaacgatatcgtgaacttactgctcgactgcggagccgatgtgaataagtgttcagatgagggccttaccgcactttccatgtgtttcttgcttcactaccctgcccagtcttttaaacccaacgtggcagaacggacaatacccgagcctcaggaacctcctaaattccctgtggtcccgattcttagctcctcctttatggacacgaatttggagtcactgtactacgaggtgaacgtgcccagccaagggtcctacgagttgagacccccgcctgccccgctcttgctaccacgggtgagcggatcccacgagggcggacacttccaggacactggccaatgtggcgggagtattgatcacagaagttccagtctaaagggcgattcacctctggttaaaggttccctaggtcacgtcgagagcgggttagaagatgtattgggaaacacagatcggggatccctttgtagcgccgagacgaaatttgaaagcaacgtgtgtgtatgtgactttagtatagaattgtctcaagccatgctcgaaaggtcagcccagagtcactcacttttgaagatggctagccccagcccctgcactagctcgttcgacaagggtactatgagacgcatggcactttctatgattgaaaggcgtaagcgctggcggaccataaagctccttttgaggcggggcgcagaccctaacttatgctgtgttcctatgcaggtactgtttcttgctgtgaaggcgggagatgtcgacggcgttcgtttactgctggagcatggagcgcgtaccgacatttgttttcccccccagcttagcactcttacaccgttgcatattgcagctgccctcccaggggaagaaggggttcagattgtggaacttcttctacacgcaatcaccgacgtggatgccaaggcatccgatgaggatgacacttataaaccgggtaaactggacctgcttccatcctctctcaagctgagcaatgaacctggtcctcctcaagcctactatagcacggatacagccttacctgaggaaggcggacgcacagctctccatatggcttgcgaacgggaggacgataataaatgcgccagagacattgtgcgcctactgttgagccacggggcgaacccaaacctattgtggagtggccatagccccctctcactgagtatcgcctccgggaacgagctggtggttaaggaattgctcactcagggggcggaccccaacctgcctcttactaagggactagggagtgctttatgtgttgcatgtgacctgacttatgagcaccaacggaacatggacagtaagttggccctgatagacaggttgatctcacatggcgccgatattctcaaacccgtgatgctgaggcagggtgaaaaggaagcagtgggcacagccgttgactacggatactttagatttttccaggatcggaggatcgcccgttgtccctttcacaccttaatgcccgccgaacgagaaacttttctggcacggaagcggctgcttgagtacatggggcttcagctccgacaggccgttttcgccaaggaatctcaatgggatccaacttggctgtacttatgcaagcgagccgaactgatcccatctcaccgaatgaaaaaaaagggcccatcattgccacgcggtctcgatgtgaaggagcagggtcagattccgtttttcaaattttgctaccagtgcggacggtccattggagtaagactgctaccttgccctcgctgctatgggattctgacctgtagcaaatactgtaagaccaaagcatggaccgagtttcacaagaaggattgtggcgatctcgtggcaattgtgactcaattggagcaggttagtagacgcagggaggaattccaatag

SEQ ID NO: 44163 - DNA, 2826 bp, Artificial Sequence
  Description of Artificial Sequence: Synthetic coding sequence
atgtaccagggcgagttcggcctgaacatgaagctgggctacggcaaattttcctggcccactggagagagctaccatgggcagttctaccgggatcattgtcatgggttgggaacgtatatgtggccagatggtagctctttcacgggcaccttttatctcagtcaccgcgagggttatggcaccatgtacatgaagacccgccttttccagggtctttataaggctgatcagcggtttggacccggcgtggagacctaccctgatggctcacaggacgtcggactctggttcagggaacagctaataaagctgtgtacgcagatccccagtggattctccttactacggtatccagagttttcttcctttattactcatagcccagcccgcattagtctatcagaagaagaaaaaactgagtggggactgcaggaagggcaggatccatttttttacgactataaaaggttccttcttaacgacaatctgaccttgccccctgaaatgtatgtatacagtaccaactctgaccacttgccgatgacaagttccttcaggaaggaattggacgccagaattttccttaacgaaatccccccattcgtggaggatggggagccctggttcataattaatgaaaccccccttttggtcaaaatacagaaacaaacctataaattccgcaacaaacccgctcatacgtcttggaatatgggggcgatcttagagggcaagaggagcggttttgcgccctgcggcccaaaagagcagctgagcatggaaatgattcttaaagccgaggaagggaaccatgagtggatttgcaggattttgaaggacaatttcgcctccgctgacgtggcagacgccaaggggtacacagtcttggccgcagctgccacacactgccataatgacattgtgaatctgctgctggattgtggagccgatgtcaacaaatgctctgacgaagggctgacagcactgtctatgtgttttcttttgcattaccctgctcagagttttaaaccaaacgtggcagagaggaccattccagagccacaggaaccaccaaaattcccagtggtgccaatcctttctagttcatttatggacacaaatttagagtccctgtactatgaggttaatgtcccctcgcagggctcttacgaactcaggccaccccccgcccctttattactcccccgggtctccggaagccatgagggagggcattttcaggatacaggtcagtgtggtggcagtattgatcatcgttcctcaagcctgaaaggggattccccactggtcaaggggtcactcggccatgtggagtccggactggaggacgtactcggcaacacggaccgcgggtccctctgctcagccgaaaccaaatttgagagcaacgtgtgcgtgtgcgatttcagcatcgaactctcacaggctatgcttgaaagatctgcccagagccactccctactaaaaatggccagcccttctccctgcacgtcctcttttgacaaagggacgatgagacgtatggcccttagcatgatcgagcgccgaaagaggtggcggacaataaagctattactgagacgcggcgcagatcccaatctgtgctgtgtgcccatgcaggtcctatttctggccgtgaaagctggagacgtggacggcgtgcgactcttgttggagcacggtgctcggacagacatttgcttcccacctcagctgtcaactctcacccccctccacattgccgccgccctgcccggggaggaaggcgtacaaatagtggaactgctcctgcacgccataaccgacgtcgacgcaaaggcaagcgacgaagacgatacatacaagcccggtaaactcgacctgttaccgagttccttgaagctatctaatgaacccggccccccacaggcctattactccaccgacacagctctgcctgaggagggtggacgtacagccctgcacatggcctgcgagcgcgaggatgataacaagtgcgcccgcgacatcgtgcgcttactgctcagccacggagctaatcctaatctcctgtggtccggacactctccgctaagcctgtcaatagctagtgggaatgagttggtggttaaggaactcctcactcagggtgccgacccaaacctccctctcactaagggcctcgggtccgctttatgtgtcgcatgcgatttgacgtatgagcatcagcgcaatatggatagcaagctggccctcatcgaccgattgataagccatggcgcagacatcctcaaacccgtgatgctacggcagggcgagaaggaagccgtgggcaccgcagtggactacgggtacttccgattctttcaagatcgccgtatcgccagatgcccctttcacactctgatgcctgcagagcgggagacatttctcgccagaaaacgtctgctcgagtacatgggactgcagcttaggcaggcagtgtttgcaaaggagtcgcagtgggacccaacttggctgtacttgtgtaagcgggccgaactgattccctcccatcgaatgaagaaaaaggggcctagcctgccgagaggactggatgtgaaagagcaaggacagatcccttttttcaagttttgctaccagtgtggccgctcaattggtgtccgactccttccttgtccccgctgctatggcatcctgacttgttccaaatattgcaaaactaaggcctggacagagtttcacaagaaggactgtggggacctggtcgccatagtgacacagctggaacaggtgagtcgacggcgtgaggagtttcaatag

SEQ ID NO: 44164 - DNA, 1320 bp, Artificial Sequence
  Description of Artificial Sequence: Synthetic coding sequence
atggagggcgcccacgccagcctgagcctggaggacgaggtgagcggcgccggatccaggcagcgtcccctggagggtaagggaggagagacacccgccgcggaggagcccggtagcttaaagaactacgctgtgtttgccacccgggacgtatcagccgccccggagaaagaggaagaggaggccgaaggtcctcttcgcgcccaggatcttcgggaatcctacattcagctagtgcagggcgttcaggaatggcaggatggatgtatgtaccagggcgagttcggacttaacatgaaactcggttatggcaagtttagctggcccacaggagaaagctaccacgggcagttttatagggatcattgtcatgggctgggtacatatatgtggccagatgggtcctccttcaccggcaccttctacctaagccacagggaggggtacggcaccatgtatatgaagaccaggctgttccaaacccattgtcataatgatattgttaacttgctgctggactgcggtgccgatgttaataaatgtagtgacgagggcctgacagccctgagcatgtgttttctgctgcactatccagcacagtcattcaagcctaacgtcgctgagaggacgatcccagagccgcaggaaccaccaaaatttccagtggtgcctatattgtcctcgagctttatggacacaaatttagaatccctttactatgaggtcaacgtgccctctcaggggagctatgaattacgcccacctccagccccacttctgctccccagggtgtccggctctcacgaaggaggccattttcaagacactgggcagtgtggaggctccatagaccatagatcttcatcgctgaaaggggatagccccctggtaaaaggctccttgggacatgtagagagcggcctcgaagacgtgctcggcaacactgatcgcgggtctctgtgctctgcggaaaccaaattcgagtccaacgtgtgcgtctgtgacttctctatcgagctaagtcaggccatgctggagcgaagcgcacagtcccactctctgctcaagatggcctccccctcaccgtgcacgtcgagctttgataaaggcactatgcgtcggatggccctgagtatgatcgagcgccgcaagcgctggagaaccattaaattactcttgaggcgtggcgcagatcccaacttatgctgtgtccccatgcaggtgctctttctggccgtcaaagctggggacgtggacggggttcgtttactactagaacatggggcccgcactgacatctgctttcctccccaatgttag

SEQ ID NO: 44165 - DNA, 225 bp, Artificial Sequence
  Description of Artificial Sequence: Synthetic coding sequence
atggagggcgcccacgccagcctgagcctggaggacgaggtgagcggcgccggctccagacagcgacctctcgagggtaaaggcggtgagacccctgcagcagaggaaccgggcagcctcaagaactacgccgtcttcgctaccagagacgtctctgctgcacctgagaaggaggaagaggaagcagagggtccgctccgcgcccaggacctgcgagagagttag

SEQ ID NO: 44166 - DNA, 684 bp, Artificial Sequence
  Description of Artificial Sequence: Synthetic coding sequence
atgtaccagggcgagttcggcctgaacatgaagctgggctacggcaagtttagctggccaaccggcgaaagttatcacgggcagttttatagggatcactgccacgggttaggaacttatatgtggcctgacgggagcagttttacgggcactttctatctaagccaccgagaggggtatgggactatgtatatgaagaccaggctattccagggcctgtacaaagccgatcagaggtttggcccaggtgttgagacttaccctgacggctcccaagacgttggcctctggttcagagaacagttgatcaagttatgtacacagatacccagtggcttcagcttactacgttacccggagttcagcagctttatcactcatagccccgccaggatcagtctgtccgaggaagaaaagaccgaatggggactgcaggaaggacaggatccgttcttctacgactacaaacggttcttactgaacgacaacttaaccctgcctcccgaaatgtatgtgtatagtaccaattcggaccatctgccaatgacaagctccttcaggaaggagctcgacgcccgtatctttctcaatgaaataccaccttttgtggaagatggcgaaccgtggttcataattaacgagacacctctgctcgtcaagatccagaagcaaacctataagtag

SEQ ID NO: 44167 - DNA, 1020 bp, Artificial Sequence
  Description of Artificial Sequence: Synthetic coding sequence
atgcgggacgtgagcgccgcccccgagaaggaggaggaggaggccgaagggccgctgagggctcaggatcttagggagtcttacatccaactggttcaaggggtgcaggagtggcaagatgggtgtatgtatcagggggaatttggactaaatatgaagctggggtacgggaagttcagttggcccactggtgaaagttatcatggccagttctacagggaccactgtcacggcctcggcacgtacatgtggccagacggatcaagtttcacagggaccttctacctgagtcatagagagggatacggtacaatgtatatgaaaaccagacttttccagacacactgtcacaatgatatcgtaaacctgttgctggactgtggagcagacgtgaataagtgttccgatgagggcttgactgctctctctatgtgttttctgctgcattaccctgctcagagctttaagccaaatgtagctgaacggaccattcccgagccgcaggagccgcccaagtttccggtagttccaattctcagcagctccttcatggacacaaacctggagagtttatactacgaggtgaatgtgcccagtcaggggagctacgaacttagacccccacctgcacctctgctgctgccaagggtctcaggaagtcacgagggggggcacttccaagatacgggacaatgtggcggttccattgatcatcggtccagttccctgaaaggggatagtcctctggtcaaaggtagtctcggacatgtagagtcagggctggaggatgtcctgggcaatactgaccgggggtccctctgctcggctgaaaccaaatttgagagtaatgtgtgtgtgtgtgattttagtattgaactttcccaagcaatgctggaacggtccgctcagtcccattcactgctgaaaatggcaagcccgtccccttgtacttcctcattcgataaaggtacaatgcgccggatggcgttgagcatgatcgagagctgcagcttgctctag

SEQ ID NO: 44168 - DNA, 741 bp, Artificial Sequence
  Description of Artificial Sequence: Synthetic coding sequence
atgtaccagggcgagttcggcctgaacatgaagctgggctacggcaaattttcttggccgacgggtgagtcctaccatggccagttctacagagatcactgccacggtctggggacctatatgtggccagacgggagtagtttcaccggcacgttttacctgagtcatagagaagggtacggcacaatgtatatgaagacaaggctgttccaaggattgtacaaggccgatcagcgtttcggcccaggtgtggaaacataccctgacggcagtcaagacgtggggctgtggtttcgcgagcagctaattaagctgtgtactcaaatcccgtccgggttcagcttgctgcgctatcccgagttctcttccttcatcacgcattctcccgccagaattagtctgtcagaggaagaaaagactgaatggggtctccaggaggggcaggacccattcttttatgactataaacggttcctgttaaatgacaacctaaccctgcctcccgagatgtatgtctattccaccaactccgatcacttgcctatgaccagttcttttaggaaggagctggacgccagaatctttttgaatgagattcccccttttgtcgaagacggcgaaccttggtttatcatcaacgagaccccactgctggtaaagatacagaagcagacttacaaattccgcttaactgcaacaaccaccctgagcactttcagctggacagtgggacccacatag

SEQ ID NO: 44169 - DNA, 1326 bp, Artificial Sequence
  Description of Artificial Sequence: Synthetic coding sequence
atggtgcacatcaagaagggcgagctgacccaggaggagaaggagctgctggaggtgataggtaagggcaccgttcaggaggccggaaccttgctgtcatcaaaaaatgtaagggttaactgcctagatgagaacggcatgacccctcttatgcacgctgcttacaaaggaaagctcgatatgtgcaagctcttgctccgccacggcgctgatgtgaattgtcaccagcatgagcacggttacacggctcttatgttcgctgctctaagtggaaataaggacataacctgggtgatgctcgaggcaggtgctgaaaccgacgttgttaattctgtgggcaggactgctgcccagatggccgcttttgtgggccagcacgactgtgtgacgatcattaacaacttttttccccgagaaaggctggactattatactaaacctcaaggtctggataaagaacctaaattgccacctaaattagctggaccactacacaaaatcatcacaactactaacctgcatcccgtgaagatagttatgttggtcaatgaaaacccactcctaactgaagaagccgccttgaacaaatgctaccgtgtgatggatctgatctgtgaaaagtgcatgaaacagcgggacatgaatgaagtcctcgctatgaagatgcactacatttcttgcattttccagaagtgtattaatttcctgaaagatggggagaataagctggatacgctaataaagagtctcctgaagggccgggcatctgacgggttcccggtttaccaggagaagatcatacgcgagtctattcgcaaattcccatattgcgaagcaactctcctccagcaacttgtgcggtccattgcccctgtagagataggctcggatcctacggcgttcagcgtcctgactcaggctataactggacaggttggcttcgtggacgttgaattttgcacaacttgcggcgagaaaggagcttccaagaggtgtagtgtttgtaaaatggttatttactgcgaccagacatgtcagaaaacccactggtttacacacaaaaaaatttgcaagaacctgaaggatatctatgagaaacagcagctggaagccgcaaaagaaaaacgtcaggaggagaaccacggcaagctggatgtcaacagtaactgcgtcaacgaagagcagcctgaggctgaagttggtatttcacaaaaggactccaacccggaagacagcggagaaggtaaaaaagaaagcttggagtcagaggccgagctggagggacttcaagacgctcctgccggtccacaagtgtcggaagagtag

SEQ ID NO: 44170 - DNA, 1290 bp, Artificial Sequence
  Description of Artificial Sequence: Synthetic coding sequence
atgctgatgagctggagccccgaggagtgcaagggccagggcgagcccctcgacgatcgccatcccctgtgcgctcgactggtggagaagccttcccgtgggtcggaggagcacctgaaatccggacctggaccaatagttacacgaactgcgagcgggcctgcgcttgctttctggcaggccgtgctcgccggcgacgtgggatgcgtcagtcggatcctcgcggacagctccacaggtctggcgcctgactccgtatttgatacttctgacccagaacggtggcgtgatttccgctttaatattcgggccctgcgactgtggagtctaacctacgaagaagagcttacaacgccactacacgtggcagcatccagggggcatacagaagtgctgagactgcttttgaggcgtcgtgcacgaccggactcagccccgggggggaggactgcactgcacgaagcttgcgccgctggtcataccgcctgcgtccacgtccttttggtggctggtgctgatccgaatatcgctgaccaggatggcaaacggcctctgcatctttgtcgtggtcccgggaccttagagtgtgccgagttactgctaagatttggtgctagggttgatggccggagtgaggaagaagaggagacgcctttgcacgtagcggcccgcctgggacacgtggaacttgctgatcttttactacggcgaggagcttgtcccgacgccaggaacgccgaaggatggactcctctgctggccgcctgcgatgttcggtgtcagtctataacagacgcagaggctacaaccgcccggtgtctccaactctgtagtttgttattgagtgccggtgccgacgccgatgccgctgatcaagataagcagagacccctccatctggcctgcaggaggggtcacgccgccgtggtggaactgctgctttcatgtggagtgtcagctaacactatggactatggtggacacacccctcttcattgcgctttgcaaggccccgccgcagccctggcccagtctcctgaacatgtcgttcgtgccttattgaaccacggtgccgtgagagtgtggcctggagcgctgccaaaaaagcaccaacgattttactcctccctgttcgccctggtccggcagcctcggtcacttcagcatctctctcgctgtgctttacgttctcatttggaaggctcattgcctcaggccctgccccgcctgccactgccaccccgattgctgaggtacctgcaattggacttcgagggggtgctctactag

SEQ ID NO: 44171 - DNA, 1359 bp, Artificial Sequence
  Description of Artificial Sequence: Synthetic coding sequence
atgccctggggcaagaacagcagcccccactggggccaccacctgggctgtctcccttccgcgcccgcttgccgaatctggaggcctcactctaggcctgcatgggaaccgccccgcccttcacccctgctgtgccaagacatggcactgcagaacgctctgtataccggcgacttagctcggctgcaggagctgtttcccccacactccacagccgatctcctcctggagagcagagcagcagagccaaggtggagctcacaccagcgcggtttgtggtctctaacatacgaggaggaactgacgaccccactgcacgtagcggcttcgaggggccacactgaagtcctacggctgctgttgcgaagaagagctcgcccagattctgctcctggcggacgcacggcgctgcatgaggcgtgcgccgcaggacacaccgcgtgtgtgcacgtgttgctggtggctggggcggaccctaatattgctgaccaggatggaaagcgccctctgcacctgtgccggggcccaggcactctagagtgcgcggaattattgttacgcttcggcgcgcgtgttgatggcagatctgaggaagaggaagagacacctctccacgtggccgccagactgggccatgtcgagctggcagatctcctgttaagaaggggcgcatgccctgacgcacggaacgcagagggctggacccctttactagcggcctgcgacgttcgctgtcagtctatcaccgacgctgaagcaacaaccgcacggtgcctgcaactctgctctcttcttctgagtgcgggcgcagacgccgacgcggccgatcaggataagcagcgacctctgcatctggcctgtagaagaggacatgccgccgtggtggaactgctactttcctgcggggtctctgcaaataccatggattacgggggacatacacccctgcactgtgcattgcaaggcccagccgctgctctggctcagtcgcctgagcatgtcgtccgggctctgctcaaccatggcgctgttcgcgtctggcccggagctttgcctaaagttctggagagatggagtacatgcccgcgcacaatagaggttctcatgaatacatacagtgtcgtacagctgcccgaagaagcagtcggtctggtaacccccgagacgttgcagaaacaccaaagattttactctagtctgtttgcgctggttcgccaacctaggtcactccaacatctgtcaaggtgcgccctgcggtcccacctggaaggctcactgccgcaggcgttgcccaggcttccgctgcctcctagattactcaggtatttgcagctcgactttgagggggtcctgtattag

SEQ ID NO: 44172 - DNA, 1404 bp, Artificial Sequence
  Description of Artificial Sequence: Synthetic coding sequence
atgctgatgagctggagccccgaggagtgcaagggccagggcgagcccctcgacgatagacatccattgtgtgcacggctggttgagaaaccttcccgcggcagcgaagaacatctgaaatctggccctggcccgattgtaaccagaactgcatccggacctgccctggccttctggcaggccgtgctcgccggcgacgtaggatgcgtttccagaatacttgccgactcctccacagggctggccccagattccgtgtttgacacaagcgatcccgaaagatggcgggatttccgcttcaacattagagcattgcgcctctggagcctgacgtacgaggaggaattgactacacctcttcacgtcgccgcatccaggggccataccgaagtgttgagactgctattacgccggagagcgagacccgactctgcaccaggcgggagaaccgctctgcacgaagcttgtgccgccggacacaccgcatgcgtacacgtacttttggtggccggcgccgacccaaacatcgcggaccaggatggcaagcggcccctgcacctctgcagaggccccgggaccctcgagtgtgctgagctgctcctgcgcttcggcgctcgcgtggatggccggtccgaggaagaagaagagacgccattacatgttgctgctcgcctgggccatgttgagcttgctgacctgcttctgcggcgcggcgcttgcccagacgctagaaatgccgagggatggacacccctgctggccgcctgtgacgtccgatgccaatctatcactgacgctgaggctactactgcgcgttgtttgcagctgtgctccctgctgttatcagccggagctgatgctgacgctgccgaccaggataagcagcgccccttacatcttgcttgtcgccggggccatgccgccgtcgtagaactgctgttgagctgcggggtctctgccaatacaatggattacggcggacacaccccgctccactgcgccctgcagggaccagctgccgccctagctcagtcccctgaacacgtggtgagggctctgctgaaccatggcgctgtccgggtctggccaggggctctccctaaggtcttggaaaggtggagcacgtgccctcgcacaatcgaggttttgatgaacacatatagtgtggtccaacttccggaagaggcggtcgggctcgtaacaccggaaactttgcagaagcatcagagattctacagttctctttttgctctggttcgacagccacggtcgctgcagcacctgtctcggtgcgcactgcggtcgcatctcgaaggctccctacctcaggctctcccaaggttacccctgccacctcggctgctgagatatctgcagctggacttcgaaggggtgctgtattag

SEQ ID NO: 44173 - DNA, 1539 bp, Artificial Sequence
  Description of Artificial Sequence: Synthetic coding sequence
atgcggggccaggtgagcctgggcgcctgggacaccggcgccttctgcctctctgtgtttccttcctgctcactgtctctttcactcccacttgcctatactagtcctccccctcactcaccattccctgcacacatgcttatgtcctggagtcccgaggaatgtaaggggcagggagaaccactcgatgacaggcaccctctgtgcgccaggcttgttgagaagccctcccggggctccgaggagcatttaaaaagcggacctggccctattgtgactcggacagcttccgggcctgcgttggctttctggcaagctgtgctggccggagatgtgggctgtgtttctaggattctggcggactcttccacagggttggctccagactccgtctttgacacatctgaccctgaaagatggagggacttccggttcaatattcgtgccctgcgcctatggtccttgacatatgaagaggaactcactacaccactgcatgtggccgcaagtcggggccataccgaagtattacggcttctccttcgtaggcgtgctaggcccgattcagcacccggcgggcggacagccttgcacgaggcatgcgcggcaggacatacggcttgtgtccacgtactccttgtggccggtgccgacccgaatatagctgaccaggatggcaaaaggcccttacatttgtgtcgggggcccggcacactggagtgcgccgaattactgctcagatttggagccagggttgacggtagatcagaggaagaggaggagaccccacttcacgtcgctgcgcgtctggggcacgttgaattagcggatcttctgttacggcggggcgcttgcccagatgctaggaacgccgaaggctggacaccactgctcgcggcctgtgatgtgaggtgtcagtccattactgacgcagaggccacaaccgctcgctgtctccagctgtgcagccttctgttgtccgctggcgcagatgcggacgcggccgatcaagataagcaacggccccttcacctggcctgccgaaggggacacgcggcagtggtcgagcttttgctgagctgcggggtttcagcaaacaccatggactacggaggtcatacacccctgcattgcgcgctgcagggtccagccgccgctctagcacagagtcctgagcacgtggtcagggccctgctgaatcacggtgcggtgagagtctggcctggggcgctgcctaaagtgttagaacggtggtccacatgtccccgaacaatcgaggtgctgatgaacacctatagcgttgtccagctccctgaggaggccgttggattggtaactcctgagacattacagaagcaccagcggttttatagcagcttatttgctttagtaaggcagccaagatcacttcagcacctatctcggtgtgctctgagaagccacctggagggcagcctgcctcaagccctacctagactccccctgccacctcgcttgctccgatacctacagctggattttgagggggtactctactag

SEQ ID NO: 44174 - DNA, 1425 bp, Artificial Sequence
  Description of Artificial Sequence: Synthetic coding sequence
atgcggggccaggtgagcctgggcgcctgggacaccggcgccttctgcctgtcggtgtttccctcatgctctttatccttgagtctcccattggcgtacacgagtccgccaccccatagcccattccctgcgcatatgcttatgagttggtcacccgaggagtgcaagggccaaggcgaaccgcttgacgataggcaccctctctgcgcacgccttgttgagaagccaagtcgagggtcggaggagcatctgaaatctggaccagggcctatcgtgacccggactgcctcggggccagctctcgccttctggcaggctgtgctggctggagatgtgggttgtgtctccagaattctagcggactcgtccaccggccttgcccctgacagcgtcttcgacacaagtgacccagaacgatggagagactttcgcttcaatatcagagctctacgcctctggagcctgacctacgaggaagagctcacaactcctttgcacgtggctgcctctcgcgggcatactgaggtgttgagactcctcctccgtagaagggctcgccccgacagtgcaccagggggacgcaccgcacttcacgaggcctgcgccgctggccacacagcctgcgtgcacgttttgctggtggccggagccgacccaaatatcgccgaccaggacggaaaaaggcctttgcatctgtgtcgagggccaggcactttggaatgcgctgaactcctgttaaggtttggggcccgtgtggatggtcggagcgaggaagaggaggaaactcctctccacgttgcagcacggctcggacatgtagagttagctgatctactgctgagaagaggagcctgcccggacgcaagaaacgccgagggctggaccccactgctcgccgcctgtgatgtcagatgtcagtccatcaccgacgccgaagcaacgactgctcgctgcttacaactgtgctccctgttgctgtctgccggtgccgacgccgacgccgcagaccaggataagcagcgcccgctccatcttgcgtgtcggcggggtcacgcagcagtggtcgagttgctgctatcatgcggagtgtccgccaacactatggactacggggggcatactcctctgcattgtgccctccagggccccgccgccgccctggctcaaagcccagagcacgttgtgcgcgcccttctcaaccacggggctgtgagggtgtggcccggagcactgccaaagaagcaccagcgcttctatagttctttgttcgccctagtgaggcaacctcggtcactgcaacacctgtcgaggtgtgcattacggtctcaccttgaaggctccctgccccaggctttgcctcgcctcccattgccgccacgcctgctgagatacctgcaactggatttcgagggagtgctctattag

SEQ ID NO: 44175 - DNA, 861 bp, Artificial Sequence
  Description of Artificial Sequence: Synthetic coding sequence
atgcggatcgtgctgcagctggccaagatgaacctgatggacatcacaaagatcttttcactgttacagcctgataaggaggaggaagataccgacacagaggagaaacaggctctgaatcaagctgtctatgataacgatagctatacgctggatcagctgctgcgccaagaacgttacaagaggtttatcaattccagatctggctggggggtacctggcacgcctctacggttggccgctagctacggtcacctgagttgcctacaggtgctcctcgctcacggcgcagatgtggattcgttggacgtgaaagcccaaactcccctgtttactgccgtgtcccatggccatctcgactgtgtgagagtgttgttggaggccggcgcttcacccggtggaagcatctataacaactgttcaccggtgcttacggccgccagggacggcgcggtcgctattctgcaggaactgctggatcatggtgccgaagccaacgtaaaggctaaactgccggtttgggcatccaacatcgcttcttgctccgggcctctctatctggccgccgtgtatggtcatcttgattgtttccgtctgcatcataattgcgaacccgagtatatccaactgctgattgacttcggagccaatatctatttaccatctctgagcttggatcttacaagtcaggatgacaagggcattgccctcctgcttcaggctcgcgccaccccacggtcgttgctgtcccaggtcaggctggtggtgaggcgcgccttgtgtcaggccgggcagccacaagcaatcaatcagctggacatcccccccatgctgatctcttatctcaagcatcagttgtag

SEQ ID NO: 44176 - DNA, 957 bp, Artificial Sequence
  Description of Artificial Sequence: Synthetic coding sequence
atgcggatcgtgctgcagctggccaagatgaacctgatggacatcactaagattttctccctgttacagcccgataaggaagaggaggacaccgacaccgaggaaaagcaggctctcaaccaggctgtgtatgacaatgatagttacaccctggaccagctgttgcggcaggaacgttacaagcgatttattaatagtcgctctgggtggggagttcccggaaccccgcttcgcctggccgcctcctacggacatctatcctgcctgcaggtgcttcttgcacatggagcggatgtggactctctggacgtgaaagcccagactcctctcttcactgcagtttcgcacggtcatctggattgcgtgcgagtgctgcttgaagccggcgcaagtccgggtggatccatctataataactgtagcccggtgctgacagcagcgcgcgacggtgcggtcgccattctccaggaactcctggatcacggggctgaggctaatgtcaaggccaagctgccggtttgggcttcgaatatcgccagctgttcaggcccgctgtacttagcggcggtgtacggccacctcgattgtttcagactactgctgctgcacggcgcagatcccgattataactgtaccgaccaggggctgctggccagagtgcccaggccccggacccttctggagatctgcctgcaccacaattgtgagccagagtacattcagctgctgattgactttggagccaacatctatctgccatcactgagcctggacctgaccagccaggatgataaaggaatcgccctgctgctgcaagcaagagcaactcctcgcagcttactgagccaggtgcgcctggttgtgaggcgcgccctgtgccaggccggccagcctcaagccataaatcagctggacattccccctatgctgatcagctacctcaagcaccagctgtag

SEQ ID NO: 44177 - DNA, 930 bp, Artificial Sequence
  Description of Artificial Sequence: Synthetic coding sequence
atgaacctgatggacatcaccaagatcttcagcctgctgcagcccgacaaggaagaggaagatacagataccgaggagaagcaggccttaaatcaggcagtgtatgacaatgactcttatacactggaccagctacttagacaggaaagatataagaggttcattaattctcgcagcggatggggcgttcctggaacgcccctccgactggccgcaagttacgggcatcttagctgcctccaggttctgcttgctcacggggccgatgtcgacagcttggacgtgaaagctcagacgcccctgtttacggcggtttctcacggccatctggactgtgtccgtgtactccttgaagccggggcctccccaggaggctccatatataacaattgcagccctgtactcacggccgcaagggacggtgccgttgcaatcctgcaggagctgctggatcacggcgccgaagcaaatgtgaaggctaagctccccgtgtgggcatcaaacattgcaagctgctcaggccccctatacctagcggcagtgtacggacacttggattgctttcgcctgttgctgctccacggagcggaccccgactataattgcaccgaccaagggctgcttgccagggtgccccgaccaaggaccctattggagatctgccttcaccataattgtgaacctgaatacatccagctgctaatcgattttggcgctaacatttacctgccatctctcagcctggatctgaccagtcaagatgacaaggggattgccctccttcttcaggcgcgggccactccacgttcactgcttagccaggtacgtttagtagtcaggagagcactttgccaggcagggcagcctcaggccatcaaccaattagacattcctcctatgctgatttcttacctaaagcaccagctgtag

SEQ ID NO: 44178 - DNA, 1764 bp, Artificial Sequence
  Description of Artificial Sequence: Synthetic coding sequence
atggacaactacaccagcgacgaggacatcgacgaggacttcgacacacagctgatcattcagcagtcactgcaggatatctataagcctggaacagcccagcatgcacctaaggatgagagtttgcactcatttctgtctgcggattataagaagattgtagaaacgatcgagaaagtcggcaaggaggatgccctgtcccaccttactaagtaccactccgctttcggcgaagcagatgagattggatggatccctctgcacaaagctgcagtgcagttgaaccggaagatcctcgagattaccctttctgcttccgatcctagcctttgggagcagacaacccacaatggagagacaccgctgttcctcgcagtctcgagctgcttactggagaacgcgacattcctgctgctgaacggctgcaaccctaacgccaaaaatttcgaggggaattctcctctgctagctgccgttcttagggattgctatgatatggcagccctgcttatcaattatggggccgatgtcaatctacgctgcgccaatgaaaggactgccctgcatgaggcggcgaaactgggccgagaggacatggttaaactgatgcttgtcagcggtgctcatcccgaccctcaatccacctacggttttacgccattggctcttgctgcccagagtggccatacggagatcatggagatgcttctgaggaagggcaaaatcttctgccttgcttcagattcctctagtattctgctcgaggccgcttccggaggaaacccagatgctgtggcgctcctgctggagtacggagccgacgccaacattccaaaaaattccggtcacctgccaattcatgtggctgcagacagagggcaccttctcgcattgaaaatactgatcccagtgactgacctggcagcaatcaagcagtctgggatctcccctgtgcactgtgcagccgcaggcgcccacccccagtgccttgagctgctgatccaagctggctttgatgtgaactttatgctggaccaaaggatcaataagcactacgatgatcatagaaaaagtgccctgtatttcgccgtctcgaacagtgaccttagcagtgtaaagctgctcctgagcgccggagctctccccaatcaggatcctgtcaactgtcttcagattgcactgcgaatggggaattacgagctgatttccttacttctcagacatggagccaacgtaaactacttttgtagagtgaaccccttgcacttccccagcgcactgcagtacaccctgaaggacgaggttatgcttaggatgctccttaattacgggtacgacaccgagcgctgcttcgattgcccccacggcgataaagttcatcctagctacaccgtagagggatggacttcaacggtgatcaaagacaccaagttctgcgaagtgatcaccctctcttggttgcagcacctaagtgggaaggtggttcgcgtgatgctggactacgtcgatcaggttcgtatctgttctaagctaaaagccgttctgcagaagcagggtatatggagtgagatccacttcatcctgactaatccccggagtctgaagcacttgtgtcgcctgaagatacgaaagtgcatggggcgcctgcatcttcggtgccctgtttttatgagcttcctgccgcttcccaatagactgaaggcctacgtcctttataaggaatacgacttgtatgggcagggcatttttacaggcacttggtag

SEQ ID NO: 44179 - DNA, 1272 bp, Artificial Sequence
  Description of Artificial Sequence: Synthetic coding sequence
atggccgccctgctgatcaactacggcgccgacgtgaacctgcggtgtgccaatgaacggaccgcgctgcatgaggccgcaaaactgggacgtgaagatatggttaagcttatgctcgtgtccggcgcccatcccgatccacagtcaacatatggatttaccccgctagcacttgccgcacagagcggccatacggaaattatggagatgctcttgagaaagggagccaatgcccacgggcaagcttccgacagctcttcaatcctacttgaagctgcttccggcggcaatcccgacgcagtggccctcctactggagtacggagcagatgccaacattccaaaaaacagcggccatttacctattcacgtggccgccgatcgtgggcacctgcttgcactcaagattctgatccctgtcaccgatttggccgccatcaaacagagtggcattagccctgtacactgcgctgccgcaggagctcatcctcagtgcctggagctgctgatacaagcgggcttcgacgtcaacttcatgctggatcagcgaataaataaacattacgatgaccaccgaaagtcagcactgtatttcgctgtcagcaactccgatctctcttcagtcaaactccttctgtccgctggggctctcccaaatcaggatcctgtgaattgtctccagatcgcgctgcgaatgggtaactacgagttgatcagcctcctgctgcggcacggggctaacgtgaattatttttgtagggtaaaccccctacactttccttccgcgctgcagtataccctgaaggatgaggtgatgctgcgcatgctgttgaactacggatacgacactgaaagatgctttgactgccctcacggggataaagtgcacccatcctacaccgtggagggatggacttctactgtcatcaaagatacaaagttctgcgaagtgatcactctaagctggctgcaacatctctccggaaaagtggtgagagtgatgctggactacgtggaccaggtgcgtatttgcagcaagctcaaagccgtgctgcagaaacaggggatctggtccgaaatccactttatcctaactaatccgcggagcctgaaacacctgtgccgcttaaagatcagaaagtgtatggggcggctccacttgaggtgtcctgtgtttatgagttttctgcctcttcctaaccgtctgaaagcctacgtcctgtacaaagagtatgatctctatggtcagggaatcttcaccggcacatggtag

SEQ ID NO: 44180 - DNA, 1764 bp, Artificial Sequence
  Description of Artificial Sequence: Synthetic coding sequence
atggacaactacaccagcgacgaggacatcgacgaggacttcgacactcagctgatcattcagcagtcccttcaggacatctacaagccgggaacggctcagcacgccccaaaagacgaaagcctgcattccttcctctccgcggactataaaaagatcgtcgaaactattgagaagggaaaagaggacgcactgagtcatttgaccaagtaccactccgcctttggggaggctgacgagattggctggatccccctgcataaggctgcagtgcagctgaatcgcaagattctggaaatcacactgtccgcttccgacccatccctctgggaacagaccacccataacggcgagaccccgttatttctcgcagtatcatcatgcttattagaaaacgcaacctttcttttgcttaatggctgcaatccaaatgccaaaaatttcgagggcaacagccccctactggctgccgtacttcgggattgctatgacatggctgctttgttgattaactatggagccgatgttaatctgagatgcgccaacgagagaacagctttacacgaggccgcaaaacttgggagagaagacatggtcaaactgatgctggttagcggcgcacaccccgacccccagagtacctatggctttacaccattggctcttgccgctcagtcaggtcataccgaaattatggagatgctgctgcgcaagggagcaaacgcgcatggccaagcctccgactcctcttcaatacttctggaagctgcaagtgggggcaatcctgacgctgttgcactcttgctagagtatggcgccgacgccaacatccccaagaactcaggacacctccccatccatgtggccgcagaccggggtcatttgcttgcgctgaaaatcctgatcccagtgactgacctggctgctattaaacaatcaggcatttctccagtgcattgcgccgctgcgggagcgcacccacaatgtctggagctgctgatacaagcaggcttcgatgttaatttcatgttggaccagaggattaacaagcactacgatgaccatcgaaagtctgctctgtactttgcagtttctaacagcgatctttcaagtgtcaaacttctcttgagtgctggggccttaccaaatcaggaccctgtaaactgtctccagattgctctgcgcatgggcaactatgagttgatcagcttactgctgaggcacggagccaacgtgaattatttctgtcgtgttaaccctctgcatttcccatctgcattgcaatacacattgaaagacgaagtcatgttaagaatgttgctcaactacggctacgatactgagaggtgtttcgattgccctcacggcgacaaggttcatccttcgtatacggtcgagggttggaccagcaccgtgatcaaagatacgaagttttgcgaagtaattacccttagctggctccagcacctgagcggcaaagtggtgcgtgtgatgctggactatgttgaccaggtgcgaatctgttctaagcttaaggccgtcctgcagaagcagggtatctggagcgaaatacatttcattctgaccaaccctagatctttgaagcacttgtgtcgcctgaagatccggaaatgcatggggcggctacacctacgatgcccggtgttcatgtccttcctcccgcttccaaatcgcctgaaagcctacgtgctttataaggagtacgatttgtacggacagggcatatttaccggaacatggtag

SEQ ID NO: 44181 - DNA, 1767 bp, Artificial Sequence
  Description of Artificial Sequence: Synthetic coding sequence
atggacaccaacgacgaccccgacgaggaccacctgaccagctacgacatccagcttagcatccaggagtcaattgaagcatcaaaaacggcgctgtgtcccgagagattcgtacccctgagcgctcagaatcggaaactggtcgaagccataaagcaaggtcacataccagagctccaggagtacgtcaagtataaatacgctatggatgaggcggacgagaaagggtggttcccacttcacgaagctgtcgtgcagccgatccaacagattctcgaaatcgtgctcgacgcctcctacaagactctgtgggagtttaaaacgtgcgacggtgaaactcccctgaccctggccgtgaaggctggtctagtcgaaaacgtgagaacacttctcgaaaagggggtgtggccaaatactaagaacgataaaggcgagacgccactgctcattgcagtgaaaaaaggctcatatgacatggtcagcacattgattaaacataacacgtccctggaccaaccctgcgtcaaacgctggagtgccatgcacgaagccgctaaacagggtaggaaagatatcgtggccctgctgctgaaacatgggggcaatgtgcacctgcgcgacgggttcggcgtaacacccctgggtgttgccgcggaatacggccactgcgatgttctggagcacctgatccataagggcggcgatgtgctagcactggcggatgacggtgctagtgtgttatttgaggctgctggagggggaaatcccgattgtatttctctgctgcttgaatacggcggaagcgggaatgtgcctaacagagccgggcacctccctatccatagggctgcttacgagggtcactaccttgccctgaagtatctcatccctgttactagcaaaaacgcaatcagaaagagcgggctgacacctatccacagtgcagccgatggtcagaatgcccagtgcttggagttgctgatcgaaaacggttttgatgtgaacacactcttggccgaccacatttcacagtcttatgacgatgaaaggaagacggcgctctacttcggcgtaagcaataatgatgtgcactgtaccgaggtactcctggccgccggcgcagatcccaacctagatccgctcaattgcctgctggtggcagtgcgtgccaataattatgaaattgtgcgcttgctcttatcgcacggtgccaatgtgaactgttatttcatgcacgtgaatgatactcggtttccatccgttatccagtatgccctgaacgacgaggtgatgctgcgattgctcctgaacaacggttatcaggtcgaaatgtgctttgattgtatgcacggggacatattcggcaacagcttcgtttggtcggagatccaggaagaagttctgccgggatggacttcttgtgtgatcaaggataaccctttttgcgagtttattaccgtgccctggatgaagcacttagtaggcagggttactcgcgtacttatcgattacatggattatgtacccttgtgtgcgaagctgaagtccgcacttgaggttcagcgtgagtggcctgaaattagacaaattcttgagaacccttgctccttaaagcacctgtgccgcttgaagattcgccgtctgatgggcttgcagaagctgtgccagcccgcaagtgtggaaaaactgccgttacctccggccatccagaggtatattctctttaaggaatacgacctgtacggccaggaactgaagttaacatag

SEQ ID NO: 44182 - DNA, 1767 bp, Artificial Sequence
  Description of Artificial Sequence: Synthetic coding sequence
atggacaccaacgacgaccccgacgaggaccacctgaccagctacgatattcagctctccatccaggagagtatagaggctagcaagacagcactctgccccgaacggtttgtacctttgagtgcccaaaatcgaaagcttgtagaggccatcaagcaggggcatatacctgagctacaggaatatgtaaaatacaaatatgccatggatgaggcagacgaaaaaggctggttccccttgcacgaggcagtggtgcaacccattcagcagatcctagaaatcgtcctggacgcgtcatacaagactctgtgggagttcaagacctgcgatggggagactcccctgacacttgctgtgaaggcgggcctggtggagaacgtgcgaacattgttagagaagggcgtctggcctaataccaagaacgataaaggggagactcccctgctcattgctgtgaagaagggctcctacgatatggtaagtactctcatcaaacataacacatcattggatcagccttgtgtgaagcgttggtcagctatgcatgaggcggccaagcaaggccgtaaagatatcgtggcactgctcttaaaacacggagggaacgttcatcttcgtgatggatttggtgtaactcctctaggcgtggccgcagaatacgggcactgtgacgtgcttgaacacctgattcataagggaggcgatgtgttagccttggctgacgacggcgccagcgtgttgtttgaggccgctgggggcggcaatccggattgcatttcactgctcctggaatacggcgggtccgggaatgttcctaaccgggccgggcacctccctatacatagagccgcttacgagggccattatctggctctgaaatacttgatccccgtgacaagtaagaacgccatccggaagtcggggttaaccccaatccatagcgccgccgacggtcagaacgcgcagtgtcttgaactgctcattgaaaatggttttgatgttaatacgctcctagcggatcatatatctcagtcatatgatgacgagcgtaagaccgccctgtatttcggcgttagtaacaacgacgtgcattgtaccgaggttctcctggcagcaggtgcagatcccaaccttgaccctctcaattgtcttttagtcgcagtaagagcaaataactacgagatcgtgcgcctactgttatcacatggcgcaaacgtcaattgctattttatgcatgttaacgatacaagattcccctctgtaatacagtacgcgctcaacgacgaggtgatgcttaggcttttactgaacaatggatatcaggtggaaatgtgtttcgattgtatgcacggtgatatctttgggaactcctttgtatggtcggaaattcaagaagaagtgctgccgggatggaccagttgcgtgatcaaggacaaccccttttgcgagttcatcaccgtcccatggatgaagcacctggtgggtagagtgacccgcgtactgattgattatatggactatgtgccactctgcgcaaagctcaaatctgccttggaggtccagagggaatggccagaaatcagacaaatattggaaaacccctgtagcttgaaacacctctgcaggctgaagatacgtaggctgatgggcctacagaagttgtgccaaccggcaagcgttgagaagctccctctcccaccagccatccagagatacatcttgtttaaagagtatgatctttatgggcaggaactcaagctcacttag

SEQ ID NO: 44183 - DNA, 294 bp, Artificial Sequence
  Description of Artificial Sequence: Synthetic coding sequence
atggacaccaacgacgaccccgacgaggaccacctgaccagctacgatatccaattaagcattcaagagagcatcgaggcgagcaagacagcgctctgtccggaacgctttgtgcccctgtcggcacaaaaccgcaagctggtggaagccatcaagcaggggcacattccagaactccaggaatacgtcaaatacaaatacgccatggatgaagccgacgaaaaaggctggttcccgctgcacgaggctgtggtgcagcctattcagcagatattggagatagtccttgattag

SEQ ID NO: 44184 - DNA, 726 bp, Artificial Sequence
  Description of Artificial Sequence: Synthetic coding sequence
atggacaccaacgacgaccccgacgaggaccacctgaccagctacgacatccagctctccatacaggagtccatagaggcgtcaaagaccgctttgtgtcccgagcggttcgtccccttgtccgcacagaaccggaagttggtggaagccattaaacaggggcacatacctgaactgcaggagtacgtgaagtataaatacgccatggacgaggccgatgaaaaaggatggttccctttgcacgaggcagtggtacaaccaatccagcagattctcgagatcgttctggacgccagttacaagaccctctgggagtttaagacttgtgatggcgagactcctctgacattagccgtgaaggcaggcctcgtagaaaacgtcagaaccctattggagaaaggcgtatggccgaatacgaagaatgacaaaggggagactccattgttgatcgcagtcaaaaagggctcctacgatatggttagcaccctaataaagcacaacacaagcctggatcagccatgtgtcaagcggtggtctgccatgcacgaggctgctaaacagggtcgcaaggatatcgtggccttactgctcaaacatggcgggaacgtgcatcttcgggacggctttggcgtgactccgcttggggtggccgctgaatacggacactgtgatgtcctggagcatttgatccacaaaggcggtgacgtgctggccctcgcagattag

SEQ ID NO: 44185 - DNA, 1767 bp, Artificial Sequence
  Description of Artificial Sequence: Synthetic coding sequence
atggacaccaacgacgaccccgacgaggaccacctgaccagctacgacattcaactgagcattcaggaatcgattgaggcttcaaaaaccgctctctgcccagagcgattcgtgccgttgtctgcacaaaaccgtaagttggttgaagctatcaagcagggccacattcccgaattacaagagtacgtcaagtataagtacgccatggatgaggcggatgaaaaaggatggtttcccctacacgaggcggttgttcagccaattcagcaaatcctcgaaattgttctcgacgccagttacaagaccctttgggagtttaagacctgcgatggagagacacctttgactctggccgtgaaggcaggcctcgtggagaatgtcagaacactcctcgaaaagggcgtctggcctaacaccaagaatgacaaaggggaaacccccctgctaatcgcagtgaaaaagggaagctacgacatggtgtcaacgctgattaagcataacacctctctggatcagccatgtgtcaagcggtggtccgcaatgcatgaggcagctaagcagggtaggaaagatatagtggctcttctcctcaaacacgggggcaatgtccacctgcgcgatggcttcggtgttacccctctgggggtcgcagcagaatacggacattgtgatgtgcttgagcacctgatccataagggaggggatgtgttagctctggctgacgatggcgcctcggttctctttgaggccgccgggggcggaaatcctgactgtatatccctgttactggagtatggaggcagcggaaatgtgcctaaccgagcaggtcatctgcctattcaccgagctgcttacgagggccattatctggctctgaaatatctgatacccgtaacctcgaaaaacgccatacggaagtccggattgacacccatccatagtgctgccgacggccagaatgctcagtgtctggagctgctgatcgagaacggcttcgacgtaaacaccctcctggcggatcacattagtcagagttatgacgatgagagaaaaacagcactttatttcggcgtgtccaataacgatgtccactgcacagaggtactgctggccgctggtgcagaccccaatctagatcccttgaactgcctgctggtggcagttagggccaacaattacgagattgttcggctgttgctatctcatggcgccaacgtcaattgttacttcatgcatgtgaacgacacccgcttccccagcgtgatacagtatgcattaaacgatgaggtaatgctgaggctgctcctcaataatggctatcaggtcgagatgtgcttcgactgcatgcacggagacatcttcgggaattccttcgtgtggtccgagatccaggaggaagtgttgcccggttggactagttgtgtgattaaagataatccattctgtgagttcataacagtcccctggatgaagcatctggtcggtagagtaactagggttctgatcgactacatggactacgttcccctctgcgccaaactaaaatccgctctggaggtgcagagggaatggccagagatcagacagatcctggagaacccgtgctcccttaagcatctgtgccgtttgaaaattcggagactaatgggcctgcagaaactatgccagcccgcttctgtggagaagcttcccttaccccccgccatccagagatacatcctgtttaaggagtatgatctctacggccaggagctgaaacttacatag

SEQ ID NO: 44186 - DNA, 1767 bp, Artificial Sequence
  Description of Artificial Sequence: Synthetic coding sequence
atggacaccaacgacgaccccgacgaggaccacctgaccagctacgacattcagctctccattcaggaaagtattgaggcttctaaaacagccctgtgccccgagaggttcgttcccctttctgctcagaaccgcaaactcgttgaagcaattaaacaaggacacatcccggaattgcaagagtacgtgaagtacaaatacgctatggatgaagccgacgagaagggctggttccctcttcacgaggccgtggtacagcctatccagcagatacttgagatcgtccttgacgcctcttataaaacactgtgggagttcaaaacgtgcgacggcgaaacacccctgactctggctgtcaaagccggcctggtagagaacgtgcggactttattggagaagggggtgtggcctaataccaagaatgataagggcgaaacacccctgctcattgccgtgaaaaagggaagctacgatatggtcagtaccctgattaaacataacaccagcctggatcagccgtgcgtgaagcgctggagtgctatgcatgaggccgcgaaacagggccgcaaggacattgttgcacttcttcttaaacatggggggaacgtacatctgagggacgggttcggagtgacgcccctcggcgttgctgcggaatacgggcattgcgatgtcctggaacatctgatccacaaaggcggagacgtcttggccctggccgacgacggggctagtgtgttgttcgaagctgccggcggaggcaacccagattgcatatccctgctcctagaatacggaggaagcggtaatgtgccaaacagggcaggacaccttccaatccatcgcgccgcttatgaaggccactacctcgcgttgaaatacttaattcccgtcactagtaagaacgccatcaggaaatctgggctaacaccaatccattcggccgctgatggacagaacgcacaatgtttggagcttctcatcgagaatggcttcgatgtcaacaccctactggccgaccacatttctcagtcctacgatgacgagagaaaaacggccctctacttcggggttagcaataacgatgtccactgtactgaagtcctgctggccgcgggagccgacccgaacctggaccccctcaactgtctgctagtggctgtgagagccaacaattacgagatcgtgagactgctcctgtcacacggcgcgaacgtgaactgttattttatgcacgtaaacgacactcgcttcccatcagtcattcagtacgcactgaatgacgaggtgatgcttcggctattgctgaacaacggataccaggtcgagatgtgttttgactgcatgcacggggatatttttggaaacagttttgtgtggtcggagatacaggaagaagtgctccctggttggacctcctgcgtaatcaaagacaaccccttttgcgaatttatcaccgttccttggatgaaacacctggtcgggcgcgttacaagggtactgatcgactatatggactatgtcccactgtgtgccaaactgaagtctgccctggaggtgcagcgcgagtggccagaaataagacagattcttgaaaacccttgttctctcaaacacctctgcagactcaaaataagacgactgatgggcctacaaaagctgtgtcaaccagccagcgttgagaaattgcctctcccccccgctattcagaggtatatcctgttcaaagaatacgatctttatggccaagagctgaagctgacttag

SEQ ID NO: 44187 - DNA, 1767 bp, Artificial Sequence
  Description of Artificial Sequence: Synthetic coding sequence
atggacaccaacgacgaccccgacgaggaccacctgaccagctacgacatccaattgagcatccaggagtccatagaagcatctaagactgctctgtgcccagagcggtttgtgcccctgtccgcccagaaccgtaagctagtagaggctattaaacaggggcacatccctgaacttcaggaatacgttaaatacaagtatgcgatggatgaggccgacgaaaaggggtggttccccctgcacgaggccgtggtccaacccatccaacagatattggaaatcgtgctggacgcgtcttacaaaacactgtgggaatttaaaacttgtgacggtgaaaccccactgacattggccgtaaaggccgggctggtggaaaacgtgcgcactctgctggagaaaggcgtttggcctaacactaaaaatgataagggtgagacgcctctgctgatagctgtgaagaagggctcgtacgacatggttagcaccctcataaagcataacacaagcctcgaccagccatgcgtgaagagatggagtgccatgcatgaagccgcaaaacagggtagaaaggacattgtggccctcctgctcaagcacggggggaacgttcacctgagggatggcttcggcgtcaccccactgggcgtggctgctgagtacggtcactgcgatgtgcttgagcacttaattcacaaggggggagatgtcctcgccctggcggacgatggggccagcgtcctcttcgaggctgcagggggcggaaacccggattgtattagtctccttctggaatacggcggatccggcaacgtccccaaccgggccggccatctcccaatccacagggcagcttacgaagggcactacctggccctaaagtacctaattccggtgacatccaagaacgctattcgaaaaagcgggctgacccctatccacagtgccgccgatggacagaatgctcagtgtctggagctgctcattgaaaatggttttgatgtaaataccctgctggctgatcatatcagccagtcttacgacgacgagagaaaaaccgctctctactttggagtgtccaacaatgatgtgcactgcactgaagtactcctagctgccggcgctgaccctaacctcgatcccctcaattgtcttctggtcgctgtccgcgcgaacaattacgaaatcgtaaggctgcttctttcgcacggagccaatgttaactgttactttatgcacgtcaacgatacacgatttcccagcgtgatccagtacgccctgaacgatgaagtaatgttgcggctgctgctgaataatggatatcaggtggagatgtgctttgactgtatgcacggagatatctttggcaatagctttgtttggtctgaaatccaggaagaagtgctcccggggtggacaagttgtgtcataaaggacaaccctttttgcgaattcatcaccgtcccctggatgaagcacctcgtcggacgagtgacccgcgtattgattgactacatggattatgtacctctttgcgcaaaactgaagtcagccctggaagtgcagagagagtggcccgaaattcgccagatactggaaaacccatgctcgctgaagcacctctgtaggctcaagattaggcgcctcatggggcttcagaaactgtgccaacctgcaagcgtggaaaaacttcctctccctccagctatccagaggtacatactgttcaaggaatatgacttatatgggcaggagttgaagctcacatag

SEQ ID NO: 44188 - DNA, 750 bp, Artificial Sequence
  Description of Artificial Sequence: Synthetic coding sequence
atgaagcagcccagcaaggccgagtacggccactgcgacgtgctggaacatctgatccacaaggggggcgacgtgttagccttggctgatgacggtgcgagcgttctcttcgaggcggcagggggcggaaaccccgattgtatttcactgttgctggaatacggagggagcggcaatgtgccgaaccgtgccggacatctccccattcaccgagcagcatacgagggccactatctcgcactgaagtatctgatccctgttacatcaaagaacgctatacggaaatcaggactgacgccaatccactccgcagctgacggtcagaatgcacagtgcttggagttactgatcgagaacggatttgatgtcaataccctccttgcagatcacattagccagagttatgacgacgaacgcaagaccgccctctattttggcgtgtccaataatgatgtgcactgtactgaggtgctactggcagccggcgcggatcctaacctcgaccccctgaattgtctcctcgtggctgtccgagccaacaattacgagattgttaggttgctgctgagtcacggtgcaaacgtcaattgctatttcatgcacgtcaacgatactcgcttccctagcgtaattcagtatgcactgaacgatgaggtgatgctgaggttgctcctgaacaacggatatcaggtggagatgtgcttcgattgtatgcacggggacatttttggcaattcgttcgtttgctag

SEQ ID NO: 44189 - DNA, 1362 bp, Artificial Sequence
  Description of Artificial Sequence: Synthetic coding sequence
atggcccgggagaccttccccttcaccagcagcatgctgcggagcttaaggctgcagcaggaatggctcgaatgggaggatcggagacgggcagctgctcagcagtgcagaagccggaggtgcccttctagccctcgcgctcggctgactcgtccacatcgcagctgcagagaccctgctgtccaccaggctctcttttctgggaacctccaacaggtccaagcgctattccaagacgaagaggccgctaacatgatcgtcgaaaccgtctcaaatcagctggcatggtcagccgagcaggggttttgggttctgacacccaagaccaagcaaacagcccccttggctatcgcaactgccagaggctacaccgactgtgcgcgtcatctgatccgtcagggggctgagctcgacgcaagagtgggagggagagcggctttgcatgaagcctgtgcccgggctcagtttgattgtgtacgacttctcctgacattcggagctaaagcaaacgttctgaccgaagagggtactaccccactgcacctgtgcaccatccctgaaagcctccagtgtgcaaaattgttgctagaggctggggccacagttaatctggcagctggggagagccaggaaacgccactgcatgtcgccgccgcacgcggactggaacagcacgtggcactttacctggaacatggcgccgatgtggggctgaggacaagtcagggcgagactgcattgaatactgcctgcgctggagcagagggtccagggtcgtgcagacgccaccaagccgccgcccggcgcctgcttgaggcaggggctgacgcccgggcagccggccgcaagcgccataccccactccataacgcgtgcgccaacgggtgcggcggcttagctgagctactcctgagatacggcgctcgcgccgaggtaccgaacggtgctggccatacgccaatggactgtgccctacaggccgtgcaagattcccctaattgggagcccgaagtcctgttcgctgccctgctggattacggtgcgcaacctgtgcgccctgaaatgctaaaacactgtgccaattttccacgtgccctggaagttctgctcaacgcctatccatgtgtgccctcgtgtgagacttgggtcgaggcagtcctgcccgagctttggaaggaacatgaagcattttattcctcggccctgtgtatggtgaaccagccaagacagctccagcatctggctagactcgcagtaagagcccggttgggctcgcgttgtcgtcaaggagctacgcgcctgcctttgccgccactgttaagggattacctgctcttacgagtcgagggttgcattcagtag

SEQ ID NO: 44190 - DNA, 888 bp, Artificial Sequence
  Description of Artificial Sequence: Synthetic coding sequence
atgagcaagagcaccaagctgtgcggcaagaccagctgcccccggagcaacatcttctgtaatctgctggataagattgtgaagcgaccttctctgcagttcctgggccaatggggataccactgctacgagcctagaatctacaggagcctagctaaaattctgagatatgtcgatctagatgggttcgacgctctgctcactgactatatagcctttgttgagaagtccggttatcgatttgaggtgtcctttaacttagactttactgagatatgcgtcaataccattctttattgggtcttcgcgcgcaaagggaaccctgattttgtcgagctgttactgaaaaaaactaaggattacgtccaggaccgatcctgtaacctggctcttatatggcgcacattcactcccgtttactgcccgtctcctttaagcggcattacccccctgttctatgtcgctcagacccggcagagtaacatctttaagatcttgctacagtacgggatcttagagcgggagaagaatcctatcaatatcgtgctgacgatagtgttgtatccaagccgggtgcgcgtcatggtggaccgggagctggctgatatacacgaggacgctaagacgtgtctagtgctgtgttctcgcgttctttcagtgatctcagtcaaggaaattaagacgcagttgtctctgggccgccatccaatcatctctaattggtttgactacatcccctcgactagatataaggatccctgtgagcttctgcatttgtgtaggttgaccatcagaaaccagcttcttacaaacaacatgctgcctgatgggatcttttctctcctgatcccagctaggctccaaaactacctcaatctagaaatatag

SEQ ID NO: 44191 - DNA, 1314 bp, Artificial Sequence
  Description of Artificial Sequence: Synthetic coding sequence
atggagcggcagcccggccccgtgcggggcaagctgcagatcttccagaagaccgagaaagatccacaggctagggcgggctcgccagttcaagagtatcataccgccctggttgctggggacttagatcatctcaagccgcttatggaccaatttttccaggacgctaatgtggtctttgagattaacaaagacgaaatggaatggcaggtaaagagcccggctaccttcggcctgtctggattatggacactcgagtataagagagagctcaccacgcctctgtgcatcgcagcagcacatggccacacagcttgtgtgagacatctgctgggcagaggtgcggatcctgacgcaagtccgggagggagaggggctttacatgaggcatgtctgggagggcacaccgcttgcgtccgtctgttgcttcagcatcgagccgatcccgatctactgtctgccgaagggttggcaccgctacacctttgtcgaaccgccgcttcccttgggtgtgctcaagccctgcttgaacacggggccagcgtacagcgagtgggggggactggccgcgatacccccctgcatgtcgccgctcaacgtggcctggacgaacatgcccgcctctacctgggacggggcgcacatgtcgatgctcgaaatggacggggcgaaaccgccctgtccgctgcatgcggagcagccaggaggcccgatgagcacggtcgatgtctacgcctgtgcgccctcctcctaagacgaggcgctgaggctgacgcacgagatgaggatgaacgttccccattgcacaaagcctgcgggcacgctagccactctctcgcccgcctgcttcttcgacatggggctgacgcaggggcccttgattacggcggggcatccccgcttgggagagtgctccaaacagctagttgcgctctccaagcctctccccaacggacggtccaggccctgctgaaccacgggagccccacagtatggcctgacgcattccccaaggtacttaagacatgtgcttctgtgcccgccgtgatcgaggtcttattcaatagttatccccagctctgtcttagtgagagctggaaggaggtgatcccagaggaggtgtttcagatgcacaaacccttctatcagagtctgtttgctcttgctctcacgccccgttgcctgcagcatctatgccgctgcgcactgcgcagactgtttgggaagagatgttttgatctgatccctctgctgcccttgccgaaacccctccagaattacctgttactcgagccccagggcgtcctccactag

SEQ ID NO: 44192 - DNA, 1401 bp, Artificial Sequence
  Description of Artificial Sequence: Synthetic coding sequence
atgagcaacagcgactacctgcccgactaccccctgaacagcgaccttgtgaagcggctgaagagcgcactggacgccaaggatgaagaacgggttcgcgatttgatctgcaccgaaatcacaccagtcgacgctgtcatcgagctggccaatgacgactggatgaaggatccaagtgcccagctccccactggaatgctgctcggagatctcgaccacctgaaacctttgatggaccagttctttcaggatgccaacgtggtgttcgaaatcaataaggatgagatggagtggcaagtgaaatccccagcgaccttcggtttaagtggtctttggacactggagtataaacgggagctcaccacaccactctgcatcgcggccgcccatggacacactgcatgtgtgcgtcacctgctgggacgcggggccgaccccgacgcgtctcccggcggtcggggggctctccacgaggcatgcctgggcggacacaccgcgtgtgtccgactgctgctgcagcaccgcgccgacccagacctcctctcagcagaagggctggcgccactgcacttgtgtcggactgccgcgtccctgggttgtgcccaagcactcttagaacatggagcatcagtgcagagggtgggcggtacgggccgggatactccgctccacgttgcagcccagcggggactggacgagcacgcacgactgtatttaggccgcggggcccacgtggatgcccgaaacgggcgtggggagacagctcttagcgccgcctgcggtgctgcccgccggcccgacgagcatggccgttgcctgcgactgtgtgcattactgcttaggagaggcgcagaggcggacgctagagacgaggacgagagaagccccttgcataaggcttgtggccacgcttcacactccctggcgcgactcctgcttcgccacggggcagacgctggcgctctcgattacggtggtgctagccccctgggcagagttcttcagaccgcctcctgtgccctccaggctagtccccagaggacagtccaggccctgctcaatcacggaagcccaactgtttggcctgacgccttccccaaagtgctcaagacatgcgccagtgttccggccgtgatagaggtgctgtttaattcctaccctcagctttgcctctcagagagctggaaggaggttatcccagaggaggtctttcagatgcacaaaccattttaccaatccttattcgcactggccctcactcccagatgtcttcaacacctttgcagatgcgcgctccgacgcctttttgggaaacggtgtttcgacctgatccctctccttccactgcctaagcccttacagaactatttgctactggagcctcaaggcgtcttgcattag

SEQ ID NO: 44193 - DNA, 990 bp, Artificial Sequence
  Description of Artificial Sequence: Synthetic coding sequence
atgagcgtgctggaggagaaccggcccttcgcccagcagctgagcaacgtctactttacgattctgtctctattttgtttcaagttgtttgtaaagatcagtctcgccatcctcagccatttttatatcgtcaaaggcaaccggaaggaggcagcaaggatcgctgcagaattttacggggtgacacaggggcagggttcatgggccgacagaagcccgctgcacgaagcggcctcccaaggccggttgctcgccttgagaactctgctctctcaagggtataatgtcaatgctgtgaccctggatcatgttactcccttgcatgaagcatgcctaggagatcatgtggcttgcgccagaaccctgctggaggcaggtgccaatgtgaatgcgatcacaatcgatggcgtgacccccttgttcaacgcatgctctcagggaagcccaagctgtgctgagctattgctagagtatggggctaaagctcagcttgaatcatgtctgccatcaccgacccacgaagcggcctcaaagggccaccatgagtgtctcgacatcctaatctcctggggcattgatgtagaccaggaaattccacacctgggaacacctctgtacgtggcatgcatgagtcagcagtttcactgtatctggaagttgctttatgccggcgcagatgttcagaagggtaaatactgggatacgcctctgcatgcagctgcacagcagagctccactgaaatcgtgaaccttctccttgagtttggggcagacattaatgcgaagaacactgaactcttgaggcctatagacgtcgcgacttctagtagtatggtcgagcggatactcctccagcacgaggccacaccgagtagtctgtatcaattgtgccgtctttgtatccggagttacattggcaaaccccgcctgcatctcattcctcaactccagctgccaaccctgttgaaaaactttttacagtaccggtag

SEQ ID NO: 44194 - DNA, 63 bp, Artificial Sequence
  Description of Artificial Sequence: Synthetic coding sequence
atgagcgtgctggaggagaaccggcccttcgcccagcagctgagcaatgtgtactttacctag

SEQ ID NO: 44195 - DNA, 957 bp, Artificial Sequence
  Description of Artificial Sequence: Synthetic coding sequence
atgctgcaccaccactgccggcggaaccccgagctgcaggaggagctacagatccaggccgccgtcgccgcgggggatgtccacacagtgcggaagatgttggagcagggctactccccaaatggccgtgatgccaacggctggacgttactccacttctcggctgctcgcggaaaagagaggtgcgtacgggtgtttctcgagcacggcgctgacccaacagtgaaggacctcatcggagggtttacagctctccactatgctgccatgcacggtagagccaggattgctcgacttatgttggaaagcgaataccggtcagatattatcaacgctaaatccaacgatggatggacacctctccatgttgccgcccattacgggcgtgacagtttcgtacgcctgctgctagaatttaaagccgaggtcgacccattatcggacaagggaaccactcccttgcaattggcaattatccgagagcgttcttcttgcgtgaaaatattgctagaccacaatgctaatatcgatattcagaatgggtttctgctgcgatatgccgtgatcaagtctaatcactcatactgtagaatgtttttgcagcgcggtgcagacactaacctaggcagactagaggatggacagacccctcttcacttgagcgctctgagggacgatgtgctgtgcgccagaatgctctacaactacggtgctgatactaacactagaaattacgaaggacaaaccccattagcagtgtccattagcatctctggtagctccagaccctgcttggactttctgcaggaagtgacacggcagcctaggaatctacaggatctgtgcaggatcaaaattaggcaatgtattggcctacaaaacctgaagctgcttgacgaactccctattgcaaaggtcatgaaggactacttgaaacataaatttgacgatatctag

SEQ ID NO: 44196 - DNA, 825 bp, Artificial Sequence
  Description of Artificial Sequence: Synthetic coding sequence
atgctgcaccaccactgccggcggaaccccgagctgcaggaggagcttcagatccaggccgccgtggccgctggcgacgttcataccgtgaggaaaatgctggagcaggggtattctccaaacggcagagatgccaacgggtggactctgctgcacttctccgctgcccggggaaaagagcgctgcgtgagggtgttcctagaacacggggctgatcccacagtcaaagatctgatcggagggttcacagccctgcactatgctgccatgcatggccgggcgcgcatcgcacggttgatgcttgaaagtgagtaccgatcggacatcataaacgccaagagcaacgatggctggacccctcttcacgtggcagctcactatggacgagatagcttcgtgcgactgctgcttgaattcaaggcagaggttgatcctttgagcgacaaaggtacaacccctctccagctagccatcatccgggagcggagctcatgtgtgaaaatcctgcttgatcacaatgccaacatcgatattcagaacggctttctgctgaggtatgccgtgataaaaagcaatcacagctactgtagaatgtttctgcagcgcggcgcagacacaaatttaggcaggctggaagacggacaaaccccactccacctgtccgcactgcgagatgacgtgctgtgtgcgcggatgctgtacaactatggagccgacaccaacacacgaaactacgaagggcagacacctcttgccgtttctatctcgatttcaggctccagcaggccttgtctagatttcttgcaggaggtgacaagtatgtag

SEQ ID NO: 44197 - DNA, 759 bp, Artificial Sequence
  Description of Artificial Sequence: Synthetic coding sequence
atggacggcaagcagggcggcatggacggcagcaagcccgccggcccgagggatttccctggaataagactactgagcaatccactgatgggagatgccgtgagcgattggtccccaatgcacgaggctgctattcacggccaccagctctctcttaggaatcttatcagtcagggttgggcagtcaacattattaccgctgatcacgtgtcaccgctacatgaggcctgcttaggcggccatctgagttgtgttaaaatcctactgaaacacggtgctcaggtgaatggggtgacagctgactggcacactcccctgttcaatgcgtgcgtctcaggatcttgggactgtgttaatctcctgcttcagcacggtgccagcgtgcagcctgaaagcgatcttgctagtccaatacatgaggccgccaggagagcctacgggggtaatattgaccacaaaattagtcatttaggtacgccactctatctggcatgcgaaaatcagcaaagggcgtgtgtcaaaaagttgctggagtcaggcgccgatgtaaatcaaggcaagggacaggactcgcctctgcatgctgtcgccaggacagcaagtgaagaacttgcctgccttctaatggacttcggagctgacactcaggccaagaatgccgaagggaagaggcctgtggaacttgtaccacctgagtcacctctcgctcaactgtttctggaaagagagggtgcttccctgcccaagcctaagccgtag

SEQ ID NO: 44198 - DNA, 789 bp, Artificial Sequence
  Description of Artificial Sequence: Synthetic coding sequence
atggacggcaagcagggcggcatggacggcagcaagcccgccggcccgagagatttcccggggattcgactgttgagcaaccccctaatgggcgacgctgtgtcagactggtcaccgatgcatgaagctgctatccatgggcatcagctctcacttaggaacttgatttcgcagggatgggccgtgaacatcattactgccgaccacgtgagtcctctccacgaggcttgtctgggaggccatctgtcctgcgtaaaaatactgttgaaacacggggcacaggtaaatggggttactgccgattggcatactccacttttcaacgcctgtgtttccggaagctgggattgcgtgaacctgctcctccagcacggggccagcgtgcagccggagtcagacctggcaagcccgatccacgaggcagcccggagaggccatgtggaatgtgtgaatagcctgatcgcttatggaggtaatatcgatcataagatctctcacctggggaccccactttatttggcctgtgagaatcagcagagggcttgtgtcaagaaactgcttgaatcaggcgccgatgtaaatcagggaaaaggacaggatagcccccttcacgcagttgcccgaactgcaagcgaagaactggcctgcttgctgatggatttcggggcagatacacaggccaagaatgccgagggaaaacgcccagttgaactggtgccaccagaatctccactcgcccagctgtttctggagcgggagggggcctccctgcctaaacctaaaccatag

SEQ ID NO: 44199 - DNA, 885 bp, Artificial Sequence
  Description of Artificial Sequence: Synthetic coding sequence
atggacggcaagcagggcggcatggacggcagcaagcccgccggccccagagattttcccggaatcaggttgctgagcaatcccttgatgggcgacgctgttagtgactggtctcccatgcacgaggccgcgattcacgggcaccagctgtccctcaggaaccttatcagccagggctgggctgtcaatataattactgcagatcacgtgagccccctacatgaggcttgcctgggcggtcatctcagctgcgtgaagattctattgaagcacggagctcaagtgaatggtgtgaccgcggactggcacacccctctgtttaatgcgtgcgtgagcggcagctgggactgtgtgaacttactgctgcagcatggagctagcgtccagcccgagtctgaccttgcttctccaattcacgaagccgccagaaggggacacgtcgagtgtgtcaatagtctcatcgcttatggcggaaacatcgatcacaagatctctcatctgggcacccctctttacttggcatgcgagaaccagcagagagcttgcgtaaaaaagctgctggaaagtggggcggatgttaaccagggcaaaggccaagacagcccactccacgccgtggctaggacagccagcgaagaactggcttgtctcctgatggactttggcgcagacacacaagctaaaaatgctgaaggcaaacggcctgtggagcttgtgccaccggagagtccattggctcagctgtttcttgagagggaaggtcctcctagcttgatgcaactgtgtagactgcgcatccgcaagtgtttcggtatacaacagcatcacaagattacaaagctcgtgttgcccgaagatctcaaacaatttctcttgcatctgtag

SEQ ID NO: 44200 - DNA, 789 bp, Artificial Sequence
  Description of Artificial Sequence: Synthetic coding sequence
atggacggcaagcagggcggcatggacggcagcaagcccgccggccctagggacttccccggtattcgacttttgagcaatcctcttatgggggacgccgttagcgattggtccccgatgcatgaagccgccatacacgggcaccaactgtctctgagaaacctgattagccagggctgggccgtcaacatcattacagccgaccatgtctcaccactgcacgaagcctgtctcggtggccacctctcttgcgtcaagatcttgcttaaacatggagcccaggtgaatggagtcactgcagactggcacactcctctgtttaatgcgtgtgtatctggcagctgggactgcgtcaatcttcttttgcagcatggggcaagtgtacaacctgagtccgatcttgcttcacccatccacgaagctgcccgaagaggacacgtggagtgcgttaatagccttatcgcctatggtggcaatatcgaccacaagatctctcacctgggtacacccctgtacctggcctgcgaaaaccagcagagggcgtgcgtgaagaagttgttggagtcaggcgcagatgtgaaccaggggaagggacaagatagcccactgcatgccgttgcgagaacagcctcagaggagttggcttgcctgctgatggactttggggcagatactcaagccaaaaatgccgaaggaaaacgccctgtcgagctagtgcctcccgagtctcctctcgcacagcttttcttggagcgtgaaggggcctccttgccgaaacccaagccttag

SEQ ID NO: 44201 - DNA, 1971 bp, Artificial Sequence
  Description of Artificial Sequence: Synthetic coding sequence
atgagcgagctgagcgacgaggccagcgagcccgagctgctgaaccgatcactgagtatgtggcatggcttaggcactcaggtgagtggggaggagctcgatgtaccgctcgatttgcatacggctgcttctatcggccagtatgaggttgtgaaggagtgtgtacaacgcagagagctagacctgaataagaaaaatggagggggctggacccctttgatgtacgcaagttacatcggtcacgacaccatcgtgcacttgttgttagaggcaggtgtgagcgtgaatgtccctacaccagaggggcagacccctctgatgctggctagtagttgtgggaacgagagtatagcatatttcctgcttcagcaaggtgccgagctggaaatgaaagacattcagggctggacggcactgttccactgcacatcagcaggccaccagcatatggttagatttttgctggacagcggagctaatgctaacgttagagagcccatctgcgggttcacccccctcatggaagcagccgccgcagggcacgaaattatcgtccagtatttcttgaatcacggggtgaaagtggatgctagagaccactcaggtgccacagccagaatgctggcaaagcagtacggccacatgaagatcgtagccctcatggacacctattcccccagcctgccaaaaagcctgtaccgttctcctgagaaatatgaggacctttcttctagcgatgagtcatgcccagctcctcagcggcagcggccttgcaggaagaaaggcgtctctattcacgaggggccccgcgcccttgctcgtatcacagggattgggctcgggggccgtgccccgcgtcctcgctacgaacaggcccctccacggggatatgtgacgttcaactcaagcggggagaaccccttagaggaagaggggctgtgttgcagagatgtgacaagcccgattaacgaacgggatgtggagagctccagtagctcctccagccgtgaggaacacgcgttttgtgccaatctcgggcctgtacagagcagcagttctagcgagggtctcgcgagggcccaaggtctgagcagcgaagcctccgtcgagtctaacgaggactcagaccacgcctgcaaatcctcagcacgaaaacaggccaagtcatatatgaagactaaaaacccggacagccaatggccaccacgcgcggccactgatagggagggtttcctggcggaaagctccccgcagactcagagagctccatattcgggtcctcaagacctcgcagcactgctggagcagataggctgcctgaaatatctgcaagtatttgaggaacaggacgtggatctacgcatatttctcacattgaccgagagtgatctgaaggagatcggcataacactctttggccccaagcggaaaatgacctctgctatagcaagatggcacagcagcgcacgaccgccaggcgatgccctagagctagcttatgccgacaggttagaggctgagatgcaggaattggccattcagctccacaagcgatgtgaggaagtggaggctacaagaggccaggtctgtcaggagcaggaactgcgagcggtcgtagaatcttgcttgctggaacaggaccgcgcaagggaggacctacaggcccgtctccgggagacatgggcgctcgcacgagacgcggcattagtactagaccagttgcgtgcttgtcaggcggagctcagttccagggtgcgacaggaccagccacctggcgcagccacactgggacttgcagtgccacccgcggattcgaaaggatggcaggctagcctgcaggctatgtctcttccggaactgtccggggccttggaggatagggtgcgggaaatgggacaggccttgtgtcttgtgactcaatcactggagaagctgcaggtgctgaacggcaagaaatggagggagacctag

SEQ ID NO: 44202 - DNA, 1584 bp, Artificial Sequence
  Description of Artificial Sequence: Synthetic coding sequence
atgaaggacatccagggctggaccgccctgttccactgcaccagcgccggccaccagcatatggtcaggtttttacttgattccggagcaaacgctaacgttcgggaacctatctgcggattcaccccattgatggaagcggctgctgcaggccacgagataatcgtgcaatactttctgaatcatggcgtgaaggtggatgctagagatcacagtggagcgactgctaggatgctggccaaacaatacggacacatgaagatcgtagcactcatggacacctattctccttccctgccaaagagcttgtacaggtccccagagaaatacgaagatctgagctcatctgacgaatcctgccccgcaccacagcgacagaggccatgccgtaaaaagggcgtgagtatccacgagggccctcgcgcattagcacgtatcaccgggattgggctaggaggaagggccccgagacccagatacgagcaggctcccccgagggggtacgtgacttttaattctagtggcgaaaaccctctcgaggaagagggcctgtgttgcagggatgtcacctcacctatcaacgagagggacgtcgagtccagctccagttcctcatcccgggaagaacatgcgttttgcgctaacctaggcccagtccaatctagcagttcttccgaaggattagcgagggcgcagggactctctagcgaagcatctgtggagtcaaacgaagattctgatcacgcttgcaagtctagtgctcggaagcaagcaaaatcctatatgaaaactaagaatcctgactcccagtggccccccagagccgctaccgatcgagaagggtttcttgctgaatcctccccccagacccagagagctccatattccggtcctcaggatctcgcagccctcctggagcagatcggatgtctcaagtacctacaggtttttgaggagcaagatgtcgatctgcgcattttcctgactttaactgagagcgatcttaaggaaattgggatcaccctgttcggccccaagaggaagatgacgtcagccatcgccaggtggcacagctctgctcggcctccaggggatgctttggaacttgcttacgctgaccggctggaggccgagatgcaggaattagctattcagctgcacaaacggtgtgaggaagtggaggcgacccgtggccaagtctgtcaggaacaagagctccgtgccgtggtggagtcctgtttgttagaacaggacagggcacgggaagatctccaggctagactcagagagacatgggccctcgcaagggatgcagctctggttttggatcaactccgtgcctgtcaagctgaattgtcctctagggtgagacaggaccagcccccgggggcagctacattgggattggcggtacctcctgccgacagcaaaggatggcaagcatcgctgcaggccatgagtctgcctgagctatcaggagccttagaggacagggtgagagagatgggacaggctctgtgcctggtgacgcagtcacttgagaaactgcaggttctcaacggtaagaagtggagagaaacatag

SEQ ID NO: 44203 - DNA, 921 bp, Artificial Sequence
  Description of Artificial Sequence: Synthetic coding sequence
atgctggccaagcagtacggccacatgaagatcgtggccctgatggacacatactcccccagtctgcctaagtctctctataggtcacctgagaagtacgaagatctgagtagttctgatgaatcatgccccgcaccacagcggcagcgaccttgtaggaagaaaggagtctcaatacatgagggcccccgcgcccttgccagaatcaccggaattggcctcggcgggcgtgctcctcggcccagatacgagcaggcgccgccacgggggtacgtcacattcaactcttctggcgagaatccactggaagaagagggtctctgctgtcgggatgtaacatcacccatcaatgagcgcgatgtggagagcagcagtagcagctcaagtcgagaggagcacgccttttgcgccaacttgggaccagtgcagagcagcagtagcagtgagggtctagccagagctcagggcctgagttctgaagcttctgtagaaagtaacgaggacagtgaccacgcttgtaaatcctccgcacgcaaacaggccaagtcctacatgaagactaaaaatcctgattcccagtggcctcccagagccgccacagacagggagggcttcctggcggagtctagccctcagactcagcgcgcaccgtatagcggtccgcaggtgcgccctcttgtgaagctcgaggttaccctgcgggatggaacgttctgcgatcttggcggcatgtgttgtgtctatgacgtgcctggggctgcacggcgaaccgagtggcgctggcacccacatggcctgctcggctctacaggaagtcagcctgcaccctggctagccgccccactgcaacgtttctacagcgtcccactgcacggcaaggacctgagcccgtgcttcccctactggtcatggcccccgtag

SEQ ID NO: 44204 - DNA, 1275 bp, Artificial Sequence
  Description of Artificial Sequence: Synthetic coding sequence
atgcggatcttcatcgccttcgagggcagcttcgagcccttcgacgtgtccgctgacgagactgtcgaggttgtgaagctcatgatcaaggactatttccacatcccactgtctgaggataagcagggcagacgataccttgagctgatgtacgccggcgcagcattgaaggattcttggtcgttggcagatgtcggcatttctttttgcagtactttaaaatgcttcgtaaaagaagaagacaagcctaccctatatgtgtttaatgccgtaacccaggatactatgccagtgatggagtcaatcagtctgctggataagacagttagtgacctccggaccctggttactctgcgctgcgggcttcctgtcagcgtctactgcctacggaccccgcgtggactggagatgtacgactgtaacaccctaaaggattatcagacggacattggcacaaccctgaggctggacgtctgggatggctggaaggagttcctgatgggctgtctgctcgggcagaagctcaaggtgcagcgatatctgagcaaggagggacccgtattgaaataccaaaaaagagtggccttgtatatagccgccttttgtggttacatagagctcacagaatgggctcttaagcagggagcacgccctcacgaggcagtgggggtccacccttatagagcctggtgtcatgaagcgctgcatgcggacgtatctaagtgtcctattcacgctgcagctgaagcaggacaattgctgattctgaaagcgtttgtgaactactcggtcctctgtctcgagtgtaaaaacgccgctggccagacgccactcacgatcgtctttaaacataagcataaagactgtgttctgtacttgttgtctaagatgtggtcaacagtcagcttccctaaaatttcggttcccatgaggatatacatcaagatcaagcaatggatcctgcgcgcccagtcccattcactccacaagagtcagttctgtggggcccgcgtgttcggcgctaaagtgggcgatacagtgatggtggacgggttcaccaagcccaagatgacctccaaatcatggcacaaagccggaaattctgatagccagtcaatcgtgctgaaactcccttcgctgtcaaagcagactgcatcatccaaacctgtgaaccctctggccatctcgcagccagatacgcgtaagcaagccctgaaattccacccactaaaaggggagagcccaaaggctgacaaatccagcggcattatgtag

SEQ ID NO: 44205 - DNA, 1635 bp, Artificial Sequence
  Description of Artificial Sequence: Synthetic coding sequence
atgcggatcttcatcgccttcgagggcagcttcgagcccttcgacgtttcagcagatgaaactgtcgaggttgtgaaactaatgatcaaggactatttccacattccactttccgaggataagcaaggaaggcgctacctggagctcatgtacgcaggagctgcactaaaagatagctggtccctggcagacgtcggaataagcttctgtagcacactaaagtgcttcgtgaaagaagaggacaaaccaaccctgtacgtcttcaacgcagtcactcaggacaccatgcccgtgatggaatcaatttcgctgctggacaagaccgtgtccgacctaaggaccttagtgaccctgcgatgcggccttcccgtcagtgtttactgtctacgtaccccacgggggcttgagatgtacgactgcaataccctaaaggactaccagactgacattgggactacgctgaggttggacgtatgggacggatggaaagaatttctgatgggttgtctgctcggccagaaactcaaagtacagagatacctctcgaaagagggccctgtgttgaaataccagaagcgcgtggccttatacattgccgctttctgcggctatattgagctgactgagtgggcacttaagcagggggctagaccacatgaagccgtgggggtgcatccctatcgggcctggtgccacgaggcccttcatgccgacgtgtccaagtgcccgatccacgctgcagctgaggccggccaactcctgattcttaaagcattcgtcaactattctgtactctgcctggagtgcaaaaatgctgccggacagaccccattgaccatcgtatttaaacataaacacaaagattgtgtgctctacctcctgtccaagatgtggtccacagttagtttcccaaagatatccgtgccgatgagaatttatataaaaattaagcagtggatcctcagagctcaatcacactctctgcacaaaagccaattctgcggcgcccgtgtgtttggcgccaaggtgggtgataccgtgatggtggacgggttcaccaagccaaagatgacttcaaaaagctggcataaggctgggaattccgactctcagtctattgtgctgaaactgccctccctcagtaaacagaccgcaagttccaagcccgttaatcctttagccatctcgcagcccgacacaaggaaacaggcgctgaaatttcatcccctggtgaatgccagttccttcagtgagcttcaaaaacatcaacaacagaatcagaagaagatcaccgcaacagctagaaaaaaggagaaacttataaaaaacacatacctgccacaagtgcctctacctcccgtgagccgggtgggctacagtcatccctcttttttttacgctacaccttctgccgattttcttctcaagagttcattctcgagttttctcgagcacagcgggaaaactccatgggagaacgcaatatactgtcttgctgtggccagtgcctttaaagagaagagatggttgcagcagcttgaaatcgctcgggtgctagccaagaagtcaatctccaatctgacaaccagaggagggcttaccgcttgtgaaaatagcctcgaaaccgtgctatag

SEQ ID NO: 44206 - DNA, 2181 bp, Artificial Sequence
  Description of Artificial Sequence: Synthetic coding sequence
atgagccccgcccccgacgccgcccccgcccccgccagcatcagcctcttcgatttgtctgccgatgcacctgtattccaggggctcagcctggtgtctcatgcccccggagaggcccttgctagggccccgcggactagctgctcagggtcgggggagagagaaagcccggagcgaaagctgctgcaaggaccaatggatatatccgaaaaattattctgttcgacctgcgaccaaacattccagaaccaccaggagcagcgtgaacactataagctggattggcaccgattcaacctcaaacagcgactcaaggataagcccctgctgagcgctctggatttcgagaagcagagctccaccggagacctctcgtccatatccgggtcagaagacagtgactcagcatctgaggaagatctccagaccctcgatcgagagcgtgccaccttcgaaaagctctctagacccccgggcttttacccccacagggtgttatttcagaatgctcagggccagttcctgtatgcatatcggtgtgttctaggacctcatcaggacccgcctgaagaggcagaactgctgctacagaacctgcagagccgcggcccccgcgattgcgtggtgcttatggcggccgccggccattttgcgggcgccatttttcagggccgggaggtggtgacccacaagacttttcaccggtataccgtccgggcgaagagagggacagcacaagggcttcgcgacgccagggggggcccaagtcatagcgcgggtgccaatctgagacgatataacgaggcaaccctatacaaggatgtgcgggacctgctggccggcccttcatgggcaaaggcccttgaagaagctggtaccatactcctcagggcacctagatctggaaggagtctattctttggcggcaagggtgcccctttacaaagaggggaccccaggttgtgggacattcctctggctactaggaggccgacctttcaggagctgcaaagggtgctccacaagttgacgactctgcatgtgtatgaagaagaccctcgtgaggccgtgaggctgcattctcctcagacccactggaagacagtgagagaagagcgaaagaaacccaccgaggaggagatccggaagatttgccgggacgagaaagaagctctgggacagaacgaagagagccccaagcagggttccggaagcgaaggtgaggatgggtttcaggtggagctcgagctggtagagctgacagtcggcactcttgacctgtgcgaatccgaagtcctccccaagagacgccggcggaagaggaataaaaaggagaaaagccgtgatcaagaggccggcgctcacagaactctcctacagcagactcaagaagaagaaccatccacccagtcttcgcaagccgtcgcagcacccctcgggccactgctggatgaagccaaagccccgggccagcctgaactttggaatgccctgttggcggcctgtcgtgccggggatgtgggagtgttgaagcttcagctggcccccagtccggccgacccaagagtactttccctgctgagtgcacctctggggtccggcggctttactctgctgcatgcagcagctgcggcaggcagggggagcgtggtccgccttctgctggaggctggagccgatcctactgtccaggactctcgagcccgccccccttacaccgtggcggcagataaatcaacccgaaacgagttccgccggttcatggagaaaaaccctgacgcctacgactataataaagcccaggtgcctggtccactcacaccagaaatggaagctcggcaggcaacccgcaaaagagaacaaaaggccgcacggcgtcagcgggaagagcagcagcagcggcagcaggaacaggaggaacgggaacgcgaagagcagaggagattcgccgccctcagtgatcgcgaaaaacgagcccttgctgctgaacgtaggctggctgcccagctgggcgcaccgaccagccccatccctgactccgccatcgtgaacactagacggtgctggtcatgcggcgcctctctgcagggtttaacacctttccactacttggacttttctttctgctcaacccggtgtctgcaggaccaccggcgccaggccggtcgaccatcttcatag

SEQ ID NO: 44207 - DNA, 2181 bp, Artificial Sequence
  Description of Artificial Sequence: Synthetic coding sequence
atgagccccgcccccgacgccgcccccgcccccgccagcatcagcctctttgacctctctgcagatgccccggtctttcaaggtctttcccttgtctcacatgcccctggagaagctctggcccgtgcacccagaacaagctgtagcgggagcggcgagcgagaatcaccggagcggaagctgctgcagggccccatggatatctccgagaagctgttttgctcaacttgtgaccagacttttcagaatcatcaggaacaacgagagcattataagttagattggcaccgcttcaatctcaagcaacggttaaaagataaacctctgctctccgcacttgactttgagaaacagtcgtctaccggggacttgagttcaatttcaggatccgaggacagcgattctgctagcgaggaagatctgcagacactcgacagagaaagagcgacgttcgagaaactatcccggccacccgggttttacccccaccgtgtcctgtttcagaatgcccagggtcaattcctgtacgcctatcggtgtgttttaggccctcatcaggaccccccggaagaggctgagctcttgttacagaacctacagagccgcggcccacgtgattgtgttgtgttaatggccgctgctggtcacttcgccggcgcgatctttcagggacgggaagtagtgacgcataaaactttccatcgttacaccgtcagggccaaacgtggaactgctcaaggattgcgggacgctcggggcgggccctctcacagtgcaggcgccaacctgagacgatacaatgaggccacactgtataaggatgtgagggatttgctcgccggcccatcttgggcaaaagcactggaggaggctggcactattcttctccgcgcacctagatccggccgctctctctttttcggaggcaagggcgcgcccctgcagcgcggggatcctaggctgtgggatattcccctggccaccagacgaccgacttttcaggagctccagcgcgtcctccataagttaaccaccctacacgtttatgaggaggatccgcgcgaagctgtgcgcctccactcaccccagacccattggaagacagtgcgggaagaaaggaagaagcccaccgaggaagaaattcggaaaatatgccgcgatgaaaaagaggcactcggccagaacgaggaaagtcccaagcaagggtcaggctcagagggagaagatggtttccaagttgagctggaactggtggaactcacggttgggaccctcgacctttgcgaaagcgaggtcctgcccaagcggcgtcggcgcaagagaaacaaaaaggaaaaatcacgggatcaggaggccggggcacaccggacattactccagcagacccaggaggaggaaccctccactcagtcaagccaggctgttgccgccccgcttgggccgcttcttgacgaggctaaggccccagggcaaccggaactttggaacgctcttttagccgcctgtcgggctggcgatgtgggggtgctgaagctgcaattggcccctagcccagccgaccccagagtcctgagcttactatccgcacctctggggtcagggggattcacactgctgcatgccgcggcagctgccgggagaggcagtgtggtcaggttgttgcttgaagcgggggccgatcccacagttcaggactctcgtgccagacctccatacaccgtagccgccgacaagtcaacaagaaatgaatttaggcgatttatggagaagaatccagacgcttacgattataacaaagctcaggttcccggaccactgacacctgagatggaagcaaggcaggccacacgaaagcgcgagcaaaaagcggcaagacgccagcgcgaggagcagcagcaaaggcagcaagagcaagaggagagggagcgcgaagaacaaagacggtttgccgctctttccgatcgcgaaaagcgggcccttgctgctgaaagacgactcgcagcccaactaggcgcccctaccagtccaatccccgatagcgccattgtcaacactcgtcgatgctggtcgtgtggggcatccctacagggcctgaccccattccactatcttgacttttcgttttgctccactcgttgcctgcaagaccatcgtagacaggccggacgacctagttcttag

SEQ ID NO: 44208 - DNA, 273 bp, Artificial Sequence
  Description of Artificial Sequence: Synthetic coding sequence
atgagccccgcccccgacgccgcccccgcccccgccagcatcagcttattcgatctgtcggctgatgcccccgtctttcagggtctgtccctggtcagccacgcaccaggggaggcattggcacgcgcacccagaacctcttgcagcggctctggcgaacgggaaagtccggagagaaagctgcttcaaggccccatggacatctctgaaaagctcttctgcagcacctgtgaccaaactttccagaatcaccaggagcaacgagaacactag

SEQ ID NO: 44209 - DNA, 423 bp, Artificial Sequence
  Description of Artificial Sequence: Synthetic coding sequence
atgagccccgcccccgacgccgcccccgcccccgccagcatcagcctctttgatctttctgcagacgctcctgtcttccagggtctctccctggtgagccatgctccaggggaagctctggctcgagccccacgcacctcgtgttccggctctggcgagcgcgaatccccagaaagaaaattgctccaggggcccatggacattagcgagaaactgttctgctctacatgtgaccagactttccaaaaccaccaggagcagcgggagcactacaagttggactggcataggtttaatctcaagcagagactgaaggacaagccattgctgtcagccctcgatttcgaaaagcaaagcagcacgggcgatctgtcctcgatctcaggcagcgaggacagcgattcggcctccgaagaggactag

SEQ ID NO: 44210 - DNA, 1263 bp, Artificial Sequence
  Description of Artificial Sequence: Synthetic coding sequence
atgagcgccgccggcgccggcgccggcgtggaggccggcttcagctcagaagaacttctgtccctgcgctttccactgcaccgtgcatgccgtgacggggaccttgccaccctctgctctctcctgcaacagacgccccatgcccatctggcatccgaagactccttctacgggtggacccctgtgcactgggccgcacacttcgggaagttggagtgcctggtgcaactggtccgggctggtgctacattgaatgtcagtacgacgcgatacgcccagactccagctcatattgcagcgttcggtggccatccacaatgtctcgtgtggctgatccaggctggggctaacatcaacaaaccagattgtgaaggagaaactcctattcacaaggccgcccgatccggaagtctcgagtgtatctcagcccttgtggccaacggagcccatgttgacctcagaaatgcctccgggctcacagccgccgatatcgcccagacccagggatttcaggaatgtgcccaattcctgctgaacctgcagaattgtcacctgaaccatttttataacaatggaatactgaatgggggccatcagaatgtattccctaaccacattagcgttggcaccaatcgtaagaggtgtctagaagactctgaggattttggagttaagaaggcccggaccgaggctcagtctctggacagtgctgtcccgctcactaatggggatactgaagatgacgccgataagatgcacgtagatagagagtttgcggtggtgactgacatgaagaatagcagctctgtttccaatactctaaccaacgggtgcgtgattaatggtcaccttgatttcccttctacaacccccctctctggcatggaatctcggaatggccaatgcctaacagggacaaacggcatctccagcggtctggccccaggacagcccttcccttcttctcaggggtctctgtgcatctccggcacagaagaaccggaaaagactctgcgagcaaacccggagctgtgtggttcactgcatcttaacggctcgccctcttcatgtatcgccagcaggccgtcatgggttgaggacattggcgataacctctactacggccactaccatggatttggtgatactgccgaaagcattcctgaattgaatagcgtggtggaacactcaaagtcagtcaaggttcaggaacgctatgacagtgcagttttaggaaccatgcacctgcatcacggttcctag

SEQ ID NO: 44211 - DNA, 663 bp, Artificial Sequence
  Description of Artificial Sequence: Synthetic coding sequence
atgagcgccgccggcgccggcgccggcgtggaggccggcttcagctccgaggagttgctgagtcttaggttccccctgcatagggcctgcagggacggggacctggccacgctgtgcagtctgctgcagcagacaccccacgcacacctcgctagtgaggattccttctatggttggactccagtgcactgggccgctcattttgggaagctggaatgtttggtccagttggtgcgggcaggcgcaacactgaacgtatcgactactaggtacgcccaaaccccagcccacattgcagcttttgggggacatccccagtgcctcgtatggttgatccaggctggtgctaacataaataagccagattgcgaaggcgagaccccaattcacaaggcggctagaagtggatcactcgagtgcatttctgccttggtggcgaatggagcccatgtggagtttatttcacaatcttctgtccactcttgcctgcccggggagttgcagcacggggtgacatttgatcccagcgtactgattcagtgtctgaagcccgagaagtgtcagtggcccgatagtagtaggcactgcacaaatcctggcttcccgcgagtgtgccccgtgtcactcgaacctccagagctcagcagcgagccctttctgtag

SEQ ID NO: 44212 - DNA, 1557 bp, Artificial Sequence
  Description of Artificial Sequence: Synthetic coding sequence
atggtgcagctggtgctgcagtaccgggactaccagcgggccacccaacggttggcagggattccggagctcctcaacaagctgaggcaggctcccgatttttacgtggaaatgaagtgggaatttacatcttgggtccccctggtaagcaaaatgtgccctagtgatgtctatagggtctggaagagaggggagtctctgcgcgtcgacacttccctgctgggctttgagcacatgacatggcagcgagggaggaggtctttcattttcaaagggcaggaagccggcgctctcgtgatggaagtcgatcatgacaggcaggtcgtgcatgtcgagactcttgggttaacgctgcaggaaccagagacgctcctggcagcaatgcgaccatccgaagaacacgtggcctctaggctcacatccccaattgtctccacccacctcgatacacggaacgtcgcattcgaacggaataagtgcggcatctggggatggcggtcagaaaagatggagaccgtctctggttacgaagccaaggtgtattccgccacaaacgttgagctcgttacaagaaccagaaccgagcatctttccgatcaggataaatctcggtctaaggccgggaagaccccgttccagagttttttaggtatggcacaacaacattcgtcccatactggtgccccagtgcagcaagcagcctcacctacaaaccccacagccatttcacccgaagagtatttcgaccctaatttctcactcgagtcacgaaacatcggcagaccaattgagatgtcatctaaagtgcagagatttaaggcaactctgtggttatctgaggagcatcctctgagcctaggagaccaggtgacaccgatcatcgacttaatggctatctccaatgcacatttcgccaaacttcgtgattttataacccttaggctgccgccagggttccctgtgaaaatagaaatccctctctttcacgtgctcaatgcccgtattacctttagcaatctatgcggctgtgacgagccactgtcctcggtgtgggtgcctgcaccatcatctgccgtggccgccagcggcaatcccttcccatgtgaggttgaccctacagtattcgaagtgcctaacggatacagtgttctgggtatggagcggaatgaacctctgagggacgaggacgacgatctgctccagtttgccatacaacaaagcctactggaagcgggaactgaagcggaacaggttactgtgtgggaggctttgacgaataccaggccgggcgcacgcccaccgccgcaggccacagtgtatgaagaacaactccagttggaaagagcgttgcaggagtcacttcagctttctaccgaaccccgagggccgggttcgcccccccgcacccctcctgctcccgggccgccgtctttcgaggaacagttaaggctcgctctggagctgtcttcaagagaacaagaggaaagggagaggagagggcagcaggaggaggaagacctccagagaatcctgcagctgagcctgacagaacattag

SEQ ID NO: 44213 - DNA, 1557 bp, Artificial Sequence
  Description of Artificial Sequence: Synthetic coding sequence
atggtgcagctggtgctgcagtaccgggactaccagcgggccacccagcggctggctggaatcccagagctccttaacaagttgcgccaggcccctgatttttacgtcgaaatgaagtgggaatttaccagctgggtgccactcgtttccaaaatgtgcccctcggacgtctaccgcgtgtggaagagaggagagagtctcagagtggacacgtcccttctcgggttcgaacatatgacgtggcaacgagggcgccgaagtttcatcttcaagggccaagaggcaggagccctcgtaatggaagtggatcatgatagacaggtggtccatgtcgagactctgggactgaccttgcaggaacccgagactttgctggccgccatgcgcccgagcgaagaacacgtggctagcaggcttaccagtccaatcgtcagtacccatctggataccaggaacgtggcatttgagcgcaacaagtgtggcatttggggttggcggagtgagaagatggagaccgtgtccgggtatgaggcgaaggtgtattccgctaccaacgtggagttggttactaggactcggactgagcatctcagcgaccaggacaaaagcagatctaaagctggaaaaaccccctttcagagcttccttggtatggctcaacagcacagttcccacacaggcgcccccgtacagcaggctgctagcccgacaaatcctaccgctatatctccagaagagtactttgaccctaatttctcattggagagccggaatataggacggccaattgaaatgagtagcaaagtgcagagattcaaggccactctttggctctcagaagagcaccctctgagtcttggcgatcaggtgaccccgatcattgatctcatggccattagcaacgcccactttgccaaacttagggactttatcacactacggctgcctcctgggtttcctgtgaagattgaaatccccttgtttcacgtgttaaacgccaggatcaccttttccaacctgtgtggctgcgatgagccactgagttccgtctgggttccggctccctcgtccgccgtggctgcttcaggtaaccccttcccctgcgaggtagaccctactgttttcgaggtgcctaatggctacagtgtgctgggcatggagcgtaacgaaccactgcgtgacgaggacgacgaccttttgcaattcgctatccaacagtcgctcttggaggccggtacagaagcagagcaggtcaccgtttgggaggccctcacgaataccaggcctggagcacgaccacctcctcaggccacggtgtatgaagagcagctccagcttgagcgggccttgcaggagagcctgcagctcagcacagaaccacggggccccggcagccctcccaggaccccgcctgcccctggacccccatcttttgaagagcagctgaggttagcattggaactgtcctcccgggagcaggaagagcgcgagagacggggacagcaggaagaggaggatctccagcgcattctccaattgagccttactgagcattag

SEQ ID NO: 44214 - DNA, 1818 bp, Artificial Sequence
  Description of Artificial Sequence: Synthetic coding sequence
atggccggccccggccccaccttccccctgcaccggctggtgtgggcaaaccggcaccgcgaactagaggccgcccttcattctcaccaacacgatatcgaacaggaggaccccaggggccggactcctttagagttggccgtgtcactgggcaacctggaaagcgtgagggtcctgctgcggcacaatgccaacgttgggaaggaaaaccgccagggctgggccgtgctgcaggaagccgttagtactggggatccagagatggtgcagttagttctgcagtatcgcgattatcagagggcaactcaacggctggctggtattcctgagctgctgaataagttgagacaggcccccgatttctacgtcgaaatgaaatgggaatttactagctgggtcccattggtttccaagatgtgcccctccgatgtctacagggtgtggaaacgcggcgaaagcctgcgggtagacacctctcttcttggtttcgaacacatgacatggcaacgcggacgcagaagcttcatcttcaagggccaggaggcaggggcgcttgtgatggaggtagatcacgatagacaggtcgtgcatgttgagaccctgggcctgactttgcaggagccggagaccctcttggcggcaatgcgcccaagcgaagaacacgttgcatcacgcttaacatctccaatcgtttccactcacctggacactcggaatgttgcctttgagcgcaacaaatgtggcatctggggttggagaagtgaaaaaatggaaacagtttctgggtatgaggccaaggtgtactcagctacaaacgtggaactggtgaccagaacacgcacagaacatctctcagaccaagacaagtccaggagcaaggccggtaaaactccctttcagtccttcctcggaatggcgcagcagcattcaagccacactggtgcgccagtccagcaagctgcgagcccaaccaacccaacagccatctcaccagaggaatattttgaccccaacttttcacttgagtcacggaacatcggtcgacccattgaaatgagctctaaagtgcagcggtttaaggcgactctatggctcagcgaggagcatccgctgagcttgggtgatcaggtaacacccataatcgatctcatggccattagcaatgctcatttcgccaagttgagggactttatcacactgcgactgccacccggctttccagtgaaaatcgagatacctttgtttcacgttcttaatgctaggattacgtttagtaatctgtgcgggtgcgacgaacccctgtcctctgtttgggtgcccgcaccatcgtcggctgttgcggcatccggaaaccctttcccatgtgaagtggatcctacggtattcgaggtacctaatggctattcagtgctcggaatggagcgcaacgaaccactccgggacgaagatgacgatctgctacagttcgcaatccagcaaagcttgttagaagccggaaccgaggctgaacaggtgaccgtctgggaagctctgaccaatactaggccgggggctcgacctcctccccaggcgaccgtgtatgaggagcagctacagctcgagcgggcgctgcaggagtcccttcaactatccacagagcctcgaggaccaggctctcctccccgaaccccaccggctcctggtccaccttcattcgaggagcagctgcgtctggctctcgaacttagctcaagagagcaggaggaaagagaacggcgcggacaacaggaggaagaagacttgcagcgcatattgcaactgtcattaaccgagcattag

SEQ ID NO: 44215 - DNA, 1557 bp, Artificial Sequence
  Description of Artificial Sequence: Synthetic coding sequence
atggtgcagctggtgctgcagtaccgggactaccagcgggccacccagcgcctcgctgggatccccgaactgttgaacaagctgcgtcaggcgcccgacttctatgtcgagatgaagtgggaatttacgagttgggtcccccttgttagtaagatgtgtcctagcgacgtgtacagagtgtggaaacgtggggagagtttgagagtggacaccagtctgcttgggtttgagcacatgacatggcagcgggggcgtaggagcttcattttcaagggacaggaggccggcgccttagtgatggaggtcgatcatgacaggcaggtggtgcatgtggaaactctgggacttacactgcaggagccagagactctcctagctgcgatgaggccatcagaggagcacgtcgcgtcccgcctgacatcacctattgtctctacgcacctcgacacacggaatgtcgctttcgagaggaataaatgcggcatttgggggtggcggagtgagaagatggagacggtgagcgggtacgaggcaaaggtttattcggcaaccaacgtcgaactggtcacgcggacgaggactgagcacctctccgaccaggataaaagtagatccaaagctgggaagacccccttccaatcctttctcggaatggctcagcagcactcgagtcacacaggagccccagtgcagcaggccgcctccccaactaaccccaccgcgatctctcccgaagagtatttcgatcccaatttcagtttggaatctcggaacattggccgacccatagagatgtcatctaaggtccagcgatttaaagctacgctttggctgagtgaagagcatccactttccctcggagaccaggttacgcccatcattgatctgatggccatcagtaatgcacactttgcgaagctgcgggactttatcacattgagacttccgcctggattcccagtgaaaattgagattcctttgtttcacgtgctgaacgccagaatcactttttctaatctctgcggatgtgacgaaccactctcctcagtttgggtgccagcaccatcttcggctgtagctgcaagtggcaacccttttccctgtgaggtcgacccaactgtattcgaggttcccaacgggtattctgtgctcggcatggaaagaaacgagccgctcagggacgaagatgacgatcttcttcagttcgccatccaacaatctctactggaagctgggaccgaagcagagcaagttacagtgtgggaagccctaactaatacaaggcccggggcccggcctcctccacaggcaactgtgtacgaggagcagctccaactggagcgagcactccaggaatcccttcagctgagcaccgagccacggggtcctggctcccctcccaggacccctcctgctccgggcccaccttctttcgaagagcagctaagactggccctggagctgagcagccgggagcaagaagaacgagaacgccggggacagcaggaagaagaggacttacagagaattctccagctgtctttaaccgagcattag

SEQ ID NO: 44216 - DNA, 768 bp, Artificial Sequence
  Description of Artificial Sequence: Synthetic coding sequence
atgagctgcggccggctgggccggttcaaggccaccctgtggctgtccgaagaacacccgctcagcctcggagatcaggtaacgcccatcattgaccttatggctatctcaaacgcccactttgctaagttgcgcgactttatcaccctgcggctgccacccggatttcctgtgaaaattgagatacccttgttccacgttctgaacgctaggatcacattctccaatctttgtggatgtgatgaacccttgagttctgtctgggtcccagccccttctagtgcagtggccgcctctggaaaccccttcccttgcgaagtagaccccaccgtgtttgaggtgccaaacggctacagtgtactgggaatggagagaaatgaaccgctccgcgatgaggacgacgacttgcttcagtttgccattcagcagtccctgttggaagccggaactgaggccgagcaggtgaccgtatgggaagcacttacaaatacccgccctggcgcacgtcccccaccccaggccacagtgtacgaggaacaactacagcttgaaagggcactacaggagagcctgcagctctctaccgagcctagaggccccggatcaccacctcggacgccgcctgcgccagggcctcctagctttgaggagcagttaaggcttgcacttgaactgtcctcacgcgagcaggaagagcgcgagagaagagggcagcaagaggaagaagatttgcagcggatactccaactgtctctgactgagcactag

SEQ ID NO: 44217 - DNA, 1011 bp, Artificial Sequence
  Description of Artificial Sequence: Synthetic coding sequence
atgaagcccaagagccgggaggtggagcggcggctgaccagccccgttataaacaccagcctcgacacaaaaaatatcgcatttgagaggacgaaatccggcttttggggttggcgcaccgataaggcagaggtagtgaacggctatgaggccaaggtatataccgtaaacaacgtgaacgtcatcacaaagatcaggaccgaacatcttaccgaagaagaaaagaagcggtataaagaccggaaccccctagagagtctcctggggaccgtggaacatcagtttggcgctcagggcgacctgacaacggaatgcgctacggccaacaaccccacagctattacccctgacgagtatttcaacgaggagttcgatctgaaggaccgcgatattggccgtcctaaagaactgacaatacgaacccagaagtttaaggcaatgctgtggatgtgtgaagagttccctctgtcacttgtcgaacaagtcatccctattattgatctgatggctcgcacgtccgcgcactttgcccgtcttcgagactttattaagttggaattcccccccggcttccctgtgaagatagccagccatatcactaattttgaagttgatcagtcggtattcgaaatccccgagtcctattacgtccaggacaacgggcgcaacgttcaccttcaggatgaagactacgaaatcatgcaatttgctatccagcagtcccttctggaatcctcaagaagtcaggaactgtccgggcctgcctcaaacggtgggatctcccagaccaacacttacgacgctcaatacgaacgagccatccaggaaagtctcctgaccagcaccgagggtctttgcccttctgctctgagcgagacttccagattcgacaatgatctccaacttgcaatggagctgtccgcgaaagaactggaggagtgggaattacggctccaggaggaagaggctgagctacagcaagtgctgcaattgagtctgactgataaatag

SEQ ID NO: 44218 - DNA, 1773 bp, Artificial Sequence
  Description of Artificial Sequence: Synthetic coding sequence
atgagcagcgcctgcgacgccggcgaccactaccccctgcacctgctggtctggaaaaacgattacaggcagctggaaaaggagctgcaaggtcagaatgtagaagccgtcgatcccaggggccggaccctgctgcatctagcagtgtccctgggccacctggaatccgcccgggtgctgcttcgccataaagccgatgtgactaaggagaatagacagggttggacagtgctccatgaagcggtcagcacgggggaccccgagatggtctacaccgttctgcagcacagagattaccacaacaccagcatggcattagaaggagttcctgagttgctacagaaaatcctagaagcccctgacttctatgttcaaatgaaatgggagttcactagctgggtgccactggtcagtaggatttgccccaacgacgtgtgtagaatttggaaatctggtgccaaactgcgcgtggacatcactctgctgggatttgagaatatgtcatggatccgcggccggaggagtttcatatttaaaggagaggacaattgggctgaactgatggaggtgaaccatgacgacaaagtggttactaccgagagatttgacctgagtcaggagatggagcgcttgaccctggacctgatgaagcccaaatcaagagaagtcgaacgacggctgacaagccccgtaataaacacatccttggatacaaagaatatagcttttgaacggacgaagagcggcttctggggatggcggactgacaaggctgaagtcgtaaacggatacgaggccaaagtttatactgtgaacaatgtgaatgttatcacaaaaattaggaccgaacacctgactgaggaagaaaagaaacggtacaaagcagacagaaaccctcttgaatccctacttggcaccgtagaacaccaattcggcgcccaaggtgatctcactaccgaatgcgcgactgctaataacccaacagctatcactcccgacgaatatttcaatgaggagtttgatttgaaggatagagatatcggtcggccaaaggaactgacaatcaggacccagaaattcaaggccatgctttggatgtgcgaagagtttcctctctccctggtggagcaggtcatcccgataatcgatctaatggctagaacaagcgctcactttgcccgcctgcgagacttcatcaagctagagtttccacccggatttccagttaagatcgaaatacctctttttcacgtgctgaacgcacgtatcacttttggcaacgtcaatggttgcagcacagccgaggaatcagtgtcccagaacgtcgagggaacccaggctgactcagcgtcacacattaccaacttcgaggttgatcagagcgtgttcgaaatcccagaatcttattacgtgcaggacaacggccggaatgtccacttgcaggatgaagattatgagattatgcagtttgccattcagcaatccctactggagtcaagccgaagccaagaattgtctgggccggccagtaatggaggaatatctcaaaccaatacttacgatgctcaatacgaacgagccatacaagaatcgttgcttacctccacagaaggcctgtgtccatccgctctgagcgagactagccggtttgataacgatctgcaactggcgatggaactgtctgccaaggaactggaagagtgggagctgaggctccaggaagaggaagccgagctgcagcaggtgctgcagctatctttaacagacaagtag

SEQ ID NO: 44219 - DNA, 1881 bp, Artificial Sequence
  Description of Artificial Sequence: Synthetic coding sequence
atgatccccgccaacgccagcgcccggaagggccccgagggcaagtaccccttgcactatctcgtctggcacaacagacatcgtgaactcgagaaagaagtgagggctggacaagtggacatagagcagctggatccaagaggcaggaccccacttcaccttgccacaaccctaggacacctggaatgcgccagagttctgttagcccatggcgcggatgtaggaagagagaaccgaagcggatggacagttcttcaagaagctgtcagcactcgcgatctggaactggtccagttggtgcttaggtacagggactaccagagagtcgtgaagcgtcttgccggaataccagttttactagagaagctgcgtaaagcgcaggatttttatgttgagatgaaatgggagttcacttcatgggttcctctcgtgagcaagatctgtccgtctgacacctacaaggtctggaagtctggccagaatcttcgagtcgacaccacgctcctaggtttcgaccatatgacctggcaaaggggcaatcgctcattcgtgttccgcggccaggacacttcggcggtagtgatggagatcgatcacgatcggcgcgtggtgtatacagagaccctggccctggctgggcaggatagggagcttctgctcgcggccgcgcagcctaccgaagagcaggttctgtctcgattgaccgcgcctgttgtgaccactcaactggacaccaagaacatctccttcgagcgcaacaagaccgggatcctcggatggcgcagcgaaaagactgagatggtcaacggatatgaagccaaggtatacggggcttccaacgtggaattaatcacgagaacccgaactgagcatctcagtgaacagcacaaagggaaagtgaaaggatgcaagaccccacttcagtcattcctgggcattgccgagcagcatggaggaccgcagaatggcacactaattactcaaaccctgtcacaggccaacccaaccgccatcaccgcagaggagtactttaatccaaatttcgaactcggcaacagggatatgggccggccaatggagctcacgactaaaactcagaagtttaaggctaaactgtggttatgtgaagagcatccactgtcgctctgcgagcaagtcgccccgattatcgacctcatggcggtgtcaaatgccctgttcgccaaattgagggattttattaccttgcggctgcctccaggtttccccgtcaaaatagaaatacctatatttcacatcctgaatgctaggatcactttcggcaatttgaacggatgcgatgagcctgtgccgtccgtgaggggctcaccaagctctgaaacccctagcccaggaagcgactcatcatcggtgtcttctagttcctctactacctcctgccggggttgcgaaatcagccccgccctctttgaggccccacgggggtattcgatgatggggggccaacgggaggctgccacccgagatgatgacgatgacctgttgcagtttgccatccagcaatccttactggaagcaggctctgagtatgatcaggttactatctgggaggctctgactaatagtaaaccaggcacccaccccatgtcttacgaggggagacggcaagaccggtctgctccgcccacaccccaaaggcagccagcaccaccagcctctgtgccatccccacgaccgtctagcggcccaggatcagggggacatgtgtttcgaagctatgatgagcaactgcggcttgctatggagctgtctgcccaggagcaggaggagcgcagacgacgggcgcgccaggaagaagaggagctggaacggatattgaggttgtcgctgaccgaacagtag

SEQ ID NO: 44220 - DNA, 915 bp, Artificial Sequence
  Description of Artificial Sequence: Synthetic coding sequence
atggcccagcccggcgacccccggcggctgtgccggctggtgcaggaggggcgcctgagggctttgaaggaggagctgcaggctgcaggagggtgtcccggacctgcaggcgacacactactgcactgtgccgccagacacgggcacagagacgtccttgcttatctcgcagaggcttggggtatggacattgaggccacaaacagagattacaagcggcctctgcatgaggctgcttccatggggcatagagactgtgtgcgatatctcctcggtcgcggcgccgcagtggactgcctgaaaaaggctgactggacaccattgatgatggcatgtacgagaaagaatctgggcgtcattcaagaattggtggagcacggggctaaccctcttctgaaaaataaagatgggtggaattcgttccacattgcgtctcgcgagggagatccgctcattctccagtacctgctgaccgtgtgcccaggtgcgtggaaaacagagtccaagatcaggcggactccactgcataccgccgcaatgcacggccaccttgaggccgtgaaggtcctgctgaagcggtgccaatatgagcctgattaccgggacaattgcggagtgacagccctgatggacgcgattcagtgcggacacattgatgtagcacgccttcttctggacgaacatggggcttgcctttctgcggaagattcgctgggagcacaggctctccacagggccgctgtgaccggtcaggacgaagcaattaggttcctggtttctgagctcggagttgatgtagacgtgcgggccaccagcacacaccttactgccctgcattacgctgcaaagccctgcatatggcctgttcaggtgagcacttggccggtaccatcttttagctgtagtcgggattag

SEQ ID NO: 44221 - DNA, 1086 bp, Artificial Sequence
  Description of Artificial Sequence: Synthetic coding sequence
atggcccagcccggcgacccccggcggctgtgccggctggtgcaggagggcagactaagggcactgaaggaggagctacaggcggccggcgggtgccccggaccagcaggagataccctcctgcattgtgccgcccgacatgggcatcgcgacgtgttagcctacctggccgaggcctggggcatggatatcgaggctactaatagggactacaagaggcctctgcacgaagccgcctctatgggacatagggactgtgtgcggtatcttctgggccggggtgctgccgttgactgtctcaagaaagctgattggacccctctaatgatggcatgtactcgaaagaacctgggggtcatccaagagctcgttgaacatggtgcgaaccccctcttgaagaacaaggacggctggaattccttccacatcgccagtcgagaaggggacccactgatcttgcagtacttacttactgtgtgtcccggagcatggaaaacagaatccaagatccgcaggacccctctccacactgctgccatgcacggtcacttggaagccgtgaaagtactgctgaaacgctgtcagtatgaacctgactaccgagataattgtggcgtaaccgccctgatggacgccattcagtgcggacacatcgatgtggcacggctgctgctggacgagcacggcgcttgcctcagtgctgaagatagtctgggcgcccaggctctgcaccgagcagccgttaccggtcaggacgaggcaatcagattcttggtgagcgagctcggtgttgacgtggatgtgcgggccacctcaacccacttaacggccttacactacgccgcaaaagagggacatacaagcacaattcaaactctactctcgctgggcgcggacattaactccaaagatgagaaaaaccgtagtgccctgcacctggcctgcgcagggcagcacctggcatgtgccaaatttctgcttcaatcaggtttaaaagacagtgaggatatcacgggcacacttgcccagcagttacctaggagagctgatgtactacagggtagcggccacagtgcaatgacttag

SEQ ID NO: 44222 - DNA, 1086 bp, Artificial Sequence
  Description of Artificial Sequence: Synthetic coding sequence
atggcccagcccggcgacccccggcggctgtgccggctggtgcaggagggcagactgagggctctgaaggaagagcttcaggccgcggggggttgccccggtcccgcgggggacacactgcttcactgcgctgcccgtcacggacacagagatgtgctggcatatctagcagaagcatggggaatggacatcgaagccacaaacagagattacaaacggcccttgcatgaggctgcgtccatgggacatagagactgcgtccgttatctgctcggccgcggggccgctgtcgactgtctaaaaaaagctgattggacacccctcatgatggcttgtacacgaaagaatctcggtgtgattcaagaacttgtagagcacggcgcaaacccccttctcaaaaataaggatggctggaacagtttccatatcgcttcgagggaaggcgacccccttattctgcagtacctgctgacagtatgcccaggggcctggaaaaccgagtccaagataagacgtaccccattgcacaccgccgcgatgcatggccatctagaggcagtgaaagtgctgctaaagcgatgtcagtacgagccagattatcgagataactgtggcgtgacggcactgatggatgcaattcagtgtgggcacattgacgtggcgagactgctgctggatgaacatggggcttgcctgtcggctgaggacagcctaggtgctcaggcactgcatcgagccgccgtgacgggccaagatgaggccatcagattcctagtctctgagctcggggtggacgtggatgtaagagcaacgtcaacacatctaactgcactccactatgccgcaaaggagggacataccagtactatccagacgctgctttccctaggcgccgatattaatagcaaggatgagaagaaccgtagcgcactccatctggcgtgtgccgggcagcacctggcttgtgctaagtttctgctacaatctggcctgaaggacagcgaagacattacaggtacactggcccagcagcttcctcggagagcagatgttctgcagggctcaggtcactcagccatgacctag

SEQ ID NO: 44223 - DNA, 618 bp, Artificial Sequence
  Description of Artificial Sequence: Synthetic coding sequence
atgaagaccgcctacgaggaggtgaccaccgagctggaggagttcaaagaagcgttcgcaggggctgtgaaggcaaataacagtatgagcaaaaagctgatgaagagcgacaaaaagattgctgtcatttccacaaagctttttacggaaaagcagcgcatgaagtacttcctgtcaactctccctacgagaccagagcccgagctaccttgcgtggaaaacttaaacagcatagagcttaatcgaaaatatattccaaagacagccataagaatccccacctctaatccccagacttccaataattgtaaaaactttctgacagagatggagctggatagggtcgaacagattatcaccgggaccaagaaatcctttgcgatgctgagcacctgttcccgcctactcagctttgtggagtctactgcacctaggaagcatcggcgcgccctgccaattatgcggagcttagtgccaaacagaagaacaaccgtggcgagcacggagtcgcggacgaatagaccagggggcgttcgttccccgggcttgcagcttgaagggacctccaccctccagtgggaacagggacctatcgcacatccaaggcatagatgttag

SEQ ID NO: 44224 - DNA, 654 bp, Artificial Sequence
  Description of Artificial Sequence: Synthetic coding sequence
atgaagaccgcctacgaggaggtgaccaccgagctggaggagttcaaggaggcctttgccggtgctgtgaaggcaaacaactcaatgtcaaaaaagcttatgaagtctgataagaagatcgctgtaatttcaaccaagctgtttaccgagaagcagaggatgaaatattttttgtctactcttcccaccaggccagaaccggagttgccatgtgtagagaaccttaattctattgagttgaataggaaatacattcctaagacggcaatacgcattcctacctctaatccacagacaagtaacaattgcaagaacttccttaccgagatggagctggatagagtagaacaaatcattacaggaaccaagaaatcgttcgcaatgttaagtacctgcagtcgcctacttagcttcgttgaaagcaccgcacctcgcaagcaccgcagagcccttcctataatgaggtctctagtccccaacagacgcactaccgtagcttctacagagatgagccaacttctatacaagggcgtaccatttcagagtcgcactaaccgtccagggggagttcggagccccgggcttcagttggaagggacttctacattgcagtgggaacaggggcccattgcccatccacggcatagatgctag

SEQ ID NO: 44225 - DNA, 2979 bp, Artificial Sequence
  Description of Artificial Sequence: Synthetic coding sequence
atgcggaagctgttcagcttcggccggcggctgggccaggccctgttgagtagcatggatcaggagtacgccggacctgggtatgatattagagattgggaacttcgtaaaattcacagggcagcaattaaaggtgatgccgccgaagtcgagcgctgtcttacaaggcgttttcgcgatctggacgccagagatcggaaggatcggacagtcctacatttagcctgcgctcatggacgggttcaggtagtaactctgctgctccaccggcggtgtcagatcgacatttgtgaccgactgaatcgaactccattaatgaaggccgtccactcgcaggaggaagcttgtgccatcgtgctgctggaatgcggagctaaccccaacatcgaagacatatacggcaatacagctttgcactacgccgtatacaacaaggggaccagccttgccgagcgcctgttaagtcaccacgccaacatcgaagcccttaacaaagagggaaacacgcctctcctcttcgctatcaactctaggagacagcatatggtggagttcctgctaaagaaccaggcaaatatccacgccgtcgacaacttcaaacgcacagctctcatcttagctgttcagcacaatctgagcagtattgttacactgctgctccagcagaatatccggatatcatctcaggatatgtttggacagacggctgaggactatgcactgtgttcagaccttcgatcaattcgccaacaaatcttagagcacaagaataagatgttaaaaaatcacttgcggaatgataaccaggagaccgctgcaatgaaaccagccaacttgaaaaagaggaaagagcgggccaaagcagagcataacctgaaggtcgcttctgaggagaagcaggagcgccttcagagatctgaaaacaaacagccccaagactcccagtcatatgggaagaaaaaagatgccatgtacggcaattttatgctaaaaaaagatatcgcaatgctgaaggaagagctctacgccataaagaatgattcattgaggaaagaaaaaaagtacattcaggagattaaaagcatcaccgagattaatgctaatttcgagaaatccgtgaggttaaatgagaaaatgataactaagactgtggcacggtatagccaacaacttaacgatctgaaggcagagaatgcccgcctgaattcagaactcgagaaagagaagcacaacaaggaaaggttggaagccgaagtagagagtctgcactcaagtctggcgaccgctatcaacgagtataacgagatcgtggagaggaaagatttggagctagttttatggcgggccgatgatgtgagcaggcacgagaaaatggggagtaacatttcccagctgactgataaaaatgagctgctgacagaacaggtccacaaagcccgtgtcaaattcaatacactgaagggcaaactgagagagacccgggacgctttgagagagaagaccctagcactcggatcagttcaactggacttgcgccaggcccagcacagaatcaaggaaatgaaacagatgcaccccaatggtgaggccaaggaaagtcaatccatcggaaagcaaaactcgctggaggaaagaatacgccagcaggaactcgagaaccttctgctggaacggcaactcgaggacgccagaaaggagggcgataacaaggagattgttataaacatccatcgcgactgcttagaaaatggtaaagaggatctgctggaggaacgcaataaggaactgatgaaagagtataactacctgaaggagaagttactgcagtgcgaaaaggagaaagccgagcgtgaagtgattgtgcgggagtttcaggaagagctcgtcgatcatttaaaaaccttctccattagtgaaagcccgctggaaggaacctcccattgtcatattaacctcaatgaaacatggacctcgaaaaaaaagttgtttcaagtggagatccaacccgaggagaagcacgaagaattccggaagctgtttgagctcatctccctgcttaattacaccgcggaccaaattcggaaaaagaaccgggaactggaggaggaggccactggctataagaagtgtctggagatgaccattaatatgctgaacgcttttgccaacgaggatttttcctgccacggtgaccttaacactgaccagcttaagatggatatactgtttaagaagctgaagcaaaagttcaacgatctcgtggccgagaaggaagccgtgtcttccgaatgtgtaaacctggcaaaagacaatgaagtgttacatcaggagctactgtcaatgcgtaacgtccaagaaaagtgtgaaaagttggaaaaagacaaaaaaatgctagaagaagaagtgctgaacctcaagacacacatggaaaaagatatggtagagttagggaaattgcaggaatacaaaagtgagctggatgaaagggctgtccaggaaattgaaaaattggaagagatccacttgcagaagcaggctgagtatgagaaacagctcgagcagcttaacaaggataatactgcctctctgaaaaagaaggaactcaccctcaaggatgtcgagtgtaagttctccaagatgaagacggcctatgaagaggtgacaacagaactcgaggagttcaaggaggcattcgccggagctgtaaaagcgaacaattctatgtctaaaaaattgatgaagagcgataagaaaatcgccgtgattagcaccaaattgttcaccgaaaaacagagaatgaagtatttcctaagcacactgccaacccgccccgaacctgagcttccctgcgtggagaatttgaactccatcgagttgaatcgcaaatatatccctaaaacggctatcagaattccaacgtccaacccccagaccagcaacaattgcaagaacttcttgacagaagttctgctatgttag

SEQ ID NO: 44226 - DNA, 3036 bp, Artificial Sequence
  Description of Artificial Sequence: Synthetic coding sequence
atgcggaagctgctgagcttcggccggcggctgggccaggccctgctcagtagtatggaccaagaatatgcaggccggggctatcatatacgtgactgggagctaagaaaaattcaccgcgccgctattaaaggtgatgccgctgaagtcgagcactgtctgaccagaaggttcagggacctcgacgtaagagacaggaaggatcgcaccgtactgcacttggcatgtgcacatggtcgggtgcaagtcgtgaccttactgctggatcggaagtgtcagataaacatctgcgaccggttgaataggaccccattaatgaaggccgtgcactgtcaggaagaggcctgcgccattatcctactgaaacgcggtgccaatcccaacatcaaggacatctacgggaacacagccctgcactacgccgtgtacaatgagggcacgtctctggctgaacgccttctttcacaccatgctaatattgaagctctcaataaggaggggaacacacctttgctgttcgctatcaactcccggcgacagcatatggtcgagttccttctcaagaaccaagctaacatccatgctgtcgataacttcaaaagaaccgcactcatcctagcagtgcagcataacctcagcagcatcgttacactgttactccaacagaatattcacatcagcagccaggatatgttcggccaaaccgcggaagactatgctttttgctgcgatctcagatccattcagcagcaaatcctcgaacacaaaaataagatgcttaagaaccacctccgcaacgacaaccaggagactgccgccatgaagcccgagaacctcaaaaaaagaaagaaacgtaaaaaactaaagaagcggaaagagggggctaaggctgaacacaacctgaaggtggcttccgaagagaaacaggaaagattagaacggagtgagaataagcagcctcaggactctcaatcatacggcaagaagaaagatgagatgttcggaaattttatgctcaaaagggatatcgcaatgctgaaggaggagctctacgcaattaagaacgattcactgaggaaagagaaaaaatatatccaggagattaagagtattacggaaattaatgcaaactttgagaagtcggtccggctgaacgaggaaatgataaccaagaaagttgcccaatactcccagcagctgaacgacctgaaagcagaaaatgcaaggctgaatagcaagttagaaaaggaaaagcacaacaaggaaagactcgaggcagaggtcgagagcctgcacagtaatctggccacagccatcaacgaatacaacgagatcctcgaacgcaaggatttagaattagtcttgtggagagccgatgacgtatcccgccatgaaaccatggggtctaacatcagccagctgactgataaaaacgagttgctcactgagcaagttcataaagctagggtgaaatttaacactctgaaagggaaactgagggagaccagggacgcattaagagagaagaccctagccctcgagtcagtgcagctggatctgaagcaggctcagcacaggatcaaggagatgaagcagatgcatccaaacggcgaagccaaagagtcgcagtctattgggaaacagaacagctcagaggagagaattcgacaaagagagctggagaatttgctgctggagaggcagctcgaggacgctcgaaaggagggagacaataaggagatagtcattaatatacaccgggattgtttggaaaatggaaaggaagacttgttggaagaacgcaacaaggagttgatgaatgagtataattatctgaaggagaagctgctccaatacgagaaggagaaggcagagagagaagtcattgtacgcgaatttcaagaggaactggttgaccatctaaaaaaattcagcatgtccgagagccccctggagggtacctcccactgtcatattaatttggacgagacgtggacgtctaagaaaaagctttttcaggtggaaattcaaccagaggagaagcatgaagaatttagaaaggtgttcgagttgatctctcttctgaactatactgccgaccagatacggaagaaaaacagagaactggaagaagaagccaccggctacaagaagtgccttgagatgacaattaacatgctaaacgcattcgccaatgaggatttctcctgtcatggtgacctgaacaccgaccagctgaaaatggacatcctgttcaagaagctaaagcagaagtttgacgatctgatggctgaaaaggaggctgtcagttccaaatgcgttaatctcgcaaaggataatgaggttctgcatcaggagctgttatcaatggggaaggtccaggagaaatgtgaaaaactggagaaggacaagaagatgctcgaagagaaggtgctcaatctgaagacccacatggagaaagatatggtggaattgggtaaagtgcaggagtacaagtctgaactggatgagagggccatgcaagctattgaaaagcttgaagaaattcatctccagaaacaggccgaatacgaaaaacagctggagcaactcaataaggataataccgcgtcactgaaaaaaaaagaactcaccctcaaagacgttgaatgcaaattcagtaaaatgaagaccgcgtacgaagatgtcaccacagagcttgaggaatacaaggaggctttcgcagtagccttaaaagcaaattcatcaatgtccgaaaagatcacgaagtctgataaaaaaatcgccgtgatcagtacaaaactttttatggaaaaagagcgaatggagtacttcttatccaccctgcccatgaggcctgacccagaactgccctgtgtggagaacctgaacagcattgaactgaatcggaaatatataccaaagatggctatacgaatacctaccagcaacccccagactagcaataactgtaaaaactctttgactgagctactgcttcgctgggcactggcaccaatctactttttactgtag

SEQ ID NO: 44227 - DNA, 1206 bp, Artificial Sequence
  Description of Artificial Sequence: Synthetic coding sequence
gagaaggagaaggccgagcgggaggtgatcgtgcgggagttccaggaagagctggtagatcatctgaagaagttttcaatgtcagaatcccccctggaggggacctcacactgtcacattaatctggacgaaacctggacatccaaaaaaaagctatttcaggtggaaattcagcctgaagagaaacacgaggaatttcgaaaggttttcgagttgatttcactcctcaactacaccgccgaccagatccgtaaaaagaacagagagctggaggaagaagccacaggctacaaaaagtgccttgaaatgacgattaatatgctaaacgcctttgccaatgaagactttagctgtcacggagatctgaacacagatcagttgaaaatggacatcctgtttaaaaaacttaagcaaaaatttgacgatctgatggcggagaaggaggctgtatcatctaagtgcgttaaccttgcgaaggacaacgaagtcctgcatcaagaactactgagcatgggcaaagtgcaagagaagtgtgagaagttggagaaggataagaaaatgcttgaggagaaggtgcttaacctcaaaacacacatggagaaggatatggtggaactaggaaaggtccaagagtacaagtcagaactggatgaacgcgcaatgcaggcaatcgaaaagctagaggagattcaccttcaaaaacaggcagaatacgaaaagcagctcgagcaactgaacaaggacaacaccgccagcctgaaaaaaaaagagctcacattgaaagacgtcgaatgcaagttctcaaaaatgaaaaccgcctatgaggatgtcacgactgagctcgaggaatataaggaagccttcgccgtggcgctgaaggccaatagctcaatgtccgaaaaaataacaaagtccgataaaaagattgctgtaatcagcaccaaactgttcatggagaaagaacgtatggagtactttctgagcacactcccgatgaggcctgaccccgaactgccatgtgtggaaaatctgaacagcatagaactgaataggaagtatataccaaaaatggccattaggattcccacgagcaacccccagacttctaataactgtaagaactccctaactgagatggagttagattgcgccgagcagatcatcacggagacaaagaagtccatgttacctaagtgcataaactag

SEQ ID NO: 44228 - DNA, 2472 bp, Artificial Sequence
  Description of Artificial Sequence: Synthetic coding sequence
atgaagctgttcggcttcggcagccggcggggccagaccgcccagggctcaattgaccacgtttacacaggctcaggataccgaataagggattcggaactgcaaaaaattcaccgggctgccgtgaagggagacgccgccgaggttgagagatgtcttgccagacgctccggggacctcgacgcccttgataaacagcataggaccgctctccatctggcgtgtgctagcgggcatgtgcaggtggtgacccttttagtgaaccgtaagtgtcagattgacgtatgcgacaaggagaatcgtacgcctctgatccaggctgtgcactgccaggaagaggcatgcgccgttattctgttggaacacggagccaatccgaatttgaaagatatttatggtaatactgcgttacactacgccgtgtactccgaatccacctcacttgctgaaaagctgttgagccacggagcacatattgaagcactggataaggacaacaacacacctcttctctttgccataatttgtaaaaaggaaaagatggtcgaatttctcttaaaacgcaaagcgtcatcacacgctgtcgaccgactccgcagaagcgctctcatgctggccgtgtactatgattcaccaggcatagtaaacatcctcttaaagcagaacatcgatgtgtttgcacaggatatgtgcggccgcgatgcagaggactacgccatatcccaccatctgacaaagattcagcagcaaattctggaacacaaaaaaaaaatcctaaagaaagaaaaaagcgacgtgggatcaagcgacgaatccgcagtgtccatctttcatgagctgagagtcgatagcctccccgcaagtgatgacaaagaccttaacgtcgccacgaagcagtgtgtccccgagaaggtatccgagccactcccgggcagctcccatgagaagggtaaccgcattgtgaatggccagggcgagggacctccagccaagcacccgagcctgaagccttctacagaggtggaggatcccgccgtcaaaggagcagtacaacggaagaatgtccagactcttagggctgaacaggcgttgcccgtcgctagcgaggaggagcaggaacgccacgaacgctccgagaaaaagcagccgcaggtaaaagaggggaataacacaaataagagcgaaaagattcagctgtctgagaacatctgtgacagtacctcaagtgccgcagccggccgcctgacacagcagcgaaaaatcggaaaaacatacccacagcagttccccaaaaagctgaaagaggaacatgaccggtgcacattgaagcaggagaatgaagaaaaaaccaacgtcaatatgctttacaaaaagaaccgagaggagcttgagcgaaaagaaaagcagtacaagaaggaagttgaggccaagcagctcgagccaacagtgcaatccctggagatgaagtcaaaaaccgccagaaacactccaaatagggatttccataatcacgaggagatgaaaggcctgatggatgagaactgtatactcaaagcagacattgctatcttgaggcaagagatctgcacgatgaaaaacgacaacttggaaaaagagaataagtatctgaaggacatcaagattgttaaggagacaaacgctgctctcgagaaatatattaaactgaatgaagaaatgatcactgagaccgctttccgctaccagcaggagctgaatgatttgaaggccgaaaacacgaggttaaacgcagaactgttgaaggagaaggagtccaagaaaagactcgaggcggatatcgaaagctaccagagcagattggctgctgctatttcaaaacactctgagtcggtgaagaccgagcgcaacctgaaactcgcactcgaaaggacgagggacgtgtctgtacaggtagaaatgtctagcgcgatttccaaggtgaaagatgagaacgaatttctgaccgagcagctgtccgagactcagataaagttcaacgcccttaaggataagttccgcaagacgagggacagccttagaaagaagtcattagcgctcgaaacagtgcaaaatgatttaagtcaaactcagcagcagactcaagagatgaaagagatgtaccaaaacgcagaggccaaagtgaataactccaccggaaagtggaattgtgtggaagagcggatctgtcacctgcagagggagaacgcttggctggtacagcagctggatgacgtccaccagaaggaggaccacaaggaaattgtgacaaacatccagcgcgggttcattgaatcagggaaaaaggatctcgtgttagaagaaaagtcaaagaagctcatgaatgagtgcgaccatctgaaagagagtctatttcagtatgagcgcgagaagactgaaggggttgtctccattaaggaagacaagtactttcagacaagtcgcaaaaagatttag

SEQ ID NO: 44229 - DNA, 2472 bp, Artificial Sequence
  Description of Artificial Sequence: Synthetic coding sequence
atgaagctgttcggcttcggcagccggcggggccagaccgcccagggcagcatcgatcatgtctatactggtagcggttaccggatcagggactctgaactgcaaaagatccacagagcagccgtaaaaggggatgctgcagaggtggagcgctgcctagcacgccgttctggcgatctcgatgctctggacaagcaacacagaacagccctccacctggcttgtgcctccgggcacgttcaggtagtgacgttgcttgtaaataggaagtgccagatagatgtctgtgataaggagaacagaacccctctgatccaggctgtgcactgccaagaggaggcttgtgcagtaatccttctggaacacggggctaatcctaatctgaaagatatctatggaaatacagccctgcattatgcggtttactccgagagcacaagccttgctgaaaagcttttgtcccatggtgcccacattgaggcactcgacaaggacaataacacacccctgctgttcgctattatttgcaagaaggagaaaatggttgagtttttgctcaagagaaaggccagcagtcacgcggtagaccgcctgcgccggagtgcactgatgttggcggtgtactacgatagccctgggatcgtgaatatcctgctgaaacagaatatagatgtgttcgctcaggatatgtgtgggcgcgacgccgaagactatgccatctcccatcaccttactaaaattcagcaacaaattctggaacataaaaagaagatcctgaaaaaggagaagtcggatgtagggtcatcggatgaatctgctgtgagtatcttccacgaattaagagttgacagcctcccagcaagtgatgacaaggacctgaacgtggccactaagcagtgtgtcccggaaaaagtttcggaacctctcccaggttcttcccacgaaaaaggcaaccgtattgtgaatggtcagggagaaggaccacccgccaagcaccctagcctaaaaccaagcacggaggtagaagatcctgccgtgaagggcgctgtgcagcgcaaaaatgtgcaaactctgagggctgaacaggctctgcccgttgcaagcgaagaggaacaagaacggcatgaacggagcgagaagaagcaaccccaggtgaaggaaggaaacaatacaaataaaagcgaaaagattcagctgtcagaaaacatctgcgactctacatcttccgccgctgctggcagactgacacagcagcgcaagattgggaagacttacccccagcagttccctaagaagctgaaagaagaacacgacagatgtaccctgaagcaagagaacgaagagaaaaccaacgtgaacatgctgtacaagaaaaaccgagaggagctcgagcgcaaggagaaacaatataagaaggaggtggaagccaaacaactagaacccactgtgcagtccctggaaatgaagtctaagactgcgcggaacacacctaacagggatttccataatcatgaagagatgaaggggctgatggacgagaactgcatactgaaggccgatattgctatacttagacaagagatctgtactatgaagaatgacaacctggaaaaagagaataaatatctaaaggacattaaaattgtaaaagagaccaacgcagctttggaaaagtatattaaactaaacgaagagatgataacagaaaccgcgttcaggtatcaacaggagcttaactatcttaaggcggagaacacccgcctcaatgctgaactattgaaagagaaggagtcaaagaagagactagaggccgacatagagagctatcagtcgaggctggctgcggctatcagtaaacattcagagtcagtgaagaccgagagaaacctaaaacttgccctcgagaggacaagagacgtttctgtccaagtagagatgagctctgccatcagcaaggtcaaagacgaaaacgaatttctgacggagcagctgagcgaaacgcagatcaaatttaatgcacttaaagataaattcaggaaaactagggacagtttgcgcaagaagtcgcttgctctggaaacggttcagaatgacttgtcacaaacgcagcaacaaactcaagaaatgaaggagatgtaccagaacgccgaagcaaaggtgaacaattcaacggggaaatggaactgtgtggaggagcggatttgccacctgcagagagagaatgcttggttggtgcaacagcttgatgatgtgcaccaaaaggaagaccacaaagaaattgtcactaatatacagcgcggatttatagaatccggcaaaaaagacctggtgttagaggaaaaatccaaaaagctgatgaatgaatgcgaccaccttaaagagtcgctgttccagtatgagcgcgagaagactgagggagtagtatcgataaaagaggacaaatactttcagacatcaagaaagactatctag

SEQ ID NO: 44230 - DNA, 2472 bp, Artificial Sequence
  Description of Artificial Sequence: Synthetic coding sequence
atgaagctgttcggcttcggcagccggcggggccagaccgcccagggcagcatcgaccatgtctacacaggatccggataccgtatcagggactcagagttgcagaaaattcatcgagctgctgtgaaaggagatgcagctgaggtggagcggtgccttgcgagaaggtcaggtgaactggacgccctagacaagcaacaccggaccgcactccatcttgcttgtgctagcggccacgtgcaggttgtaacgctcctagttaacagaaagtgccagatagacgtgtgtgataaggagaataggactcccctgatccaggccgtgcactgccaagaggaagcttgtgcagttatactgctcgagcacggggccaaccccaacctgaaggatatttatggaaacacagcccttcattatgccgtctacagtgagtccacttctctggctgagaagctgttgagtcatggggctcatattgaggctcttgacaaagataataatacacccctcctctttgccatcatctgtaagaaagagaagatggtggagttcctcctcaagaagaaagcctcttcacatgccgtcgacagactgcgtcgcagtgcactgatgctcgccgtatactatgatagccccggcatcgtcaacattctgctgaaacagaatatcgatgtctttgctcaagacatgtgcggccgggacgcagaagactacgcaatctctcaccatctgacaaaaattcagcagcagattctggaacataaaaagaaaatcttgaaaaaagaaaagagcgatgtcgggtcgtccgacgaaagcgctgtttccatctttcatgaactgagagtggactcccttcctgcttccgacgataaggacctcaacgtcgccaccaaacagtgcgtgccagagaaggtgtctgaaccgctaccaggctcctcccacgaaaaaggcaatagaattgtaaatggccagggtgagggacctccagcaaaacatccttctctgaaacctagtacggaagttgaggacccagccgttaagggagctgtacagcggaagaatgtgcaaaccctgcgtgcagagcaggccctgccggttgcttccgaggaggaacagcaacggcacgaaagaagcgaaaaaaaacaacctcaggtaaaagaggggaacaataccaataagagcgagaagattcagctgtcagaaaatatctgcgatagtacttctagtgcagctgcggggagactcactcagcagcgtaaaatcggcaagacgtacccccagcagtttccaaagaaactcaaggaggagcacgatcgctgtacactgaagcaggaaaacgaagagaagacaaacgtgaacatgctctataagaaaaatagagaggaactggagcgcaaggaaaaacagtacaaaaaggaagtcgaggccaagcagctggagcctacggttcagtccctggaaatgaagagcaagacggccaggaatacacccaactgggacttccacaaccacgaggagatgaagggcctcatggatgagaactgtattttgaaagctgacatcgccatcctcagacaagaaatatgtactatgaaaaacgacaacctcgagaaagagaataaatatctgaaggatatcaagatagttaaagaaactaacgctgccctcgaaaagtacatcaagctcaatgaagaaatgatcacagaaaccgcctttcggtaccaacaagagctcaacgatctgaaggcagagaacacccgtttgaatgcggagctccttaaggagaaagagtccaagaagcgtcttgaagccgatatcgagtcataccagagccgcttggccgcggcaatttccaagcacagcgagtccgttaagactgagcggaacctcaagctcgctcttgaacggactcaggacgtaagcgttcaagtcgagatgagttccgccatctcaaaggtgaaagatgagaatgagtttcttacagaacagttaagcgagactcaaattaagtttaacgcccttaaggataagtttcgaaaaacgcgggattctctgcggaaaaagtctctcgccctggaaaccgtgcaaaataacctgtcacagacacagcagcagacgcaggaaatgaaggagatgtaccaaaatgccgaggccaaggtgaataacagcaccgggaaatggaattgcgtggaggagcggatctgccacctgcagcgggaaaacgcatggctggtgcagcagctggacgacgtacaccagaaagaagaccataaagaaattgtgacaaacatccagaggggtttcattgagtccggcaaaaaagatttcgtgctggaggagaaaagcaaaaaacttatgaacgaatgtgaccacttgaaggaaagtctgttccagtatgagcgtgagaagaccgaggtggtggtttcgattaaggaggacaaatattttcagaccagtcgcaaaaagatctag

SEQ ID NO: 44231 - DNA, 576 bp, Artificial Sequence
  Description of Artificial Sequence: Synthetic coding sequence
atgggcatcctgtacagcgagcccatctgccaggccgcctaccagaacgatttcggacaagtctggagatgggttaaagaagatagtagctacgcaaacgttcaagacgggtttaacggcgatactcccctaatttgtgcttgccgacgaggacacgtgaggattgtttcgttcctgctgcggcgtaatgctaacgtcaacctcaagaaccagaaggaacggacttgcctgcattatgcagttaagaagaaattcacattcattgattacctgctgatcatcctgttgatgccagtgctcctaatcggttactttctcatggtatccaagaccaagcagaacgaagctctggttaggatgctgctggacgcaggagtcgaggttaacgccacggactgttacgggtgcacagcgctgcactacgcgtgtgaaatgaagaaccagtcactgatccccctgttgctcgaagcacgggccgatccaaccattaagaacaaacatggtgagtctagtctggacatagcccgtcgcctcaagttttctcaaatcgagttgatgcttcgtaaagctctgtag

SEQ ID NO: 44232 - DNA, 3711 bp, Artificial Sequence
  Description of Artificial Sequence: Synthetic coding sequence
atgcagcccgccgcctgcgccggcgagggcgccggcccccccgcccccagaccgccgcacccgcccggagacaaggtgcggcgcggcagagggggggcaccatccctgtccccacagcctcccgccccttatctgggattacccatcccttcccggggtggcggaggatggaggggcggtcagggcggcggtggaggcaccagggaaggaggaaccggtcgggctggcggagctgggtcttctgggtccgcccagccgcgtcccccggcggcaccccgggggccctcccgacccagtggccgtcggttattattggaacccagggcccctcctgccccacgggccccagatgccatgaaacagctgtgcctgtgtgcagctgcatcttttgcaagtcaggattggggcaaaagcgatgaaagactgctgcaggccgtagagaacaacgatgctccgagggtggcagccctgattgcacgaaagggtctagtgccaactaagctggaccccgagggtaagagcgcttttcacctcgctgccatgagaggggccgcctcgtgcctggaggtgatgattgcccatggcagcaacgttatgagtgccgacggcgccggctacaatgcattgcatctggcggcaaagtacggccacccccagtgcctgaagcagttactacaagccagctgcgtggtagatgtggtggacagcagcggttggacagccctgcaccatgctgcagccgggggttgtctttcatgttcggaggtgttgtgttccttcaaagcccacctgaacccacaggatcgtagcggcgccacgccgctgattatcgctgcacagatgtgccatactgacttatgtcgacttctgttgcagcagggcgccgccgccaacgatcaggacttacagggcagaaccgcactgatgctcgcctgtgaaggcgcaagcccagagaccgttgaggtgctgttgcaagggggggcccagccgggaatcacggatgcgctcggccaagacgccgcacattatggggcattggccggcgataaactcatactgcacttactgcaggaagccgcccagagaccctcacctcccagcgcactcaccgaagacgatagcggggaggcctctagtcagaactcgatgagtagtcacggtaaacaaggagctcctaagaaacgcaaggccccccccccccccgcatccattcctatgccagacgacagagatgcgtacgaggaaattgtacggctgcgccaggagagagggcggctgctgcagaaaatcagagggcttgagcagcacaaagagaggagacagcaggaatcccccgaagccagctctctccatatcttggaacgacaggtgcaagagctacagcagctgctggtagaacggcaggaggagaaggagtctttggggcgggaagtcgagtcactccagtctcggttgtctctgctcgagaacgaacgggaaaacacctcctacgatgtgactacgctgcaggatgaggagggtgagctacccgatctgcccggggcagaggttctgttatcacggcagctgagtccaagtgcccaggagcacctggcttcactgcaagagcaagtggccgttttgactcgccagaaccaagaactgatggaaaaggtacaaatcctggagaattttgagaaagatgagacacagatggaagtggaggcccttgccgaagtcatacctctcgctctgtacgattcgttgagagccgaatttgaccagctccggagacagcatgcagaagccctgcaggcacttaggcaacaagagacccgggaggttccaagggaagaaggagccgcttgcggagaatctgaagtggctggagcaacggccaccaaaaacggccccacccacatggaactgaatggatccgttgcacccgagacaaaagtcaacggggctgaaactatagacgaggaggcagccggagacgaaacaatggaagctcggactatggaggccgaagccacaggtgctgaggccacaggcgcggaggccacaggtgctaaggttaccgagacaaaacctactggggccgaggtccgtgaaatggaaacaaccgaagaagaagctaacatggaaacaaagccaacgggcgcccaggccacagatactgaaaccacaggtgtcgaggcaatgggcgtcgaagccacaaaaaccaaggctgaagaagccgagatgcaggcctatggagtgggggcaggccaggctgagcccccagtgaccggcactacaaatatggaggcaacaggctctagagccaccggcatggaaagtacaggtgtgtccgcaacaggtgttgagaatcctggcgtggaagcaacagtcccagggattagcgccgggccaatcctgcaccccggggccgccgaggccagtgaaaagttacaggtggagctggagaccaggatccgaggcctggaagaagctttgagacagcgggaacgtgaggcagccgcggagcttgaggcagctctgggaaaatgcgaagccgccgaagctgaggcaggccgtttacgcgagagggtgcgcgaggccgaaggcagcggtgcttctggcgggggaggaggtgacacaacccagctgcgtgccgccctcgaacaggctagagaagacctccgggacagggattcccggctgcgagaactggaggcggcgagtgcatgtcttgatgaagctcgggcttctaggttactcgccgaggaagaggcacggggactgcgtgccgagctcgcccagcgcgaggaggcccgcttagaacagtctagagagctggaagtgctgagagagcagctcgccactgcaagagccactggggagcagcaacggacagctgctgccgagcttggtcgcgcccgcgacgcagctgaagcgagagtagccgagttacccgcagcctgtgaggaggcacgacagggactcgcagagctgcgggaagctagcgaggccctccgtcagtcagtggtccccgcttctgagcataggcgcctgcaggaagaggcgctagaattgcgcggccgcgcagcgtcattagagcaagaggtggttgcaaccggcaaggaagctgcgcggcttagagcagagctagagcgggagcgtgtttgtagtgtcgcattgtcagagcacgaacgcatagtgggcaccctccaagccaatgtggcccagttagaaggtcagttagaggaactgggaagacgtcatgaaaagacctccgcagaggtgttccaggtccagagggaggcactcttcatgaagagcgagcgacacgcagccgaagcacagcttgcgaccgcagaacagcagcttcgcggcctacgcaccgaagcagagagagcacgccaggctcagtcacgagctcaagaggccctcgataaggctaaggaaaaagataaaaagatcaccgagctgtcgaaagaggtctttaaccttaaagaagccttgaaagagcagcccgcggctcttgcaacccctgaggttgaggctctcagagatcaggtgaaggatctccaacagcagcttcaagaggccgcccgggaccacagcagcgtcgtggctctataccggtcgcacctcctttacgctatccagggccagatggacgaagacgtacagcggattcttagccagattcttcagatgcaaagattgcaggcgcagggacgatag

SEQ ID NO: 44233 - DNA, 3441 bp, Artificial Sequence
  Description of Artificial Sequence: Synthetic coding sequence
atgaagaccctgcgggcccggttcaagaagaccgagctgcggctgtcacccacggacctgggctcctgtccaccctgcggcccgtgtccaatccccaagcccgccgcacgggggagacgccagagccaggattggggtaagtctgacgaaagactgctgcaagcagtggaaaataatgatgcccctcgagtggccgccctgattgctagaaaggggcttgtcccaaccaagttagacccagagggcaagagcgcatttcatttggccgcaatgcgaggcgccgcctcctgcctggaggttatgatagcccatggctcaaatgtcatgagcgcggatggagccggctataacgccctgcacctggctgctaagtacgggcaccctcagtgcttaaagcaactcctgcaggcgtcgtgtgtcgtcgacgtggtggacagctcggggtggaccgccctgcaccacgcagctgccggtgggtgtctgtcttgcagcgaggtactgtgttcatttaaggctcatctgaacccccaggacaggtctggcgccactcccctcatcattgccgcacaaatgtgtcatactgatctgtgtaggctcttacttcagcagggggccgcggctaatgatcaagatttacagggaaggaccgcactgatgctggcctgcgaaggcgcaagtcctgaaactgtggaagtgctgctacaagggggggctcaacccggcatcaccgatgccttgggacaagatgcagcccattatggtgcgctggccggggacaagctgatcctgcacttgctccaggaagcagctcaacggccctctccaccctctgcactgaccgaagatgattctggagaggcgtcaagtcagaattccatgtcatcacacggcaaacagggcgcacccaagaaaaggaaggcaccccccccaccagcctctatccctatgcctgacgaccgcgacgcgtacgaagagatcgtcagactgagacaagagcgcggacgcctgcttcagaaaatcagaggactcgagcagcacaaggagcgaagacagcaggagtcccctgaggccagcagcctccacattctggagcgccaggtacaggaactgcagcagctcctggtggagagacaggaggagaaggaaagcctcggccgggaagtggaatccctgcaaagccgcctgtccttgctagaaaatgaacgagaaaacacctcctacgacgtcaccacactgcaggacgaagagggcgaacttcccgacctgccaggagcagaagtgctcctcagcagacagctgtctccctctgcccaggagcatctggcctccctgcaggagcaggtagctgtgctaacccggcaaaaccaggagctcatggaaaaggtgcaaattctggaaaattttgaaaaagatgagactcagatggaggtcgaagccctcgccgaggtgattcctctggccttatacgattctttgcgagccgagtttgatcaactgcgtcgccagcacgctgaagctctgcaggcgctccgccagcaggagacacgcgaggtccctcgagaggagggcgccgcgtgtggagagagtgaagtcgccggagccacggctactaagaacggccctacgcacatggagctgaacggatcggtggcacctgaaacgaaggttaatggtgctgagaccatcgacgaggaagccgccggagatgagactatggaggctcgaaccatggaggctgaggccaccggcgccgaagcaactggtgccgaagcaactggggccaaagtaaccgaaaccaagcctacgggtgcagaagtgcgggaaatggaaaccacagaggaagaggcgaatatggagacaaagccaaccggagcccaagccaccgacactgagactacaggggtggaggccatgggggtcgaggcaactaaaaccaaggcggaggaggccgagatgcaagcctacggcgttggggccggccaggctgagcctccagttacgggtaccaccaatatggaggcaaccgggagtcgggcaacaggcatggagagcacgggagtgtccgctacaggggtggagaacccaggtgtcgaggcaaccgtgccaggcatctccgctggacccattctccatcccggggcagctgaagccagcgagaaacttcaggtagagttggagaccaggatccgaggcctagaggaggcgctaaggcagagggaaagggaagctgcagctgaactggaggcagctttaggaaagtgtgaagctgcggaggcggaggccggtaggctgcgggagagagttcgcgaagccgaagggtctggagctagcggcggtgggggcggggatactactcagttaagggcggctctggagcaggccagggaagacctcagggatcgtgatagccgattgagagagctggaggccgcatcagcctgtctggacgaggctcgtgcctctcgtctgctggcagaggaagaggctagggggttgcgagccgagctggcacaaagagaggaggcaagactcgaacagtctcgagagttggaagtccttcgcgaacagctggccacagcccgagcgaccggcgagcagcagaggacagcagccgctgagctcggccgcgcacgcgacgccgcagaggctcgcgtcgcggagcttcctgccgcatgtgaagaggcacggcagggacttgccgagttacgagaagctagcgaagcgctgagacaatccgtcgtcccagcttctgagcacagacggctgcaggaagaagccctggagttgcgcggtagagcggccagcctggagcaagaggtggtggcaaccggtaaagaggctgccagactcagagcagagttagagcgagagcgcgtttgcagcgtcgccctttccgaacacgaaaggattgtcggaacgctacaagctaatgttgcacagctggagggccagctggaggaactaggccgacggcatgagaagactagtgccgaggtttttcaggtgcaacgagaagcactgtttatgaaaagcgagcgccacgctgctgaagcccagctggcgacagcagaacagcagctcagaggcctccgcacagaggcagaaagagcccgccaggctcagagtcgggctcaggaggcgctcgataaggctaaagaaaaggacaaaaagatcaccgagctgagtaaagaggtatttaacctcaaggaggccctcaaggagcagccagctgctctcgccactccagaggtggaagctttacgggatcaggttaaggatttgcaacagcagctgcaagaagcagcgagggaccacagttccgtggtggctttatatcgctctcaccttctttacgccattcaaggccaaatggacgaggatgttcaaaggatcttaagccagattcttcagatgcagagacttcaggcccaggggaggtag

SEQ ID NO: 44234 - DNA, 3441 bp, Artificial Sequence
  Description of Artificial Sequence: Synthetic coding sequence
atgaagaccctgcgggcccggttcaagaagaccgagctgcggctgtcacccaccgacttgggctcgtgcccaccttgtggcccttgtcccatccccaagcccgcggcccgcggacggagacagtcccaggattggggtaagagtgacgagcgactcctgcaggctgtagagaacaatgacgctcctcgggtggccgccctcattgcgcgcaaaggtttagtcccaacaaagctggaccccgagggcaaatcagcttttcatctggccgccatgaggggcgccgcttcttgtctcgaagtcatgattgcgcacggctctaacgtcatgtccgcagacggagctggttataacgccttgcacctcgctgcgaagtacgggcacccacagtgtctgaagcaactgttgcaagcttcctgcgtggtggacgtggtcgactccagcggatggacagcgctgcaccacgccgctgccgggggatgcttgtcatgctctgaagtgctgtgtagcttcaaggcgcacctcaaccctcaagatcgatctggtgccacacctctgattatagcggcgcagatgtgtcacaccgatctgtgccgcttgcttttacagcagggggctgccgctaatgaccaggacctgcaaggtaggactgcccttatgctcgcttgcgagggggcctctcctgagacagttgaagttcttctgcagggcggagcgcaacctggaattacagatgccctgggccaggacgcagcacattacggagcactcgcgggagacaagttaatcttgcacctgctccaggaggccgctcagagaccatccccacccagcgctctgactgaagacgactctggcgaggccagctcccagaattccatgtcttcacatggaaagcagggtgcccccaagaagcggaaggctccacccccccctgcctcgatcccaatgcccgatgatcgagatgcttatgaggaaatcgtgcgattacgccaggaacgcgggcgcctcctccagaagatacgggggctggaacagcataaggaacgccggcagcaagagtcccctgaggcatcctccttacacatcctggaacggcaagtgcaagagttacagcaactactggttgagaggcaggaagagaaggagagcttaggccgcgaagtcgagtcactgcagagtagactgagcctcctcgagaacgagcgtgaaaatacttcttatgatgtcaccacactccaagacgaagagggggagctccccgacctgccaggcgcagaagtcctgttgtcccggcagctctcaccatctgcccaagaacatctcgcctctctgcaagaacaggtcgccgtactaacaagacagaatcaggagctgatggaaaaagtgcaaatccttgagaacttcgaaaaagacgagacacaaatggaagtggaggcactcgccgaagtgatcccactagccctctatgattctctgagagcggaattcgaccagctgcgccgacagcacgccgaagcgctgcaggcgctgcggcagcaggagacccgagaggttccgagagaagagggcgctgcctgtggtgaatctgaggtggccggcgccaccgctaccaaaaacggaccaactcacatggagctgaatggcagtgttgctccagaaaccaaagtgaatggggctgagacaattgatgaagaggctgcaggtgatgagacaatggaggccagaaccatggaggctgaagccacaggcgcagaggccaccggggctgaggccactggcgctaaggtcaccgagacgaaaccaactggggccgaggtccgggagatggagacaactgaggaagaggctaacatggagaccaagcctaccggcgcccaggcaaccgacacagagaccaccggtgtcgaagccatgggagtagaagcgaccaaaacaaaggctgaggaggctgagatgcaggcctacggcgtcggcgccggacaagcagaacctcctgtgaccgggactaccaatatggaggctactggttcccgagccactggcatggagagtacaggcgtcagcgctaccggggtggagaacccgggcgtggaagcaacagtgccaggtatctcggctggacccatactccatcctggcgccgccgaggctagcgaaaagctgcaagtggaactcgagacaaggattagaggtctggaggaggctctgagacagcgcgaacgggaagcagccgcggagctcgaagcagcacttggcaagtgtgaagccgccgaagccgaagcggggcgcctgcgcgagagagtgcgggaggctgagggtagcggcgcgagcggcggtggcgggggcgataccacacagttacgcgcggcccttgagcaggctcgggaagatctcagggacagagacagcagattaagggagctcgaagccgcctctgcatgcctggacgaggccagggcaagtagactgctcgccgaggaggaggctagaggactgcgcgctgagctcgcgcagcgggaggaggcaaggctggaacagtctcgcgagttggaggtgctgcgcgagcagttggccaccgcccgggctactggagagcagcagcgaactgcagcggcggaactgggcagagctcgcgacgctgccgaggcccgagtggccgaacttccagcagcatgcgaggaagctagacagggactcgccgagctgagagaagcctcagaagccctgagacaaagcgtggtccctgcctctgagcatagacgattacaagaggaggccctggagctacgagggagggcagctagtttggagcaggaagttgtcgctacgggcaaagaagccgccagactacgggccgaacttgaacgagaaagagtgtgtagcgttgccctttccgaacacgaacgcattgtcggaactttgcaggccaacgtcgcccagctcgagggacagctcgaagagctcggcaggcggcacgaaaagacaagtgcagaggtcttccaagtgcaacgcgaagccctgttcatgaaatcagaaaggcatgcggctgaggctcaacttgcaactgcagagcagcaactgcggggactgcgaaccgaggcggagcgagcccgccaggcccaatctcgggcacaggaagccctggataaagcaaaagaaaaagataagaaaatcactgagctgtccaaggaggtgtttaacctgaaagaagcattgaaagaacagcctgccgctttggcaacaccagaggtcgaggcactccgagatcaggtgaaggatctccagcagcaactccaggaggccgcgcgcgatcactcatcagttgtggcattgtatcgatcccatctactgtatgccattcaggggcagatggacgaggacgttcagcgcatcttgagccaaatacttcaaatgcaacggcttcaggcccaaggtaggtag

SEQ ID NO: 44235 - DNA, 807 bp, Artificial Sequence
  Description of Artificial Sequence: Synthetic coding sequence
atggaggagaacagcttccagaaggagacccccctggccaacgccgccttctgggctgcaagacgcggcaacttggctctattaaaattgcttcttaactctgggcgagtcgacgtggattgtagggacagtcatggtacaaccctcctgatggtggcagcatatgcagggcacatcgattgcgttagggaactggtcctgcagggcgctgatattaaccttcaacgagagtcggggactacagccctgttcttcgctgcccagcagggacataacgatgtggtccgcttcctcttcggatttggggctagcacagaatttcgcaccaaagacggcgggaccgccttgctggccgcttctcagtacggccatatgcaagtggtggagactctgttgaaacatggtgctaatatccacgatcaactgtatgacggagccacagcactcttcctcgcagcccagggtggctacctggacgtgattcgcctcctgttggcctcaggtgccaaagtgaaccaacctcgtcaggatgggacagcacctctctggatagcgtcgcagatggggcactcagaggtggtgagggtcatgcttctgcggggggccgacagagatgctgccaggaatgatggaacaactgcactgctgaaggccgcaaataaagggtacaacgatgtcatcaaagaattgctgaagttctcccccactctgggcattctaaaagctaatgagctgcccgcagagctcacgaagaatgagagaatcctgagactgttgagatcgaaggagggacctcggaagtcatag

SEQ ID NO: 44236 - DNA, 906 bp, Artificial Sequence
  Description of Artificial Sequence: Synthetic coding sequence
atgtgccggatgagcttcaagaaggagacccccctggccaacgccgctttctgggccgcccgtcgggggaacctggcactcctcaagcttctgctgaattccggacgcgtagacgtagactgcagagacagccacgggactaccctacttatggtagccgcctatgcaggccacatagactgtgtgcgcgaattggtgctgcagggagcggacatcaatcttcagagggagtctggaaccacggccctcttttttgccgcacaacaggggcacaacgacgtagtcaggttcctgtttggatttggcgcctcgacagagtttcggaccaaagatggcggaactgcgctactcgctgcctcccagtacggccatatgcaggtggtggaaactctcctcaaacacggtgcaaatatccacgaccagttatacgatggtgccacggctctgtttctcgccgcccagggcggataccttgacgttatccggctgctgctggccagtggagcaaaggtaaatcagcccagacaggacggcactgcacctctctggatcgcctcccagatgggccattcagaggtcgtgagagtaatgctccttcgaggcgccgacagagacgctgccaggaatgatgggacaactgctctccttaaggccgcaaataaagggtacaatgatgttatcaaagaactattaaagttttcaccgaccctcgggatccttaagaacgggacctccgccctccacgcggccgttctcagcggaaatattaagaccgtcgccctactcctggaggctggggctgaccccagtttgcgtaacaaggcgaacgagctgcctgccgagctgactaagaatgagagaattcttcgactactaaggtctaaggaggggccgcggaagtcttag

SEQ ID NO: 44237 - DNA, 906 bp, Artificial Sequence
  Description of Artificial Sequence: Synthetic coding sequence
atgtgccggatgagcttcaagaaggagacccccctggccaacgccgccttttgggcggccagacgaggtaacctggctctcctgaaactgcttttaaactctggcagggtggatgtcgattgtcgggattcacatggtaccaccttgcttatggtggccgcctacgccggccatattgactgtgtcagagagctggtccttcagggcgccgatatcaatctgcagagagaatcagggaccacggcactgttttttgcagctcagcaaggccataatgatgtggtgcgctttctcttcggatttggggcatcgaccgagtttagaacaaaagatggcggcacagctctcttagcagcatcccaatacggacacatgcaggtcgtagaaacactcctgaaacacggcgcgaatatccacgatcaactctacgatggcgctacggccctgttcttggccgctcagggcggataccttgatgtgattcgattactgctcgcgtccggcgcaaaggtcaatcagccccgacaggatggaaccgcccctctgtggatcgcaagccagatgggacactcagaggtggtgcgtgtaatgctactcagaggggctgaccgtgacgctgctcgcaatgatggaactaccgctttgcttaaggctgctaacaagggttacaacgatgtcataaaggaactgcttaagtttagtccaactctgggcattctgaagaacggaacatcggctctgcatgctgctgtgctctccggtaacatcaagacagtcgcactactcctggaggcaggagctgacccctctttacgcaacaaggctaacgagctgccggccgaactgacgaagaacgagcgcatattaaggctcctgcgctctaaggaggggccgcggaaatcttag

SEQ ID NO: 44238 - DNA, 2439 bp, Artificial Sequence
  Description of Artificial Sequence: Synthetic coding sequence
ccctgcaagaccctgctgcagaacgacgtgtgcctgcccaaggccacacatcagaaggagtttgacaccctgagcggcaagctggaggtgtacttctgtcctattggtatgttgactaacacgaagacccagaagacacccaagcctagcgtcatcccattccaatctaaacacgacttcctgctcgaaagtcctgacaaagacggactgcttaagccgacttgtggtcggaaggtgtcattgccaaacaaagccctggagcttaaggatagggagacattgaaagccgaatctcctgacaaggatggtctcttaaaaccgacctgtgtgcgcaaggtctcgctgcccaacaaggcactggaactaaaggaccgcgaaactctaaaagccgcccagatgtttccctctgaatctaagcagaaggacgacgaggagaattcctgggacttcgagagtttccttgaggcactcctccagaacgacggctgtttaccgaaggccacacatcagaaggaattcgataccctttccggcaaactggaagagtctcccgacaaggatgggctgctgaaaccaacttgcggcatgaaaataagcctccctaacaaggccttggaattgaaggatcgtgaaaccttcaaggcggaggatgtgagctccgtggaaagtactttctccttattcggaaaacccacaacagagaatagccaatctacaaaagtggaggaggactttaacctcaccactaaagagggggcgaccaagaccgtcaccggacagcaggaaagagatataggtattatagagcgggcccctcaggatcaaaccaacaaaatgcctacaagtgaattggggcgaaaggaggacaccaagtctacgagtgactccgaaattattagtgttagcgacacacagaactatgaatgtctgcccgaggcgacctaccagaaggagattaagactaccaacggcaagattgaagaatccccagagaaacctagtcattttgagcccgccacagagatgcaaaactccgtgccgaacaagggtctcgagtggaagaacaagcagactctgcgagccgactccactaccctttccaagattttagatgcgcttcccagctgcgagaggggccgcgaattaaagaaagacaactgtgagcagataactgccaagatggaacaaaccaaaaataaattttgtgtgctgcaaaaggagctaagcgaggccaaagagatcaaatcacagctggaaaatcagaaggccaaatgggaacaggaactatgcagcgtgaggcttaccctcaaccaggaagaagagaagcggaggaacgtcgatatcctgaaggagaagatcagaccggaagaacagctgcgtaagaagcttgaagttaaacagcagctcgaacagaccttgaggatccaggacatcgagctcaaatccgtcacgtccaatctcaatcaggtgagccacacgcacgaaagcgaaaatgacctgttccatgagaactgcatgctgaagaaagaaatagctatgctcaaactcgaggtggcgactcttaagcatcaacaccaagttaaagaaaataaatatttcgaagacatcaagatacttcaagagaagaatgccgaattacagatgacactgaagttaaaacaaaaaacagtcacaaaaagggcatcgcagtaccgcgaacagttgaaagtgttgacagctgagaataccatgctgacctccaagctcaaagagaaacaggataaggagatcctggaaaccgagatcgagtcccaccacccacggctcgccagtgcccttcaggatcacgatcaatcggtgacatccaggaaaaaccaggagttagcctttcactctgctggcgacgctccactgcaggggattatgaacgtagacgtgagcaatacaatatacaacaacgaggtgcttcaccagcccctgtacgaggcccagagaaagagcaaatcacctaagattaatctcaactacgccggcgacgacctgcgggagaatgctttagtgtcggagcatgcgcagagagaccgttgtgagacccagtgccagatgaagaaagctgaacatatgtaccagaacgagcaagataacgtggataagcataccgaacagcaggaatcccttgagcaaaaactgtttcagttggagtccaagaacaggtggcttcgccagcagctcgtttacgcacacaaaaaagtgaataagtcgaaagtcacaatcaatattcagtttcccgagatgaaaatgcagagacacttaaatgagaaaaatgaagaagtgttcaactacggcaaccatcttaaggaaagaatagaccagtatgaaaaggaaaaagcagagcgtgaggtgtctattaaaaagtataaatacttctcaaactttctaaaggagtctggcctcggctag

SEQ ID NO: 44239 - DNA, 2361 bp, Artificial Sequence
  Description of Artificial Sequence: Synthetic coding sequence
aacgcctgggacctgaacagcttcctggagaccctgctgcagaacgatgtgtgcctcccaaaggcaacgcaccagaaggagttcgacaccctttcaggaaagctggaggagtcacccgacaaggatggcctgctgaagccaacctgtggccggaaggtttcgttaccaaacaaagccctcgaactcaaggatagagaaactctcaaagcagagtcaccggacaaagatgggcttttaaagccaacatgcgtgcgaaaggtgtccctgcccaacaaagctttggagcttaaggatagagaaactctcaaggcagcacaaatgttcccatctgagagtaaacagaaggatgatgaagagaactcctgggatttcgagagcttcctggaggctctgctgcagaatgacggttgcctgcccaaggcgacgcaccagaaagaatttgacaccctgtccgggaaactggaggagtctccagataaggatggactgctgaagccgacatgcggaatgaagatctccctgccaaacaaggctctcgagctcaaggaccgagagacatttaaagccgaggacgtgtcatccgtggaatcaaccttctctctgttcggcaaacctacgactgaaaactcacagtccacaaaagttgaagaagactttaacctgaccacaaaggaaggtgctaccaagactgtgacggggcagcaagagcgcgatatagggatcatcgaacgggccccgcaggatcaaaccaataaaatgccaacatcggagttgggaagaaaggaggacaccaaaagcaccagtgactcagagatcatctcagtcagcgacactcagaattacgagtgccttccagaagcaacgtatcagaaggaaatcaaaactacaaacggaaagattgaagaaagccccgagaaaccctcacacttcgagcccgccaccgagatgcagaatagtgttccaaacaaagggctggagtggaaaaataaacagaccctgagggcagactccaccaccctctccaagattctcgatgcactcccaagctgcgagagagggcgggaactgaaaaaggataattgcgaacaaatcacagctaaaatggaacaaacaaaaaacaaattttgtgtccttcagaaggaactgagcgaagctaaggaaattaagagtcagctggagaaccagaaagccaaatgggaacaggagctctgtagcgtgaggctgacattgaatcaggaagaggagaagcgccgaaatgtggacatcttaaaggaaaaaatcaggccagaggaacagctgcgaaaaaagctggaggttaagcagcagttagagcagacactgcggatccaggacattgaacttaagagtgtgacctctaatttgaaccaagtgtcccacacgcacgagtccgagaatgacctcttccatgagaactgcatgctcaagaaagagattgccatgcttaaacttgaggtggcaaccctcaagcaccagcatcaggttaaagagaacaaatatttcgaggacatcaagatccttcaggagaagaatgccgaattacagatgaccttgaaactgaagcaaaagaccgtgaccaagcgggctagccaatatcgagagcagctgaaagtgctgaccgcggagaatactatgctcacgagcaaactgaaagagaagcaggacaaggagatcctggaaactgaaattgagtcacaccatccaaggcttgccagtgcactgcaagaccatgatcagagcgttaccagtcgtaagaaccaggaattggcttttcactccgctggtgacgccccactccaggggatcatgaatgtcgacgtttccaacacaatttacaacaatgaggtgctccaccagcctctgtatgaagcccagaggaagagcaaatccccaaaaattaacctaaactatgccggcgatgacttgcgcgagaatgccctagtaagcgaacacgctcagcgagaccgttgtgagacacagtgtcagatgaagaaagccgaacacatgtatcagaacgagcaggataatgttgacaaacatactgagcagcaggagagcctggagcaaaagttgtttcaacttgagtccaaaaaccggtggctgcggcagcaacttgtttacgctcataaaaaagtcaacaagtcaaaggtgactataaatatccagttcccagaaatgaagatgcaacgccatcttaacgagaagaatgaggaagtattcaactacgggaatcatctgaaggagcggatcgaccagtatgagaaggaaaaagcagaacgagaagttagtattaaaaagtacaagtatttttccaatttcctgaaggaaagcggcttggggtag

SEQ ID NO: 44240 - DNA, 4179 bp, Artificial Sequence
  Description of Artificial Sequence: Synthetic coding sequence
atgaagcggctgctggccgccgccggcaagggcgtgcggggccccgaacctcccaatcccttcagtgaaagagtgtacacagagaaggactacggaactatctacttcggggaccttgggaagatccatacggccgctagccggggacaggtgcaaaagctcgaaaagatgaccgtggggaaaaaacctgtcaatctcaataagagagatatgaagaagcgaacagctcttcactgggcttgcgtgaacgggcacgccgaggttgtcacgtttctggtggatcgcaaatgccagcttaatgttctggatggcgagggccgcactccgctgatgaaggccctgcagtgtgagagagaggcctgcgccaatatcttgatcgatgctggtgctgacctgaactacgtggatgtctacgggaatacagcactgcattatgctgtatactccgagaatttactgatggtggctactttgctcagttacggagccgtaattgaggtgcagaataaagcatcgctcacacctctgttactggcaatccaaaaacgcagcaaacaaaccgtggagttcctcctaactaaaaacgctaatgccaatgccttcaatgagagtaaatgcacagccctgatgctcgccatttgtgagggatctagcgaaatcgttggaatgctccttcaacagaacgtagacgtttttgcagaggacatccacggaattaccgccgaaagatatgctgccgcgtgtggagtaaattatatccaccaacaattactggagcacattcgtaagcttccgaagaacccccagaatactaatcctgaggggacatcgactggaacccccgacgaagctgctcctctcgcggaaagaacgcccgacactgccgaatctttactagagaaaactcccgacgaggctgcacgtctggttgaaggcactagtgccaaaatacagtgcctgggcaaggcaaccagtggcaaattcgagcagtcgacagaagaaacaccacggaaaattctcagaccaactaaagagactagcgaaaagttttcttggccagctaaagagagatcgcgcaagatcacctgggaagagaaagagaccagtgtgaagactgagtgcgttgccggtgttaccccgaataagactgaagtcctggagaagggcacttcaaatatgatcgcttgtcctacaaaagaaacctccacgaaggcttcaacaaacgtcgacgtgagctccgtcgagccaattttctccctctttggaacacgcactatagagaactcccagtgtacgaaagtggaagaggactttaatcttgcgacgaagattatctcaaagagcgccgcccagaactatacatgcctgcccgatgccacgtatcaaaaagacatcaaaaccattaatcacaaaatcgaggaccagatgtttccctccgagtccaagcgcgaggaagatgaggaatactcatgggattctgggagcctgttcgaatcctccgccaaaacacaggtctgcattcccgagagcatgtatcagaaagtcatggagataaatagagaagtggaggagctccccgagaagccaagcgcttttaagcccgcagtggagatgcagaaaacagtcccaaacaaggcattcgaattaaagaatgaacagacactccgggcggcacagatgttcccgtcagagtctaaacaaaaagatgacgaagaaaacagctgggactctgagtcaccatgcgaaaccgtgtcccaaaaggatgtgtatctgcccaaagccactcaccaaaaggagtttgatactctatcaggaaagcttgaggaatcgcccgtgaaggatggcttgctaaaaccgacctgtgggcggaaggtgagcctgccaaacaaggccctggagctgaaagatcgcgaaaccttcaaggccgagtcaccagacaaagatggcttactgaagcccacttgtggcagaaaggtgtccctcccaaataaagcgctggaactcaaggatcgagagaccctgaaggcagagtcacccgataacgacggactactgaagcctacatgtggacgcaaggttagcctgcccaacaaagccctggaactcaaggatcgtgaaacatttaaggcggctcagatgttcccttctgaaagcaaacagaaagatgacgaggagaactcatgggactttgaaagttttctggagactcttttgcagaacgatgtctgcttaccaaaagccacacatcagaaagaattcgacaccctgtcaggaaagctggaagagtcccccgacaaggacggcctgctgaagccaacttgtggaatgaagatcagcttgcctaacaaggcccttgaactgaaggatcgggaaacgttcaaagccgaagatgtttctagtgtagagagtacattcagccttttcggtaagcctactaccgagaatagtcaatctacaaaggtggaagaggactttaatttaacgactaaggaaggagccaccaaaactgtgaccgggcagcaggagagagatataggaatcattgaaagagctccacaggaccagactaataaaatgcccacatccgagctgggcaggaaggaagatacaaaatcaactagtgattcagagattattagcgtgtccgacactcaaaactatgaatgtctgccagaagccacttaccagaaagagatcaagacgaccaacggaaagattgaggagtctccagaaaaaccctctcattttgagccggctacagaaatgcagaactctgttccaaacaagggcttggagtggaagaacaagcagactctgagggccgatagcaccaccctaagcaagattctagacgcccttccctcttgtgagcgggggagggagcttaagaaggacaattgcgagcagataaccgctaagatggaacagacaaaaaacaagttctgcgtcctacagaaagagctgtcggaggcaaaagaaattaaatctcaactggagaatcaaaaggcaaagtgggagcaagagctgtgcagtgtccgccttacactgaatcaggaggaagagaagcgaaggaacgttgacatcctgaaggaaaagataagaccagaggagcagctgcgtaaaaaactagaagtcaagcaacagcttgagcaaactctgcgaatacaggatatcgagctcaagtccgttacctctaacctgaatcaagttagccacacccacgagtccgaaaatgacctgttccacgaaaattgtatgctgaaaaaagaaatagcaatgctgaagttggaggttgccacccttaaacaccagcaccaggttaaagagaataagtactttgaggacattaaaatcctgcaggagaagaatgctgaactgcagatgacactaaaactaaaacagaagacagtgactaaacgagcaagccaatatagagaacagctcaaggtgttgaccgcggaaaacacaatgttgacatcgaaactgaaggagaaacaggataaggagattctggaaacagagattgaatctcaccacccccgcctcgcttcggccctgcaagatcacgatcagtcagttacgagcaggaaaaaccaggagctggcatttcactctgccggcgatgcacccctgcagggtattatgaatgtggacgttagtaacacgatttacaataacgaagtgctccatcaaccactgtacgaggctcagaggaaaagcaagagcccaaagattaatcttaactatgctggggacgacctgcgcgaaaatgctttagtatccgaacacgcccagcgagaccgctgcgaaacacaatgtcaaatgaaaaaagctgagcacatgtaccagaatgagcaagacaatgttgacaagcacaccgaacaacaagaaagtcttgaacagaagctgttccaattggagtccaaaaatcgctggcttcggcagcagctggtgtacgcccacaagaaggtcaacaagagtaaagtgactataaacatccaatttcctgagatgaagatgcaacgccatttgaatgagaagaatgaagaggtctttaactatggcaaccaccttaaggaacgcattgaccagtatgaaaaggaaaaggcggagagagaagtgtcaatcaaaaaatataaatatttctctaatttcctgaaagagtctgggctggggtag

SEQ ID NO: 44241 - DNA, 1860 bp, Artificial Sequence
  Description of Artificial Sequence: Synthetic coding sequence
atgaagcggctgctggccgccgccggcaagggcgtgcggggccccgagccgcccaaccccttctctgagagagtttacactgagaaggattacggtaccatctactttggcgatctcgggaaaatccatacggcagcttctcgaggacaggtgcagaagctggagaaaatgaccgtcggcaaaaagcctgtgaatctgaacaagagggatatgaagaaaaggacagccttacactgggcttgtgttaacggacatgctgaggtcgtgaccttcttggtcgaccggaaatgccagctcaatgttctcgacggagagggaaggacccctcttatgaaagccctgcagtgtgagagggaggcatgtgcaaacattctgatcgatgccggagcagacctgaattacgtcgatgtgtatggcaacaccgcccttcactacgctgtgtactccgagaacctccttatggtggcgaccctgctttcctatggcgcagtgatcgaagtgcagaataaagcctcgctcaccccacttttgttggcgatacagaagaggtcaaaacagacggtagaatttttactgacaaaaaacgctaatgcaaacgcctttaacgagagcaaatgcactgctttaatgctagcaatctgcgaagggagctcggaaattgtcggaatgctgctacagcagaatgtcgacgtatttgcggaagacatacatggcatcacagcagagaggtacgccgccgcctgtggcgtgaattatattcaccagcagttgcttgaacacattaggaaactgcccaagaaccctcagaacacaaatcctgaaggcacctctactggaacgcctgacgaggccgcaccactcgcagagagaaccccggataccgcagaatcacttctggagaagactcctgacgaggccgcccgactggttgaggggacctcggctaagatccaatgccttggtaaggctacctccggaaaattcgagcagtcaaccgaagagaccccccgaaagatcctgcgacccactaaggaaacatccgaaaagttcagttggccggcaaaagaaaggtcccgaaaaataacctgggaggagaaagagacatccgttaagactgaatgcgtagccggcgtcaccccaaacaagactgaagtcctggaaaaaggcactagtaacatgattgcatgtcctacgaaggagacctccaccaaggcctctacgaatgtggatgtctcctccgtagaacccatcttctccttgttcgggacccggaccatagagaactctcagtgcacgaaagttgaagaagactttaatctggctactaagatcatcagtaaatcagcggcccagaattacacatgcttacctgatgctacataccaaaaggacattaaaaccattaaccacaaaatcgaggaccagatgtttccaagtgaatccaaacgggaggaggatgaagaatatagttgggattctggatcactgtttgaaagtagtgcaaagacccaggtctgcatccctgagagcatgtaccagaaggtcatggaaatcaatagggaggtagaggagctgccagagaagccatccgcctttaaaccagcagttgaaatgcaaaagaccgtccccaacaaggccttcgagctgaagaatgagcaaaccctgagagccgcacagatgtttccctccgaatcaaaacagaaagacgacgaggagaacagctgggattcagaaagtccgtgtgaaaccgtttctcagaaggacgtttacctgcccaaggcgacccatcagaaggagttcgacaccctgagcggcaaattagaggcttatctctggaaagaaagtttcagttctaaatag

SEQ ID NO: 44242 - DNA, 5622 bp, Artificial Sequence
  Description of Artificial Sequence: Synthetic coding sequence
atggaggagggcgtgcaggcccccgactgggacagcgacgagaccgtcatcgaaggctctgtaacagaaagtgacctcgaagaaaaggagctcccatggaggcgcctgttgttcgatcaggacgcttcacttaaaagtgagttcagcctacatcctgatacaagggggatgtgcaagggtatgccatcccctgagattcagcttgggtttaaacttcgcgaggatttgcaggaacagatgaataagaataagatgatgccggttttgagtgaggacactatcctgcagagccaggatgagacggaacggaaccaggctctcctgcagacacgtaagaactgctccatgttcattggcagttttcgccagtcaggcctttctctgaatcatcagaatatagaagggccggaggcagagagtcctgaggtgctgccccatattgagaaggagctcagcgaaggacgtgattcaccggaggtgtccttgctcagtggcaccgccatcaccgtgtccgacaccgtcgctgtgaaagagaccagtctcgttgaacctgagaaaatcttggcggcgcctaacacattctttgagccacgaaaggaggtgaccatgacaatgacttcagaggaaaccaaggacgaggaaagctctctagagaccttcgtgtccgctttggagtcactcctgacttcccctgagtccacccaggaggaaaggttgtttgagttggttagtgactttgatcggaaggaacttatgaacccactgagcgatagcctgtcaagtatatccattcccctaaactcttggtcggcttgtcaccgagacctgctggaggacgccaaagacgacgcactgccagccgagttgctcgaggccctcaacaccctgtctgaggccaaggtagagactatctgtcatcggaaagaaggagggagctcactgatcgcccgcaatgagtgcctggaagtggagtttaatacctcacagaccaacgaggactgcactcagattgcagaaacactccaggaccctaacccgtcaggcttgcaaacgctagctcatcagaatattacttcgtgcgagcccctcagcaacaaaaggaactccaattccgtgacaaattctagtgaccaagagacagcctgcgttctgcgaaggagcagtcgccttgagaagcttaaggtgtcaagggacgcaaaatattcggaccatatgtataagatgcccgagaaaatactaccgaagatcctcggctgtgaggaccttactaataacaatagtagtgcccagaacttccgcatgcaagatcctgctctcatgattgatgggaaggaaaagaatatgcactcggcccgctttaaaaacgggaaacagattcgcaagaatgagcaattttcgggtaaaaaggagaagatgaaagttaacaagattagcctccactccattaataggcgtaatatctttggcgaaaacctcgtgtacaaggcagcccttcacgacgacgccgatttggtgcatcactgcattaaaaaaggaggtaacgtcaaccagccaagctacgccgggtggacagctctacacgaggcttcagtcgggggtttctaccgaaccgcttcggaactgctcaaaggaggggcagatgtcaacattaaagggttatatcagatcacaccactccacgacgctgtcatgaatggtcactacaaggttgccgaattgctcctgctcaacggtgccgatcccttgttccgtaacgatgacgggaagtgcgcacttgacgaggctaaggacctctgcatgaagcggttactcgagcgttacattccgaagcaccagaagtgcttgactagtgctcagcgctcgagcatcgaccccctcgacatcgaagatgtttaccagcacaagaagcctaagttttcctccaaatctcacatctggcacgtttacaatgagaactccaacaggcagaagttggagcatgtcaaggtgaacaaaggctccaaggcatccctgtttatcaataaagaagatgtctacgaatactaccaaaaggaccctaagaataccaaattcggaaagtccaagcacaaacagtctaccctggatcagatttactctaccgggctgagaaaggggaatttgcacaatgtcaaggacccaaatacaaacgtgcccaagggtatcggacgccggaaaacgcagcataaaaggacccaggtggacgatgttgactgtaacccaagaaaaatcttggcagtgagccccagccgcaggatcaacagactcgtgacctaccagcagcatatacccgaaacacacaacgatcttcccgaggagttgtgcgagcctagctccctgaccctcagttcgttaagaaatggcctcgactcatcaacagaagcatgcagtgtttcaaaggaaaagcatatccagaatttggacttgagtgatagccaggaagtccagtgcctggagctggaaagtgtcgatcaaaccgaagctgtgagttttccaggcctgcttttgcacaaagagatcaagttgcccgtcgtgaccaccgacaagcagcctcacacccttcaagaacagcaccacgtgctttataagtcacatgagaatagcaatctggtacctaaggatgagcgttttaacaaatgggaaaactcatttctcagctttgtgaaagagaatagcgacaacgacgatgatgatgattgtagtacatcagagaaggccatcacctccaaaaaggttttgtgcagcactggcgggaaaaagcattataatttcaaggagaacctaaccaataaaaaggaaatgggctttcagcagttcctactgagcgaagatcatctgtctcaggaaaacgaattgaaggcagtgtctctgacaacacttcctgaacaggaggccgtgaatttcagctactccgacaacgccgtgatctcagaacatgtggctaactacgagcagtgcatcttcggtccaagcttcgaccacagcaacggcaaccctgagcagaatagcctcgcctgtatgaggacccttctgacacatgaagcaagcaaactgactaatcacgtcgagctcttcaagaagcctcaggactacatcccccgggcaccaaccttcctgatgaatcagaccgacacgcatatcgtggagaagatggccaaaaattgcgacaccgagcgcaattacatcgaccgcgatcaaaagattatctattccaatgagccgttgagcattgtggcgcactcacaagtgatagagactaccaaggttgagaaaagaaggcaaaaccacctagaatctgaaaccattcacaacatcgacagccattcgacagataacatgagcaaggaactcgccaatatttccaagttgtcccagagagagaaaaaggaaattagtcataagccagggatgaaagctggacgcattaacaagcgcaacgcccgaggggaatcgcaactacacctcgccgtgcggagaggaaacctcccattagtcaaagctctcatagaatcaggcgccgacgtgaatctgaatgataacgctggatggacacccctccatgaagcctcgaacgaggggagtatcgatattattgtcgaactgctcaaggcaggggccaaggtgaactgcgagaacattgatggaatcctgccactgcacgacgctgtcgctaataaccatctgaaggccgccgaaatccttctccagaatggtgcgaaccctaaccagaaagatcaaaagcagaagtccgctctcgatgaggctgacgacgagaaaatgaaggagctcctccgatcatacggggccattgagacagtgaacagggatgaaagcgatgccatcgtaaatgagaagattcctgctgtccggagcaaacgacacaaacagtgtttttgtgacgatggaaaaactattgattcgagctctctttcacaccaagaacggtcacgggaatctctgagcgtgcaccagaccctatcggcaatcctccaagatatcgaagagaaacaagagtacctcctcgaattcgagattcggaaccccgaggacgctgaacagtatatcgagaagatgctgaagatcaagaagattatggacaacgtcctggccaagcagaaggcggagcgggacgacctcgccaaaaagtacagggtgtctatcgagagctttaagcacggcgccctgcgagagcagctggccaatctcgccgccagacagaagtctctgctggtggtagcgaagaagcagaaaaaaataagcctgaagatccagaactgtcggaacgtaacttctctcccctgtctctcgcttaggaaactgccgccccggtccgagattagtagtgagaaggattcacaggaattgacaagtctggagaatctcgaacatcctcaaagcgggtccctgtccccagtgagtgggagtatgcaggagacacaactctcgctggagacatggaactactctcagaatacaaacatctgtctaaattccgaggctgttcgtagaggagaattttccggtaacgacatgaactccaagcagaatggatcagactgcactctcgatggatttcccaagagtagacacagcgacggaacagagaagaacaaactgcccagccagccagtggcgttcatcggccagaccgaatatagtcagaaggagaatgacctcactgaggctacagataaggaccatgagttctacgttagcagtcccgtgatcggcaaactcaacatttcggaaacagcctcggttctggccgaaaacgccgcacacccatcgaatatcatctgtgatcaggacctgtctaactatgacccaaaacggggaaatagaaagacaagcagtcagcaaagccctaccggcgctagcgagtcgctggcacaccaggggatcgcagtcctgggtagcgatactgtccaccagatgaaaccatatcttaagaagtctgtgtccgtggtgccttgtgccgatgacagtcagatcagctcctcctccgggtcgggccaacaggatacgattaagaaagcccttaactactccaccgctcccaagaagaaatgtatacagatcaaggatctcattttactcggccgcattaatcctgggaacaatatcctggagttcaaaacccaggagacaactcataaagcaagtatcttgttaaatggcaagctgaaggtagaaagcggccagatatataagaatcccgtgacctggttaaaggatctcctgggtgggaactcttacgttacgtggaactatgcatggtctaaggtgacttatctcggtaaggagctactgaggtatgtgtctgaggacgcacctatcctgcccgagccaaactcagtcccacaacagtatcagccttgtctgcctgaggtggcctgccttgatgatccagtgcaggaacccaataagagcatgtttgaaaagaccaaatttggtcagggcacctctagagagagtatgcagtcaagcccaaggtatctgcaaattaacgagattctgctgatcagcgatcaggagtttctgccatgtcacatcatggatcagcattggaagttctgtgtggagtgcgaggagctgactccatag

SEQ ID NO: 44243 - DNA, 819 bp, Artificial Sequence
  Description of Artificial Sequence: Synthetic coding sequence
atggtggcctgctaccacggcttccagagcgtggtggccctgctgtcccattgcccttttcttgacgttaaccaacaagacaagggaggggatacagcactgatgttagcagcccaggcaggccatgtgcccctggtttcccttctgctaaactattacgtggggttagatcttgagcgcagagaccagcggggtcttaccgctctgatgaaagccgctatgcgaaatagatgcgagtgtgtggccaccctacttatggcaggcgctgatctgacagccgtcgacccagtacggggaaagactgctctggagtgggcagtcctgacagattcatttgatactgtttggcggattcggcagctactgaggcgcccgcaagtcgaacagctgagtcagcactacaaaccagagtggccagctctgagcggcctggtggctcaagcccaggcccaggcacaggtggctcctagcctcttggagcgattacaggctactctttcactgccatttgcccccagtccccaagagggaggtgtcctggatcatctcgtgaccgccaccacttcgcttgcttctcctttcgtaacgacagcctgccacacattatgtcccgaccatccgccatcgctaggaactcgctctaaatcagtgcccgagctgcttgtacctgcagaagctcagtccttcagaacgcctaagagcggcccatctagcctggccatcccaggggcccaggatcgggaagaggagaccggtggaggtgggcagaacggcaccgaagttggcgaggatggcatagggcaggcaggcaatcggtag

SEQ ID NO: 44244 - DNA, 612 bp, Artificial Sequence
  Description of Artificial Sequence: Synthetic coding sequence
atgaaggccgccatgcggaaccggtgcgagtgcgtggccaccctgctgatggctggggccgatttgacggcagtagatcctgtgcggggcaagacagcactggaatgggccgttttgaccgatagtttcgacacggtatggagaattcggcaactcctgcgcaggccccaggtcgagcaactctcccagcactataaaccagagtggcccgcactgtccggtcttgtcgcccaagcccaggcgcaggctcaggtcgccccaagcctcttggagagactccaggccacactgtccctcccttttgccccttctccccaagagggcggagtgctcgaccatctagtcaccgcaaccacctctctggcctcaccatttgtcaccacagcctgccacaccctgtgtcctgatcatccgccgtccctcgggacccggagcaagtcagtccccgagttgctggtccccgccgaagcacagtccttccgtacccccaaaagcggaccctccagtctcgccatccccggagcacaggatcgcgaggaggagaccggaggaggtggccagaacgggaccgaagtcggggaggacggcatagggcaggctggcaaccggtag

SEQ ID NO: 44245 - DNA, 1485 bp, Artificial Sequence
  Description of Artificial Sequence: Synthetic coding sequence
atggtgctgctggccggcaccggccccgagggcggcggcgcccggtgcatgacaccaccccctccatctccacctaggggagcgcaagtcgaagaagaccccgccgattacgaggagttcgaggacttctcttctctgcccgatacgcggtccatcgcaagcgacgactccttctacccttttgaggatgaggaggagcacggtgttgaatcggccgagagcgtcccagaaggagttcccgaatccgttccagagactgccactcttctgagggcagcatgcgctaacaacgtgggccttttgcgcaccctggttcggcgcggtgtttcagtcgaagaagcccaagagacggatcgcaatggaaggacagggttgatcgttgcctgctaccatgggttcgtggacactgtagtggccttggctgaatgcccacacgttgatgtcaactggcaggattccgagggtaataccgcattgattactgccgctcaggcaggccacgctatcattacgaattatctcctgaactattttcctggcttggaccttgaaaggagaaacgccttcggatttacagcactgatgaaggccgccatgcaagggaggacagactgtatccgggccctcatgctcgccggcgctgacgttcatgcccgggacccccggcggggcatgagtccccaggagtgggccacctacactggacgtgtggatgctgtccgccttatgcagcgacttcttgagcggccctgtcccgaacagttttgggaaaaatatcggcctgaattgcctccacctcctgaagccgctcgaaaaccggccgggtccaagaactgtctgcaaagactcacggactgcgtactgagcgtgttgactcctcgctctgttcgaggccccgaggatggaggcgtgctggaccacatggtgaggatgactacgtccctgtactctcccgcggtcgcaatcgtgtgtcagactgtttgtcctgaatctcctcctagtgtcggcaagcgtcgcctggcagtgcaggagattcttgccgcccgtgctgctcgcggtccacaggcacaagaagaggacgaagtggggggcgccggccaaagggggagaaccggtcaggaggatgccgattcccgagaagggagcccaagggccggcctcccgcctgctctgggcagtagagggcccgcagctccagcccctagaaaagccagcctgttgcctcttcagcggctccgccgacgatctgtgcgaccgggcgtagtagtaccccgggtccgcgtatccaaagcccccgctcccacgttccaacccgaacggccggctaggaagggctccacgaaagattcggggcatcttcagatacccaagtggagatataaagaggccaaggaggaaaagaggaaagctgaagaagcggaaaaaaagcgtcaggctgaagcacaaaaggaacgtcggactgctccctggaagaaaagaacgtag

SEQ ID NO: 44246 - DNA, 1491 bp, Artificial Sequence
  Description of Artificial Sequence: Synthetic coding sequence
atgctgcacaccgagggccacgccctgctgcgggccgtgggccaggggaagcttagactggccagactgttgttggaaggaggcgcgtacgtgaacgagggcgacgcgcagggagagacagcgctaatggctgcatgcagagctagatacgacgacccccagaacaaagcccggatggtacggtatcttctggagcagggtgccgatccaaatattgccgacaggctgggccggacggctctaatgcacgcgtgtgccggagggggcggtgctgccgtggcatctcttctcttggcacacggggcagatccaagcgtccgcgatcacgccggcgcttcggctctagtgcacgctctcgacagaggagaccgggaaacactcgcaactctgctggacgcctgcaaggccaaaggaaccgaggtaatcatcattaccaccgacacgtctcccagcggcaccaagaagaccagacaatatctcaacagccccccaagtcctggcgtagaggatcccgcccccgcgagcccgagtccaggcttctgtactagcccttccgagattcagttgcaaaccgctgggggagggggacgaggaatgttgagccctcgcgcccaggaagaggaggagaagagggacgtcttcgagtttccattgcccaagccacccgatgaccccagtccaagcgaacccttacccaagcccccccgccatccccctaaaccactgaagaggctgaacagtgaaccctggggcctggtcgcacctccacaacctgtcccccctacagaggggaggcccgggatcgagaggctgactgcagagtttaatggattaacactcacaggcagaccccgactgagccggagacatagcaccgagggccccgaggacccacccccctgggcagaaaaggtgacgtcaggggggccgctttcgcgaagaaacacagcacctgaagcccaggaatcgggccccccatccggcctgcgccagaaactgagtcggatggagccagtcgagctggacaccccgggacatctgtgccccgacagtcccgagtcttcacgtttgtcactcgaaagaagacgctatagtgcttctccacttacccttccccctgccggcagtgctccttctccacgacagtcgcaggaatcgctgccaggagccgtgagtcctctgagcggacgccgtcgcagtcccggactgttggagcgacgcgggtccggtaccttgttactggaccacatctcgcaaacccgccctgggtttctgcctcctctcaatgtgtcaccccaccctccaatccccgacattcgtccacagccgggaggtagagctccaagtctcccagcgcctccatacgccggagcccccggatcacctaggactaagagaaagctagttagacgtcacagtatgcaaactgagcaaatccggctactcggggggtttcagagcctggggggtcccggcgaaccaggacggtag

SEQ ID NO: 44247 - DNA, 1608 bp, Artificial Sequence
  Description of Artificial Sequence: Synthetic coding sequence
atgatggacgacgacaccgagctgcggaccgacggcaacagcctgctgaaggctgtatggctgggtcggctgcgtttgacaaggcttttgctcgaagggggggcctatatcaacgagtctaacgacaagggagaaactgcattgatggtcgcctgcatcacgaaacatgtggatcagcagtcaatcagcaaatcaaagatggtgaagtacctgctagataaccgagccgaccccaatatacaggacaaaagcggcaaaactgcactgattcatgcctgtattagaagagccgggggggaagtcgtctctttgctgttagaaaatggagcagacccctccctggaagacaggaccggcgcctcagccctcgtttacgctatcaacgccgacgataaagatgcccttaaacacctcctggacgcttgtaaggcaaagggtaaagaggttatcatcatcaccacagataaaagtagttcagggactaagacaactaaacagtatctcaacgtgccacccagcccaaaggttgaggataggcattcccctccactttgcgcatctccttctgacatcgagcttaaagcgcttggacttgattcccctctcaccgagaaagaagatgattttttctccctccaggcaggccaccccagctcttgtaatacctctaaggcagtcaatgagccagggagcccaactcgcaaggtttctaacctgaagcgggccagactgccacaactgaagcgcctccagtcggaaccatggggactcattgccccctctgttctggcggcctccactagacaggacgaaacccacggcgccagtaccgataatgaagtgatcaaatcaatctcggacatttcattcccaaagagggggccactgagcagaacaaatagcatcgattcgaaagacccaacgctgttccacacagtgacggaacaagtgttgaaaataccagtgagctcagcgcccgcatcttggaaagccgcatatgaaaagggccaggcgccccaccctcggctcgcccgtcgcggcactctccccgtggaccaggaaaaatgcgggatgggacccagtggccctagcgcgttgaaggagccggcttccctgaaatggttagaaaatgacttatatgacttggatatacaacccgggcctgatcccccaaattccatcagtcttgagtcagggaaaggacccctcgaccgaaagaaactcaacagtagccatttgtccctcttccatgggtctagagagtctttagataccgtcccctcaacatctcctagcagcgccaggcgccgcccaccccacctgctcgagagacggggctcaggtaccctcttgcttgataggatttctcacacaaggcctggcttcttacctcccttgaacgtcaacctcaatccccccataccagacattaggtctagtagcaaacccagctgtagcctggcatccggcttgaagagcatggtcccagtcgctccctcatcccctaagagggtggatctcagaagcaaaaagaaactgctcaggaggcactcgatgcaaattgaacagatgaagcaactgtctgacttcgaggaaattatgacatag

SEQ ID NO: 44248 - DNA, 3006 bp, Artificial Sequence
  Description of Artificial Sequence: Synthetic coding sequence
atgaagcggatcttcagctgcagcagcacccaggtggccgtggagcggtggaatcgccatgatcagaagctgctggaggccgtacacagaggtgacgtgggccgcgtggcagccctggcctctaggaagagcgcacgcccgaccaaactcgattccaacggtcaatctccatttcatctggccgctagcaagggtctcacggagtgtctgacgatcctccttgctaacggcgctgacatcaactccaaaaatgaggacggctctactgcgctccatctagccacgatttcctgccagccccagtgtgtcaaggtgctgctccagcatggagccaacgaagatgccgtggacgctgagaatcgcagtcctctccactgggccgcctcgtcaggatgtgcgagttccgtgctgctgctgtgcgaccacgaagctttcttagacgtcctggataatgacggtcggacaccactcatgatcgcatctctggggggtcatgcagcaatatgcagccagctcctgcaaaggggagctcgggtgaacgtaacagacaaaaacgacaagtccgccctgatcctggcttgtgagaaggggagtgctgaagtggctgagctgctgctatcccacggggccgacgccggggccgttgatagcacaggccatgatgccctgcactatgctttgcacacccaggacaaggctttgtggcggcatctccagcaggccttatctcgccgaagaagaggcgggcaacggttagtgcagcaccctgatttagcaagccaggcatctccgagcgaaccccaggcaggaagccctcctaagtccagttggagggccgagcccgaagaagagcaggaagaaaaggaggatgaggatccatgttccgaagaatggcggtggaaatacgaggaagagcgccgcaaagtggtcagactggagcaggaactggtacaaaagacggaagaatgtaaaactcaagccgcagcttacctggatctagagaatcagattagagaacaggcccaggagctcggggttctgttgagctgggagccaagagcttcagggaagcagggtagcagtttaaggcccggaggagacggaatggagcagggatgtccaaaagacctgctggcagaaagcacacaggagctgaaaaaacagcagcaggcggcggcaaccgttaaccctgtactagcacccaagaaagcggaggacagcgccccaggcaagatccagtatgaggtgcatggacggagccagcctgaggagcaagggcctcctcagagtccagcctcagagacaattcggaaagccactggccagcaactcacaaccaatggtgcacagacgtttggaccagaccatgcggaccaattgcccgccggccaaaaagaatcttcccaggtgctgggggtggaaccgggaggtaccgtagccgagccagtgggtccggccgcaatgaatcagctgctgctgcagctgagagaagagttggccgccgtgtggcgcgagaaggatgctgcacgtggtgctctatcaagaccagtaatggaaggggctctcggcacccctcgagcggaagcagcagctgccgcttgggagaaaatggaagcccgactggagcgtgtgctggctagattggagtgggcaaaggcaggtctgcaagtgaagcccgaggtgccaagccaggaatctcgggaaggcgcactgaaagctgcaccaggaagtatcaaacaggacgaagaaaaagaaaagagggttccaggtgcccggggggagcctctcggcgcactaggcggcgagaaggccctcggcgggctggctaaaggccagctcgagaaggaaatgtctgtgcttagactcagcaactctaacctcctggaggaactgggagagctcgggcgagagcggcaacggttacagagagagctgcagagcctgagccagcgcctgcagagggaattcgtgccgaagccagaggcacaggtgcagctccagcagttgcggcagagcgtgggcctcctcaccaacgagttggcgatggaaaaggaggcaacagagaagcttcggaagttacttgcgtctcagtcttctggcttacgcgggttgtgggactgcttacccgcagacctggtaggcgaacgttctgcccagtcaaaggctgccgagagtctggaggaactccgcgcctgcatcagcacactggtggatcgtcacagagaggcccaacaggtgctcgcccgccttcaggaagaaaaccagcaactacgcggcagcctctctccctgtagagagcccggcactagtctgaaggccccagcctcccctcaggtcgctgccctcgagcaggacctcggtaaactggaagaggagcttcgcgccgtgcaggcgaccatgtccggcaagagtcaggagatcgggaaacttaagcagcttctgtaccaagcgacagaggaagtggcagagctcagggcccgcgaagctgcgagcctgagacagcacgaaaaaactcgaggatctctcgtggctcaggcacaagcgtggggccaggagctgaaggcattattggagaaatacaataccgcttgcagggaggtgggcaggcttcgagaggcggtggctgaggaacgccggagatctggcgatttagctgcccaggccgccgaacaggagcggcaggcctctgaaatgaggggcaggtctgagcagttcgagaagaccgctgagctgttgaaggaaaaaatggagcatttgattggcgcttgccgagacaaggaagccaaaattaaagagctgctgaaaaaactcgaacagctatctgaggaagttctggcgatccgcggcgaaaatgcccgtctcgcactgcagcttcaggatagtcaaaagaaccatgaagagattatcagcacctaccgcaaccatcttctcaatgcggctagagggtacatggaacatgaggtctataacatccttctgcagatcctgagcatggaagaggagtag

SEQ ID NO: 44249 - DNA, 2733 bp, Artificial Sequence
  Description of Artificial Sequence: Synthetic coding sequence
atgaagcggatcttcagctgccagccccagtgcgtgaaggtgctgttgcaacatggcgccaacgaagacgccgtcgatgcggaaaatagatctcctctgcactgggccgcctcttcggggtgcgcaagcagtgtccttctgctctgcgaccatgaggcttttctggacgttcttgataatgacggacgcacgccgctcatgatcgcatcgctgggtgggcacgccgccatctgctcgcaactgctacagcgtggagcaagagtcaacgtcaccgacaaaaatgacaaaagcgcgctgatcctcgcctgcgaaaagggctcggctgaagtggcagagctacttctgtctcacggggcagacgccggcgcggtggatagcactggccatgacgctcttcattacgcccttcacacacaggacaaggccttatggaggcatttgcagcaggccctgagcagaaggcggagagggggacagcgactggtgcagcacccagatctggcctctcaggcgtcaccttcagagccacaagcaggctcaccccccaagtcctcctggcgggcagagcccgaagaggaacaagaggaaaaggaagatgaggatccctgctcagaggagtggaggtggaaatacgaagaagaacggaggaaagtggtgaggcttgagcaagaattagtgcagaagacagaggaatgcaagacacaggcagccgcctaccttgacctagagaaccagatcagggaacaggctcaggagttgggcgttctgctgtcatgggagcccagagcatctgggaagcaaggcagttccctcagacctggaggagacggtatggaacaagggtgtccaaaggacctgctggccgaatccactcaggagcttaaaaaacaacagcaggcagccgccactgttaacccggtgttagctcccaaaaaggccgaggacagcgcacctggcaagatacaatatgaagttcatggtaggtcccagcccgaggaacaaggaccaccacagtcacctgccagtgaaaccatccggaaagccacggggcagcagctgacgactaacggagcccaaacatttggaccggaccacgccgatcagctacctgcgggtcagaaggagtcctctcaggtcctgggcgtggaaccaggtggcaccgttgccgagcccgtcggtcccgctgctatgaatcaactgctgctccagctgagggaggagctggcagctgtgtggcgcgagaaggatgccgcacggggcgcactgagtcggcctgtcatggaaggggctctcgggactccaagggccgaagctgccgccgcagcatgggagaagatggaggcccgtcttgagagagtgttagcccgcctggagtgggctaaggctgggctccaggtaaagcctgaagtcccctcccaggagtcaagagagggagcgctgaaggcagcgcctggatctatcaaacaagatgaggagaaggaaaagcgtgtgccgggcgcaagaggtgagccgctgggggctctcgggggagagaaagctttaggaggtctggctaaggggcagctggagaaagagatgtccgtcctacgattgtcaaatagcaacctcttggaggagctgggagagcttgggcgagaaaggcaacggctgcaacgggaactgcagtcccttagccagagactgcagcgggaatttgtacctaaaccagaggcgcaggtccagctgcaacagcttaggcagagtgtgggactactgacaaacgaattagccatggagaaggaggcaacagagaaattgcggaaattgctagccagtcagagcagcggactgcgcggcctgtgggattgtctgcctgctgacctcgtaggcgaaagaagtgctcagtccaaagctgccgaaagtctagaggaactgagggcctgcatcagcacccttgtggataggcatagggaagcccagcaagtcctcgcaaggctgcaggaggaaaaccagcagctccgtgggagcctgtccccttgtagggagccaggcacatcccttaaggctccagcatctcctcaggtggcagcacttgaacaggaccttgggaaacttgaggaagagcttcgcgcggtacaggcgacaatgtccggaaaaagccaagaaatcggaaagctaaagcaactcttgtaccaggcaacagaggaagtagctgagctgcgtgccagggaggctgcatcacttcggcagcatgagaagactcgaggctctctggttgcacaagcccaggcatgggggcaggagttgaaggccctcctggaaaagtacaacacggcttgtcgtgaagtgggcaggctccgcgaggctgtagctgaggagcggcgaaggagtggagatttagccgcacaggccgcagaacaggaacggcaggcatccgaaatgcgagggcggtccgagcagtttgagaagactgctgaattgctcaaggaaaaaatggagcacctgatcggagcatgccgagacaaggaggccaaaatcaaagaactgcttaagaaactggagcagttaagcgaagaagttctagccatccgtggcgaaaacgcgagacttgctctgcaacttcaggactcccagaaaaaccacgaggaaatcatttccacctatagaaatcacctgcttaatgccgcccggggctatatggaacacgaggtttacaacattctgctgcagattttatctatggaggaggaatag

SEQ ID NO: 44250 - DNA, 414 bp, Artificial Sequence
  Description of Artificial Sequence: Synthetic coding sequence
atgaagcggatcttcagctgcagcagcacccaggtggccgtggagcgatggaacaggcacgaccagaaactgttggaggcggtccacagaggggatgtgggccgtgtagcggcacttgcgagccgcaagtctgctcgtccaacgaagctcgattcaaatgggcagtccccgtttcatttagccgcgtccaagggtttgactgagtgcctcacgattctgttggcaaatggggctgacattaatagtaaaaacgaagatgggtccacagccctccaccttgccaccatcagttgccaacctcaatgcgttaaggtattactgcaacctccccttgcagtcccccaagtttgctcatgttgtgtcacaaccaagccctcctggacttgctggatcatgatggacgtgcatccttag

SEQ ID NO: 44251 - DNA, 489 bp, Artificial Sequence
  Description of Artificial Sequence: Synthetic coding sequence
atggaggacggcaagcgggagcggtggcccaccctgatggagcggctctgctccgacgggtttgcatttccacagtacccgatcaaaccctatcacttaaaaaggatacacagggctgtgctgcacggtaatctggaaaaacttaagtatctgctgttgacctattatgatgcaaataagagggacagaaaggagcggaccgctctgcacctggcatgcgctacaggccagcctgagatggtgcacctgttagttagtcggcgatgcgaactgaacctgtgtgaccgcgaggatcgcactccactcataaaggccgtgcagctgcgccaggaagcctgtgctacattgctgctgcaaaatggagccaatcctaacattaccgatttcttcgggcggacagccctccactatgcagtttataatgaagacacctctatgatcgagaagttgctcagccacggcacaaatatagaggagtgttcaaaatag

SEQ ID NO: 44252 - DNA, 384 bp, Artificial Sequence
  Description of Artificial Sequence: Synthetic coding sequence
atgctgctgcagcagcagctggacgacgcccggaacaaggccgacaatcaagaaaaggccattttgaatatccaggcccggtgcgacgctcgcgtgcagaacctacaggccgaatgcagaaagcacaggttgctgttggaggaagacaataagatgttagtgaacgaactgaaccactccaaggagaaggaatgccagtacgagaaggaaaaggctgagagggaggtggctgtgcgccagctgcagcagaaaagagatgatgtgctgaataaagggagtgccaccaaggcgctcttggacgccagctcccgacattgtacctatctcgaaaatgggatgcaggattctcgaaaaaaattagaccagatgcgtagtcaggcatag

SEQ ID NO: 44253 - DNA, 1041 bp, Artificial Sequence
  Description of Artificial Sequence: Synthetic coding sequence
atggaggacggcaagcgggagcggtggcccaccctgatggagcggttgtgttcagacggatttgcttttcctcaatatcccatcaagccttatcacctaaagcgaatccatagggcagtgctccacggtaacttagaaaaactcaagtacctgctgctcacctattacgatgccaacaagagagatcgtaaggagcgcacggccctgcacttggcttgtgctacaggtcagcctgaaatggtacacctgctcgtgtcaagacgttgcgaacttaacttatgcgaccgagaggatcgaactcctttgatcaaggctgtgcagctgcggcaggaagcctgcgccacattacttctgcagaatggagctaatcccaatatcaccgatttttttggcaggactgctcttcattatgctgtatacaatgaggacacatccatgattgagaaattgcttagtcacggaacaaacattgaagagtgtagcaagtgcgagtaccagccactgctcttcgccgtgagccggcggaaagttaaaatggtcgagtttctcctgaagaaaaaagcaaacgtcaacgccattgactatctcggacggagcgcgctgattcacgcagtaaccctgggcgagaaagatattgtaatcttactcttgcagcacaacatcgacgtgctgagccgggatgcatttaggaaaatcgccggcgactacgccatcgaggccaagaatcgcgtgatctttgacttaatatatgagtatgagaggaagagatacgaggacctccctatcaattccaatccagtatcttcacagaaaccccctacactcaagggaacttccgacgaagaagactccgtcctgggtatcgcacgtgagaataaagatggggagaagtcacggaccgtcagctcggagaagccccctggcttaaaggcttccagcgctgaaaaggacagcgtgctgaacattgcacggggaaaaaaggatggcgaaaagacaaagagggtgtcttctcgcaaaaaacctagccttgaggcaacgtag

SEQ ID NO: 44254 - DNA, 5826 bp, Artificial Sequence
  Description of Artificial Sequence: Synthetic coding sequence
atggaggacggcaagcgggagcggtggcccaccctgatggagcggctatgctcagacgggtttgcctttccacagtacccaatcaaaccatatcatctgaaaagaattcacagggcagtcctgcatggcaatctggagaaactgaaatatctgctgctgacatactacgacgctaataaacgcgaccgcaaggaacggaccgccctacatctcgcctgtgcaacgggtcaacctgagatggtccatctgctggtgagtagacggtgtgagctgaacctctgcgatcgggaggacaggaccccacttattaaggccgtgcagctgaggcaggaggcttgtgctaccctcttgttgcaaaatggcgccaaccccaacatcactgactttttcggccggacggctctgcactatgcggtttacaatgaggatacttccatgattgagaaattgctctcacacgggacaaatatcgaagaatgtagcaaatgcgaataccaaccgctactctttgccgtcagcaggcgcaaagtgaagatggtcgagttcctcctaaagaaaaaagccaacgtgaatgctatcgattacctggggagaagcgcgctgatccacgctgtaactttaggcgagaaagacattgtgattctgctcttacaacacaacatagatgttctcagtcgtgacgcttttcgaaagatcgccggtgactacgccatagaggcgaagaatagagtgatctttgacctgatctacgagtacgaaaggaagaggtatgaggatctcccaataaattcaaaccccgtgtcctcacagaaacaacccgctctgaaggcaacaagcggtaaagaggatagtatcagtaatatcgccacagagatcaaagatggacaaaaaagcgggaccgtgagctcccagaagcagcccgccctcaaggacaccagcgacaaggacgactctgtcagtaacacagccaccgaaattaaggatgagcagaagtccgggaccgtgctccctgcggtggagcagtgccttaaccgatcgctctaccgaccggatgccgtcgcccagcctgtgacggagaatgagttctcactggagagcgaaattatctccaaactttacattccgaaaaggaagattatttcccccagaagcattaaggatgtcttaccgccagtcgaagaggccgtggatcggtgcctatacttgttggaccggtttgctcagcccgtgacaaaagacaaattcgcgctggagtctgagaatatctccgagccctatttcaccaacaggagaacgatctcccaacagtcagccgagaacttggatgccgcctgcggcattgataagacagaaaatggtaatatgttcgaagaccagaacgtggataaagagggtaaagcattaccagctacgggtcagaaggcaaacgtgtctcctgagcagccccctttgtttacccataccgtcaaggatagagaccatatctcaactcgctttctcggcggcatggattcgctcacatcaagcgaggaatcctcagagcgccccccattatcaaccctgacactgaaggaagccgacccaagttcaaaagcagccatgcgccgcaaagactctccccctcccggaaaggtgtcgtcacagaagcagcctgcggaaaaagctacaagtgacgacaaggattctgtgtccaatatcgctaccgagatcaaagaaggtcccatttcgggcacggtcagctctcagaaacaacccgctgagaaggccacatctgatgagaaagattcggtatcgaacattgccactgaaatcaagaagggtcaacagtcgggaacagtgtcacctcagaagcagtcagcttggaaagtgatcttcaagaaaaaggtatcactgttgaacatcgccacacgaataatggggggagggaagtcgggaaccgtctcttctcagaaacagccagcctctaaggcaacctccgacaagaccgattcggccttgaatatagccacggagatcaaagatggtctccagtgtgggacagtatcctctcaaaaacaaccagcactaaaggccacaaccgacgaagaagattcagtgagcaacattgcaaccgagatcaaggatggagagaagtcaggcactgtttcatcccaaaaacagcctgcacttaaggctacaactgacgaagaggattctgtgtcaaacatcgccactgaaatcaaagatggggagaaaagcgggacggtttcctcgcaaaaacagccagcccttaaagccacaactgacgagaaggactccgtgagtaacatcgccaccgagatcaaggatggcgagaaaagcggaacagtgtcctcacaaaaacctcccgccctcaccgccacctctgacgaagagggcagtgtgctctctatcgctcgagagaataaggacggagaaaagagccgaacagttagtagtagaaaaaaaccggccctgaaagccacatccgacgagaaggacagcttttccaatattactcgcggcaaaaaggacggggagatatcccgaaaagtgagttcgcagaaacccccaaccttgaaaggaacaagtgacgaagaagacagtgttctcgggattgcccgtgagaacaaggatggagagaaatctcgaacagtatcctcggaaaagccacccgggttaaaggcatctagcgccgaaaaagatagtgtactaaatatcgcccgcggtaagaaggatggtgaaaaaactaaaagagtctcatctcggaaaaaaccctcactcgaagccacttccgacgaaaaagatagtttcagcaacatcacccgggaaaagaaggatggggagattagccggaaggtctcttcccagaagcctcccgccttgaaggggactagtgatgaggaagactcggtgctgggaattgccagagaaaataaggatggagagaagtctagaactgtgtcatctgaaaagcctcccggtcttaaggcaacttctgacgagaaggatagtgtgctgaacatagccagggggaagaaggatggggagaagacacgaacggtcagcagtcaaaagcccccaacgttgaaagcaacgtctgacgaggaagacagtgtgttgtctatagcccgggaaaataaagatggtgaaaagtcgcgcaccgtatcaagcgagaagcctagtggtcttaaggctacttcagccgaaaaagactcagtgctaaatatagcaagaggaaaaaagtacggagagaagacaaagagagtgtcctcaagaaaaaagccagcactcaaagccactagcgatgaaaaggactccgtgctgtatatagcaagagaaaagaaagacggagagaagtcacggactgtgagttcccctaagcagccagccttaaaggctatttgcgataaagaggattctgtaccgaatatggctacagagaagaaggatgaacagatcagcggtacagtctcttgtcagaaacaacccgctctcaaggctacatctgataagaaagattctgtcagcaatattccaacagagatcaaagatggccaacaatctggaacggtgagcagccagaagcaaccggcatggaaggccacatcagtcaaaaaagatagtgtgagtaatatcgctactgaaattaaggacgggcaaatccgaggtacaggaattttggagtatacatttaacgtcatgtttgaccagattgaagaaaaatttactagccttaacaaatctgccggagtcagcccgcagaagcagtcagctcagaaagtaatttttaagaagaaagtatccttgctgaatatagctacccgcataaccgggggatggaaatctggcacagaatatccagaaaacctaccaaccctgaaagctaccattgagaataagaatagtgtcctcaacaccgctacaaagatgaaagacgtgcagacatctacacccgcggaacaggacctggagatggcctcagaaggcgagcagaaaaggctcgaggaatacgagaataaccagccccaggtcaaaaatcagatccattcacgggacgacctagatgacatcatccagagttcccagaccgtctcggaggacggggacagtctgtgttgcaattgcaaaaacgttatattgctgatcgatcagcatgaaatgaaatgcaaggattgcgtccacctgcttaagatcaagaataccttctgtctgtggaaacgcttgatcaaactcaaagacaatcactgtgagcaacttagggtgaaaatccggaaactgaagaataaagcctccgtgttacagaaaaggatttctgagaaggaggaaataaagtcccagctgaagcatgagattttggagttagagaaggagctatgttcactgcgattcgccatacaacaggaaaaaaagaagcggaggaacgttgaagaggtgcaccagaaggttcgggaaaagctccggatcaccgaagaacaataccgtattgaggccgatgtgactaaaccaattaaaccagctttgaaaagtgctgaagtggaactgaaaactggcggtaataatagtaatcaagtgtcggaaacagatgaaaaggaagatctgttgcacgaaaaccgacttatgcaggacgaaatcgcacgcttaaggctggagaaggatacaatcaaaaaccagaatcttgagaagaagtaccttaaagatttcgaaatagtgaagagaaaacacgaggacttacagaaggccctgaagcgaaacggcgagacactggcaaagacaattgcttgctattccggccagctcgcggcgctcactgatgagaacaccaccctgcgctccaaactcgagaaacagagagagagccgccagcgtctcgaaaccgaaatgcaatcttatcactgtaggctgaacgcggctcgctgcgatcacgaccaatcacactctagtaaacgcgatcaggaactcgcattccaggggaccgtagacaaatgcagacacctccaggagaacctgaatagccacgtgcttatcctctccctacagctttccaaagccgaatctaagtcccgcgtcctaaagacggagttgcactacactggtgaagctttaaaggaaaaggccctagtatttgagcatgtacagtctgaattgaagcagaaacaaagtcagatgaaggatattgaaaaaatgtataagtccggctataatacgatggagaaatgcatcgaaaaacaagagagattttgccaactgaagaaacagaacatgctgttgcagcagcaactcgacgatgcgagaaacaaggccgataatcaagagaaggcaattctgaatatacaggcacgttgtgatgcacgggtgcagaatctacaggcagaatgcaggaagcaccgcttactgctggaggaggataacaaaatgctggtcaacgagctaaaccactctaaagagaaggaatgccagtacgagaaggaaaaagccgagcgggaagtggctgtgcgccagctgcagcagaagcgggacgatgtgctcaataaggggagcgcgacaaaagcattactagacgcttcctctaggcactgcacttacctggagaatggaatgcaggactctaggaagaagctcgaccagatgcgatcacagttccaggaaatccaggaccagctaacagccacaattcgctgcacgaaagaaatggaaggtgacactcagaaactagaagtggagcacgttatgatgcgcaaaatcatcaagaagcaggatgatcaaattgaaagattggagaagatccttcagcactcttctctcatgttgcaagtattcgagagctag

SEQ ID NO: 44255 - DNA, 930 bp, Artificial Sequence
  Description of Artificial Sequence: Synthetic coding sequence
atggaggacggcaagcgggagcggtggcccaccctgatggagcggctgtgcagcgacggctttgcgtttcctcagtaccctataaagccatatcaccttaagcggatccatcgggcggtgctccatggcaacttggaaaagctgaaatatctgctgctgacctattacgacgcaaacaaaagagaccgaaaggagagaaccgcccttcatcttgcctgtgctactggtcagccagagatggtgcacctgttagtgtctcggaggtgtgaactgaacctctgtgacagggaggatcgaactcctctgatcaaggccgtgcaattgcggcaggaagcttgcgcaaccttgctgttgcaaaacggggctaatcctaacatcacagacttcttcggccggacggctctccattacgctgtgtacaacgaagatacaagcatgattgagaagctgctctcccatggaaccaacatagaggaatgcagcaaatgtgaatatcagccgctgctgtttgccgtcagccgacgcaaggtgaagatggtcgagtttctgcttaaaaagaaggctaacgtaaatgcgatcgactatctgggcagaagcgcgctcatacatgccgtcacactaggcgaaaaagacatagtaattctgctgcttcagcacaatatcgatgttctttcgcgggatgcctttagaaagatcgctggcgattacgctatcgaggccaaaaatagagtaatctttgacttgatatacgagtacgaacgcaagaggtacgaggacctccctattaattctaaccctgtctcatcccagaagcaacccgcactggcaacagaacaggatagtatgagcaaaattaagaagcgaaagctcatcgtcatgaaaaagaaatcaatggtgattcagcggtttctcgtcaccttctgcaagtag

SEQ ID NO: 44256 - DNA, 5826 bp, Artificial Sequence
  Description of Artificial Sequence: Synthetic coding sequence
atggaggacggcaagcgggagcggtggcccaccctgatggagcggctctgctccgacggatttgctttccctcaatatcccatcaagccctaccacttaaaacgcatccaccgagctgtgctgcatgggaatctggaaaagctcaaatacctccttctcacgtactacgatgccaataaaagggaccgcaaggaacgcaccgccctgcaccttgcctgcgctacgggacagcctgaaatggtgcacttgctcgtgagtcggaggtgtgaattaaacctttgcgatcgagaggatcgtactccactgataaaagccgtgcagttgaggcaggaagcctgtgccacccttctacttcagaacggcgccaatccgaacatcacggatttctttggacgcacagctctgcattatgccgtgtacaatgaagacacaagcatgattgaaaaactgctctcgcatgggacaaacattgaggagtgcagcaagtgtgagtaccagccactgctgtttgccgttagcaggcggaaagttaaaatggtggagtttctgctgaaaaagaaagccaatgtgaatgccatcgattacctggggcggtctgcactgatccacgccgtgaccctgggcgagaaagatattgtgatcctcctgctccagcataatatagatgtattgagccgtgatgcattcagaaaaatcgccggcgattacgctattgaggctaaaaaccgggtaatttttgaccttatttacgaatatgagagaaagagatacgaggacttgcccatcaatagcaaccctgtatcttcccagaaacagccagccctcaaggccacatccgggaaagaagacagcatcagcaacattgccacagagatcaaggacggacagaaatccggtacggtgtccagccaaaaacagcctgccctcaaggatacctccgacaaggatgatagtgtctctaacacagcaactgaaataaaagatgaacagaaatctggaaccgtgttgccagctgtggaacagtgcttgaatcgttccctatatagaccagacgcggtcgcccaaccagtgaccgagaatgagttttccctcgaaagtgagataatctcaaagctgtatatccccaaacgcaagattatctccccgaggtctatcaaggatgtgctcccacctgtggaagaagcggtcgacaggtgcttgtacttgctggaccgatttgcccagcctgtaacaaaagacaagtttgcactcgagagtgagaacatcagcgagccctactttacaaaccgcagaaccatctcacagcagtctgctgaaaaccttgacgccgcctgtggtatagacaagaccgaaaatggaaatatgttcgaagaccagaacgtcgacaaggagggaaaggccttgcctgccaccggccagaaggctaacgtatcccctgagcagcctcccctgttcacccataccgtgaaagatcgcgaccacatctctaccagatttctggggggtatggactctttgactagcagcgaggagtcctcagagagaccacctttgtccaccctgacattgaaggaggctgacccatccagcaaggccgcaatgaggaggaaggatagtccaccaccaggcaaagtgagctcccagaaacaacctgctgagaaggccacgtcggacgataaggactcagtatcaaacatcgccactgagataaaagaaggccccattagcggcacagtttcgtcccagaaacaacccgcggaaaaagccactagtgatgagaaggactcagtcagcaacatcgctactgaaataaaaaagggtcaacagtccgggacagtgtcaccccagaaacaatcagcttggaaggtcatcttcaagaagaaggtgagcctgctcaatatcgctaccagaattatgggaggtggcaaaagcgggaccgtatcaagccagaaacagccggccagtaaggcaacttctgataaaacagattccgctctcaacatcgccacagaaattaaggatggactgcaatgtggaaccgtgtcctcacagaagcagccggcattgaaggcaaccactgatgaggaagattctgtcagcaacatcgcgactgaaatcaaggacggtgaaaaatcgggtaccgtgagttcacagaaacaaccagccctaaaagctactactgacgaggaggacagcgtttcaaacatcgcgacagagataaaagatggcgagaaatcgggtactgtatcttcgcagaagcagcctgctctaaaggctactaccgatgaaaaggactccgtcagcaatatcgcaaccgagatcaaggacggggagaaatcaggcacggtgagtagccaaaagcctccagctctgaccgccacgagtgatgaggagggaagtgttttaagcatcgcccgcgaaaataaagatggtgagaaaagccgcaccgtcagttcccgcaagaagccagcccttaaagccaccagcgatgagaaagatagctttagcaacattaccaggggcaaaaaagacggcgaaatttccagaaaagttagcagccagaagcccccgactttgaagggcacctccgatgaggaagactcagtgctcggtatcgctagggagaacaaagatggagagaagagcagaacagtctcgtctgaaaaaccacctgggctaaaggcttcctcagcggagaaagatagtgtcctgaatatagcccgcgggaagaaggacggagaaaaaactaagcgcgtttcttccaggaagaaacccagcctcgaggctacaagcgatgaaaaggatagcttttccaatatcacaagagaaaagaaggatggcgagatctcgcgcaaagtgtcttcccagaagccaccagctctgaaagggacgagcgacgaggaagactccgtccttgggatagcgcgcgagaacaaggacggagagaaatctcgcacagtgtcttccgagaagccaccaggacttaaggctacaagcgacgagaaggactcagttttgaacattgccaggggcaaaaaagatggcgagaagactcggactgtatcatcacagaagccaccaacactgaaggccactagtgatgaggaagatagcgtgctctccattgctcgggagaacaaggatggggagaaatctcgcaccgtgagcagtgaaaagcctagcggcctgaaggcaacttccgcagagaaagattctgtgcttaacatcgcccgcggaaaaaaatacggcgaaaaaacaaaacgggtcagctctcggaaaaagcctgctctcaaagcgactagcgatgagaaggactcggttctgtatattgctcgcgaaaagaaggatggggagaaatctaggaccgtttctagtccaaaacaacctgctcttaaggctatatgcgacaaggaggatagcgtccctaatatggctaccgaaaagaaggatgaacagattagtgggacggtaagctgccagaagcagccggctctgaaagccacaagcgacaaaaaagattccgtctctaacatcccgactgaaataaaggacggccagcagagcggaactgtgtctagccagaaacagcccgcctggaaggccacaagcgtgaagaaagattctgtctccaacatagcaactgagatcaaggatggccagattcggggcaccggtatcctggaatatactttcaatgtaatgttcgatcagatagaggagaaatttacttctttgaacaaatccgccggggtctcgccgcagaaacagagtgctcagaaggtgatttttaagaagaaggtgtcccttctgaatattgccaccagaatcactggtgggtggaagtccgggaccgagtaccccgaaaacctgccgacgcttaaggctacaatcgagaataaaaactccgtgctgaacaccgccaccaagatgaaagatgtccaaactagcaccccagccgagcaggatctggagatggcctccgagggcgagcagaaacgcctagaagagtatgagaataaccagccccaggttaaaaatcagatccattcacgggatgaccttgatgacataattcagagcagtcagacagtgtctgaggatggagactctctgtgttgcaattgtaaaaacgtgatcctcctgattgatcagcacgagatgaaatgcaaagactgtgttcacctgcttaaaatcaaaaacacgttctgcttatggaagcggcttattaagctgaaggataaccactgcgagcagctgagggttaagatccgtaaactgaaaaacaaggcctccgtgcttcagaagcgcattagcgaaaaagaggagattaaaagtcagctcaaacatgaaattctcgaactggagaaggagttgtgttcactcagatttgctatacagcaggagaaaaagaaacgccggaacgtcgaagaggtgcaccagaaagttagggagaaattgcgcatcactgaggagcagtacagaattgaggcagacgtgaccaagcctatcaaaccggccttgaaaagcgctgaagtagagttgaaaactggagggaataattccaatcaagtgtcagaaacagatgagaaggaagacttactgcatgagaaccgtctgatgcaggatgaaatagctaggcttcgcctggaaaaggatacaatcaaaaatcagaatctcgaaaaaaagtacctgaaagattttgaaattgtgaaaaggaagcatgaggacctccagaaagccctgaaaagaaacggcgagacactggccaagacaatcgcttgctacagcggccagctcgctgcactgactgatgagaacacgaccctccgcagcaagctggagaaacagcgggaatcaaggcaacggttagagaccgaaatgcagtcttaccattgtagattaaacgcggcacggtgcgatcacgatcaaagccacagcagcaagcgtgaccaagaactcgcctttcagggaactgttgataagtgccggcatctgcaggagaacctgaactcccatgtactaattctgtctttgcagctgtcaaaagctgagtcaaagagcagggtgttaaagacagagctgcactacaccggagaagctctcaaggaaaaggcgctggtttttgagcacgttcaatccgagctgaaacagaaacaaagccaaatgaaggatattgagaagatgtacaagtccggctataacactatggagaaatgcattgaaaaacaggaacgcttctgtcagttgaagaaacagaatatgctgttacaacagcaactggacgacgctagaaacaaggccgacaatcaggagaaggccatcctaaatatacaggctcgatgtgatgcacgagtgcagaacctgcaggccgaatgtcgcaagcatcgattactgttagaggaggacaacaagatgctcgttaacgagctaaaccattctaaggagaaggaatgtcagtacgaaaaggagaaggctgaaagagaagtggctgtgcgccagctgcagcagaagagagatgatgttctcaataaaggcagcgcaactaaggccctgttggatgcttcctctcgccattgtacctacctggagaatggaatgcaggattcaaggaagaagcttgatcagatgcgctctcagtttcaggaaatccaggaccaactcacggctacaattagatgcacgaaggagatggaaggggatacacagaaactggaagttgagcatgtgatgatgcgaaagataattaaaaaacaggacgatcagatagagaggcttgaaaagatcctccagcactcgtccctcatgctgcaggttttcgaaagctag

SEQ ID NO: 44257 - DNA, 3627 bp, Artificial Sequence
  Description of Artificial Sequence: Synthetic coding sequence
atgggcggcggcaagagcggcaccgtgagcagccagaagcagcccgccagcaaagctacttccgacaagacagacagtgccttaaacatcgcaacagagattaaagacggactccagtgcggcaccgtcagtagccaaaagcaacccgccttgaaggctactaccgacgaagaagattctgtatccaacatcgctacggagatcaaggacggcgaaaagtctggcacagtgtcctcgcagaaacaacccgctctcaaagccacaacagacgaagaggatagcgtctcaaacattgcaacagagataaaggacggcgaaaagagtggcacggtgtcctcccaaaaacagcctgccttgaaagcaaccacagacgagaaggactccgtatccaatattgctactgaaatcaaagacggagagaagagcggaacagtgtcctcccagaaacccccagcactcaccgcaacctcagatgaggagggatcagtgctttcaattgccagagagaataaggacggagagaagagcagaacagtgtcttcaagaaagaaacctgcattgaaggctacttctgacgagaaagactctttctccaacatcacccggggcaaaaaggacggggagattagccgaaaggtctcaagccaaaagcctccaaccctaaaagggaccagcgacgaagaggactccgttctgggcattgcgagggagaacaaggacggagagaagtctcgcacagtctcatccgaaaaaccccctgggctgaaagccagttccgccgagaaagattccgttctgaatatcgcccgcggtaagaaggacggcgaaaaaacgaaacgggtctcgtccagaaagaagccttcccttgaagcaacatccgacgaaaaggacagcttctcgaatataacacgggaaaaaaaggatggagagataagccggaaagtctcctcccagaaacccccggcgctcaaaggcacctcagatgaggaggatagtgtgttagggattgctcgagaaaacaaggacggcgagaaaagtcggaccgtgtcatccgagaaaccgcccgggctcaaggccacctccgatgaaaaggatagcgtgttaaacattgcccgaggaaaaaaagacggtgagaagacaaggaccgtctctagcccaaaacagccggccctgaaggctatttgcgataaggaagacagcgtgcctaacatggcaacggaaaagaaggatgaacagatatcagggacggtctcttgccaaaagcaacccgctctcaaggcaacatccgacaaaaaggactccgtaagtaacatacccactgaaatcaaggacggacagcagtccggcaccgtcagcagccaaaaacagcccgcctggaaagccacaagtgtgaagaaggactccgtctccaacatcgcaacagagattaaagatggtcagatcaggggcactgtgagcccccaagtgcctataccgaggcataaagtgggaaatattaaatcctatccaaacactggccgccgcatccagctcgatgccaatacatttagcgtctccccgcagaaacagtctgcgcaaaaggtgatcttcaaaaagaaggtgagcctgctcaacattgccaccagaatcactggaggatggaaaagcggcactgagtaccccgagaatctgcccaccttgaaagctacaattgagaataaaaattcagtgttgaatacagctactaaaatgaaggatgttcagacttccacccccgctgagcaggatctggagatggcgtcagagggagaacagaaaagacttgaggagtacgaaaacaaccagccccaggtcaaaaatcaaattcactccagagatgatctggacgacattatccaatcttcccagacagtcagtgaggacggcgactctctatgttgcaactgtaaaaacgttattctgttaatcgaccaacatgagatgaaatgcaaagactgcgtgcatctgttaaaaataaagaacaccttttgcctctggaagagattgatcaagttgaaagacaatcactgcgagcaattacgggttaaaatccgtaaactcaagaataaagccagtgttctgcagaaaagaattagcgaaaaagaggaaattaagtcacagctaaagcacgagatcctcgaattggagaaagagctttgctccctccgatttgctatccaacaggagaagaaaaaaagacgaaacgtggaagaggttcaccagaaggtgagggagaagctgagaatcactgaagagcaataccggattgaggctgatgtcactaagccaattaagccggccttgaaatcagctgaggtcgaattgaagaccggaggaaataacagtaatcaggtgtccgaaaccgatgaaaaggaggacttgcttcacgaaaatagactgatgcaggatgaaattgcgcgcctccggctcgagaaagacacaataaagaatcagaatttggaaaaaaagtatctgaaagatttcgaaatcgtgaaacgcaagcatgaggacctccagaaagcactgaaaaggaacggcgagaccctggccaagactattgcctgttactccggacaactagctgcacttaccgacgagaataccacactgagatccaagctcgaaaaacagagggaaagccgccagcgcttggaaaccgaaatgcagtcataccactgtcgtcttaatgcagctaggtgcgaccatgatcaaagccattccagcaagagagaccaagagctagcctttcagggaaccgttgacaaatgccgccatcttcaggagaatctgaatagccacgtgctgatattgtccctacagctatccaaggcagaatcaaaaagtcgcgtcctcaaaaccgaactccattacaccggtgaagccttgaaggagaaagcactggtgtttgagcatgtgcagtcggagttaaaacagaagcagtctcagatgaaggacatcgagaagatgtataagagtggttataacaccatggaaaagtgcatcgaaaaacaggagcggttttgccagcttaaaaaacaaaatatgcttttacagcaacaactggacgacgcacgcaacaaagccgacaaccaggaaaaggcaattctcaacatccaagcacgctgtgatgcccgcgtccagaaccttcaggccgagtgccggaaacacagactactgctcgaggaagacaataagatgttggtgaatgaactgaatcatagtaaggaaaaggagtgtcaatatgaaaaagaaaaggccgagagagaggtcgcggtaaggcagcttcagcagaagagggatgatgtgcttaataagggaagtgcaaccaaagcacttctggacgccagttcccgccattgcacttacctggagaacggcatgcaggattctcggaaaaagctggaccagatgcgatctcagtttcaggaaatacaagaccagctcaccgctactataagatgtacaaaggagatggaaggggacacccagaaactggaggtggagcacgtgatgatgcgaaagatcattaaaaagcaagacgatcaaatcgaaagacttgagaaaatcctgcaacatagctcactgttgctcctgaacttcgagacctag

SEQ ID NO: 44258 - DNA, 1821 bp, Artificial Sequence
  Description of Artificial Sequence: Synthetic coding sequence
agcagccggaagaagcccgccctgaaggccaccagcgacgagaaggatagcttctccaacatcaccagggagaagaaagacggggaaactagccggacggtaagttcacaaaagcctcccgcacttaaagcaacatctgacgaggaagattcagtgctctcaatcgcacgagaggagaaggatggcgagaagtctcgaacagtttcttccgagcagcctccaggactgaaggcaacgagggatgagaaggattctctgctgaatatcgcccgggtcatccaagccggaggtcagtccttttcagtttcctctagaaagaaagccgctcttaaggccaccagtgacgagaaagattcattttctaacatcacccgggagcgtaaggatggagagacttctagaacggtctcttcccaaaagcctcccgccttaaaggcaacctcagacgaggaagacagtgttcttaacatagcgcgagagaagaaagatggagagaagagcaggaccgtaagttcccggaaaaaggcagccctaaaggcaacttccgatgagaaagatagcttctcgaatattacaagggaacgcaaagacggtgaaactagccgcacggtctcaagccagaagccacctgccttaaaagctactagtgatgaggaggacagtgtcttgaacatcgcccgtgagaagaaggatggagagaaatcccgtactgtgtcaagcgagcagcctcctgggctgaaggctacaagggacgaaaaggatagtttacttaacattgcaaggggcaagaagcacggggagaaaacaaggcgggtctcatcaagaaaaaaagcagctctcaaagctacttctgatgagaaagattctttctcaaacatcactagagagcgcaaagacggtgagacatctcgtactgtcagcagccagaaacctcccgccctgaaggctaccggtgatgaggaggacagtgttttaaatatcgccagggaaaagaaggacggcgaaaaatcgagaacagttagcagcgaaaaacccagcggtcttaaggccacctccgatgaaaaagatagcgtgctaaatattgctagggggaaaaagcatggagagaaaacacggagggtgagctcacataaacaaccagcccttaaggcgacttccgataaagagaatagtgtccccaatatggccaccgaaaccaaggatgaacagatcagcggcaccgtcagctctcagaaacagccagccctgaaggccacgtccgataaaaaagactcggtctccaacatccccaccgagatcaaagacgggcagcagtccggtactgtgtcctcacaaaagcagctggcttggaaagcaacaagcgtgaaaaaggattccgtatctaacatcgccacagagattaaagacggccagattcggggcactgtgtcttcccagcgacagccagctctcaaagctacaggagacgaaaaggacagcgtctccaacatagcaagggagatcaaagatggggagaaaagcggcactgtatccccacagaagcagtctgcccagaaggtgatctttaaaaaaaaggtgtctctgctaaacatcgcaactaggattacgggtggatggaagtccgggaccgagtaccccgagaatctacccactctgaaggctacaattgaaaacaagaattccgtattgaacacggccactaagatgaaggatgtgcaaacctcaacgccagaacaggacttagaaatggccagcgaaggcgagcaaaagcgtctggaagaatatgagaataaccagcctcaggtgtacttcagcttctag

SEQ ID NO: 44259 - DNA, 2400 bp, Artificial Sequence
  Description of Artificial Sequence: Synthetic coding sequence
atggccaccgagaccaaggacgagcagatcagcggcaccgtgagctcacagaaacagcctgcgctgaaagctacatcagataagaaggatagcgtgtcaaatataccgactgagatcaaagacggacagcagagtggtaccgtgtcatctcagaaacagttggcttggaaggcaactagtgttaagaaagattctgtgtctaacatcgcgacagaaatcaaagatgggcagattagaggcacagtgtcgtcccagcgacagcccgcactgaaggcgaccggggacgaaaaggatagtgtgagtaacattgcaagggagatcaaagatggggagaaatcagggaccgttagcccacagaaacagtctgcacaaaaagttattttcaagaaaaaagtcagtctgctaaacatcgccaccagaattactggcggctggaagtccgggacggagtacccagagaacctgcccacactgaaagcaacaattgagaataagaatagtgtccttaataccgccaccaagatgaaggatgttcagacctccacccctgagcaggacctagaaatggcaagcgagggagagcagaagaggctggaagagtatgagaacaaccagccccaggtgaagaaccagatccactcacgggatgaccttgacgatatcattcaatcaagccagactgtgagcgaggatggagactcactctgttgtaactgcaagaacgtgatcctgcttattgatcagcacgaaatgaagtgtaaagactgtgtgcacctgctcaagataaagaagaccttctgtctctgcaagcgactcacagaactgaaagataatcactgtgagcaacttcgggtgaagatacgcaagctgaaaaacaaggcgtccgtgttacagaagaggctgtccgagaaagaggagattaagtcccaactaaagcatgagaccctggagctcgaaaaagaactgtgcagcctaagattcgctatacaacaggaaaaaaaaaagagacgcaatgtggaggagctgcatcaaaaggtgcgagagaagttgaggatcacagaggagcagtacaggattgaggccgacgttaccaagccaattaaaccagctcttaagtcagccgaagtggagcttaagacgggcggtaacaactctaatcaggtcagcgagaccgatgagaaagaggacttactccacgaaaaccggctgatgcaggacgaaatcgctcgattacgcttggaaaaagatacaatcaagaatcagaacctagaaaaaaagtatctgaaggacttcgagatagtaaaacgaaaacacgaggacctccagaaagctctcaaacgaaatgaggagaccctggcggagactatagcgtgttattcgggccagttggccgcgcttaccgacgaaaacactactttgcgaagcaaactggaaaaacagcgggagtctggccagagattggagaccgagatgcaatcctatcgatgccggctcaatgccgcactctgtgatcatgaccagagtcactcctccaagcgggatcaggagctcgccttccaaggtacagtcgataagtgctgccatttacaggagaatctgaactcacacgttctcatcctctccctgcaactcagcaaagctgagtcaaagtttcgggtattggaaacggaactgcattacactggcgaggcactcaaggagaaggcgctggtcttcgagcacgtgcagtcagagctgaaacagaaacagagtcagatgaaagacatcgagaagatgtacaaaagtgggtataacacgatggagaagtgcatcgaaaagcaagagcggttctgccagcttaaaaagcaaaacatgcttctgcagcaacagcttgacgatgctcggaataaggcagacaaccaagaaaaggcgatattaaacatccaagctcggtgcgatgccagagtggagaacctccaggcggagtgccgaaaacaccgcctgctgctagaggaggacaataaaatgctcgtgaacgaacttaaccattccaaagagaagaaatgtcagtacgagaaggagaaggcggagcgcgaggttgccgtccgccagcttcagcagaaacaagatgatgtccttaacaagaggagtgccactaaggcccttctggatgcttctagccggcactgtatttacctggaaaatggaatgcaggattcccggaaaaaattagatcaaatgcgctcccagtttcaggagattcaggatcagctgactgccactataagatgtactaaggagatggagggtgatgcccaaaagttagaagttgagaacgtgatgatgcggaaaatcattaaaaaacaagatgaacaaatcgaaagattcgagaaaatccttcagcacagctcgctggtatag

SEQ ID NO: 44260 - DNA, 3090 bp, Artificial Sequence
  Description of Artificial Sequence: Synthetic coding sequence
agcagccggaagaaggccgccctgaaggccaccagcgacgagaaggacagcttttctaacatcacacgggagcgaaaagacggggagacaagtcggaccgtttcgagtcagaaaccgcccgccttgaaggccactagtgatgaagaggacagtgttttaaacatcgcgagagagaagaaggatggtgaaaagtcccgcactgtgtcctctgagcagccgcctggactgaaggcaactcgggacgagaaagattcgctactgaatatcgccagagggaagaagcacggcgaaaagactcggcgagtctcttctcgtaaaaaagccgccctaaaggcgacgagcgacgaaaaggatagtttttcgaatatcacacgggaacgaaaagatggcgagaccagtaggactgtttcaagccagaagccacccgcacttaaggccacaggggacgaggaggattcagtgttgaatatagcaagagaaaagaaagacggcgagaagagtagaaccgtaagcagcgaaaaaccttctgggctgaaggcgactagcgacgagaaagactctgtcctgaacatcgcccgtgggaaaaagcacggggagaagacaaggcgggtatcaagtcataagcagccagcactgaaagccacgtctgacaaggagaactcagtacccaatatggcaacggagaccaaagatgaacagatatccgggaccgtttcttcacagaagcagcccgccctgaaggctacttcagacaagaaggatagtgtatcgaatatccccaccgaaatcaaggacggtcaacagtccggaactgtgtcgtcacaaaagcaactcgcttggaaagccactagtgtcaagaaagacagtgtgtctaatattgctacggagatcaaggacgggcaaatcaggggcaccgtgtctagtcagaggcaaccagccttaaaagccacgggggatgaaaaggactctgtttcaaacatcgctcgggaaataaaggacggagagaagtcaggtacagtgtctccgcagaaacagtccgcccagaaagtcatttttaaaaagaaggtctccttgctgaatatcgctacccgcattactggaggctggaagtctgggacggagtacccagaaaatctgcccacacttaaggctacgatcgagaacaagaactccgtgctgaataccgcaacaaagatgaaggacgtccagacttccacgcccgaacaggacttggaaatggccagcgagggagaacagaagcggttagaggagtacgaaaataaccaaccacaggttaagaatcaaattcatagcagagacgaccttgatgatatcatccaatcgagccagaccgttagcgaggacggagacagcctctgctgcaattgcaaaaatgtaattctgctgatagatcagcacgagatgaagtgtaaagattgcgtgcaccttctaaaaatcaagaagacattctgcctgtgtaaaagattaacagaactcaaggataaccactgtgagcagctgagggtgaagattagaaaactgaagaataaagcctctgttctccagaaacgcctgagcgagaaagaagagataaagtctcagctgaagcacgaaacactggaactcgaaaaggaattgtgttccttaaggtttgcaatacaacaggagaaaaaaaaaagacggaacgttgaggagctccaccagaaagtgcgagagaagttgaggatcacagaagagcagtatcggattgaagccgacgtgaccaaaccaatcaaacccgccctgaagtcagccgaagtggagctaaagacaggtggtaataattcaaatcaagtgtctgaaaccgatgaaaaggaagacctcctgcacgaaaaccgccttatgcaagacgagatagcacggcttaggcttgaaaaagacacgatcaagaaccaaaacctcgagaagaaatacctgaaggactttgaaattgtcaaaaggaagcatgaggacctgcagaaggccttaaagcgcaacgaggaaacactagcagagaccattgcctgctattccggtcagctggccgcgctcactgatgagaataccacactccggtctaagctggaaaagcagcgagagtctgggcagagactcgagactgaaatgcagagctaccgttgccgtcttaatgctgccctttgcgaccatgatcagtcacacagctccaagagggaccaggagcttgcttttcagggcacagtggacaaatgttgtcacctgcaggagaacctgaactctcacgttcttattctgagccttcagcttagtaaggcggagtctaaattccgtgtgctggagaccgaactgcattacacaggcgaagctctgaaggagaaggccctggtgtttgaacatgtccagtccgagttgaaacaaaagcagtctcagatgaaagacatagaaaagatgtataaatccggatacaataccatggaaaagtgcattgaaaaacaggagaggttttgccagctgaaaaagcagaatatgctactacaacagcagttggacgatgcaaggaataaggcggacaatcaagagaaggccattctgaatatacaggcaaggtgtgatgcgcgggtggagaatctccaggcagaatgccgcaagcatcgactgctgctggaggaagataacaagatgctggtaaatgagctcaaccacagcaaggagaaaaagtgccagtatgaaaaggagaaggccgaaagggaggtggccgtgagacagttgcaacagaagcaggatgatgtgcttaacaagcgcagcgctacaaaggctttgctggacgcttcatcacgtcactgtatctacctggagaacggcatgcaagacagcagaaaaaagctggaccagatgcgcagtcagtttcaggaaatccaggatcagctgacagccacgatacgctgtactaaggagatggaaggtgatgcgcagaaacttgaggtggagaacgtaatgatgcgcaaaatcattaaaaaacaggatgagcagattgagcggttcgagaaaatcctgcaacactccagtctggttagcattatctttgaaacgtag

SEQ ID NO: 44261 - DNA, 5337 bp, Artificial Sequence
  Description of Artificial Sequence: Synthetic coding sequence
atggacgacaaggagcccaagcggtggcccaccctgcgggaccggctttgctcagacggctttctgtttcctcagtaccctataaaaccttatcacctgaaaggaattcatcgggccgtcttttatcgcgacctggaagaactaaaatttgttctgttgacacggtatgatatcaataagcgggacaggaaagaacgaactgcgcttcacctcgcttgcgccaccggtcaacctgaaatggtgcacctgctggtgtcccggcgctgtgagctcaatctctgtgatcgagaagatcggacccctctcatcaaagcagttcagctcaggcaagaggcgtgtgctacgctccttctccaaaatggcgcggaccccaatatcactgatgtgtttggaaggactgctctgcactatgcggtgtacaatgaagacacatctatgattgaaaaactgctgagttacggcgccaacatcgaggagtgctccgaggacgagtatccacccctgtttctggcagtttctcagcgtaaggtaaagatggtcgagtttcttttaaagaagaaagcaaatatcaatgccgtggactacctaggcaggtcggcactgattcacgctgtaaccctaggcgaaaaggacatagtcattctgcttttacagcataacatcgatgtgtttagcagagacgtttacggcaagctcgcagaggactacgcgtctgaggcaaagaatcgggtgatcttcgagctgatttacgaatacgagaggaagaaacacgaagaactatctataaattccaatcctgtctcaagtcaaaaacagccagccctgaaggccacctcaggtaaggaagacagtatatctaacatcgcgacagagattaaggacggacagaaaagcgggaccgtctcctcccaaaaacagccggccctgaaaggcacaagcgataaaaatgatagcgtttcgaatacagccacggagataaaggatgagcaaaagtccggcacagtgagctcacagaaacagcctgcgttaaaagacaccagtgacaaaaatgactcagtcagtaatacggctaccgaaatcaaggacgagcagaaaagtggcacagtcttgcctgctgtagaacagtgtctcaacaggtctctttataggccagacgcagtagcccagcctgtgactgaagacgagtttgcccttgagtccgagatcatcagtaaactgtacattcccaagagaaagattatctccccccggtcaatcgaagacgtgctcccaccagttgaggaggccgtcgacaggtgcttgtaccttctggacagatttgcccaggcagtaactaaagataaatttgcccttgagtccgaaaacatcagcgagccatattttactaacaggcgcactatcagccagcaaagtgccgaaaagctggacgcagcctgtgggattgataagactgaaaatggcactctctttgaagaccagaatgtagacaaggaaggtaaagctctgccagctacgggacagaaagccaacgtttcaccggaacagcctccactgtttacacacacagttaaagacagtgatcatatctcaacacgctttctggggtctatggattcattgacatcaagcgaggaatccagtgaaaggccaccactcagcactctgacattaaaagaagctgaccccagcagtaaagccgctatgaggcggaaagacagcccaccccccggaaaggtaagtagtcaaaagcagccagcagaaaaagcaaccagcgatgataaggactccgtgagcaatatcgccactgaaattaaagagggaccaatatccggcacagtatcttcacagaagcaacccgcagagaaggcaactagtgacgaaaaggattccgtgagtaatatcgccacagagatcaaggaaggacagcaatctggaacagtgagcccacagaaacagagcgcgtggaaggtaattttcaagaagaaggtctccctgctgaatatcgccacacgaattacgggcggcggcaaatctgggaccgtatccagccaaaaacagccaccctcgaaggcaacgagcgataagacggacagtgcattaaacattgccacagaaatcaaggatggactgcaatgcggcactgtgtcatcacagaaacagcccgcactgaaagccacaacagacgaagaagactctgttagcaacattgctacagaaattaaagacggggagaagtccggaaccgtgagctctcagaagcagccagcactgaaggcaactaccgatgaagaggattctgtgtctataatcgctaccgaaattaaggacggagagaagagcggcacagtctccagccgcaagaagcccgcattgaaagctactagcgatgagaaagatagcttctccaacatcacacgagagaagaaggacggcgaaatctcaaggacagtaactagcgagaagccagctgggctgaaggctaccagcgatgaggaggactcggtgctgaatatcgcccgagggaaggaggatggagaaaaaacaagacgggtgtcctccagaaagaaaccggcacttaaggccaccagcgacgagaaagacagtttctctaatatcacacgggaaaagaaagacggtgagacaagtcggacggtctccagccagaaaccacccgctctgaaggctacctcagatgaggaagactccgtattaaacatagcaagagagaagaaggatggcgagaagagccggacagtaagctcagagaaacctagtggtctgaaggcaacctctgacgagaaggatagcgtgctgaatattgcccgcgggaaaaaacacggggagaagacccggagggtcagctcccataagcagcctgctctaaaggcaacttcggataaggaaaacagtgttccaaatatggctacagagactaaggatgaacagatctccggtacagtctcctctcagaagcagcccgccctgaaggcgacttccgacaagaaggacagtgtatcaaatatcccaactgagatcaaagatgggcagcaaagcggcacagtgtcctctcagaaacaactagcgtggaaggccactagcgtcaagaaggatagcgtctctaatatagccacggagattaaggatggtcagattagaggcactgtctccagtcagagacagcccgccctcaaagccacaggtgatgaaaaagactcagtatccaacatcgcccgggaaataaaggacggagaaaagagtggcaccgtctccccccagaaacagtccgcccagaaagtcatcttcaagaagaaggtcagcctgctgaacattgcaactaggatcacaggaggctggaagtccggaaccgaatacccagaaaacctgccgactctgaaggctaccatcgaaaataagaattctgttctcaacacagcaaccaagatgaaagacgtccagacctcaaccccggaacaggaccttgagatggctagtgagggcgaacagaaacgactggaagagtacgaaaacaaccagcctcaggtgaagaatcagatccacagccgggatgacctagatgatattatccagagcagtcagaccgtcagcgaggacggggactctctgtgttgcaactgcaagaacgttattctactgatcgatcagcatgaaatgaagtgcaaggactgcgttcatctgctgaaaatcaagaagacattttgtctctgcaagcgattgactgagctcaaggacaatcattgcgaacagctgagagtcaagatccggaagctgaagaacaaggcgagcgtactgcagaagcgcctctcagagaaagaagagatcaaatcccagctgaaacacgagaccctggagctggagaaagagctgtgctcactgagattcgccatccagcaggagaagaagaagcggcgtaatgtggaagaattgcaccagaaggtgcgcgagaagctgaggataactgaggagcagtaccggatcgaggccgacgttacaaaacctattaagcccgccctgaagtctgctgaggtggaattgaaaacaggggggaacaatagcaatcaggtgtctgagacagacgagaaggaggatcttctgcacgagaataggcttatgcaagacgaaatcgcccgcctgcgactcgagaaggacaccattaagaaccaaaaccttgaaaagaagtatcttaaggattttgaaatcgtcaagcggaagcacgaggacttgcagaaggcgctcaaaaggaacgaggagactttggctgaaacgattgcttgctactctggtcagctggcagcactaacagacgagaacacaacactgaggagcaagttggaaaagcagcgggaaagcgggcagcggctggaaaccgaaatgcaaagctatcggtgcagactgaatgctgccttgtgcgatcatgatcagagccacagcagcaaacgtgaccaggaattggcatttcaaggcaccgtggacaaatgttgccacctccaggagaacctcaactcccatgtactcatcctcagcttgcagctgtccaaggccgagtccaagtttagggtgctggagactgagctccactataccggtgaagcgctaaaggaaaaggcgctggtatttgaacacgttcaaagcgaactgaaacaaaagcagtcccagatgaaagatatagagaaaatgtataagagcggttacaatacaatggagaaatgcatcgaaaagcaggagagattctgtcagttaaagaaacaaaatatgcttctgcagcagcaactcgacgacgctcggaataaggctgacaaccaagagaaagcaatcttaaatattcaagctaggtgcgatgcacgtgtcgagaatctccaggccgagtgtaggaagcaccgactgctactggaagaggataataagatgctagtcaacgagcttaatcacagcaaggagaaaaagtgccagtacgaaaaagaaaaggctgaaagagaggtcgctgttaggcagcttcagcagaaacaggatgacgtgctgaacaaacgctctgcgacaaaagcactgctggacgcatcctcccgccattgcatttatcttgaaaacgggatgcaggactcacgcaagaaattggatcagatgaggagtcagttccaggagatccaggaccaactgactgccaccatcaggtgcaccaaggagatggagggggacgcccaaaaattagaagtcgagaatgtaatgatgaggaagatcatcaaaaaacaggacgagcaaattgaacggttcgagaagattctccagcactcttcacttatgctgcaggtgttcgagtcttag

SEQ ID NO: 44262 - DNA, 552 bp, Artificial Sequence
  Description of Artificial Sequence: Synthetic coding sequence
atggccaccccccggccctgcgccgacggcccctgctgcagccacccttccgcagtcctgggcgtgcagcagactctggaggagatggactttgaaagaggcatttggtccgctgccttgaacggggaccttgggagggtgaaacacctcatccagaaggccgaagaccccagtcagcccgactcagcaggctataccgctttgcactatgcgtctaggaatggacactatgccgtgtgtcagtttctgttggaaagcggcgctaaatgtgacgcacagacgcacggaggggccacggccttacatcgtgcttcatattgcggccacacagagatcgcaagacttttgctctcccatggaagcaaccctcgagttgtcgacgacgacggaatgacatctctgcacaaggcagctgaacgcgggcatggcgatatctgttccttgttgctgcagcactcgccggcccttaaggctatccgggatagaaaggctaggcttgcatgcgacctcttgccttgcaactcagacctgcgagacctgctgagcagctag

SEQ ID NO: 44263 - DNA, 1107 bp, Artificial Sequence
  Description of Artificial Sequence: Synthetic coding sequence
atgaacgccctgctggagcagaaggagcagcaggagcggctgcgggaggccgcggctttgggagacatacgggaagtgcaaaagctcgtggaaagcggggtggatgtcaactcccagaacgaagtgaacggctggacatgccttcattgggcatgcaagcggaaccacgggcaggtggtgtcctacctcctcaagtctggcgctgataaagagatcctgactaccaaaggcgaaatgcccgtgcagctcacttctcgacgcgaaatccgtaagattatgggggtggaggaggaggatgatgacgacgacgacgatgacaatcttccccagctgaaaaaagagtctgagctgcccttcgttcccaactacctagcgaatccggccttcccatttatctacacccccacggctgaggattcggctcagatgcaaaacggaggcccaagtaccccacccgcctctcctcctgcagacggctcacccccactgctgcctcccggagagcctccgttactggggactttcccacgcgaccacacaagtcttgcactcgttcagaacggagatgtttccgcgccttctgccattctaagaaccccggaaagtacaaaaccgggtcctgtctgtcagccaccggtctcccagtcaaggagcctgttttccagcgtgcccagcaagcctcctatgtctctggaaccacaaaacgggacatatgcaggaccggcccccgcatttcaaccattttttttcaccggagcattcccgttcaacatgcaggaactcgtacttaaggtccgcattcaaaacccatcactccgcgagaacgactttatagagatagagctggaccggcaagagttaacctaccaggagttactgagggtgtgctgctgcgagctgggggttaacccggatcaggtggagaagataaggaaattgcccaatacccttctccggaaggataaagacgtcgcgcgactacaggactttcaggaactcgaactcgtgctgatgatttccgaaaacaactttctcttcaggaatgctgcaagcactctgaccgagcgtccctgttacaaccggagggcaagtaagctaacctactag

SEQ ID NO: 44264 - DNA, 777 bp, Artificial Sequence
  Description of Artificial Sequence: Synthetic coding sequence
ggcgagaccctggccttccccggccacgtggccgccttcaagggcgatctcgggatgctgaaaaaactggtagaagatggggtgatcaacatcaatgaaagagctgacaacggttcaacccccatgcataaagctgccggtcaagggcatatcgagtgcttgcagtggctgatcaaaatgggagctgacagcaacataacaaacaaagctggagaacggcccagtgatgttgcaaagcggtttgcccacttggctgctgttaaactgctggaggaacttcagaagtacgatatcgatgacgagaatgagatagatgagaatgatgtgaagtattttattcgccatggcgtggaaggtagtaccgatgccaaggatgacctatgtctgtcagacctggataagacagacgcccgtatgagggcctataaaaagatcgtagaactgaggcatctgcttgagatagccgaatcaaattacaagcatcttggtgggatcacagaagaagacctaaaacagaagaaggaacagctcgaatcagagaaaaccattaaggagctgcagggtcagctggaatacgagagactgagaagggaaaagctggagtgtcaattggatgaatatcgggccgaagtggaccagttgcgggagacattagagaaaatccaggtcccaaacttcgtcgcaatggaggacagcgccagctgtgaatcaaacaaggaaaagagaagggtgaagaagaaggttagctccggcggtgtgttcgttcgccgctattag

SEQ ID NO: 44265 - DNA, 597 bp, Artificial Sequence
  Description of Artificial Sequence: Synthetic coding sequence
atgcccggcgtggccaacagcggccccagcaccagcagccgggagacagccaacccctgttcgcgcaagaaggttcacttcgggtctattcatgatgcagtgcgggctggtgatgtgaaacagttgagtgaaattgttgtaagaggcgcaagcattaatgagttagatgtcctgcacaaattcactcctctgcactgggccgctcactctggctccctagaatgccttcactggttactctggcatggagcagacataacccatgtcaccacacgtggttggacagccagtcacattgcggcaatacggggacaagatgcatgcgtccaggccctgattatgaatggagcaaacctgacagcacaggacgaccggggctgcacccctctccatttagcagccacccatggacacagctttaccttgcagataatgttacgatccggggtcgacccttccgtcacagacaagagggagtggaggccggttcattacgcagcttttcatggccgactagggtgtctgcagctccttgttaaatgggggtgctctatcgaagacgtggattataatggtaatctgcctgagccgccctag

SEQ ID NO: 44266 - DNA, 1170 bp, Artificial Sequence
  Description of Artificial Sequence: Synthetic coding sequence
atgcccggcgtggccaacagcggccccagcaccagcagccgggagaccgcaaacccttgctcgcgcaagaaggtgcatttcggctccattcatgatgccgtccgcgcgggtgatgttaagcagttgagcgagatcgtgtgcctgcactggcttctgtggcacggcgccgacatcacccacgtcactaccagaggatggaccgctagccacatcgcagctatccgaggccaagatgcatgtgtacaggccttgattatgaatggcgcgaatttgaccgcccaggatgatagaggatgcacaccactacatctagcggctacccacgggcattcctttaccttgcaaattatgctccgcagtggggtagatccctcggtgaccgacaagagagagtggcgtccggtgcattacgctgcattccatggcaggctgggttgcctccaactcctggtgaagtggggatgcagtatcgaagatgtggactacaacggcaacttgccagtgcatctggctgccatggagggtcacctgcactgttttaagttcttggtctctaggatgagttccgccactcaagtattgaaggcgttcaacgacaacggggaaaacgtactggatctggcacaacgattctttaagcagaatattctgcagttcattcagggggcagaatacgagggaaaggacctggaagaccaggagactctggcgttccctggccatgtggccgctttcaaaggcgacctaggaatgctgaagaaactagtggaggacggcgttataaacatcaacgagagagctgataatggctccacccccatgcacaaggcggccggacaaggtcacattgagtgcctgcagtggttaataaagatgggcgctgattcgaacattacaaataaagctggggagaggcctagcgatgttgccaaacgattcgcccacctggctgcagtgaagctgctggaagaactgcagaaatacgacatcgacgacgaaaacgagatagatgagaacgacgttaaatactttatacgccatggtgtggaggggtcaactgacgctaaagatgacctgtgcttgtccgatttggacaaaacagatgcaaggcgaccatcgaagaactgtagagcatcttggagcatgaatgattacgtggagaagaattag

SEQ ID NO: 44267 - DNA, 1776 bp, Artificial Sequence
  Description of Artificial Sequence: Synthetic coding sequence
agcttcccccggcggcggccctgctgcctgagcagccaggtggccggcgtcggcaggctggagcgcgacagtgagaaagtgccggcagagggcggaagacggtacggtgactcccagggcgtggccgatgaagatggagggcggcggacatcacaccatgtatggcgcataaatggcttgcatggacactccggagcagagtcacgagagcgtgtgagtgacgatggagagaggaagtgcgaggagtcagatcggagatcccgagtggccgccggcagccttagcgctgatgctggcttctctcgaagtgatcttagaagagtgagtgaaaacctgggccattgccgctcagtcagtcgcgaacgggtccgaggcgactctgggcactctcacagttgttcctgggaaagagtgcggggtgatagcaccttctgtagcagcgacgtgaacttttcagaggttggcggccaccagactacagattctagaggtacggcgagggaggacagagggttaagactgtcgggcccctgggaaggggtttccgatattagggaccctcgtacaagcgatttcggagaccgtgtgagcgacgaccgctcccgaaggtttagtggcagctgggaagggggcagcgtcgagggtggccacagcgttggctcttcgtgggaggaagtgagcggggacagagggtacgctgcaagcgattcaagcggggtttcagggagcgaagacgcctcttaccggttttctggattctgggagcgtgagagtgaggatgaggggtttcgctgctctttttgggagagggcaagagaggacctcggccccagaccgagtgacgatggagaagagggccgctgtcgttgctccgggagctgggtcagagcgtcagaggataggaggagcattcgtggccttgacagtacaccaccacaatccaggcgctgttgcgccatgcctggcgtagctaacagcggaccctccacttcgtctagagagaccgccaatccttgctcaagaaagaaggtccatttcggcagcatacatgacgctgtcagagccggtgatgtaaaacaactgtctgagattgttgtgaggggggctagtatcaacgagctggacgtcctccataaatttaccccactgcattgggccgcccatagcggatcactggagtgcttgcactggctactatggcacggggctgacatcacccacgtgactacaaggggctggaccgcttcccacattgccgctataagaggccaagatgcttgcgttcaggccttaatcatgaatggtgccaatctcacagctcaggacgaccgcgggtgtacacctctccatctggctgcaacacacggacacagtttcactctccagattatgctgcgtagcggggtcgatccctccgtaactgacaagcgggaatggaggcctgtgcattacgccgcgttccacgggagactgggatgtctgcagctactggttaaatggggctgctctatcgaagatgtggattacaacggcaacctcccggttcacctggccgccatggaaggacatctgcactgtttcaagttcctggtatcaaggatgtctagtgccacgcaggtgttgaaagcctttaacgataatggtgagaacgtgctggatttagcgcagagatttttcaaacagaatatcctgcagtttattcagggcagtccaaagccggctaccgatctgcagggggaaacaggagccaccgagcttgcccccagagagtcatag

SEQ ID NO: 44268 - DNA, 1650 bp, Artificial Sequence
  Description of Artificial Sequence: Synthetic coding sequence
atggccctggccgccgccgccgccgccgccgccgccggcgtgagccaggccgctgtgctcggcttcctccaagagcacggaggcaaggtgagaaattcggagctgttatcaaggtttaaaccgctgctggatgccggcgaccccagagggcgagccgcccggagggaccggtttaaacagtttgtcaataatgtggccgttgtaaaggaattagatggcgtgaagtttgtagtgctgaggaagaaacctcgacccccggaacccgaaccagctcccttcggaccccctggtgccgccgcacagccttcaaaaccaacatctacagtgctgcctagatctgcttctgccccaggagcacctccactcgtacgagtcccacgccccgttgaaccccctggggacttgggactacccacagaacctcaggatacccccggtgggcccgctagtgaaccggcacagcctccaggcgaacgatccgctgacccccccctgcctgccctggaactggcccaggctaccgagcgcccatcagccgacgcagccccaccaccacgggctccaagcgaagccgcttccccatgcagtgatcctccggacgcagagcccggcccaggtgctgctaagggtcccccccaacagaagccatgcatgctacccgtaagatgtgtgccagcgcctgccacactccggctgagggccgaagaaccaggcctgcgcaggcagttgagcgaggaacctagcccaagatcttcaccactccttttgagaagactgtctgtggaggagtcaggactagggttggggcttgggccaggtcggagcccgcacctccgccgattgtcccgcgcagggccgcgcctgctgtctcccgacgctgaggagcttcctgctgcccctcctccttcagctgtgcccctagagccatcagagcatgagtggctcgtgcgcactgccgggggtcggtggacacaccagctgcatgggctgctgctacgcgaccgcgggttggcggcaaagagggatttcatgtctggattcaccgctctgcattgggccgcaaaaagcggcgacggcgagatggcactacagctggtcgaagtggctcgccgctctggtgctcccgtggatgtcaacgccagatcacacgggggttatactccattacacttggctgcacttcacggacacgaggacgccgcggtcctgctggtcgtgcgcttaggcgcccaagtacacgttagggaccatagcggtcggcgcgcctatcaatatctgcggccggggagcagctacgcactgagacgcctgcttggcgacccagggctgcggggaactaccgagcctgacgcaacaggcggcggcagtgggtcacttgctgcacgtcggcccgttcaggtagccgccaccattctatctagtaccacatctgcctttttgggtgtactggcagatgatctgatgctccaggacctggcacgcgggcttaagaaaagcagcagtttctccaagttcctgagcgccagccccatggcgccccgtaagaagacaaaaattcggggcggtctacctgccttttctgaaattagccgccggccgactccaggtccactggcgggcttagtgccgtcttttccacctaccacctag

SEQ ID NO: 44269 - DNA, 2958 bp, Artificial Sequence
  Description of Artificial Sequence: Synthetic coding sequence
cagccccccctggtgcaggccatcttcagcggcgaccccgaggagatacgcatgctgatacacaaaacagaggatgtaaacacgctggatagcgagaagcggactcccctacatgtcgccgcattcctcggcgatgctgaaatcatagagctcctgatcttaagcggcgctcgggttaacgcaaaagataacatgtggttgacccctcttcacagggctgtcgcatcccgctcggaggaagccgtgcaagtactgatcaaacattccgcagatgtgaatgctcgcgataagaattggcagaccccactgcacgttgccgctgctaataaagccgtgaaatgcgctgaagtgataataccgctcctgagctctgtcaatgtatccgaccggggcggcaggactgcactgcaccacgcggccctgaacggacatgtggagatggttaacttgctgctagccaagggggcgaatatcaatgccttcgacaagaaagaccgacgcgccttacattgggcagcatatatgggtcatcttgacgtggttgccctactaattaaccacggtgccgaagttacgtgtaaggataaaaaaggctatactcccttacacgcagccgcatcaaatggacaaattaacgttgtgaaacatttgctgaacttgggggtagagattgatgagattaacgtgtatggtaataccgctcttcatattgcatgctacaacggtcaggacgctgtggtgaacgaactcatagattatggcgcgaacgttaaccagcccaacaataacgggtttacccccctccactttgccgccgccagtactcacggcgcactctgcctggagctgctggtgaacaatggagcggatgtcaacattcagagtaaagatggaaagtcccctcttcacatgaccgcagttcacggccgctttacgcgttctcagacccttattcagaacggaggtgaaatcgactgcgttgacaaagatgggaataccccacttcacgtcgctgcacgctacggtcatgaactcctaattaataccttgatcacatctggagccgacactgccaagtgtggtatccattccatgtttccattacacctggccgcccttaacgctcacagtgattgctgtagaaagttacttagcagcggttttgaaatcgatacacccgataaattcggtcggacctgcttgcacgccgccgccgccggtgggaacgtagagtgtattaagctcctgcagtctagcggggccgatttccacaagaaggataagtgcggtcgaacgccccttcactacgcagcagcgaactgtcattttcactgtattgaaacactggtgaccactggcgcaaatgtgaacgagacagacgattggggccggaccgccttacattacgccgccgcatccgacatggataggaataagactattttagggaacgcacacgacaattcggaggagcttgagcgggcccgtgagctcaaagaaaaggaggcgactctttgtcttgagtttctcctgcagaacgacgctaatccatctatccgggacaaggaggggtacaactctatccattacgccgctgcatacgggcaccgacagtgcctggagcttttgttggagaggaccaacagtggtttcgaggaaagtgattctggcgctactaaatctcccctccacctggcggcttataatggccaccaccaagccctggaagtgctgctccagtctctcgtagacttagatattcgagacgagaagggcagaacagccttggatcttgccgcctttaaaggccatactgagtgcgtggaagctctaatcaaccaaggggccagtatttttgtaaaggacaacgtcaccaaaaggacacccctacatgccagtgtgattaatgggcacaccctgtgccttcggctgctcctcgaaattgcagataatcccgaggccgttgatgtcaaggacgcaaagggccagactcccctgatgctcgcagttgcctacggtcacattgacgccgtttcccttttattggaaaaagaggctaacgtagataccgtggatatccttggctgtacggccctgcaccgcggaataatgaccgggcacgaagagtgcgtgcagatgttgctggaacaggaggtgagtatcctctgtaaggattctagaggccgtacccctctccactacgccgctgccagggggcacgctacatggttatccgaacttctgcagatggctctgagcgaagaagattgctgttttaaggacaaccagggttatacccctctgcactgggcttgttacaatggaaacgaaaactgcatcgaggtgttgctggaacagaagtgctttcgcaaattcattggtaatcccttcactccccttcactgtgcaatcattaacgaccacgggaactgtgcaagtctcctccttggcgccattgacagtagtattgtgagctgtagagacgacaaaggaaggacccctcttcacgccgccgcctttgctgatcacgttgaatgccttcagctgttactgcgacacagtgcgccagtaaacgctgtagataatagcggcaaaactgctctcatgatggccgcagagaatggccaggctggcgcagttgatattctggtgaacagtgcccaggctgacctgactgtgaaggataaggatttgaataccccactccacctggcatgttctaaaggtcatgagaagtgcgctctgctgattctggataaaattcaggacgaaagtctgattaatgaaaagaacaatgctctgcagacgccacttcacgttgccgcacggaatgggttaaaagtggtcgtcgaagaacttctcgcaaaaggcgcttgtgtattggccgtcgatgagaacgcgtcaagatccaacggcccacgcagcacgcctggaaccgccgttcagaaggaagaatag

SEQ ID NO: 44270 - DNA, 2760 bp, Artificial Sequence
  Description of Artificial Sequence: Synthetic coding sequence
atgctgatccacaagaccgaggacgtgaacaccctggacagcgagaagcgcactcctcttcacgtggccgcgtttctgggcgacgcagagatcatcgagttgctaatccttagtggagccagggtaaacgctaaagataatatgtggcttaccccactgcacagggctgtggcttcgaggagcgaggaagccgtgcaggtgttgatcaagcattccgcggacgtgaatgctcgcgacaagaattggcagaccccccttcatgtggcagcagcaaacaaggcggtgaaatgtgctgaggtgattatccctctgttatctagcgtaaacgtgagcgatcgcggtggaaggactgcactgcaccatgccgccctcaacggccatgtcgaaatggtcaatttgctgctcgctaagggcgctaacataaatgctttcgataagaaggatagacgggccctccactgggctgcttacatggggcacctagatgtggtcgccctactcataaaccatggggcagaagttacctgcaaggataaaaaagggtacacccctctccacgcagccgcgtctaacggccagatcaacgtggttaaacatttgcttaatctcggcgtagaaatcgacgaaattaacgtgtacgggaacacagccctacatattgcctgctacaatggccaggacgccgtagtcaatgagctgatcgactacggtgcaaatgtgaaccagcccaacaataacggcttcaccccacttcacttcgctgcggctagcacccatggagctctctgccttgagctgctcgtcaataatggcgcagatgtgaatattcagtcgaaagatggcaagtcacccttgcacatgaccgcagtccatgggagatttaccaggagccagaccctgatccagaatggcggtgagatagactgcgtcgataaggacggcaacactcctttgcacgtggccgcaagatatggccacgagcttctgatcaacactttaattacaagcggcgcagataccgcgaagtgcggcatacatagcatgtttccccttcacttggcagcacttaatgctcactctgactgttgccgtaaactgctgagcagcggctttgagatcgacacccccgataaattcgggagaacttgtctacacgccgcagccgccggcggcaatgttgagtgcatcaagctcctccagtcaagcggagcagacttccacaagaaagataagtgcggaagaactccattacactacgcagccgccaactgtcactttcattgcatagagaccctcgtgacgactggcgccaatgttaacgagactgacgattgggggagaacagcgctgcattatgccgcagcctcagacatggataggaataaaacaattctgggcaacgcacatgataactcagaggagttagagcgagccagagagctcaaagaaaaagaggccaccctgtgcctcgagttcctgctgcagaacgatgccaacccgtccatccgggataaagaaggatacaacagtatccattacgctgcagcatacggccatcgccagtgtctcgagctgcttctggaaagaaccaactctggattcgaagaatcagactcaggcgccacaaagagccctctgcacctggcggcttataatggccaccaccaagctctcgaggtcctcctccagtctctcgtggacctggatatacgggatgagaaaggccggacagctctggaccttgccgccttcaaaggccacacagagtgcgtggaagcactgatcaaccaaggggcgtctatattcgtcaaagataatgttacgaagcggactccactgcacgcatcggttattaacgggcataccctgtgcctgaggcttctgctcgaaatcgcagacaatccagaggccgttgacgtgaaggatgcgaaggggcagaccccccttatgctggcagtcgcctatgggcacattgacgctgtgtctctgctgcttgagaaggaggcaaatgtggacactgtggatattctcggatgtacggccctacacaggggaattatgactggacacgaggagtgcgtgcaaatgctcctcgaacaggaagtttccatactgtgtaaggactccagaggccggactcctctgcactatgccgccgcccgcggacatgccacctggttatcagagctgttgcaaatggccctctctgaagaagactgctgttttaaggacaaccagggctatacgcccctgcactgggcctgttataatggcaacgaaaactgcatcgaagtgctcctcgaacaaaagtgctttcgtaagtttatcggtaatccttttactcccctgcattgtgctatcattaacgatcatgggaactgcgcttcccttctgcttggggctatagactctagcatcgtgtcgtgtcgtgacgacaaaggtcgaactcccctgcatgcggccgccttcgccgaccatgttgaatgcctgcaactgctgctgaggcactctgctccagtgaatgcagtggacaatagcggtaagacagctcttatgatggccgcagagaatgggcaggccggcgccgtggacatattggtgaatagcgcacaggccgacttgactgtgaaggataaagacttgaacaccccacttcatctggcttgttcaaagggacatgaaaagtgcgcactgctgatactcgataagattcaggatgagtcactgattaatgagaagaacaatgcactgcaaacttag

SEQ ID NO: 44271 - DNA, 2760 bp, Artificial Sequence
  Description of Artificial Sequence: Synthetic coding sequence
ctgctgatctacaagaccgagatcatcagcaccctggacagcgagaaaaggacgccacttcacgtcgctgcattcttgggggacgccgaaatcatcgagcttctgatcctgtccggtgccagagtcaacgcaaaagacaatatgtggcttacccccctccaccgcgcagtagcttcaaggtctgaggaagcggttcaggtgctcatcaagcactccgcggacgtcaacgccagagataaaaattggcaaacccccttgcacgtagctgcagccaataaggcagtgaagtgtgccgaggtcatcattcctctcctgtctagtgtgaatgtgagtgacagaggcggaaggaccgcgctgcatcacgcagccctgaatgggcacgtcgaaatggtcaatctgctccttgctaaaggtgcaaacattaacgccttcgacaagaaggatcgcagggccctccattgggccgcctatatggggcacctggatgtggtggccctgctgatcaatcacggcgccgaagtgacctgtaaggataagaaaggctatactccattacacgctgccgctagtaacggtcagataaacgtggtgaagcacctgctaaacctgggcgtcgaaatcgacgagatcaacgtgtatgggaacaccgcgctgcatatagcgtgttacaacggtcaagatgctgttgtaaacgagctgattgactatggtgccaatgtgaaccagcccaataataacggctttaccccccttcacttcgcagctgcttctacacacggtgctctgtgtctggaactgctggtcaataacggcgccgacgtgaacattcagagcaaggacgggaagagccctctccatatgaccgcggtgcacggtaggttcaccagaagccaaacgttgatccaaaatggcggagaaattgactgcgtggataaggacggaaacacgccactccacgtggcagccaggtatgggcacgaactgctgatcaacactttgataactagtggcgccgacaccgccaaatgtggaatacacagcatgttccctctgcatcttgctgccttgaatgcccattctgattgctgcaggaaactactttcttccggttttgaaattgatacccccgacaagtttgggcgaacctgcctgcacgctgctgccgcagggggcaatgtggaatgcattaagctgctacagtcttctggagcggatttccacaagaaggataagtgtggccgcacaccactccactacgcagcagcgaactgccattttcattgcattgaaaccctcgtcaccaccggcgccaatgtaaacgagactgatgattggggccgcaccgcactacattacgccgccgccagcgatatggatcgtaacaaaaccattctgggcaatgctcacgacaattctgaagaattagagagagctagagaactcaaggagaaggaagcgaccctgtgcctggagtttctcctgcagaatgatgctaatcctagtatccgagacaaagagggatacaattcaattcactacgcggctgcctatggccaccgccagtgcttggagctgctcctggagcgaacgaatagtggatttgaagagagtgacagtggggcaactaaaagccctcttcatctcgctgcatacaacggacatcaccaagccctggaggtactgctccagagtctggttgatctggatatacgggacgagaaggggagaacagcactagacttggccgccttcaagggccatacggagtgtgttgaggccctcattaaccagggagcctctattttcgttaaagacaacgtgaccaagagaacaccattgcacgcgagcgtgattaacggccatactttatgcttgcgcctgcttctcgaaattgcagataaccccgaagctgtagatgttaaagatgcgaaggggcaaacacccctaatgttagcagtggcctatggtcacatagatgcagtgagccttcttctggagaaagaggcaaatgtcgacaccgtggatattctcggttgcacagctctgcatagaggaatcatgacgggacacgaagaatgcgtccaaatgcttctggaacaggaagtctccattctgtgcaaagactctagagggcgaaccccactccattacgctgctgcccgaggccacgcaacgtggttgtccgagttgttgcagatggccctgtcagaggaggactgctgctttaaagataaccagggctataccccacttcactgggcttgttacaatggaaacgaaaactgcatcgaggtcctgttggagcagaaatgcttccgcaagtttatcggcaacccttttacccccctccactgcgccattataaacgaccatggaaattgcgcctcactcctgctcggggctatcgattcgtcaatcgtgagctgccgagatgacaagggccgcacgcccttgcacgccgccgccttcgcggaccacgtggaatgcctccaacttttactccgtcacagtgcccctgtgaacgccgtcgacaattccggaaaaacggccctgatgatggcagcagaaaatggccaggccggagctgtcgatattttggtgaactctgcccaagctgatctcacagtgaaagacaaggatttgaacactcctctgcatctggcatgcagcaagggccatgaaaagtgcgcactgctcatcctcgacaagatccaggacgagtctctgatcaacgagaagaataatgctctgcagacctag

SEQ ID NO: 44272 - DNA, 1740 bp, Artificial Sequence
  Description of Artificial Sequence: Synthetic coding sequence
atggccgtgctgaagctgaccgaccagccccccctggtgcaggccatcttctcgggggatcccgaggaaatacgtatgctcatccataagacagaagatgtgaacaccctggatagcgaaaagagaaccccgctccacgtggctgcttttctgggggacgccgagatcatcgagctgctgatcttgtccggggccagagtgaatgcaaaggacaacatgtggctaacaccactgcaccgcgcggtggcctcgaggtctgaggaagccgttcaggtgcttatcaagcatagcgccgatgtgaacgccagggataaaaactggcaaacccctctgcacgtggcagctgctaataaggctgtaaagtgtgctgaagtaatcatccccctactgagttcggtgaacgtgtccgatcgtggtggaagaactgctctgcatcatgctgcactaaacgggcacgtcgaaatggtgaatttactgctagcgaaaggggcaaacatcaacgcttttgataagaaggacagacgtgctttacattgggccgcgtacatgggccacctggatgtcgtggctctgttgattaaccacggggctgaggtgacatgtaaggacaagaaaggctacacacccctgcacgctgccgcctctaatgggcagataaatgtcgtcaagcatttgctgaacctgggcgtggagatcgatgagataaatgtctacggtaacaccgcactacacattgcttgctacaacggtcaggatgccgtggttaacgagctgatagattacggggccaatgtgaaccaacccaataacaacggattcacaccactacactttgcagctgcttcaacacatggcgccctttgccttgagctgttggtaaataacggcgctgatgtgaatatacaaagcaaagacggcaagagcccgctccatatgacggcagtgcacggccgcttcacgaggtctcagaccctaatccaaaacgggggagaaattgattgtgtcgataaagacggtaacacgcccctccacgtagctgccaggtacgggcacgaattactgattaataccctgatcacaagtggcgcggacacagctaaatgcggtatccattccatgtttccacttcacctggccgctctcaacgcccactccgattgttgccgaaagttgctcagtagcgggttcgagattgacacacctgacaaattcggtcgtacctgtctccacgcagccgccgccggcggcaacgtggaatgcatcaaactgctgcaatcgtctggcgctgactttcacaaaaaagataagtgtggtcggactcccctacactatgcggctgcgaattgccacttccattgtatagaaactctggttaccacaggcgctaacgtgaatgagaccgatgactggggcaggacagccctccactacgccgctgcttccgacatggacaggaacaaaacaattttgggcaatgctcacgataattccgaggaactggaacgggccagggaactgaaagaaaaggaagcgaccctttgcctggaatttctgctgcagaacgatgccaacccatccatcagggacaaggagggatataactcaatccactacgcagcagcctatgggcaccgacagtgtctggaactggtgagttgttttgttctgttctcactaactcatacacatacccacaccccaaaccaccgcgggattaactgctttttccccgagctgtag

SEQ ID NO: 44273 - DNA, 1104 bp, Artificial Sequence
  Description of Artificial Sequence: Synthetic coding sequence
atggccgtgctgaagctgaccgaccagccccccctggtgcaggccatcttctcaggtgaccctgaagagattcggatgctcattcacaagacggaagacgtcaacactcttgacagcgagaagaggactcccttacacgtggccgcttttctaggagatgcggagattattgagctgttgatactgtcaggagctcgggtgaatgctaaagataacatgtggcttacgccactgcaccgagccgtggcgagtagatctgaagaggccgtgcaggtgctgattaagcactcagccgacgttaacgccagggacaagaattggcagacaccactccacgtggcagccgctaataaggcggtgaagtgtgctgaggttattataccgttgctgtccagcgtaaatgtgagtgaccgggggggacggacagctctgcatcacgctgctctgaacggtcacgtggagatggttaatctgttactggcaaaaggcgccaacattaacgcttttgataaaaaagataggcgtgctttgcactgggcagcctacatgggccacttggacgtggtagcactgctcataaatcacggcgctgaagtgacgtgtaaagataaaaaagggtacacgccactgcacgctgccgcttccaatgggcagattaatgtggtcaagcatctgttgaatttaggcgttgaaattgacgagattaatgtttacgggaacaccgctctgcacattgcatgttacaatggccaggatgccgtggtgaatgaactcatcgattacggggccaacgtaaaccagccgaataacaatggatttacaccactccactttgcggccgcatccacacacggagccctgtgccttgagctcctcgtgaacaatggggcagacgttaatatacaaagcaaggacggcaagtcccccctgcacatgaccgccgtccatggtcgctttacacggagtcagactttgatccagaacggcggggaaatagactgtgtagacaaggatgggaacacccccttgcatgtggccgcccggtatgggcatgaattactgattaatactttaattacgtccggggctgatacagccaaatag

SEQ ID NO: 44274 - DNA, 2760 bp, Artificial Sequence
  Description of Artificial Sequence: Synthetic coding sequence
atgctgatccacaagaccgaggacgtgaacaccctggacagcgagaagcgaacacccctgcacgtggcggcctttttgggagacgccgaaattatcgaactgctgatcctgagtggtgcccgcgtgaatgcaaaggacaatatgtggctgactcctcttcatagggccgttgcaagtaggtccgaagaagctgtgcaggtgctgataaagcactcggcagacgtgaacgctcgggataagaactggcagactcctctgcacgtggcggcggccaataaagcggtcaaatgcgccgaagtgataatccctctccttagcagtgtaaatgtgtcggatcgtggagggaggaccgccctgcaccacgccgctctcaatggtcacgtcgagatggtgaatttactgttggccaagggggccaatatcaacgcttttgacaaaaaagatcgtcgtgctttgcattgggctgcctatatgggtcatctggacgtagtcgccctgttgatcaaccatggcgcagaggtaacctgcaaggataaaaagggctacacgccactgcacgctgccgcctctaatgggcagataaacgtcgttaagcatttgctgaatctgggcgtagagatcgatgagattaacgtgtatggaaacaccgcacttcacatcgcctgctataacggccaagacgcggtggtgaacgagttaatagattacggggctaatgtgaaccagccaaataacaatggatttacacctctgcacttcgctgcagcgtctactcatggtgcactttgtctagaactgttagtcaataacggcgccgatgtcaacattcaaagtaaggacggcaaatcaccactgcatatgactgcagtacacggtcgtttcacaaggagtcagacattaatccaaaacgggggcgagattgattgtgttgataaggacggaaacacccctcttcatgtggccgccagatatggacacgaactgttaataaacacactgatcactagtggagccgacacggccaaatgtgggatccactccatgtttcctctgcacctcgccgctctaaacgcccacagtgattgctgccgtaagttactctcctctgggttcgagattgatacaccagacaaattcggccgcacctgcctgcacgccgccgccgcaggggggaacgttgagtgcattaagctgctgcagagttccggagccgatttccataaaaaagataagtgtggccgcacccccttgcactacgcggcggctaattgtcatttccactgtatcgagacccttgtgactactggggccaacgtgaacgagacggatgactggggccggaccgcacttcattatgctgctgcttctgacatggatcgtaacaaaaccatacttggcaacgctcacgacaatagcgaagagctggagcgggcaagggaacttaaagagaaggaggcaactctgtgcctggaattccttctccaaaacgacgccaaccccagcatcagggacaaagaaggctacaatagtattcattatgccgccgcctatggtcacaggcagtgcctggagctgcttcttgagcgaacgaattcaggtttcgaggagagtgactccggcgcaacgaagagccctctgcacttagctgcgtacaacggacatcaccaggcactggaagtgttgttacagtctctagtcgatctagacataagggacgagaaggggcggactgccctggatcttgccgctttcaagggccataccgaatgtgtggaagcgcttatcaatcagggggcgtcaatcttcgtcaaggataacgttactaaaaggacccccctgcacgccagtgtgattaacggccacaccctatgcctgagactgcttcttgaaattgcagacaaccctgaggccgtggatgtgaaggacgctaagggccagaccccacttatgctagcggtcgcttatgggcacatagacgccgtgagcttacttctcgaaaaggaagcgaacgtcgatactgtggatatcctggggtgcacggccctgcacaggggtatcatgactggacatgaggaatgtgtgcagatgctcttagaacaggaggtttcaatcctgtgcaaggattccaggggacggactcccttgcactacgccgcggcaaggggccatgccacctggctgagtgaactgttgcagatggccctctccgaggaagattgctgctttaaggataaccagggctacacaccgctgcactgggcttgctacaatggcaatgaaaattgtattgaagtcctcttggagcagaagtgtttccggaaatttatcggaaatccattcacccccctccattgtgccataataaatgaccatggcaattgcgcctccctgctactgggcgctatcgactcaagcatcgtgagctgtcgggatgacaaaggaaggaccccattgcatgctgccgcctttgcggaccacgtagagtgcctgcagctcctgctgcgtcacagtgcgcccgttaatgcagtggataacagcggcaaaactgccctgatgatggctgccgagaatggacaggccggcgctgttgatatccttgtgaactcggcgcaggcagatctaaccgtgaaggacaaggaccttaacacgccactacacctggcctgttcaaaggggcacgaaaagtgcgcgctgcttatcctggataaaattcaggatgaatccttgattaatgagaaaaataacgcccttcaaacttag

SEQ ID NO: 44275 - DNA, 1524 bp, Artificial Sequence
  Description of Artificial Sequence: Synthetic coding sequence
atgtggctgacccccctgcaccgggccgtggccagccggagcgaggaggctgtgcaggttctcatcaagcatagcgcggatgtcaatgccagggacaagaattggcagacacctctccatgtcgcagccgcaaacaaagccgtgaagtgcgcagaagtaatcattcctcttctgtcctcggtgaacgtctcagatcgcggtggtaggaccgccctgcaccatgccgcccttaatgggcatgtggagatggtcaacctcctgctggccaaaggtgccaacatcaatgccttcgataagaaggatcggagagctctgcattgggcagcctacatgggacacttggacgtcgtggctttgctgatcaaccatggcgccgaggtgacatgcaaggacaagaagggctacactcccctgcatgccgctgccagtaacggacagataaacgtggttaagcacctgctgaatttgggggtggaaatcgatgaaattaatgtgtatggaaatacagccctgcatatagcgtgctataacggccaggacgccgtcgtgaatgagctgatagactatggagctaacgttaaccagccaaacaataatggatttacgcccctgcactttgctgctgcaagcacgcatggggctttgtgtctggaactactagttaacaatggagcagatgtgaacatacaatctaaggatgggaaatcccctcttcatatgacagcggttcacggcagattcacaagaagtcagactttgattcagaacggcggcgagattgactgcgtggacaaggacggaaatactccactccacgtcgcggctaggtatggccacgaactcttgatcaataccctaatcacaagcggcgccgacactgccaagtgcggcatccatagtatgttccccctgcatctggccgccttgaacgctcactccgattgttgccgaaagctgctgagcagcggcttcgagattgacacacccgataagttcggacggacatgtctacacgctgctgccgcgggtggcaatgtggaatgtataaagctgttacagagcagcggagcagatttccataaaaaagataagtgcggtcggacccccctgcactacgctgccgcaaattgtcacttccactgtattgagaccctcgtcactactggagcgaacgtgaacgaaactgatgattggggcaggacagccttacattacgctgcggctagcgacatggaccggaataagactatcttgggaaacgcccatgacaatagcgaggagctcgagcgagcgagagaattgaaggagaaggaggccaccctttgtctggaattcttactgcaaaacgacgccaatccaagtatccgcgataaggagggatataactccatccactacgcggccgcctacggacacagacagtgcctagaattggtatcttgcttcgtgcttttcagtctgacccatacccatactcatacccccaatcataggggtataaactgtttttttcccgagctctag

SEQ ID NO: 44276 - DNA, 801 bp, Artificial Sequence
  Description of Artificial Sequence: Synthetic coding sequence
atggagagcgagggcccccccgagagcgagagcagcgagttcttcagccagcaggaagaagagaatgaggaggaagaagcacaggagccggaggagaccggaccaaaaaatccattgctccagccagctctcactggggatgtggagggtttgcagaaaatttttgaggacccagaaaatccccaccacgagcaggccatgcagctgttactcgaggaggacattgtgggcagaaatctactctatgccgcgtgcatggcaggccagagcgatgtgataagggcactggccaagtatggagtgaacctgaatgagaagaccacacgcggctacacgttgctacactgtgctgctgcctggggaaggctggagacgctgaaggcactagtcgagttggacgttgacattgaggccttaaattttcgcgaggagcgggctcgtgacgtcgctgcaaggtacagtcagaccgagtgcgtcgagttcctggactgggcagacgctagactaacactcaagaagtacattgcgaaagtcagcctggcagtcactgatactgagaaaggtagcggaaaactgctgaaggaagataagaacaccatcctgagcgcctgtagggcaaagaacgagtggctggagactcataccgaagccagcattaacgagctgttcgagcaacgacaacagcttgaggacatagtgacccccatattcaccaaaatgaccaccccttgccaggtcaaaagtgctaagtccgtgacctcccatgaccagaaaagaagtcaggatgacacgtctaattag

SEQ ID NO: 44277 - DNA, 2331 bp, Artificial Sequence
  Description of Artificial Sequence: Synthetic coding sequence
atggccctggccgacaagcggctggagaacctgcagatctacaaggtacttcagtgcgtgcgtaacaaggataaaaagcagattgaaaagcttacgaagctgggatatcctgaattaatcaattacacagagccaataaatggactgagtgccctacacctggcctctgtgagcaatgacatcgacatggtgagctttcttttagacttaggagcacacccggacgtccaggacaggatggggtgcacaccgactatgcgggcagcagaattgggacatgaactgtcaatggaaatcctcgccaaggccaaggctgatatgacgattgttgataacgagggcaaaggggtgctgttttattgcattctaccaactaaacggcattaccggtgcgctctgatcgcacttgaacacggggcggatgtcaataactccacctacgaagggaaacccatattcttgcgcgcatgcgaagatgctcacgatgtgaaggacgtatgcctgacatttcttgaaaagggtgccaaccccaacgcaattaatagtagtacaggaagaacggccttaatggaggcttcccgggaaggtgttgtggagatcgtccgggggatcctggaacgggggggagaagtgaatgcctttgataatgatagacaccacgccgctcactttgccgctaagggggggtttttcgacatcctcaagttgctctttgcgtacaatggtgacgtggggctcatctctatcaatggtaacacccctctgcattacgctgcaatggggggctttgccgattgctgcaaatacatcgctcaacgcggttgcgacttgaaatggaagaatttggaccataaaacacctcgtgccgtggccaaggagggaggatttaaagctgcatccaaggaaatcaggagagcagaaagaattgcgaacaagttggccaggcccggcgctaagaaccccaaccctctgtgggccctgaggctgcatgactggtcagtggagcgagaagccttcttgagagaggcttttgctgtacttgaccgcggagatgggtctatttctaagaacgatttcgtgatggtattagaggagcgccaggattatgctagcagtgaacagttggcggctatcgcacacctgcatgagaaaacaaggggcggcggcgttaatattaacgaattctttaaaggaacgaggtacctgaataagtccttcgtgctgggaagttatggccccaaaaaaaaggaaaagggaatgggcaagaagggcaagaagggaaagtttgtgctcccgttgcctatctgtgtaatacctgagtacgcctttccacgaagacaggacggaggcccaccttactatatgatcgagacatacaagaatgtgacagattccagtaggttcaaccgggatcaccccccagaacacccaatccaggacgattcggtgtggtatattgatgattccgagaaagtattctctaatatcaacataatcacaaaggcaggtgatctcgcatctttaaagaaggccttcgaatctggcatccctgttgatatgaaggacaattactataagactccgctgatgactgcatgcgcgtccgggaatatcgatgtggtcaagttcctgctagaaaagggcgctaacgttaatgccaccgacaatttcttatggactcctttacactttgcctgtcacgctgggcagcaggatatcgtagaactgctcgttgagagcggcgcgctgatagacgcggctagcatcaataactctacccctttgaacagggccatcgaatcatgtaggctcgacaccgtgaagtacctcttagatatcggcgccaagtttcagctcgagaataggaaaggccattcggcaatggatgtggctaaggcatacgccgattacaggattattgacttaattaaggagaaactggacaacctccccaaacccgcggagaaccagaagctaaaaggcaaaacaccgcccatcctgaagacagagggcccggaaattaagaaagaggaggaacttctgagcagcatatatggtgtccccaccaccagtgaaggcaaaaaagtgcagaagggtaacgtggtacacttaaattccctgataacatcaggatacaccaagaaggtcgacatcacatttatcccccgccgcatctggagccctgaggccaccaccgcagaacttatcaggaagcgagagttgcggcgagagaggtttacacacgaggtggattttgacgactttatgatgccatttcagaaaaatattaccgagaaagcccgtgccctggaagcggctttgaaaacctag

SEQ ID NO: 44278 - DNA, 2331 bp, Artificial Sequence
  Description of Artificial Sequence: Synthetic coding sequence
atggccctggccgacaagcggctggagaacctgcagatctacaaggtgctccaatgcgttaggaacaaagataagaagcagattgagaaacttactaaacttggttatcccgagctgatcaattataccgaacccattaacggactctcagcgttacacctggcaagtgtgtccaacgacattgacatggtaagcttcctgctagacttaggagcgcatcccgacgttcaggatcgcatgggttgtaccccgaccatgcgagcagccgaattgggccacgagcttagcatggaaatattggcaaaggctaaggccgacatgaccatcgtggataatgaggggaaaggagtgttattctactgcattctgcccactaaaaggcactaccgatgtgcactgatcgctctcgagcacggcgcagacgttaataactcgacgtacgagggcaagccgatctttctacgtgcttgtgaagacgcccatgatgtgaaggatgtatgcctgactttcttagaaaagggcgcaaaccctaatgccatcaactcctcaactggcagaacggccctgatggaggcctccagggagggtgttgttgagatcgtgaggggcatccttgagcgggggggggaagttaacgcctttgacaacgatagacaccatgccgctcactttgccgcaaagggcggattcttcgatatcttgaagttgctgttcgcatacaatggagatgtgggcctcatcagtatcaacggcaatacccctttgcattatgcagccatgggcggattcgccgattgttgtaaatacatcgctcaacggggatgtgacttgaaatggaagaatttagatcacaaaaccccccgcgctgttgctaaggagggaggattcaaggcagcatccaaagaaattcggagggcggagcgcatcgccaataaactggcgcgccctggtgcaaagaaccccaaccccctgtgggccctgcgcctgcacgactggagtgtcgagagggaggctttcctgcgggaggccttcgcagtgctggaccgcggtgatggtagcatatctaagaacgattttgtgatggttctggaagagaggcaagattatgcttcatccgaacagctcgctgccattgcacatctacacgaaaagacacggggcggcggcgtcaacattaacgaattctttaaggggacacggtaccttaataagtccttcgtactggggtcttacggtcctaagaaaaaagagaaagggatggggaaaaaaggaaaaaagggcaagtttgtcctgcctcttccaatctgtgtgattccggagtacgccttcccacggaggcaggatgggggacctccctattacatgatcgagacatataaaaatgtaacagacagctctcgctttaacagagaccatccacccgagcatccaatccaggacgactcagtttggtacattgacgatagcgagaaagttttcagtaatatcaatattattactaaagctggtgatctagctagcctgaaaaaggccttcgaatcagggatcccggtggacatgaaagacaattactataaaacaccactcatgaccgcctgtgccagcggcaacattgatgtggttaaatttctcctggaaaaaggcgctaatgtcaacgcaactgataactttctgtggacacccctgcattttgcatgtcatgctggtcagcaggacattgtggagctcctcgtagagtcgggggccctcatagatgctgcgtcaatcaacaactcaactcccctgaatcgggctatcgaatcctgtcgcctggatacggtcaagtatctgttagacataggagctaagtttcagttggagaacagaaagggtcactctgctatggatgtggccaaagcctacgccgactacaggattatcgacctgataaaagagaagctagacaacttgccaaagccggcagagaaccagaaacttaaaggcaagaccccgcccattctcaagaccgaagggccagagatcaagaaagaggaggagctgttatcatctatctatggggtgcctactacgtcagaagggaaaaaggtacagaagggaaatgtggtgcatctaaattccttgattacatccgggtatactaagaaagttgacatcacattcatccctcggcggatctggtcccccgaggcgactaccgccgagcttatacgtaagcgcgagcttcgaagggaacgattcacgcacgaggtggacttcgacgacttcatgatgcccttccagaagaacattactgaaaaggcccgggctttagaggcagccttgaagacttag

SEQ ID NO: 44279 - DNA, 4290 bp, Artificial Sequence
  Description of Artificial Sequence: Synthetic coding sequence
atgaccaacccctgggaggagaaggtgtgcaagatggcccagacctctctcctgcagggtaagcagttttattgccgtgagtgggttttccacaagcttcagcactgcttgcaggaaaagtctaattgctgcaacagcgccgtcaacgcccctagcctcgtcatgaatagcggaaataacgcctctggcgtcagcggtaagggcgcagcctggggtgttctcctggtgggtggacccggaagtgggaagacggccctctgcaccgagttgctctggccctcgtccccagcaagccttcagagaggactgcaccgccaggctcttgccttccacttctgtaaggcacaggattcggacactctttgtgtgggtggatttatccgcggcctggtggctcaaatctgcagatctggtctactgcaaggttatgaggataagttacgagatccggccgtacagagccttctacagccaggcgaatgtgagcggaacccggcagaagccttcaagcgctgtgttttgctgccactcttgggcatgaagccaccccagcagtccttgtatctgctcgtcgactcagtagacgaaggctgcaacatcacagaaggtgaacagactagtacaagcctgagcggaactgtggccgctttgcttgcggggcaccacgaatttttccctccttggctgctcttgctttgctctgcaagaaagcaatctaaggcggtgactaaaatgtttacaggatttcgcaaaatctcgcttgacgacctccgtaaggcctacatagtgaaagacgtccaacagtatatcttacaccggctggatcaggaggaggctctgagacaacatttgacaaaagagacggctgaaatgctgaatcagctgcatataaagtcttccgggtgcttcttgtatctggagagggtgttggacggggtcgtggagaacttcatcatgctgcgcgagattagagatatccccggcactttgaatgggctgtatttgtggctctgccagcgcctttttgtgcgcaaacagttcgctaaggttcagcccattttaaacgtaatcttagcagcctgcaggcctctcactattacagagttataccacgccgtctggactaagaacatgtctctgaccctggaagacttccagagaaagctggatatacttagcaagcttctcgtggatggcctgggcaataccaaaatccttttccactattcttttgcggaatggctgttggacgtgaagcattgtacacagaagtacctttgtaatgccgccgaaggacacaggatgttggccatgtcctacacctgccaggctaagaatctgacgcccctcgaggcgcaggaattcgcccttcatctgatcaacagtaatctccagctggagacagcggagctagccctttggatgatctggaatgggacccccgtacgggactcattgagtacgttaatacctaaagagcaggaggtactgcaattactggtgaaagccggtgctcacgttaactccgaggatgacaggacttcctgcatcgttaggcaggctcttgagcgggaggatagtatcaggaccctgctcgacaacggcgcaagcgtcaatcagtgcgatagcaatggccgtacactgttagcgaatgccgcttacagcgggagtctggatgtcgtgaacttgctcgtctcccgaggcgccgacctcgagattgaggatgcccacgggcacaccccccttacattggccgcgagacaggggcacaccaaggtggtgaattgcctaataggctgtggtgcgaatatcaaccatacagaccaagacggatggacagctctaaggagcgctgcctggggcggacatactgaagttgtgagcgccctgctttatgcaggcgtaaaagtggactgtgccgatgccgactcaagaaccgccctgcgtgctgctgcgtggggaggacatgaggatatcgtgctgaacctgctgcagcatggggctgaggtgaataaggcggataacgaaggtagaactgctttaattgcagccgcatatatgggacacagagagattgtggaacatttgctggaccacggcgccgaggtgaaccacgaagacgtagatgggaggactgcgctaagcgtcgccgcactgtgcgtgcccgcctcgaaggggcatgcctcagtggtctctctgctcatcgaccggggcgcagaggtggatcattgtgataaagatggcatgacacctctcttggtcgctgcatacgaagggcacgtcgacgtggtcgatctgctgttggaagggggggccgatgtggaccacacggacaacaatggtagaacgccactccttgcagccgcttctatgggacatgcttcagtggtgaatacactgctcttctggggtgctgcagtcgactcaattgacagcgaagggagaaccgtgctgtcaatagcatcagcacagggcaatgtcgaggtggtgcggacactcctagatcggggcctggacgagaaccatagggacgacgcaggatggacaccacttcacatggccgctttcgaaggccacaggttgatctgcgaagccctgattgagcagggagccagaacaaatgagatagacaatgacgggcgcatccccttcatattagcctcacaggagggccattatgattgcgtgcaaatcctgttggaaaataaaagcaacatcgaccagagggggtacgatggcagaaatgctctccgcgttgccgcactcgaaggtcatcgcgacatcgtggagttacttttttcccacggggcggatgtgaactgtaaggacgccgacggcagacctactttatacattctcgctcttgagaaccagctgaccatggccgaatactttctcgagaacggcgctaacgtggaagccagtgacgccgagggccgcactgcactgcacgtgtcatgctggcagggccacatggagatggtacaagtcctgattgcttaccacgccgacgtgaacgcggcagataacgagaaaagaagcgctctacagagtgccgcatggcaggggcatgtcaaggttgtccagctgctgatcgaacatggcgccgttgtagatcacacatgcaaccaaggagcaaccgcactttgtatcgccgcacaagagggtcacatcgatgtagttcaggtccttctggagcacggagcagatccgaatcatgctgatcagttcggccgaaccgctatgcgggtggccgccaagaacggacatagtcagatcataaaactgctggaaaagtatggcgcatcctcactgaacggctgttccccatctcccgttcacacaatggagcagaaaccgctccaaagtctgtcttcgaaagttcagagtcttaccataaagtccaattcctctggaagtacaggcggaggagacatgcagccttccctaagagggctcccaaatgggcccactcacgccttcagttccccctctgagagcccagactccaccgtggatcgacagaagtcttccctttctaacaatagcctgaaaagctctaagaactctagtctaaggaccacatcctctacggctacagctcagactgtgcccatcgactccttccacaacctgagctttacggagcagattcagcagcatagtctgcccagaagcaggagtcgtcagagcatcgtatccccttcctctacaactcagtctttgggccagtcacacaactccccctcctcagaatttgaatggtcccaggttaaaccaagccttaagagcactaaagcatcaaagggtgggaaaagcgaaaacagcgcaaagtctggttccgctggaaagaaggccaaacagagcaacagctctcagccaaaagtcttggaatatgaaatgacacagtttgaccggagaggacctatcgccaagtccggtacggcggctcctcccaagcagatgccagccgagtcccagtgtaagattatgattccttctgctcagcaggagataggtcgcagtcaacagcagttcctgatccaccagcaatctggagagcagaagaagcggaacggaatcatgactaatcccaattatcacctgcagtctaatcaagtcttcctcggcagggtgtcagtgcccaggacaatgcaggacaggggccaccaggaggtactggaggggtatccctcatctgagacagagctctccttgaagcaggccctgaagctgcaaattgagggttcagacccctcctttaattacaagaaggaaacgcctctgtag

SEQ ID NO: 44280 - DNA, 3753 bp, Artificial Sequence
  Description of Artificial Sequence: Synthetic coding sequence
atgaagcccccccagcagagcctgtacctgctggtggacagcgtggacgagggttgtaacattaccgagggtgaacagacctctactagcctgagtgggactgtggccgcccttctggccggccaccatgaatttttccctccttggctactgttgctttgctccgcccggaagcagtccaaggcagtcactaagatgtttaccggttttcggaagatctcactcgacgacctgaggaaggcctacatcgttaaggacgtgcagcagtatatactgcacagattggatcaggaggaggccctgcggcagcacctgactaaggagactgcagaaatgctaaatcagctgcacatcaagtcttccggctgtttcctctatttggaaagagtactggacggagtggtggagaactttatcatgttgagagaaatccgcgatatccctggaactctaaacggcctatacctttggctttgccagaggttgttcgtccgcaaacagtttgcgaaggttcagccgatactcaatgttatcttggctgcttgtcggcccctgacaatcacagagctctatcacgcagtgtggacaaagaatatgtctcttactctagaggacttccagagaaagctcgacattctgagcaagcttctcgtggatggcctcgggaataccaagattctgttccattatagtttcgcagaatggttgttggatgttaagcactgtacccagaaatacctgtgcaatgccgccgagggtcacagaatgcttgctatgtcctatacttgccaagctaagaacctgacgcccttggaagcccaggagtttgctttacatctaatcaactctaacctccagttagagacagccgagcttgcattgtggatgatctggaatggaacccctgtgagggactcgctttcaactcttatccccaaggagcaggaggtgctgcaactgctggtaaaagcgggcgctcacgttaatagcgaggacgaccgcacatcatgtattgtgaggcaggcccttgaaagagaagactccattcggacgttgctcgataatggcgcctcagtaaatcagtgtgacagcaacggccgcaccctcctcgccaatgccgcttactctggtagcttagatgttgtcaatctgctggtttctcgcggagctgaccttgagattgaagacgcgcacggccatacccccttgactcttgcagccaggcaggggcacaccaaggtggttaactgtttaatcggatgtggcgccaatattaatcatactgaccaagatggctggaccgccctccgatctgccgcctggggcggccacacagaagttgtcagtgcattgctgtatgctggagtaaaggttgattgcgcagacgcagattctcgaacagccctgagagcagcagcatggggaggacatgaggatatcgtgctcaacctccttcagcacggcgcagaggtgaataaagctgacaatgagggtcggacagccctgattgcagccgcatatatgggtcacagagaaattgtggaacacctgctcgatcacggagcagaagtgaaccatgaagatgttgacggcagaacggcattgtccgtcgcggccctctgtgtaccagcctctaaagggcacgccagcgtggtcagtctgctaattgaccgcggtgcagaagtggatcattgtgacaaggacgggatgacacctctgttagttgccgcatacgaaggccatgttgacgtggtggacctacttctggagggaggagctgatgtggaccacaccgacaataacgggagaaccccacttctggccgccgcctcaatggggcatgcctctgtagtgaacacactgctcttctggggcgccgccgtggacagtatcgatagcgagggccggaccgtcctctccatcgcaagcgcccaggggaatgtcgaggtagtgcgcacactgctcgaccgaggcttggatgaaaaccaccgggatgacgccggctggacgccacttcacatggctgcattcgaagggcatcgattgatttgcgaggcattgatcgagcaaggcgcacgtaccaacgagatcgataatgatgggaggattccatttattctcgcctctcaggagggtcattacgattgcgtgcagatccttctggagaacaaatccaatattgatcagagggggtacgatggccgcaacgcgttacgcgtggctgcattagagggccatcgcgatattgtcgagcttctgttctctcatggcgcagacgttaattgcaaagacgcggacggccggcccactttatatattctggcgcttgaaaatcagctaacaatggccgaatattttctcgaaaacggcgccaatgttgaggcaagcgatgcagaaggcagaacggccctccatgtttcctgttggcagggtcatatggaaatggtccaggttctcatcgcataccacgccgacgtcaacgccgctgacaacgaaaaaagatctgcactgcagtctgccgcttggcagggccacgtcaaagtggttcaattattgatcgagcatggagctgtggtagatcacacttgcaaccaaggcgccacagctctctgcattgcagcacaagaagggcacattgacgtagttcaggttctgctggaacacggggctgacccgaatcatgctgatcagtttggacgcactgcaatgcgggtcgccgccaagaatgggcactcgcagatcattaaacttctcgaaaagtacggcgcgagcagtttaaatggctgcagcccgtcccctgtccacacaatggaacagaaaccactgcagtcactcagctccaaagtccagtcacttacgataaaatccaacagctctggctccactggaggcggggacatgcaaccctccttacggggcctgcccaatggacctactcacgccttttccagcccttctgagtctcctgatagcactgttgaccggcagaaaagcagcctttctaacaacagccttaaaagctcaaaaaacagctccctccgcactacaagctctaccgcaactgcgcagaccgtgccgatcgactctttccacaacttaagttttactgagcaaattcagcaacactcgcttcctagatctaggagtagacaatccatcgtctctccttcgagcacgactcagagtcttggacagtcacataacagcccttcctccgagttcgagtggagccaagtgaaaccgtctttgaagagtaccaaagcctcaaaagggggaaaaagcgaaaactcagccaaaagcggctcggctgggaagaaggccaaacagagtaactcctcccagccaaaagtgttggagtacgaaatgacacagtttgataggcgcggacctatcgccaagtctggcactgctgctccccccaaacagatgcccgcggagagtcagtgcaagatcatgataccctccgcccagcaggagattgggaggagtcagcagcagtttctcattcaccagcaaagcggagagcagaagaagcgaaatggcatcatgacaaatccaaactaccatctgcagtccaatcaggtctttttaggccgggtatctgtgcctaggaccatgcaagaccgcggccatcaggaagtgttggaaggctacccctcctctgagaccgagttatcattgaaacaggctcttaaactgcagatagagggatcagatcctagtttcaactataagaaggagacccccttatag

SEQ ID NO: 44281 - DNA, 3231 bp, Artificial Sequence
  Description of Artificial Sequence: Synthetic coding sequence
atgggcatcctgagcatcaccgaccagccccccctggtgcaggccatcttttcacgcgacgtagaagaagtgagatccctgttatctcaaaaggaaaacatcaacgttctggaccaagaacgcaggacaccactgcacgctgctgcttacgtcggagacgtcccaattcttcagcttctactgatgtccggggcaaacgtcaatgctaaggacactctctggttgacacccctccaccgagcagctgcttcaagaaatgaaaaagtgctgggcctgttgctcgcccatagtgcggatgtgaacgcaagggataaactgtggcagactcccctacatgtggctgccgccaatagggccacaaaatgtgctgaagccctagcccctttactgagctcgctgaatgtggcagaccgatcaggaaggagtgcgttacatcatgctgttcattccgggcacctggagaccgtgaaccttctgttaaacaaaggtgcttcattgaatgtgtgtgataaaaaagagcggcagcccttacattgggcagcattcttaggccaccttgaggtactgaagctgctggtcgcccgtggagctgatctcggatgtaaagatagaaagggctatggactgttgcacaccgccgccgccagtggacagatagaagtagtgaagtacctgcttcgaatgggcgcagagattgatgagcccaatgcctttggcaataccgccttacacattgcatgttatctcggtcaagacgcggtggccatcgagctcgttaatgccggagccaacgtcaatcaaccaaatgacaaaggcttcacgcctctgcacgttgccgccgtttctactaacggagcattgtgtctggagcttctggtaaataatggcgctgacgtgaactatcagtcgaaggaggggaaatctcccctgcacatggccgccatccatggacggttcacacgctctcagatcttgatccagaacggcagcgagatcgattgtgctgataaattcggcaatacgcctctgcatgttgctgctcggtatggccatgagttactgattagcactctcatgaccaacggcgctgacacggctcgacgggggattcacgatatgtttcctctccatctggcagtcctgtttggcttttccgactgctgcaggaagctcctgtcgtccgggcagctgtactcaattgttagctccctatccaatgaacatgtccttagcgctggtttcgacattaacacaccagataacctgggacgcacttgcctccacgccgccgcttccgggggcaacgttgaatgtttaaatttgctgctgtcaagcggcgctgacctgcgccgacgcgataaattcggcaggactcctctccactatgcagcagctaacggcagttaccagtgtgccgtaactctggtgaccgccggcgctggtgtcaacgaagccgattgcaagggctgttctcctttacactatgctgccgctagtgacacctacaggcgtgccgaacctcacactcctagttcccatgacgccgaggaagatgagcccctgaaagaatctcgcaggaaagaggcgttcttttgtctagaatttctcttagataacggggccgatccaagccttcgggacagacaaggctacactgcggttcactatgcggccgcttacggcaacaggcagaatctggaactactcttggagatgagcttcaactgtctggaagacgtggaatcaacaatccctgtatcccctctgcatctcgcagcctacaatgggcattgtgaagccctcaaaactctagccgaaactctagtgaatctcgatgttagggaccataagggacggacggcgctgttcctggctacagagcgaggcagtaccgagtgtgtggaagtgctcactgcgcacggcgcaagtgctctgattaaagagcggaaacgcaagtggacacctcttcacgccgccgccgccagcggtcacaccgattcactccacctcctgatagactctggtgaacgcgcagacataaccgacgtgatggatgcctatggccaaacccccctcatgctagcgatcatgaatggtcacgtagattgtgttcatctactgcttgaaaagggctccacagccgatgccgccgacctgcgggggcgcactgcactgcatagaggagctgtgactggctgcgaggactgcttggccgccctgttagaccacgatgcctttgtgctgtgccgggacttcaaaggacggactcccattcacttggcaagcgcatgcggtcacacggccgtgctccggacgttgctccaggcagccctgagcacagatcctctagacgcaggagtggattacagcggctacagccccatgcattgggcctcctatacgggtcacgaagattgtttggagctcttgttggagcattccccattcagctatctggagggaaatcccttcactcctttgcattgcgcagtcataaacaatcaggactcaacgacggaaatgctactcggtgctctaggggccaagattgtgaactcacgcgacgcaaaagggcgcacccccctgcatgccgcagcattcgccgataatgtcagcgggcttagaatgctgctacagcaccaggcagaggttaacgccacagaccacacaggaagaaccgctctcatgaccgcggccgagaatggacaaacagccgccgtggaattcctgctgtaccgggggaaagctgatctaacggtcctcgatgagaataagaacaccgctctgcacctcgcttgctcaaaaggacacgaaaagtgtgcactcatgatattagcagaaactcaggatttgggactgattaatgcaaccaatagcgcacttcagatgccgttacacattgccgctcggaatgggctcgcgtccgtggtccaagctctcctctctcatggagctaccgtgctggctgttgatgaagagggtcacacgccagcactggcttgcgccccaaataaagatgtcgccgactgccttgccctcattctgagcaccatgaagccatttccgcccaaggatgccgtctccccattttcattctcgctgcttaagaattgttcgatagccgctgcgaagaccgtgggggggtgcggggctctcccccacggtgcaagctgtccatattcacaggagcggcccggcgccattggcctcgatggatgttacagtgaatag

SEQ ID NO: 44282 - DNA, 3231 bp, Artificial Sequence
  Description of Artificial Sequence: Synthetic coding sequence
atgggcatcctgagcatcaccgaccagccccccctggtgcaggccatcttcagcagggacgttgaagaagtgaggtctctgctgagccagaaagaaaatattaatgtgttagatcaagaacggcgtaccccccttcatgctgctgcttatgtgggtgatgtacccatcctgcagttactcttgatgtctggtgcaaacgtgaacgctaaggatacgctctggctgaccccgctgcatagggcagctgcttctcgtaacgaaaaggtgctggggcttctgctcgcacattctgctgatgtgaatgcgagagacaagctctggcagacccctctgcatgtcgctgccgccaatagggctaccaagtgcgcagaggccttagcacccctgctgagttctctgaacgtggcggaccggtcaggcaggtcggctctccaccacgccgtccatagcggccatctcgaaaccgtgaacctgctgctgaataagggagcaagtctgaatgtatgcgataagaaggaaaggcagccgttacactgggccgcctttttgggccacctggaggtgttgaagctccttgtggccaggggcgcagacctaggatgtaaggaccggaaaggttacggcctgctacacactgccgcagcatctggccaaatcgaggtagtgaagtacctcctgaggatgggcgctgagattgatgaacccaatgcattcggcaatacagcattgcacatcgcctgctatcttggacaggacgccgttgctattgaactggtaaacgccggtgccaatgtaaatcagcctaatgacaagggtttcacgccgctccacgttgcggcagtttcaacaaacggggcgctgtgcctggagctgctagtgaataacggtgcagatgtaaattaccaatccaaggagggtaagtccccattgcatatggcagctatccatggacgcttcacgcggtctcagatccttattcagaatggcagtgagattgattgcgccgacaagttcgggaatacacccctccacgtggctgctaggtacggccacgagctgcttatcagcacgctgatgacaaacggggccgacaccgctagacggggcattcatgacatgtttcccctccaccttgcagtcctttttggattttcagattgctgccgcaagcttctcagcagtggacagctgtactccattgtctcttccctgagtaatgagcacgtgctgagcgccgggttcgatatcaataccccagataatctcggccgaacgtgcctgcatgcagcagcatcaggtggtaacgtcgagtgcttgaatctgttactgtcctctggcgcagatctgcgccgcagagataaatttggacgaactccgctccactacgcggccgcgaacggctcctaccagtgcgctgttacgctggtcacagcaggtgccggggtgaacgaagctgattgcaaggggtgcagcccgctacattatgctgccgcctccgatacgtacaggagagcagagccacacacaccttcctcacatgacgcagaggaggatgaaccacttaaggagagccggcgtaaggaggcctttttttgtttggaatttctgttagacaacggagctgacccgagtctgcgggacaggcaggggtacacagcagtacactatgcagctgcctacggcaaccggcagaatttagaactcctcctggagatgagctttaactgtctggaagatgtagagagtaccatccccgtcagtccgcttcacttagcggcttacaacgggcattgcgaagccctaaaaaccctcgccgagacccttgtgaatttggacgtccgggatcataaaggccgaacagcgttgtttctcgccaccgagcgtggatctaccgaatgtgtcgaggtgctgacagcacacggggcctctgcattgattaaggagagaaagaggaagtggacgcctttgcatgctgctgccgcctcaggccacacagatagccttcacctgctgatagattccggagagcgagctgacattaccgatgtaatggacgcctacggtcagacacccctgatgctcgccatcatgaatggccatgttgactgcgtgcatctgctcttggaaaaaggctccacggcagatgccgccgatcttcgaggtcgcacggccctgcaccgaggagcagtcaccggctgcgaggactgcctagctgcccttttagaccatgacgcctttgtgctttgtcgggactttaagggtcgaactcccattcacctcgcaagcgcatgtggccacaccgcagtccttaggaccctcctccaagcggcactgtccacagatcccctggatgcgggggtcgactactccggatattcccctatgcactgggccagctatactggccatgaagattgtttggaattgctgctggaacattcgccattctcatatctagagggtaacccctttacaccactgcactgtgcggttattaataaccaggacagtaccacagaaatgctgctcggggccctgggggcgaagatcgtcaattcccgggatgccaaggggagaacccccttgcacgccgcagcttttgccgataacgtgagcggactgcggatgctgctgcaacatcaggctgaagttaatgcgactgaccacactggacgaaccgcactgatgacagctgccgagaatggccaaacagccgccgtcgaatttttgctgtatcggggcaaggcagatctaactgttctggacgagaataaaaacactgccctgcatctggcatgtagtaaggggcacgaaaagtgcgcactcatgatcctggctgagacgcaagatctcggcctgataaacgctaccaacagtgccctacagatgcctctccatatagccgcccgcaatgggctggccagcgtggtacaggccctgttgtcccacggcgctaccgtcctggccgtggacgaagaaggacacaccccagccctggcctgcgcccccaacaaggatgtggccgattgcttggccctcattctgagcacgatgaagcctttccccccaaaggatgccgtgagcccattctctttctcactattgaagaattgttcaatcgccgctgcaaagacggtcggcgggtgtggagcattaccacacggggcctcctgcccttactcccaggagcgccccggagctattgggctggatggctgctacagtgagtag

SEQ ID NO: 44283 - DNA, 1032 bp, Artificial Sequence
  Description of Artificial Sequence: Synthetic coding sequence
atggccagcgccggcagcaccgcccggcgggccggcagcggcagctggcacagtgagaggggagaagggagaggggcccggccacaaccaacgccctccgggtcaatgcagcaggcaaacaaagtgtctctgaaagccacctggactgacgccgaatctaagcagccctcacagccattgccagatctggcggatcacctgtctgcacaggccaccgcgctcgccaggccgagaagaccagcgagtcttaccccccctcgggctgacccatcccctagtaaggagagcgatcagaccgcgattgaccaaacagcaatcgggagttactaccagcttttcgccgctgcagtaggcaatgtagagtggctccgtttttgtttgaaccagtctctgcgtgagatacctaccgacgataagggattcaccgccatacacttcgccgcccagtggggcaagctcgcctgcttgcaagtcctggttgaggagtataaattccctgttgatctactaaccaacaactctcaaaccccactacatttagtgatccacagagacaatactacagtcgcactgccctgtatctattatctgctggagaagggagctgatctcaatgcccagacttgtaacggctccacgcccttacacctggccgcgcgcgacggcctgctggattgcgtgaaagtcttggtacaatctggagccaatgttcatgcccaggacgctatgggctacaaaccgatagacttctgcaagatttggaatcacagggcttgtgctcgcttcttaaaggacgccatgtggaaaaaggacaaaaaagacttcgcaagagagatgacaaagatgaagatgttcaaatctcaacttaccctgatggaacataattatctgatcgagtaccagggccagggatgcagtgtgcacttcccatttgcattttctcccataactcctgagacccttctgtggcaagatatcagtctgctcagtgactgcggcttcctgtggaggagacgcgagctgtccttttag

SEQ ID NO: 44284 - DNA, 1593 bp, Artificial Sequence
  Description of Artificial Sequence: Synthetic coding sequence
atggccagcgccggcagcaccgcccggcgggccggcagcggcagctggcattccgaacgaggagaaggccgcggggcacgccctcagccaaccccgtccgggtccatgcagcaggccaacaaggtcagtcttaaggccacatggacggacgctgaaagtaagcagccatcacagccattaccagacctggcagatcacctctccgcacaggcaactgcattggcgcgacccagaaggccggccagcctaacgcctccacgggcagacccttctccgtctaaagaaagcgaccagaccgctatcgaccagaccgccatcggatcgtattaccagctctttgccgccgctgtgggaaacgtggagtggctgaggttctgtctgaatcagagcttgcgggagatccccacagacgacaagggttttacagctatccatttcgctgcacagtggggtaaattagcctgtctgcaggttctggtggaggaatacaagttcccagtcgaccttctaacgaacaatagtcagacgcctcttcatctcgtgatccatagagacaacaccacggtcgccttaccctgcatatactatttgctggaaaagggcgctgatctcaacgcccagacatgcaatgggtcaacccccttgcacctggcagcccgagatgggttactggactgtgtcaaggtgctcgtacagtccggagccaacgtacacgcccaagacgccatgggctacaagccaatcgacttttgtaagatatggaaccacagggcttgcgcacggttcctcaaggacgctatgtggaagaaggataaaaaagactttgcaagggagatgacaaagatgaaaatgtttaagagccagctcactctcatggaacataactacctgatcgagtatcagaaagagcacaagatcctaagggaggcggccattagaaagtggctacacggaaagctgcacccgggccattctctagtgtccaacactaaacaggctcgggcgacggccctctccaaaacccccgagcagcgcgaaagccagcgtagcagaagctttcatcctagcgtcgacgccaggctgcaatgcatcccacaacccacagagatgccgaaacctatatatcggaaacctaccgtaaagagacccactatgtggaacgtaagcaataatcctgcccggcccccaacgacccaaatatctcacagccagggaattcgccttggggtccaccccgatccaacgcctgagcatgacttcagttcttttctggaggtgaggcccgatggtcacgggggggctagactgcacaccgtcgatggacattgggttgcacccgtgccccgtttgcccttcgaggtgctactccgcatgttatatcccagggtatggccctaccgcatgaaggtgccccagggcttctaccctatatccatgagagaggtgccccggaagcggcatcttggtgataacactttttggacagacacactggccatgaacctacgtgacactttcgacgaagcattcctggcagctgtgcgcagtcaccaaggcttgccaacactaccatctccacagacgaatccctag

SEQ ID NO: 44285 - DNA, 1845 bp, Artificial Sequence
  Description of Artificial Sequence: Synthetic coding sequence
atgatgcggcaggccaccatggacttcagcacccccagcgtgttcgaccagcagaggggagactcctccgaagaagttgatttgactatggtataccaggctgcctccaacggcgacgtgaatgcactgaccgccgtaatccgcgaagatccatctatcctcgaatgttgcgacagtgagggctgcaccccgctcatgcacgcagtctcgggccggcaggccgataccgtcaaactcctgctgaaaatgggagcaaatataaatatgcaagatgcctatggcagaacgagcctttgcctggctacctatcttggctggctggaagggtgcgtaagcctccttcgaaacggcgcaaaacacaatatccctgataagaatggccgcctgcccctgcatgctgcaaccgccgaacctgacatgaggttgctcaccgtgcttttgcagcagtccaatattagcgagatcaatcatcaagacaacgagggcatgaccccacttcattgggccgctttccataaccagccacagcacacccagatgttgcttaaaaaaggggccgatccgaccctggtcgataaggatttcaagaccgcgctccactgggctgtccaatctggtaataggatactgtgttcaattatccttagccatcatcaggggccttctataatcaactacgacgacgagtccgggaaaacatgcgtccacattgccgcggctgcagggttcagcgatatcatccatgagctggcccgcgtacccgaatgtaatttgcaggccttggacgtggacgaccgtacccccctgcactgggcggctgctgcaggtaaggccgaatgcgtacagtctctgctcgagttagggatggattccaacttgcgggatatcaacgagtcgactcctctggcatacgcattatattgcgggcacacagcgtgtgtcaagctgctgtctcaagagtcccgcacagaaccaaccagaccccctcccagccagtcctctagacctcagaagaaggagcgccgattcaatgtcttaaaccagatcttttgcaaaaataaaaaggaggagcaaagggcccaccagaaggacccttcaagggatcggtacagggaggaagatacttctgaagttaatgatataattacaacgtttgacagcattgttggaacaaattgtcaggaacaacctggcgatcaggtcgcaatggtggagttcaaaaaaaagacctctgataatagcaagtacttactgcccgaaaagaagcccttggcacgcaaggggctgcctcctatccgcacccagagcctacctcccatcaccctggggaacaatttcctgacagcatcccaccgtgccacctcacacgcggggctgtcaagcgcaccccatcacatggcacaacggtcacagaaaagcaggagtgagcaggatctgctgaacaacaggaccgggtgccagatgctgctcgacaatccttggaagagtgacagcaatcaggttttttcgtacaaggtgtggactgtaagctcctctgataaactactcgacagactgctatccgtaaggcccggacaccaggaggtctcagttcctccgcatctcaggcatctgcacaacccctcctccgggcagaacttccaacacctgagtcccaaccgtcacaagatacgggacctcccatttactaggaataatctggcaccactccctgatcagaagtttctcagcggcgagccccttcggacaaaccgcgtacttcctgctattccttcacaacggcgacactctacggcagcagaggagagtgagcacagtgctaaccccactagtgatgagaactag

SEQ ID NO: 44286 - DNA, 981 bp, Artificial Sequence
  Description of Artificial Sequence: Synthetic coding sequence
atggacagcaacctgcgggacatcaacgagagcacccccctggcctatgccctgtactgtggacataccgcctgcgtcaagctactctctcaggagtccaggaccgaacctacgagaccccctccatcacaatcttctcgccctcagaagaaggagagacgttttaacgtcctcaaccaaatcttttgcaagaataagaaagaggaacagcgggcacaccagaaggatcccagccgtgaccggtaccgcgaggaggacacgtccgaggtaaatgatatcattaccacatttgattccatagttggcaccaattgtcaggaacagccaggagatcaggtagcgatggttgagttcaagaaaaagaccagcgacaattcgaagtatctgctcccagaaaaaaaaccactagctagaaagggacttcctccgatccgcacacagtctctgcctcccataaccttagggaataactttcttaccgcctctcatcgcgccacatcgcacgccggcctttcctccgccccacatcacatggcccagaggtctcagaaatcccgttccgaacaggacctgctgaacaatagaaccggatgtcaaatgctcttagacaacccttggaagtctgactccaaccaggtgttctcatacaaagtttggactgtttcctcatctgacaaactattggacaggttgctgagcgtacgccctgggcaccaagaagtgtcggtcccaccccacctccggcatcttcataatcccagttcaggccaaaatttccagcacttatccccaaacagacacaagatccgggacttgcccttcactcggaacaacctggcacctctccctgaccaaaaattcctctcgggggaacccctacggactaacagggtgctgcctgcgatcccaagtcagagaagacattccaccgctgcagaagagtctgaacactcagccaaccctacttcggacgagaattag

SEQ ID NO: 44287 - DNA, 1845 bp, Artificial Sequence
  Description of Artificial Sequence: Synthetic coding sequence
atgatgcggcaggccaccatggacttcagcacccccagcgtgttcgaccaacaacgaggggactcgtccgaggaggtggatctgactatggtttaccaggctgcctcgaacggtgacgtcaacgccctaacagccgtaattcgcgaagaccctagcatcctggagtgctgtgattccgaaggctgtacgcccctcatgcatgctgtcagcggtagacaagcagatacagtgaagttgcttctaaaaatgggcgctaatatcaatatgcaggatgcttacggccgaacctcgctgtgcctggccacttaccttgggtggcttgaggggtgtgtgtctctgctgagaaatggggccaaacataacatcccagacaagaacggtcggctgccactgcacgcggctactgcggaacccgatatgcgtctcctgaccgtgttgctgcagcagtctaacatatctgagataaaccatcaagacaatgaaggaatgactccccttcattgggccgcctttcataatcagcctcagcatacgcagatgctgctgaaaaaaggagctgatccaactctggtggacaaagatttcaaaactgcactgcattgggcggtgcagtccggaaaccgcattctttgctcaatcatcctgtctcaccaccaggggccgagtattattaactacgatgacgagtctggtaaaacctgtgtgcatatcgctgccgcagctggattctctgatatcatacatgaacttgcaagggtgcccgaatgtaatttgcaggcgctggacgtggacgatagaacccctcttcattgggccgctgccgcagggaaagcggagtgcgtgcagtccctgcttgagctgggtatggattccaaccttcgcgacattaacgagagtacacccctggcatacgccctgtactgtggacacactgcatgtgtgaagttgctcagtcaggaaagcaggactgaaccaacgcgcccacccccctcccagtcgtcccgacctcagaagaaagaaaggcgatttaacgttctgaaccagatcttttgtaagaacaagaaagaggagcagcgagctcaccaaaaggatccatccagagacaggtaccgggaagaggataccagcgaagtgaacgatatcatcaccacattcgattctattgtggggacaaattgtcaggaacagcccggagaccaggtggcgatggtcgagtttaaaaagaagacctcggacaatagtaagtacctgctgcccgagaagaagcctttggcacgaaaaggcctcccgccgattagaacacagagcttgccccctatcacactggggaataacttcctgaccgccagccacagggcgacttctcacgccgggctgagttcagctccacaccacatggcccagcgtagtcaaaagtcccgctccgagcaggacctcttaaataatcgaaccggctgtcagatgcttcttgacaacccgtggaaatctgatagcaatcaggtgttcagctataaggtctggacggtctcctcaagtgacaagctcctcgacagactcttgagcgtgcgccccggccatcaggaagtatctgttccccctcatctgaggcacctccataatcccagcagcgggcagaattttcagcacctgtcccctaaccgacacaaaatcagagacttgccgttcaccaggaacaatttggccccgctacctgatcaaaagtttctgtcaggagagcctttgcgcacgaatagagttctgccagcaatacctagtcagcggcgtcactcaacagcagccgaagagtccgagcacagtgccaatcccacatctgatgagaactag

SEQ ID NO: 44288 - DNA, 2382 bp, Artificial Sequence
  Description of Artificial Sequence: Synthetic coding sequence
atggcccgggagctgagccaggaggccctgctggacttcctgtgccaagctggcggccgcgtcacaaacgccgctctactctcccacttcaaatcattcctccgcgatcccgacgcctctccatctcagcaccagcatcgccgtgagctgtttaagggctttgtgaactccgtggccgcggtgcgccaggatccggacggtaccaagtacgtggtgcttaaaaggcggtatagggacttgctgggcgaggagggtctccagcggccgcgagagccacccgcagccgccccttctgccggaggtgccgccccttgtagcccaagaggtgcacggaggggggagccgccccaacaacaacctcgcaggaggcggagggagaaggaacccgaggaggaaccagctggggccgcagctcgcgccgctgacgcagcctgcaatggactccctggcagcgactcaagaagggctcccggcaagggaggtgggtctaagggcagccccggacagcgtccaccagtgcccgccgcagccgcagccggcgcgcaggcacgagcaagctgcgcggctgcgaagacacaagggaggtgttgctgggaatgtttgcagaataatttggccgtgttgccaggcgaactgggcgcattgccacatagcgcaactgccgaagagaagcccgcccgagcccttccagcccaggacgaccgcggcgcttcccgagaaagggaagagggcgcgctggccgagcctgctccggtccctgcagtggctcactctccccccgccacagtggaagccgccacaagtcgggctagccctccagcccttctccccgggcctgcaccgcgaggtgacaggcccgagctcctgacaccttcctctttacactatagcacgctgcaacaacagcaacaacggactcgagaatgggtggcacggcaccctcaggtgcctgaggcccgcgaccagggtcctatccgtgcctggtccgttcttccagacaattttttacagttaccactggaacctgggtccactgagccaaatagcgagccccccgatccgtgcctgagtagtcacagccttttcccagtggtgcccgacgagtcatgggagtcttgggccgggaacccatccctcactgtgttccgctctatcagatgtcaactttccctccaggacctcgacgattttgtagatcaggagtctgacggcagcgaagaatcctcttcaggccctaaggatagtccaggcgcctccgaggagggtttacaggtcgtgcttggaacccccgacagaggtaagcttcgaaatcccgcgggcggattaagtgtatctcgtaaggagggatcacccagtagatcacctcaaggcctccgaaatcgcggtgacggacatatatcacaacaagtgccagctggagccaatggactggccgggcacccactaaaaccacttccgtggcctgtgcccaagctccggcgatctctacgccgttcctctcttgctggcagagccaagctttcaagcagcgatgaggagtatcttgatgagggattgttgaaaaggagtcggaggcccccacgctctaggaagccaagtaaggcgggaacagccccttcacctcgtgtcgatgccggtttaagccttaaactggccgaggtcaaggcagtggtggccgagagaggatggagacattcattgtgggtgccaagtggcgaggggtccgctgctcttgccccccataggacaagcgagcataagtctagtcttgttccgctcgatgccagagagcatgaatggattgtgaaactcgcctccggctcatggatccaggtctggactctcttctgggaggatccgcagctggcactccacaaagactttctgacgggatacacagccctgcattggatcgctaaacatggtgaccttcgcgccctacaggacctggtgtccggcgctaagaaggccggaatcgtcctcgatgtgaacgtaaggtcaagctgtggttatacgccactccatctggccgccatacacggccaccagggagtaatcaagctgctcgtgcagagactggcatccagggtgaatgtgcgagacagttcaggtaagaaaccctggcagtatctgacttccaacacttctggagaaatctggcaactgctcggggccccccgtggaaagccgatcttcccagtgtatcccctggtcggcagctcctcaccaacccgcaaggccaagtcgaaggagatctcacgttcagtaacaagaaagactagcttcgccgccctcctgaagtctcagcataacaaatggaagctggcaaaccaatacgagaaatttcattctcccagggaaagggaggagtactccgactag

SEQ ID NO: 44289 - DNA, 1578 bp, Artificial Sequence
  Description of Artificial Sequence: Synthetic coding sequence
atggagggccccgccgagtggggccccgaggccgccctgggccccgaggccgtcctcaggttcctagcggagcgcggcggtcgggctctccacgccgagctggtccaacacttccgcggcgccttgggcggagagccagagcagcgggcccgggccagggcacacttcaaggaactggtgaatgcagtagctactgtgcgggtcgacccggccgacggcgcaaagtatgtccatctgaagaaacgcttttgtgaaggccccagtgagccttctggcgacccaccacgcatccaggtgacagctgagccggaggcaccggatggacccgctggtccagaagcgcgcgacaggttgccagatgccgcagctccagaaagcctccccggacaggggcgtgagctgggggaaggggagcccccagcgccggcccactggccaccattatcagccggggcccgccgcaaaaacagccgaagagacgttcagcccctcccgagaacgcctgccccgggtccttctgaagacctggaactgccgccccatggttgcgaggaagctgaccgtgggtcaagcctggtgggggccactgcccagaggccagcgcgtcaaaatctccgcgatctggtaatgggaagcagcccccagttgaaacgaagtgtctgccccggagggtcctcccccgggtcatccagcgggggtggccgagggagaggcgggggagactccgacagcgccagcgtggccagctcctccgccgaggaagaaagctctggcggcgggtctgtcaccttagaccctctcgaacacgcatggatgctgtcagccagcgatggtaagtgggactctcttgagggcctcttaacctgtgagccagggctcctcgtaaagcgagatttcatcaccggtttcacatgcttacattgggcagcgaaacacggtagacaggagcttttggctatgctggtcaattttgccaacaagcaccagctgccagtcaacatagacgctagaaccagtggaggttacacggccctccatttggcagcaatgcacgggcacgtggaggtagttaagctcttggtgggcgcgtatgatgccgatgtcgacattagagattactctgggaagaaggcctcacagtatctgagtcgcagcatagcagaggaaatcaaaaacctggttggcgccttggatgaaggcgacggagaaagcgcagcgggcagcggtggtggtagatggagactcagcaaagtgctaccctctcatctgatcacctataaattgtcccacgcacttgaagatgggggagaccaccaccaccaccaccatagcgccgaaggctgggttggaggtaaggcaaaggaccctggtcgtaaggcgtccgggtccagctcaggcaggattaaacctaggctaaataagattcgcttcagaacccagattgttcatacaaccccttcattccgggaccccgaacagccgctggagggtcgcggagaggaaggcgtgggggaggagaggcccgttaaaggccactctccctttacccttcggccaaaaagcaatgtcttcggctag

SEQ ID NO: 44290 - DNA, 948 bp, Artificial Sequence
  Description of Artificial Sequence: Synthetic coding sequence
atggcccagctgggcggcgccgccaaccgggcccccaccgccagcctggctccaacgtctcaaagtctgaggtgtgcaccacagccccgcccctccagggcagatactgggtccctgggaagatactggggaaaagcagctgccgcagcctcccgggagcatcctttccctggtacattgatgcattctgccgccggatccggccgcagacgcggagccctgcgagaattgctgggattgcagcgtgctgctcccgctgggtggttatccgaagagagagcggaggaactgggtgggccatcaggacccgggagctccagactgtgtttggaaccgagggaacacgcctggatactggcagccgcagaggggcgctacgaggtgctgagggaactcttagaagcggaaccagaactgctcctgcggggagatcctatcacggggtactccgtactccattggctagccaagcacggcaggcatgaggagctaatcctggttcacgactttgccttacgccgaggattaaggctcgatgtgagtgcccctggcagtggggggctgactccgctacatctggccgctcttcaggggcacgatatggtgatcaaggtgctggttggggccttaggcgcagatgcgacccgacgggaccactcaggtcatagagcgtgccattacttgcggcctgacgccccgtggcgcttacgagagctgtctggcgccgaggagtgggaaatggaatccggctccggctgtacgaatctgaacaacaactcttcgggcactaccgcctggcgcgccgctagcgctgtgggtgccactgctgtggaaacgtccagacgagtggcagcctcccggaccaaggccaaggacactgccgggagcagagtagctcagatgcatagtctgtttaggcaccttttcccttctttccaggacaggtag

SEQ ID NO: 44291 - DNA, 1026 bp, Artificial Sequence
  Description of Artificial Sequence: Synthetic coding sequence
tgagcctggggcatgcggcgggccgccgccggcgccggcggcgccagagctgcagggcccacaggcggtgcctcgcggctccatccaaatgccgggcggcgctctggcgcaagagctggcgcgcaaggatgcggggggccccgcgtagggtccgccgattcccgtgccctacctgcacagccactcgcatgtgcacgcgggcgttcgcagagactcgtctgcgatccaaaagcggcatcagctttacctgacctcgcgccagatgtgtttgttctccgggtgcggctagaggagaccggggaaatgttccgggtggcaaattgccgtggagatatgacggttagggaactgaaagaagagctcgatctcatggtgggcattccttttaacttgcagcgcctccagtatctggacgagggcgtactgatggatgacactacactgaagttccatgatgtggtgcccgggggaattattagtctttgcatttggcatcacgacggctggactgagctcgttctggcagccgttgagggcgaccccagcaagctgagttgcctcgggttgaccgaagatagcttctatcgaacagccaactctgagcattttgagggtgaaaaatggaaacattggacctcccagcgggcattcgtagccctttacgtcgccagtcacagggggcacttcgatgccgtgcaatatcttctagaacacggcgcctcatgcctttccagatcccctctcggccgtacccctctgcacgtggctgcagctatgggacggtctgattgtattattctccttctccaacatggggcttccattcacgaccgggatgctaaaggagagacccctatatccatcgcccaccggttgaaccatactttgtctgagaggcagatggtgctgctccatcgcatcgccaagtcaggcatccgagacctgaatgaccttgtcatgaaaaacgccctacaaagggtgaaaagtggttttagatcggagaagatgaccatgacgccccattag

SEQ ID NO: 44292 - DNA, 1038 bp, Artificial Sequence
  Description of Artificial Sequence: Synthetic coding sequence
atgacccggggccgggcctggggcatgcggcgggccgccgccggcgctggaggtgcccgggccgccggccccactggaggcgcaagtaggttacaccccaatgctgggagacggtccggggctcgggctggagcacagggctgcggcgggcctagggtcgggtctgcagactcccgggctctgccagcccagcctcttgcgtgtgcccgcgggcggtcccagaggcttgtgtgtgaccctaaggctgcctccgctctcccagacctagctcctgatgttttcgtcttgcgagtgaggctagaggaaactggggaaatgtttcgggtggccaactgtaggggagatatgacagtgagggagctgaaggaggagttggacctgatggttggcatccccttcaatctgcagcggctgcaataccttgacgagggcgtcctgatggacgacactacccttaagtttcatgacgtggtaccagggggtattatttctctgtgcatctggcaccatgacgggtggacagagcttgttctcgccgcggtggagggtgaccccagcaaactttcctgtctcggcctgaccgaggatagcttttaccgcactgctaattctgagcattttgagggtgagaagtggaaacactggacgagccaacgggccttcgtcgccctgtatgtcgcatcccacaggggacactttgacgcagttcagtacctgcttgaacatggggccagttgtctaagcagaagcccccttgggcggaccccactgcatgttgccgctgccatgggccgctctgattgcataatactactgctccagcacggagcaagcatccatgaccgggatgccaagggggagactcctatctcaatagctcatcgcctcaaccatactttgagcgaaagacaaatggtcttgctgcacagaattgcgaagtccgggatacgggacctgaatgatctggtgatgaagaatgcactgcagcgcgtgaagtctggctttcggagcgagaaaatgacaatgacacctcactag

SEQ ID NO: 44293 - DNA, 2712 bp, Artificial Sequence
  Description of Artificial Sequence: Synthetic coding sequence
atggccacctggcggaagaaccgggacaaggacggcttcagcaaccctggttaccgggtgcggcagaaagacctgggaatgattcataaagcggccatcgctggagatgttaataaggtcatggagtctattctcctgcgattgaatgacttgaatgaccgcgataagaagaaccgcacagccctccttctcgcatgcgcgcatggtcgacccggagtcgtggctgatttggtcgcccgaaaatgccaactaaacttaactgactccgagaatcgtacagcgctaattaaggctgtgcaatgtcaagaggaggtatgcgccagtatactattagaacacggagcgaatccaaatgtccgcgacatgtacgggaacacagcacttcactacgccattgataacgagaatatctcgatggcaaggaagctactggcgtacggagccgacatcgaggcccggagccaagacggccacactagcctactcctggccgtgaatcgcaagaaggaacaaatggtggctttcctgctgaaaaagaagccggatctgacagctatcgacaattttggaaggaccgctctgatcttagccgcgcggaatggatccacctctgtcgtatatcagttattacagcacaatattgacgtcttctgccaggacatcagcgggtggactgctgaagactacgctgtggcaagtaaatttcaggccattcggggtatgatatctgagtacaaggccaataagcgatgcaagagtttgcaaaatagcaacagtgaacaggacctagaaatgacttcggaaggggaacaagagcgtctcgaggggtgtgagtcgagccagccccaagtggaggaaaagatgaagaagtgtaggaacaagaagatggaagtgtccaggaacgtgcacgcggatgattccgataactataatgatgacgtggatgaattgatccataaaataaaaaaccgcaagcccgacaatcatcagtcccccgggaaagagaatggagagtttgaccgcctagcacggaagacctcaaacgagaagtctaaagtgaagagccaaatttacttcaccgacgacttgaatgacatctccggcagctcggaaaagacttctgaagacgacgagctgccatatagcgatgacgagaactttatgctgttgattgagcagagcgggatggaatgtaaagactttgttagccttagcaagtccaagaacgccaccgctgcatgcgggcggtctatagaggatcagaaatgttactgtgaacggctgaaggtgaaatttcagaaaatgaagaacaatatcagcgtgctgcagaaggtgctttcggagaccgacaagacaaagagtcagtctgaacatcagaatctgcaaggcaaaaaaaaactttgtaacttacgatttatcctgcaacagcaagaagaagaacggattaaagcagaggagttatatgagaaggacatcgaagagctcaagattatggaggagcagtatcgtacccagactgaagttaaaaaacagagtaaattgaccctaaagtctcttgaagtggaactgaagacagttcgctccaatagcaatcagaacttccacactcacgagcgggagagggacttatggcaggagaaccatctaatgcgagacgaaattgctcgactgcgcttagaaattgatactatcaagcaccaaaatcaggaaacagagaataagtatttcaaggatatcgaaattatcaaggaaaacaacgaagacctggaaaaaaccttgaaaaggaacgaggaggccttgaccaaaaccatcactaggtattccaaggagcttaatgttttaatggacgaaaacacaatgctcaatagtgaactccagaaggagaaacagtccatgtctagattagagacggagatggaaagctatagatgcagactcgcagctgcactgtgcgatcacgaccagcgacagtccagcaagagagacctgcagttggcgttccaatcaacagtgaacgagtggtgtcacctgcaagaagacacaaatagccacattcagattctgtctcagcaactgtccaaagccgaatctacatccagtggcctggagactgaactgcattacgaaagggaggcccttaaagagaagaccctgcacatcgagcatatgcagggcgtcctcagccggacccagcgccgtcttgaggacattgagcatatgtaccagaatgaccagcctatactcgaaaaatacgtgagaaagcagcagagtgtcgaggacggattatttcagctgcagtcccagaatttactttaccaacagcagtgcaacgacgcacgcaaaaaggctgataatcaggaaaagacgataattaacattcaggtcaaatgcgaagataccgttgaaaagctgcaggcagagtgtaggaaattggaggagaacaacaagggcctgatgaaagagtgcacactgctaaaggaaaggcagtgccagtatgagaaagagaaggaggagcgagaagtggtcaggcgacaactgcagcgggaggtcgacgatgccttaaacaagcaactgctgctcgaggctatgctggagatctcatctgagcggaggattaacctcgaagatgaggcccagtctttaaaaaaaaagcttgggcagatgaggagccaggtatgtatgaaactgtccatgagcacagtgaccctgtag

SEQ ID NO: 44294 - DNA, 1920 bp, Artificial Sequence
  Description of Artificial Sequence: Synthetic coding sequence
atgaccagcgagggcgagcaggagcggctggagggctgcgagagcagtcagccgcaggtcgaggagaaaatgaagaaatgccggaacaagaagatggaggtgtcacgtaatgtgcatgctgatgatagtgacaattacaacgacgacgtggacgagctaatacacaagatcaaaaatcggaaaccagataaccaccagagtcccggaaaggagaatggtgagttcgatcgcttagcccgcaagacatccaatgagaaatcaaaagtgaagagccaaatctactttacagacgacctgaacgacattagtggctcatccgagaagacatctgaagatgatgagctcccctactccgacgacgagaatttcatgctgttgatcgaacagtcgggcatggagtgtaaggactttgttagccttagtaaaagcaaaaatgccaccgctgcatgtggacgctccattgaggatcagaaatgttattgcgagaggctgaaggttaaattccaaaaaatgaagaataacatatccgtgctgcagaaagtgctctccgaaactgataagacgaagtcacagtctgaacatcagaaccttcagggaaaaaagaaactgtgtaacctccggttcatactacagcagcaggaagaggaacggattaaggctgaggagttgtatgagaaagacattgaagaactcaagattatggaggagcagtatcgcacacaaaccgaagtcaagaagcagagcaagttgaccctgaagtctctggaagtcgagttgaagaccgtcaggtctaactccaatcagaattttcacacccatgaaagggaaagagacttgtggcaggagaaccatctgatgcgcgacgaaattgcccgcctgcggctggagatcgacaccattaagcatcagaatcaggaaaccgaaaacaagtacttcaaagacatagaaataatcaaggagaataacgaagaccttgagaagaccctcaaaagaaatgaagaagctctgactaagactatcaccagatacagcaaggaactgaatgtgctcatggatgaaaatactatgctgaactcggagctacagaaagagaaacagagtatgtcaaggttggagacagagatggagtcctataggtgcaggctcgcagctgccttgtgtgaccatgatcagagacagagcagcaaacgtgacctgcaactagccttccagtcaactgtcaacgaatggtgtcacctgcaagaggacacgaacagccatatccaaatcttatcccagcaactgtctaaggccgagtcaacctctagtggccttgagactgagcttcattatgaacgggaggctctaaaagagaagacactgcatatcgagcacatgcagggtgtgctctcgcggactcaacggcgcctggaggacatcgaacacatgtaccagaatgaccagcccatcctggaaaaatacgttcgaaagcagcaatctgtcgaagacgggctgttccaattgcagtcccaaaacctgctttaccagcagcaatgtaatgatgctcgcaagaaggccgacaaccaggagaagactataatcaacattcaggtgaaatgcgaggataccgttgagaagctgcaagccgagtgtcggaagctggaagagaacaataaaggccttatgaaggagtgtacactactgaaggaacggcaatgtcagtatgagaaggagaaggaggagagggaggtggtcagacgccagctgcaacgggaggttgacgacgccctgaataagcagctgcttctggaagcaatgctggagatctcctccgagcggagaattaatctggaagatgaagcccagtctctcaaaaagaagttgggccaaatgagaagtcaggtttgcatgaagctttctatgagcacagtcaccctgtag

SEQ ID NO: 44295 - DNA, 1143 bp, Artificial Sequence
  Description of Artificial Sequence: Synthetic coding sequence
atgctgaagcccaaggacctgtgcccccgggccggcacccggacctttctcgaggcgatgcaagccggcaaggtacatctggctcgttttgtgttagacgcactcgacagatcgattattgactgtcgggcagaacaaggtcgcacccccctcatggtcgcggttggattacccgacccagcactgcgtgccagattcgtgcgtcttttgctcgagcaaggcgctgctgtcaatctgagagatgagcgggggagaacagctttatcgctggcttgtgaaagaggtcacctggatgccgtccagctgcttgttcagtttagcggagacccggaggccgccgacagcgcaggcaatagccccgtgatgtgggccgctgcttgtggacacggcgcagtgttagagtttctggtgcgttcatttcggcgattgggcctccggctggataggacaaatagggctggccttactgctctgcagctagcggctgctagaggacatggaacatgtgtgcaggcgttgacggggccctgggggcgcgcagctgcagccgccgccgcacgcggctcgaactccgattctcccccagggagacccgcccccgctgcctctccagaacatcgccgccctagtcccagaagactcccccgtcccctgttggcccgcttcgctagagcagccgggggccacggcggggaagccgggtccgctgggaagaacagtgggaggcatcgtgcccaggggtctgagcggccggaactaggcagaagtatgtccctcgctctcggcgcggtgaccgaggaggaagccgctaggctgcgcgcaggtgcgctcatggctctgcccaacagtcctcagagcagtgggaccggacggtggcggtcgcaggaagtgctagagggcgcccccccgaccctggcccaggccccgatcggtctcagtccacaccctgaaggcggacctggcagcggacgactcggtctccgccgccgtagcacggcacctgacatcccttccctagtgggcgaagcaccagggcccgagtcaggccccgagctggaggccaacgctttatccgtgagtgtgcccggacccaatccatggcaggcagggaccgaggccgtggtgctcagagctcaaaggtag

SEQ ID NO: 44296 - DNA, 1200 bp, Artificial Sequence
  Description of Artificial Sequence: Synthetic coding sequence
atggacagccagcggcccgagccccgggaggaggaggaggaggagcaagagctcagatggatggagctggactctgaggaggccctcggaactagaactgaagggccaagcgtggtgcagggatggggacatctcctccaagctgtgtggaggggccccgcaggtctggtcacacagctgctgaggcagggagcttctgttgaagaacgcgatcatgcgggtcggacacctctacatctggccgtccttagggggcatgcacctttggtgcgactgcttttgcagagaggagctcccgtgggggcagtcgatcgtgccggcaggacagctctgcatgaagctgcttggcacgggcatagtagggtcgccgaattactcctgcagcgcggagcttctgctgccgcacgctctggaactgggctgacaccattgcactgggcagcagctttggggcacaccttgctcgccgcaagactgcttgaagcccctggccccggcccggctgccgcagaggccgaagatgctaggggatggacagctgcgcactgggccgctgctggagggcggctcgcagtgctggagttgctggcagccggcggcgctggccttgacggggcattgttggttgcagctgcagccggcaggggcgcagcattaagattcttactcgctaggggcgcccgggtggacgcccgcgatggcgccggtgctacagcactcggcttggcagctgccttaggtaggagccaggacatcgaagtgctactcgggcacggagccgaccccggaatccgcgatagacacggaagaagcgccttgcatagggctgccgctcgaggacacctgctcgctgtccagctccttgtgacccagggagcggaagtcgacgcaagagatactcttggactcacaccacttcaccatgcttcgcgagaaggacacgtagaagtggctggttgtctactcgatcgtggcgcccaggttgacgcgacagggtggttaaggaaaacaccgctacatcttgcagccgagcgcgggcatggcccaactgtcggtctactgttaagccggggcgcttcaccaacactacgaacacagtgggccgaggttgctcaaatgcccgaaggagacttgcctcaagctttacctgagctcggtggaggagagaaggagtgcgaggggatagagagcacaggatag

SEQ ID NO: 44297 - DNA, 525 bp, Artificial Sequence
  Description of Artificial Sequence: Synthetic coding sequence
atggacagccagcggcccgagccccgggaggaggaggaggaggagcaggaactccgctggatggagctggattccgaagaagctctgggaacccggaccgaaggacctagtgtcgtccagggctggggacatctgctccaggccgtctggcgcggccccgccgggttggtcactcagctgttgagacagggggcgtctgtggaggagagaacactcagatgttgttgggccacaggccagacacaggcgagtggtacagggatggccgctctccgttgtacaggattgccccccgaggacacatgcctgcctagttcatgttggtccccgagaggacctagatggatgcgagggacgccctgggcgtcacacccttgtataacgcccctgggaaaagctacatggaggctgccagcggcatgttggaccggcgttccacgatggatgctccccgcagggtccgagcgtcctccttacacttggctacagtctgaaggtatgggcctaccatggggattctgttag

SEQ ID NO: 44298 - DNA, 198 bp, Artificial Sequence
  Description of Artificial Sequence: Synthetic coding sequence
atggacagccagcggcccgagccccgggaggaggaggaggaggagcaggaactgaggtggatggaacttgatagcgaggaagccctcggaacaaggacagaaggaccctcggtcgtgcagggatgggggcacctgctgcaggctgtgtggaggggaccagcgggcctggtgacacagctgttacgccagggacattag

SEQ ID NO: 44299 - DNA, 954 bp, Artificial Sequence
  Description of Artificial Sequence: Synthetic coding sequence
atgccctgggacgcccggcggcccggcggcggcgccgacggcggccctgaggcttctggggccgctcggtcacgggcccagaaacaatgccgtaagtcctctttcgcattctatcaagccgtgcgagacctactacctgtctggcttctcgaagacatgcgagctagtgaggcatttcattgggatgagcgcggaagagctgccgcttactctccttctgaggccctgctctatgccctcgtgcacgaccatcaggcctatgcccattatctgttggcaacgttcccgagaagggccctggctcctccatccgcggggtttcgctgttgcgcggcccctggaccccacgtggcactagcagtgagatataatcgggtgggcatccttcggaggattctcagaactcttagggactttcctgctgaggagcgggcgcgcgttctggacaggagggggtgctctcgcgtcgaaggaggcggaacaagcctgcatgtcgcttgtgagctcgccagaccggagtgcctcttccttttactgggccacggcgctagccccggcttaagagatggcggagggctgacacccctcgagctgctattacgccagctcggacgggacgctggggcaacaccatccgcagccggagccccagcttcggctcccggggaaccccgacaaaggaggctgctgttgctggatctactggccctgtacacaccagtgggagctgccggttccgccaggcaagaattattgggagaccggcccaggtggcagcgacttctgggggaggataaattccagtggctggctggactggcaccaccgagcctgttcgccagagctatgcaggtgctggtgactgccatcagccccgggcgcttcccagaggccctcgacgaactgccactgccgccattcctgcagcctctggacctgacagggaagggttag

SEQ ID NO: 44300 - DNA, 318 bp, Artificial Sequence
  Description of Artificial Sequence: Synthetic coding sequence
atgccctgggacgcccggcggcccggcggcggcgccgacggcggcccggaagcatccggcgccgctagaagtagggctcaaaagcagtgtaggaagtcttccttcgcattctaccaagccgtaagggatttactcccagtgtggcttctcgaggatatgcgcgccagtgaggccttccactgggacgaaagaggtcgcgctgcagcctattctccgtccgaagccctgctgtacgccttagttcacgaccaccaagcatatgcccattatttgcttgccacgtttccccgacgcgccctggcaccaccgtcagcgtag

SEQ ID NO: 44301 - DNA, 783 bp, Artificial Sequence
  Description of Artificial Sequence: Synthetic coding sequence
atgccctgggacgcccggcggcccggcggcggcgccgacggcggccccgaggccagcggagccgcgcgatctagggcccagaaacagtgccgaaagagttcctttgcattttaccaggccgtgcgtgatcttcttccggtatggctgctggaggacatgcgagcaagcgaagctttccactgggacgagcgaggacgtgccgctgcatattcaccctccgaggctctcctttacgccttagttcatgaccatcaggcttatgcgcactatctcctagctacctttccacgtagagctcttgcaccccctagcgcaggcttcagatgctgtgccgcaccagggccacatgtggctcttgcggtccgctacaatcgcgtaggaattcttcggcggattctgcgaacccttcgggatttcccggcagaggagcgggccagagtgctagatagaaggggctgttctagggttgaagggggagggacaagcctgcatgtggcatgtgaactggcacgccccgaatgtttgttcttgctgctgggacacggggcttctcccgggctgagggatggaggaggcttaaccccgcttgagctattgctgcgccagctgggtcgtgatgcaggagcaacaccgtcagcggcaggggcccctgccagtgccccaggggaaccaaggcaacggcgcttgctactgctggatctgctggccctgtatactccagttggagcggctggctctgctcgacaagaactgctgggcgaccgacccagatggcaacgctag

SEQ ID NO: 44302 - DNA, 954 bp, Artificial Sequence
  Description of Artificial Sequence: Synthetic coding sequence
atgccctgggacgcccggcggcccggcggcggcgccgacggcggccctgaggcctctggagctgccaggtccagagctcagaaacagtgccgcaaaagctcatttgccttctatcaggcagtacgcgatctgctgcctgtctggctattggaggatatgcgcgcaagcgaggccttccactgggacgagcgcgggagggctgctgcctattcccccagcgaggccctgctgtatgccctcgtgcacgaccaccaggcttatgcccactacctgttggcaacttttcccaggcgggctctggcccctccttctgcgggctttcgctgctgtgctgccccaggacctcatgttgcgctggcagtccgatataatagagtcggaatcctgcgcagaattctgaggaccttacgcgacttccctgctgaggagcgagccagagtgttagataggaggggctgttctcgcgttgagggcggaggaacgtcattacacgtggcatgtgagttggcccgacccgagtgcctgtttctgcttcttgggcatggtgcgagtccaggacttcgcgacggcgggggtctcacacctctcgagttactgttgcgccagcttggtagagacgctggcgccacaccctccgccgccggggcacccgcgtcagctccgggcgagcctcgccagcggcgtctgctcctgctggatctgttagccttgtacaccccggtgggcgccgcaggttctgctagacaagaactcctcggagaccggcctagatggcagcgattgttaggcgaggacaagtttcaatggcttgccggactggcgcccccatcactgtttgccagggctatgcaggttctggtgacagccattagccccggacgcttccccgaagctttagacgaactgccactacctcctttcctgcagcctctggatctgaccgggaaagggtag

SEQ ID NO: 44303 - DNA, 954 bp, Artificial Sequence
  Description of Artificial Sequence: Synthetic coding sequence
atgccctgggacgcccggcggcccggcggcggcgccgacggcggcccggaggcatctggcgctgcgagatctcgggcacagaagcagtgtaggaagtcaagctttgctttctatcaggctgtgagggacttgttacccgtgtggctcctggaggatatgagggcatctgaagccttccactgggacgagagaggccgggccgctgcctactccccatctgaagcacttctatacgcactggtccatgatcatcaggcgtatgctcactacttattggctacattccctcgaagggccctggcacctccaagcgcgggatttaggtgctgcgctgcccctggaccccacgtggccctagcagtccgctataaccgagtgggcatactgcgcagaatactgaggacattacgggattttcccgccgaggagagggcccgggtgctcgatagacgcggctgctcccgtgtcgaggggggaggcacttctctgcacgtggcatgtgagcttgcgagacctgagtgcctgtttttgctgcttggccatggggcttcaccaggtctgcgagacgggggtggcctgaccccactcgaactgctgctgcgtcagcttgggcgagatgccggcgctacaccttctgccgctggcgccccggcctccgctcccggtgagccccggcagagaaggctgttacttcttgatcttctggccctgtataccccagtgggagcagcaggtagtgcccgccaggagctcctgggggacaggcctagatggcagcggcttctcggcgaggataaatttcagtggctggcagggctggctcccccctccctcttcgctagagcaatgcaagtgctcgtgacagccatctctccaggtaggttccctgaggctctcgacgaattgccattgcctccttttttacagcctctcgacctgactggtaagggctag

SEQ ID NO: 44304 - DNA, 2292 bp, Artificial Sequence
  Description of Artificial Sequence: Synthetic coding sequence
atggaggccagcctgacccggcggctgctgttcaaggaccggcacttcacctgcagcaagatcatcggaagaagatttgcttgtttcgcccagagattgtctcataggagaaagcagagtcagtgcgatctcctgaacgaatcgacgggtcagttgcctacgacatgtagctccgccgcaagcaattccatcaactggaactgccgggtgaaaatgacccagcaaatgcagaatctccatctctgccagagcaaaaagcacagcgccccatcctcgccaaatgccgccaagcggctctatcgcaatctttccgaaaagctgaagggctctcactcctcatttgacgaagcctatttcaggactcgcaccgacagactgtcactgaggaagacctcagtcaatttccaggggaacgaggctatgtttgaagcagtggaacagcaggacatggatgcggtgcagatcctgctttaccaatataccccagaagagctggacctgaacacgccaaacagtgagggtctaactcctttagatattgcgattatgactaacaatgtgcctatcgccaggattctgctacggacaggtgcaagagaatccccccattttgtttcactggaatcaagagctatgcacctaaacaccctcgtgcaggaagcacaggaaagggtgtcagagctgtctgctcaagttgagaatgagggctttacactcgataacacagaaaaggagaaacagctgaaagcttgggaatggcgttacaggctgtatcggcgcatgaaaaccgggtttgagcacgctagggcccccgagatgcccactaatgtctgcctaatggtcacttcttccaccagcctgactgtttccttccaggaacctctgtctgttaatgctgcagtggttaccaggtataaagtagagtggagcatgtctgaggatttcagcccactggccggcgaaatcatcatggacaacctccaaactctccgctgtactatcacagggctgactatgggccaacagtatttcgtgcaggtcagtgcgtacaacatgaaaggctgggggccggctcaaaccacgacccccgcctgtgcatccccatctaactggaaagactacgacgaccgggaaccacgccataagggccagagtgaagtactggagggtctccttcagcaggttcgagcccttcatcagcactactcatgtcgggagagtaccaaactgcaaaccacagggcggaaacagtcagtgagccgatctttgaagcatctgttccactcctctaacaaatttgtgaaaaccctgaagagaggcctgtacattgctgtcattttctattacaaggataacatcctggtgaccaatgaggaccaggttcccattgtggaaatagatgactctcacacttcctccatcactcaggatttcttgtggtttaccaagctatcttgcatgtgggaagacattcgatggctgcgtcaaagcatccctatcagcagctcctccagcactgtattgcagacaaggcagaaaatgctggctgccacagcgcagctgcagaatctcctgggaacccacaaccttggaagagtctactatgagcccatcaaagacagacacggcaacattctgattgtgaccatcagggaggtcgagatgctgtattcattttttaatgggaaatggatgcagattagtaaactgcagagtcaacgtaaatcactgtccacacccgaagagccaaccgcactggatattctgctcatcacaatccaagacatacttagctaccacaaaaggtcccatcagaggctatttcccggactgtatctaggatacctcaagttgtgctcctcagtagatcagatcaaggtcttagttacccagaaacttccaaatatactgtgccatgttaagattcgggagaataataatatctccagggaagaatgggaatggatccagaagctcagcggcagtgagagcatggagagtgtggaccatacctcagattgcccaatgcagctgtttttctatgagctgcagatggctgttaaggcacttctccaacagatcaacatccctctccaccaggcccggaacttcagactctatacacaggaggtgttagaaatgggtcataatgtctcgtttctgctgctgctgccagcgagcgacgatgtgtgcacagcccccggtcagaacaatccatatacaccccatagtggcttcctgaatttgcccctccagatgtttgagttgggaatcgtggcatgcttcacatag

SEQ ID NO: 44305 - DNA, 831 bp, Artificial Sequence
  Description of Artificial Sequence: Synthetic coding sequence
atggcctggtggaagagctggatcgagcaggagggcgtgaccgtgaagtccagttcccatttcaacccagatcctgacgcagagacattatatcaggcaatgaagggaatcggcgttggcagtcagcttttgtcccatcaggccgctgccttcgcctttccttcaagtgccctgacctccgtgagtccatggggccagcagggccatctgtgttgtaaccccgccggcacgaatgaacaagctataattgatgtgctcaccaagcggtcgaatacccagcgccaacagattgcaaagagttttaaggcccagttcggtaaggatcttactgaaactctgaaatccgagctgtccgggaagtttgaaagattgattgtagctctcatgtacccgccatataggtacgaggctaaggagcttcatgacgctatgaagggttcccgggacgatgttagctcgtttgttgacccaggtctggccttgcaggatgctcaggatctgtacgcggctggagaaaagattcggggaactgacgagatgaagtttatcactatcttgtgtacacgcagcgcgacacacttactcagggttaagtgcactcagaacttgcacagctacttcgccgaacgactgtattacgctatgaagggggccggcactcgcgatggaaccctcatccgtaacatcgtctcccggagcgagatcgaccttaatctgatcaaatgtcacttcaagaagatgtatgggaagaccctcagctccatgattatggaggatactagcggagattacaaaaacgcccttctgtccctggtgggaagcgacccctag

SEQ ID NO: 44306 - DNA, 984 bp, Artificial Sequence
  Description of Artificial Sequence: Synthetic coding sequence
atggcctggtggaagagctggatcgagcaggagggcgtgaccgtgaagagtagcagccacttcaatcccgatccggacgccgaaactctctaccaggctatgaagggtatcgggaccaatgagcaggctatcatcgatgttctgactaagcgctccaacacccagcgccaacagatcgctaaatcattcaaggcacagtttggaaaagatctgacggaaacgctgaagagtgaattatccgggaagttcgagcgcctgatcgtggcgttgatgtaccctccctatcggtacgaagccaaggagttgcacgacgcaatgaagggcctcggaacaaaagaaggagttataatagagatcctggcctcgcgtacaaaaaaccagttaagagaaattatgaaagcctatgaggaagattatggtagcagtcttgaagaggacatccaggcggatactagtggctacttggaacggatcctcgtgtgccttcttcagggctcccgcgatgacgtttcctcattcgtggatccaggtctggcgctccaggacgcccaggacttgtacgccgccggggagaagatccggggtaccgatgagatgaagtttattaccatcctctgtaccagaagcgccactcacctgctgcgcgtattcgaagaatacgaaaagattgctaataagagtattgaggattccattaaaagcgaaacgcacgggagtcttgaggaggccatgctcacagtggtgaaatgcactcagaatctccattcatactttgctgagaggctctattacgccatgaaaggtgctgggactagggacgggactctgatcagaaatatcgtttcccgctcagaaatcgacctgaaccttatcaagtgccattttaaaaaaatgtacgggaagactctaagcagtatgataatggaggatacaagcggggactataaaaatgccctgctgtcactggtcgggagtgacccttag

SEQ ID NO: 44307 - DNA, 798 bp, Artificial Sequence
  Description of Artificial Sequence: Synthetic coding sequence
atggcctggtggaagagctgggacctgaccgagaccctgaagagcgagctttccggtaagtttgagcgcctgatcgtggctcttatgtatcctccttatcgctatgaagcaaaggagctgcacgacgctatgaaggggctgggaacaaaagagggcgtcattatcgaaattttggcctctcgcaccaaaaatcagctcagggagataatgaaggcgtatgaagaagattatggctcctccttagaagaggacattcaagcagacacaagcgggtacctggagcggatcttagtctgtctattgcagggatctagggatgatgtgtcttcttttgtggatccaggcttggctctgcaagacgcccaggacctgtatgccgcaggcgagaaaataaggggtactgatgaaatgaagttcataactatactatgtacgagaagcgcaacgcaccttttgagggtttttgaggagtatgagaaaattgctaacaaaagtatcgaagattcaattaagtcggaaacacatggcagtctggaggaggcaatgcttaccgttgtcaagtgcactcaaaacctgcacagttatttcgcagagaggctgtactacgccatgaagggagcggggaccagggacgggacgctgatacggaatatcgtctcccgttctgagatcgacttgaatctcatcaagtgccacttcaaaaaaatgtacggaaagaccctgagttctatgatcatggaggacacgagcggtgactacaaaaatgccttactgagtttggtggggagcgacccttag

SEQ ID NO: 44308 - DNA, 426 bp, Artificial Sequence
  Description of Artificial Sequence: Synthetic coding sequence
atggcctggtggaagagctggatcgagcaggagggcgtgaccgtgaaatcctcatcccactttaacccagatccagacgccgaaaccctgtatcaagcaatgaaaggaatagggactaacgagcaagccatcatcgatgtcctgaccaaacggagtaacacacaacgccagcagattgccaaatccttcaaagctcagttcggcaaagacctcactgaaactttgaagtcggagctctctggtaagttcgaacgtttaattgttgcactgatgtatcccccctacagatatgaggcgaaagaactccatgatgcgatgaaaggtttaggcaccaaagagggggtgattattgagatactcgccagccggaccaaaaatcaactgcgcgaaataatgaaggcctacgaggaaggtcagcagggttag

SEQ ID NO: 44309 - DNA, 831 bp, Artificial Sequence
  Description of Artificial Sequence: Synthetic coding sequence
atggcctggtggaaggcctggatcgagcaggagggcgtgaccgtgaaaagttcctcccattttaaccccgaccccgatgccgagaccctatacaaagcaatgaagggcatcggtgtggggtctcagctgttgtcccatcaggccgcagccttcgctttcccctccagtgcactgaccagtgtgtcaccatggggtcaacaaggccacctgtgctgtaatccagcaggtactaatgagcaggccattatagatgttttgaccaaacgctctaacacccaaagacagcagattgccaagtctttcaaggctcaattcggtaaagacctaactgaaacactgaagtcagagctctcagggaaattcgagcggctgattgttgctctcatgtatcctccttaccgatatgaagcaaaggagctgcatgatgccatgaagggctcccgggacgatgtcagctctttcgtggatcccgcgctggccctgcaagacgctcaggacttatatgcagccggggaaaacatacggggaacagacgaaatgaaatttattacaatattgtgcaccagatcggcgactcacctgttgcgagtcaagtgtacgcagaacctgcatagctattttgccgaacgactctactatgctatgaagggcgcgggcacccgggacggcaccctgattaggaacatcgtaagcagatcagagattgatctgaatttgatcaaatgccatttcaagaagatgtacgggaagactctatcgagtatgatcatggaagacacctcaggagactacaagaacgctctgctgagcctggtgggttccgacccctag

SEQ ID NO: 44310 - DNA, 984 bp, Artificial Sequence
  Description of Artificial Sequence: Synthetic coding sequence
atggcctggtggaaggcctggatcgagcaggagggcgtgaccgtgaagagcagttcccattttaatcccgatccagacgctgagaccctgtataaggccatgaaaggaatcggcaccaatgagcaagcaattatcgatgtattaactaagcgctctaatactcaacgccaacagatagctaagagcttcaaagcgcagttcggaaaggatttaaccgaaaccctgaagtccgagctgagtgggaaatttgaacggctgatcgttgcattgatgtacccgccatataggtatgaagcaaaggagttgcatgacgctatgaaggggttaggtacaaaggagggggtgattattgaaatcttggcttctcggacaaaaaatcaactgcgggaaattatgaaggcttatgaagaggactacgggagcagtctggaggaggatatacaggctgatacttccggctacctggaacggattctcgtgtgcctattacaaggctctagggacgatgtgtcctcattcgtcgatcccgcactggctctccaggacgcccaggatctgtacgcagcgggagaaaatatcagaggtaccgatgaaatgaagtttatcacaatcctgtgcactcgatctgccacccacttactccgtgtgttcgaagaatatgaaaagattgccaataagtccatcgaagactctataaagagcgaaacccacggatccctggaagaagccatgcttacagtggtgaaatgcacccagaatctgcactcttattttgccgagcgcctctactatgcgatgaaaggcgccgggacccgagatggtactctgattagaaacatagttagccggtctgagattgacttgaacctgatcaagtgccactttaaaaagatgtatggcaaaacgctgtcttccatgattatggaggacaccagcggggactataagaacgcgctgttgtctctcgtgggctccgacccatag

SEQ ID NO: 44311 - DNA, 426 bp, Artificial Sequence
  Description of Artificial Sequence: Synthetic coding sequence
atggcctggtggaaggcctggatcgagcaggagggcgtgaccgtgaaaagttccagccactttaaccccgatccggatgccgaaacgctgtataaagccatgaagggaattggtactaacgagcaggctatcatagacgtgctcactaaaaggtcgaacacccaacgtcagcagattgctaaatccttcaaggcacagttcgggaaggatttgacggagacacttaaatctgagctctcggggaagttcgagagactgatagtggccctgatgtacccaccctacagatacgaggccaaagagctgcacgacgccatgaaggggctgggcacaaaggagggcgtcattattgaaattctggcctccagaaccaaaaaccaattgagggaaatcatgaaggcctatgaggagggccagcaaggctag

SEQ ID NO: 44312 - DNA, 798 bp, Artificial Sequence
  Description of Artificial Sequence: Synthetic coding sequence
atggcctggtggaaggcctgggacctgaccgagaccctgaagagcgagctaagcggaaaatttgaaaggctaatcgtggccttgatgtatccaccctacagatacgaggcaaaggagctccacgacgcaatgaagggtctcggaaccaaagagggggtgataattgaaattctcgcatcacgaactaagaaccagctgcgggagatcatgaaagcatacgaggaggattacggctcttctctggaagaagatattcaggcggacacatccggttacttggaaaggatactggtgtgccttctgcaggggtcaagggacgatgtctcatcctttgtggatccagctctcgctctgcaagatgcacaggatctgtatgccgcgggcgagaacatcaggggcactgacgaaatgaagttcattactatcctctgtactcggagtgccacacacttgctgcgtgtctttgaggaatatgaaaaaatagccaataagagcatcgaggactccatcaagtccgaaactcacgggtcccttgaggaggcgatgttgactgtggtgaagtgcactcagaacctccacagttactttgcggagcggctgtattacgcgatgaagggggcagggacccgagatggaacgctcatcaggaatattgtaagccggtccgaaatagacttgaacctcataaagtgccattttaagaaaatgtatggtaagaccctttcttctatgataatggaagacacctctggggactacaaaaacgcgcttcttagtttagttggatctgatccatag

SEQ ID NO: 44313 - DNA, 306 bp, Artificial Sequence
  Description of Artificial Sequence: Synthetic coding sequence
tgacacgtgcacctgggcttcatcatcgccttcgagaacgtggtgttcttttttctgtgcccaaatgaccggctggtccccgacgtgcccgcgctggcgacgaagattacggcccgcgctttgcccgggcaggcgggagggggccgccagcctggggacgcagtgtcagtgagcaaactgcgcatttgggctgttagccagggtagaagcggctcatggatgagagggctcgaattcccgggcgatttacagacttgtaccgccaccctcccatgtagctgtctgctggcttccgtgcagtgctag

SEQ ID NO: 44314 - DNA, 777 bp, Artificial Sequence
  Description of Artificial Sequence: Synthetic coding sequence
atgccccggccccggcgggtgagccagctgctggacctgtgcctgtggtgttttatgaaaaacatttcccgctacctcactgatatcaagcctctcccgcccaacattaaggataggctaatcaaaattatgagcatgcagggacaaatcaccgactccaatatttctgagattcttcatccagaggtccaaaccctggacctgagaagctgcgatataagtgacgctgccctgcttcacctctctaactgcaggaagctgaaaaaactgaaccttaacgctagtaaaggaaaccgcgtgtccgtcacatcagaggggattaaggcagttgcctcctcttgttcctatctacatgaggcctcgttaaagagatgctgcaaccttacagacgaaggcgtggtcgctctcgctttaaactgccagctcctgaagatcattgatttgggcggctgtctatcaatcacagacgtgagcctgcacgctctgggcaaaaactgtcctttcctgcagtgcgtggatttctccgcgacacaggtctctgactccggagtgattgccctggtatctggtccatgtgctaagaaattggaagaaattcacatgggccattgtgtgaacttgactgacggagcggtcgaggccgttctgacttattgtccccaaatacggatcttgctgttccacggttgccccctgataaccgatcacagccgagaagttctggagcagcttgtgggcccaaacaaactcaaacaggtgacctggaccgtgtactag

SEQ ID NO: 44315 - DNA, 588 bp, Artificial Sequence
  Description of Artificial Sequence: Synthetic coding sequence
atgggcgccgccgtgttcttcggctgcaccttcgtggccttcggccctgcattcgccctcttcttaataaccgtagccggcgatcctctccgggtgattattttagtcgcagggagatgctcggctctccccaccacaagctgccttatcagtggcctcagttttggcattatatccggtgtcttctctgtgattaacatcttagcagacgcgttggggcccggagtggtgggcatccatggagactctccatactactttttgacatctgctttcctgaccgccgcaatcatactcctgcatacattctggggggtggtcttttttgatgcctgtgaaaggagacggtattgggcattagggctggtcgtcggatctcacctgctgacatccggattaacttttctcaatccctggtacgaagcttcactcctgcctatctacgccgtgaccgtgtctatgggactgtgggcttttatcactgctgggggctctctgcgatcaatccagagatctcttctgtgcaggcgacaggaggatagtagagtcatggtctattcggcactcagaattccaccggaggattag

SEQ ID NO: 44316 - DNA, 495 bp, Artificial Sequence
  Description of Artificial Sequence: Synthetic coding sequence
atggaggaggaggccgagaccgaggagcagcagcggttcagctaccagcagaggctgaaggcagccgtgcactacacagtgggctgtctgtgcgaggaggtggcgctggataaagaaatgcagttttctaagcagacaattgccgcaatttctgaacttaccttcagacagtgcgagaactttgccaaggatttggaaatgtttgcacggcacgctaagcgtaccaccataaataccgaggacgtcaaactcttagcaagacggagcaattccctacatatgcaagaagccgctgggattcgcaaatcaagccttctgacttttttggcctggtggttcgagtggacatcccaggctagcgctgggccacttatcggagaggaagcaagagaagtggcgcgacgacaggaaggggctccccctcagcagagcgcaagaagagaccgcatgccttgcaggaattttttttggaagacgttttctagctgtaagtag

SEQ ID NO: 44317 - DNA, 234 bp, Artificial Sequence
  Description of Artificial Sequence: Synthetic coding sequence
atggaggaggaggccgagaccgaggagcagcagcggttcagctaccagcagcggctgaaagcagccgtacactacaccgtgggatgtctctgcgaggaagtagccctggataaggagatgcaattcagcaagcagactattgctgctatatcagagttaactttccggcaatgcgaaaatttcgctaaagacctcgaaatgttcgcaagcatctgtcgaaagcgccaggaatag

SEQ ID NO: 44318 - DNA, 600 bp, Artificial Sequence
  Description of Artificial Sequence: Synthetic coding sequence
atggaggccagccccgccagcggcccccggcacctgatggacccccatatcttcacgtccaatttcaacaatggcattggaagacacaaaacatatttatgttatgaagtcgagaggctggataacggaactagcgttaaaatggaccagcaccgagggtttttgcacaaccaggcaaaaaaccttctgtgtgggttctacgggaggcatgccgagctcaggttcctggacctggtcccctcattgcagttagatccagcacagatctatagggttacctggttcatttcctggtcgccctgtttttcctggggctgtgctggggaagtgagggcctttttacaagagaacacacacgtgcggctccgtatattcgctgccagaatttatgactacgaccctctgtataaggaggcccttcagatgctcagggacgccggtgctcaggtatctattatgacctacgatgagtttaagcattgctgggacacatttgtggatcatcagggctgtccttttcagccttgggacgggctggacgagcactcacaggccctgtctgggaggttgcgggccatcttacaaaatcaggggaactag

SEQ ID NO: 44319 - DNA, 1161 bp, Artificial Sequence
  Description of Artificial Sequence: Synthetic coding sequence
atgcacgcccggggcccccacggccagctgagccccgccctgcccctggccagctctgtgctgatgctgctgatgtccaccctttggctagtaggagctggtcctgggcttgtgctggctcctgagctgctgcttgacccctggcaggttcacagactcttgacgcatgcattgggacataccgccctccctggcctgttgttgagcctgctgctgcttccaactgtgggctggcaacaagaatgccatctcggaacgctgcgattccttcatgccagcgcgttactagctctggccagtggccttttggccgttttgctggccggactcgggctctcatcagctgcgggctcatgtggctacatgccggtgcatcttgccatgctggccggagagggacatcggcccaggaggcccaggggagccctgcctccctggctgagcccttggttactactggcccttacccctctgttatcttcagaacccccctttctgcagttattgtgtgggctccttgcagggctggcctacgcagctggggccttcagatggctggagccttctgaacgccgtctgcaagtcctgcaagaaggcgtcttgtgcaggactcttgcaggttgctggccattgagattgttggcgacgcccgggtcgctcgccgaactacccgttacccatccggcgggagtgagaccaccaataccagggcccccttatgttgcatcccctgacttgtggagtcactgggaggactctgcactgccacccccatctctaagacccgtacagccaacatgggaaggaagcagtgaagcaggtcttgattgggccggcgcttcgttcagcccaggaacccctatgtgggcggcgctggatgaacaaatgctccaagaagggatacaggcaagtctgctggatggtcccgcgcaggagccacagagcgctccctggctctctaaatctagtgtttctagcctccgcttgcagcaactggagcgaatgggatttccaactgagcaggcagtggtggctttggctgccaccggcagagtggaaggcgcagtgtctctcctggttggcgggcaggtgggaacagaaacgctggtcactcatggtaagggcggccccgcacattctgaaggccctgggcctccttag

SEQ ID NO: 44320 - DNA, 1161 bp, Artificial Sequence
  Description of Artificial Sequence: Synthetic coding sequence
atgaacccccagatccggaaccccatggagcggatgtaccgggacacattctacgacaattttgagaacgagccaatactatacgggcgcagctacacatggctctgttacgaagttaaaattaaaaggggcagaagtaatctgctctgggataccggagtctttcgaggaccggtgctgccaaagcgtcaaagtaatcataggcaagaggtctactttcgattcgagaatcacgcagagatgtgttttctgtcatggttttgcggaaaccgactcccagccaacagacggtttcagattacgtggtttgtgtcttggaacccttgtttaccatgcgtggtgaaagtgacaaagttcctcgctgaacatcctaatgtgactcttactatttcagcagcaagactgtactactacagagatagagattggcgctgggtgcttttacggctccataaggccggggcacgagtgaagatcatggactatgaagatttcgcatattgttgggaaaattttgtttgcaatgagggacaaccttttatgccatggtataaatttgatgacaactacgcatcattgcaccgaacacttaaagagatactgcgtaacccgatggaggctatgtaccctcatatcttctattttcattttaagaatctcctgaaagcctgtggtaggaacgagagctggctatgttttaccatggaggtaaccaaacaccactcagccgtgttcaggaagagaggcgtgtttcgcaatcaggtagatccagaaacgcattgtcatgccgagcgatgttttttgtcatggttctgcgatgatatcctcagtcctaatacaaattatgaggtgacgtggtacacatcctggagtccttgccccgagtgcgctggtgaggttgcggaattcctggccaggcattctaatgttaacttaacaatctttacagcacggttgtgttacttttgggataccgattatcaggagggcctctgtagtctgagccaggagggcgccagcgtcaaaattatggggtataaggatttcgtgtcctgttggaagaattttgtgtattctgacgatgaacccttcaagccatggaaaggcctgcagaccaacttcaggctcctgaaacgacggcttcgagagattttgcagtag

SEQ ID NO: 44321 - DNA, 609 bp, Artificial Sequence
  Description of Artificial Sequence: Synthetic coding sequence
atgaacccccagatccggaaccccatggagcggatgtaccgggacacgttttatgataatttcgaaaatgaacccatcttgtacggccggtcctacacgtggctgtgctatgaggtgaagataaaacgaggtcggagcaaccttctgtgggataccggagtgttccgcgggccagttttaccaaagaggcaatcaaaccacagacaggaggtagacccggagacacattgccacgcagagagatgctttttaagctggttttgtgacgacatcctctctcccaacactaactacgaggtcacctggtatacatcctggtctccctgccccgagtgcgcaggtgaggttgctgaattcctggcccgccactctaatgtgaacttgacaatcttcactgcacgcctctgctacttctgggacaccgactaccaggagggcttatgcagcttaagtcaagagggcgcgagcgtcaagattatgggctataaagattttgtttcttgttggaagaactttgtttacagcgatgatgaacctttcaaaccctggaagggcttgcagacaaacttccgattgctcaagcgtcggctgcgcgaaattctgcagtag

SEQ ID NO: 44322 - DNA, 3210 bp, Artificial Sequence
  Description of Artificial Sequence: Synthetic coding sequence
atggacttcctgcggctgtacctgcccggcctgcaccaggccctgcgaggcgccctggattccttgggaacgttcgtgagctacctgctcggtgacgcagtgcctaccgtcgaacgcgaggcacaggcagcagaggaactaggtgtggtggctgtaggaaaaacagggaagattgtggaggaagaggcgcaggaagacctcgaggggttgcgggggtcgcagaatgaaggtgccggtcgcttaagagggcccggcgacgatcgtcgacacgaagttggatcctctgcggtcgaacagacgtggggctggggtgacggcagctctcacgggtctcaggccgagagacaggatagcggtgccggcgaaacggccaaagccgccagatgtcaagaaccttctgcacacttagaggcacgaaagaaatctaaggctgggtcaggagcttgccaagaccgttcgggtcaggctcaggaacggcaggaatctcacgagcaggaggttaatcgggaggaacgtctgaggtcttgggagcaggaggaggaagaagaagaagtgcgcgcccgggaaccagggatggcccggggcgccgagtctgaatggacttggcatggcgagactgaaggcaaagctggggctgtaggccccaaagccgcaggggacaaccgggagatggagcagggggttagagaagctgacgccggagaaacagaggagccaggggcagagggcgccggtaaaggcgaggaggttgtggtggtagagaaggcgtgtgagtctactagagcttggggcacatggggcccaggagctgaacctgaggactggggcatccttgggagggaagaagctagaacgaccccgggacgtgaagaagctagggcaattctcgacggtgaggaggctcggaccatttctggaggcgaggaagcagagaccgcctctggcggagaggaagctgaaaccgcgtctggtggggaagaagcaggtaccgcttcaggaggcgaagaagcaggcatcgccagcggtggcgaggctggcactgcttctgggggggaggaggccggcaccgccagtgggggagatgaagcgtggaccacatccggaaaggaggaggccgacttgttgggcgtcagacagactgagtatggagccgtcccgggcgagagactgctagaggctacaggtaaggtgtgggtattggaagaagagggggatgaggagcgcgaagcagaagtgtctcctttcccgaaacagcctcaggtgttagggaccgagagaacagaggaggctgccgaaagtcagacagctggacgcgaagccgtgggcggacaggaagcaggagagagctttgagggccaggtggacctgcgaggcaaggaggctgaaatgcgccaagacctgggaatccgggccgatagagcacgcatggaagagctggtgcaggctgaagaagcacaggaggagaggggctcgagtcgggatcctgtggctgagctgccatcagacggtgaggccgaaggaaccgcagaccttgaggcaactcccgaggctaggccagaggaagaacttactggcgaagaatcggaggcagcccagacatcgtgcggtctattgggggtggaatggggcggactgactcactccgtcactaagggacagggacccgagctgatggggggggcgcagactcctactaagcagcccgaggagcgggaggcaggagaggttgaattgatgggggtcctggcattatctaaggaagagcaagagcgctcccttgaagcaggccctagacatgctggcagtgtgaagcctgaggccagcgaggccttccccggagcttgggaaaacaggacgcggaaggatatggaacgaggaaacacgcaggaagatgctgccgacggtgaacagagagaggaggaagagactgcaggcggccaaacactggcggccgaggcggagggcgacagagagagcgagctcagcgaagtgccggaagccggtggcgaaggtttgaccacacaggacgccggctgtgggaccgaagaaggcgaagcctccgtgtctgaaaaccaggagctggacgggtccactggcgcggatgcagggccatgtccatctctcggagaagcctatgcacgggaaaccgaagacgaggaggctgaggcagatagaacatctaggcgcggatggcgcttgcaagctgtcgccgtgggcctacccgatagggaggacgcccaaaccggttccgtcgctgcgggaattatggggggcgatgtggtaccccatatctccgcggccggagctggagaagcgttggagggggttctggggcagggctgggattccaaggagaaagaagaggctgccgccggggagcatgccggtgggcaagagtttgggttggaaggttcagccgaggaagaagttaccggccggggtagtcaagtggaggctttcgaaagccgcgaaggagggccctggggggggcgcgtggaggctgaagaaagcgctggcgctgaagactcctgcggcttagacccggccgggtcacagactgcacgggccgaggggatgggggctatggtggaggccggtggactactagagaaatggaccctcctggaagaggaggcggtcggttggcaagaacgggaacagcgggaggactcagaaggacggtgtggggattatcaccctgagggggaagctccccgacttttggacgcagaggggctcatggtgactgggggccgacgggctgaagcaaaggagactgaacctgaatccctggagcacgtcagaggccaagaggagcagcccacccaccaagcgcctgccgaagcggccccggagagcgttggtgaagcggaaaccgccgaagccatgggctcagcccgcggtggcgcggctaatagctggagcgaggcccctctcccgggtagtctattggacgtcagtgtgccccggtccagagtgcatctctccagaagctctagccaacgccgtagccgaccctcttttagaaggactcccgcttgggaacagcaggaagaacccccagcccccaacccacctgaggaggaactgtcagcacccgaacagaggcccctgcagctagaggaacccttggagcctaggtgggaggatcgactgaggccgggcgtgcgggaccagccaggccagcactctaaaattcctattttttag

SEQ ID NO: 44323 - DNA, 3267 bp, Artificial Sequence
  Description of Artificial Sequence: Synthetic coding sequence
atggacttcctgcggctgtacctgcccggcctgcaccaggccctgcgaggggcactggactccctcgggacctttgtgagttacttgctgggtgacgcagtgcccactgtggaacgggaggcacaagcggccgaggaactgggtgtggtcgccgttggaaagacaggaaagattgtcgaagaggaggctcaggaagatctcgagggactccgtggtagccaaaatgagggtgctggtcgcctgcggggacctggggacgataggagacatgaggttgggtcctcggctgtggaacagacctgggggtggggggacgggtcatcccacggatcacaagctgagaggcaagacagtggtgccggtgaaacggctaaagctgcacgatgtcaggagccatccgcccacctcgaagctcgtaaaaagtctaaggccggctccggtgcttgtcaggatagaagtggacaggctcaggaaagacaggagtctcacgagcaggaggtgaaccgcgaagagagactgcggtcttgggaacaggaggaagaagaggaggaagtccgtgcacgcgagcctggaatggctagaggggcggagtccgaatggacctggcatggggagacagaagggaaggcgggcgccgtgggacctaaggctgccggcgataaccgggagatggagcagggggtcagggaagcagatgccggagaaaccgaggagccaggagccgagggtgccgggaagggcgaggaagtcgtggttgtggaaaaagcttgtgaatctaccagagcatggggaacatggggccccggggccgagccagaagattgggggatactgggccgagaagaggcaaggacgacccccggcagagaggaggctcgcgcaatactcgacggcgaagaggcccggaccatatctgggggagaggaagcagagacagcgtccggcggtgaggaggccgaaacagcttctggcggcgaagaagccggcaccgcctccgggggcgaggaagccgggatcgcttcaggcggggaagccggtacagcctcgggaggcgaggaggccggcacagcctcaggcggcgatgaagcttggactacatcgggcaaggaggaggcagatctcctgggcgtccgccagaccgagtacggagcggtcccgggagagaggctgctggaagctaccgggaaggtctgggtgttggaggaagagggcgacgaggagagagaggctgaggtctcccctttccctaaacagccacaggtccttggcactgaacgcaccgaggaagctgctgaatctcagactgccgggagggaagctgtggggggccaggaagcgggcgagagtttcgagggtcaggtcgacctgcgaggcaaggaagccgaaatgcggcaagacctgggcattcgtgcagatcgggcccggatggaggagttggtgcaggcagaggaggcccaagaagagaggggcagctcaagggatcctgtggccgagttaccaagcgatggagaggcagaaggcaccgccgatctagaggccactcccgaagctaggcctgaggaggagctgacgggggaggaaagcgaggccgcccagacttcttgtggcttgcttggggtggaatggggggggctgacgcattctgtgacaaaggggcagggccctgagctgatggggggcgcacagactccaacaaaacaaccagaggagagggaggctggggaagtcgagctgatgggtgtgctggcactctctaaggaggaacaggaacgatcactggaggcgggccctaggcatgccgggagcgttaagccagaagcctccgaagcattccccggagcttgggagaataggaccagaaaagacatggagaggggcaatacacaagaggacgccgccgatggagagcagagagaggaagaagagaccgcagggggtcagacccttgctgcggaggccgaaggagatagggagtccgagctgagtgaagtgccggaggccggaggcgaggggttgaccacgcaggacgccggttgcgggaccgaggaaggtgaggcttctgtgtcggaaaaccaggagctggacgggtctaccggcgccgatgccgggccatgcccatccctgggtgaggcatacgctagagaaactgaggatgaggaggcggaggctgataggacttctagaagggggtggcgtcttcaggctgtggcggtcgggctccccgaccgagaggatgcacagaccggtagtgtagccgccggcataatgggtggggatgtggttccccatatctccgcagccggcgccggagaagctctggaaggagtcctcggtcaaggatgggatagcaaagagaaggaagaggccgccgcgggcgaacacgcaggcggccaagagttcggcttggaaggttcggcagaagaggaggtgactggccgtgggagccaagtggaggccttcgagtcccgggaaggaggaccttggggagggcgcgtcgaggccgaggaatcagctggggccgaggattcttgcggattagatcccgccggcagccagactgcccgggccgagggtatgggggcgatggtggaggccgggggcctgctcgagaaatggaccctgctcgaggaagaggccgtggggtggcaggaacgggaacaacgggaagacagcgaaggtcgctgtggcgactatcacccggagggagaggctcctcggctgctcgatgctgaagggctgatggtgacagggggacgccgcgcagaagccaaagaaacagagccggaatcgttggagcatgtacgaggccaagaggagcagcccactcaccaggcccccgctgaggccgcccccgagagcgttggagaggcagagaccgctgaagcaatgggctcagcacggggcggcgccgccaatagttggtcggaagccccgctccctggctctttactcgacgtttcagtgccgcggtctcgggttcatttgtcacgaagctccagccagcggaggagtcgcccttcttttcggcgaactccggcatgggagcagcaggaggaaccacccgcacccaatccgcctgaggaggagctcagcgctccagagcaacgacctctgcagctggaagaaccattggagcccagccctctacggcatgacggtacgccagtgcctgcacgcaggcgacccttagggcacggctttggacttgcccatcctgggatgatgcaggaactccaagctagactgggtcgtcctaagcctcagtag

SEQ ID NO: 44324 - DNA, 3294 bp, Artificial Sequence
  Description of Artificial Sequence: Synthetic coding sequence
atggacttcctgcggctgtacctgcccggcctgcaccaggccctgagaggagccttggattcattggggactttcgtaagctacctgctgggcgacgccgtgcccacagtggagcgcgaggctcaggccgccgaggagctgggcgtagtggctgtggggaaaactggaaagattgttgaggaggaagcacaggaggaccttgaaggcctgcgggggtcacagaatgagggagccggcagactgcggggtccaggagatgaccgcagacatgaggtcgggagctcagctgtggaacagacatggggctggggtgatgggagcagccatggttctcaggccgaaaggcaggattcgggtgcaggtgaaacagctaaagcagcccgctgccaggagccgtccgcgcacctggaggcaagaaaaaagtccaaggctggatctggagcctgccaagaccgcagtggacaggctcaggaacggcaggagagccacgaacaggaagtcaatcgggaagagagacttaggtcctgggagcaggaggaggaggaagaggaggtgagagccagggagcccggtatggcccgcggcgccgagtctgagtggacctggcacggtgagaccgaaggcaaggccggcgcggtaggccccaaggcggcgggagacaatagggagatggaacagggggtgcgcgaagctgatgcaggcgagaccgaagaacctggggctgagggcgccggtaaaggagaggaagtagttgtagtggagaaagcatgtgagtctacacgcgcttggggaacatggggaccgggtgccgaacccgaggattggggaattctgggccgcgaggaagcccggaccacacccggacgcgaggaggcccgcgccattctggacggtgaggaggctcggaccatatccgggggtgaagaagctgagaccgccagcggcggggaggaggcagaaacagctagcgggggggaagaggccggaaccgccagcgggggcgaggaggctggcatcgcatcgggcggagaggccggtaccgcctccgggggagaagaagccggcacggcctccggcggagaggaagcggggaccgcctcaggcggtgatgaagcatggactacctctggaaaggaggaggccgacctgcttggggtgcgccagaccgagtacggagccgttccgggagaacgcttgttagaggccaccgggaaagtatgggtcctcgaggaggaaggagatgaagagcgtgaagcagaggtgagcccattccccaaacagccccaggtgttaggaacagagaggaccgaagaagccgccgaaagtcagacagccggtagagaagctgtaggaggacaggaagcaggcgagtcattcgagggccaggtggacctgcgtgggaaagaagccgagatgcgtcaggacctgggaatcagagccgatagggcgaggatggaggagctggtccaggctgaggaagctcaggaggagaggggttcgagccgggatcctgttgcagaactcccgagcgacggtgaggccgaagggaccgcagatcttgaggccacacccgaagctaggcccgaggaggagctgaccggcgaagagtctgaagcagcgcagacctcatgcggcttattgggagtggaatggggcggcctcacccattctgttacgaaaggccaaggtccagagcttatggggggggcacagacccccactaagcaaccagaagagagggaggcaggtgaagtcgaactgatgggtgtcttagccctctctaaggaggagcaagagcgcagcctcgaggcaggacctcggcacgcagggtctgtcaagccagaggcctccgaagccttccccggagcatgggagaataggacccgcaaggacatggaacgtggcaatacccaggaggatgccgcggacggggaacagcgtgaagaagaggagaccgctggcggccagacactggccgccgaggctgagggagatcgcgaaagtgagctgtccgaagttccggaggctggaggagaaggtcttaccactcaggacgccggttgcggaacggaggaaggcgaagctagcgtcagcgaaaatcaagagctggacggtagtaccggagctgacgccggtccatgccctagtctcggcgaagcatatgctcgagaaactgaggatgaggaagccgaagccgacagaaccagcaggcgagggtggaggctgcaggcagttgccgttggcctgcctgatcgagaagatgcacaaaccggcagcgtcgctgccggaatcatgggaggagatgtggttcctcatatctctgcagcaggcgccggggaagccttggaaggtgttctcggccagggctgggactccaaggagaaagaagaggcagcggccggggagcacgccggtggtcaagagtttgggctggagggctctgctgaggaagaggtgactggaagaggttcgcaagtggaagcctttgagtcaagagaaggaggaccttggggcgggcgagtggaggccgaggagtccgccggcgctgaggacagctgcggcctggatcctgccgggagccaaaccgccagggccgagggcatgggcgcaatggtggaagctggtggtctactcgagaagtggactttgctggaagaggaggcagtcggatggcaggaaagggagcagcgggaggacagcgaaggcaggtgtggggactatcacccagagggtgaagcgcccaggcttttggatgctgaagggttgatggtgactggtgggcgccgagcagaggctaaggagacagaacccgaatcacttgagcatgtcaggggtcaggaggagcagcctacccatcaggccccggcagaagctgcaccggaaagcgtgggcgaagcggagaccgcagaggcaatggggagcgcgcgcggcggtgctgctaactcttggagcgaggcaccgctgcccgggagccttctggacgtatccgttcctaggtcccgcgtgcaccttagcaggtcctctagtcagcgacgctcacgaccctcatttagaaggacacccgcatgggaacagcaagaggagcccccagcccctaaccctcccgaggaggagctgtccgctcctgaacagcgaccgctgcagttagaggaaccactggagcccagcccattaagacatgacggaactccagtccccgccagaaggcgcccactgggccacggctttggcctggcccacccgggcatgatgcaagaactccaggctagacttggccgacctaagccccagtag

SEQ ID NO: 44325 - DNA, 384 bp, Artificial Sequence
  Description of Artificial Sequence: Synthetic coding sequence
atgagcctgctgcggaaccggctgcaggccctgcccgccctgtgcctgtgtgtgcttgtgttggcttgcattggggcttgtcagcctgaagcccaggaaggaactttgtctcccccccccaagctgaagatgagtaggtggtctctggtaaggggcaggatgaaagagctgttagaaactgtggttaacaggacccgggacggttggcagtggttctggtcaccgtcgacgtttcgagggttcatgcagacttattacgatgaccaccttagggacctcggacccctaacaaaggcatggttcctggagtctaaggatagcctgctcaagaaaacccactctttgtgccctcgactggtatgcggggacaaagaccaggggtag

SEQ ID NO: 44326 - DNA, 924 bp, Artificial Sequence
  Description of Artificial Sequence: Synthetic coding sequence
atggccggcctgaacgtgagcctgagcttcttcttcgccaccttcactctgtgcgaggcggctcgcagggctagtaaggcgctcttacccgtgggcgcctatgaagttttcgcccgagaggcagtcggcgctgttcagctgggcgcttgcttcttagagatgcgcaccttggttgaacttggaccgtgggccggcgacttcggaccagatctgttactgacactcctcttccttttgtttctggcccacggggtcacactcgacggggcctcagcaaatccgactgtttctctgcaggaattcctgatggctgaggagtcactgcctggcacccttctgaaattagctgcgcagggcctgggcatgcaagctgcctgcacactgaccagattatgctgggcctgggaacttagcgatctgcatttgctccaaagcctaatggcacagtcctgtagcagtgctttaagaactagtgtgccccatggggcgttagtagaagccgcctgtgctttctgtttccatctcacgctactccatcttaggcactctccgccagcatatagtggcccagctgtcgccctcttagtaaccgtcaccgcatacacagccggcccattcactagcgcatttttcaatccagccctggcggcttctgtcaccttcgcttgctctgggcacacactattggagtacgtccaggtgtactggcttgggcctttaaccggaatggtcctggccgttctgctgcatcagggcagattacctcatctgtttcaaaggaaccttttttatggccagaaaaacaaatatcgagctccccgcggaaagcctgcaccagctagcggagacacccaaacccctgctaaagggagctcagtgcgggagcccggccgctcgggtgtggaaggccctcacagtagctag

SEQ ID NO: 44327 - DNA, 1497 bp, Artificial Sequence
  Description of Artificial Sequence: Synthetic coding sequence
atgctgcagtgccggcccgcccaggagttcagcttcggcccccgggcactgaaggacgccctggtcagcacagatgcagctctgcagcagctgtacgttagcgccttcagcccagcggagcgcctttttctggcggaggcctataaccctcagcgtacactgttttgcacgttgctgattcgaaccggatttgactggttactgtccaggcctgaagccccagaagacttccagacattccatgcatctttgcagcacagaaagccgcggttggctcggaaacacatctatctgcagcctattgacctgtccgaagaaccagtgggatcaagcctactccatcagctctgctcttgcacggaagccttctttctgggactcagggttaagtgcctgccctcggtggccgcagcctccatcaggtgttcaagtcgccctagtcgggattctgacaggcttcagctgcacaccgatggaattctttcctttctcaagaacaacaaacctggtgacgctctttgtgttctgggcctgactctgagtgatctttacccacacgaggcgtggtccttcacctttagcaagttcctgcctggccacgaagtaggcgtgtgctccttcgcacgcttcagtggagagttccctaagagcggaccttcggctcctgacctggccctggtggaagctgccgctgatggaccagaagccccccttcaggatcgcgggtgggctctctgtttttctgccctcggcatggtgcagtgctgtaaggttacgtgtcatgaactgtgccatttgcttgggctgggaaactgccggtggctgcgctgcctgatgcagggggccctgagtctggacgaggccctgaggcgacccctggacttgtgtcccatttgtttgagaaaactacaacacgtgctgggcttcagattaattgaaagatatcagagattatatacttggacacaggctgtggtggggacatggccaagccaagaagcaggcgagccttcagtgtgggaggacactcctccagctagcgctgactccggaatgtgctgtgagtccgattcagaaccgggcaccagcgtgtctgagccgttaactccagacgcgggctctcacacatttgcaagcggacctgaggagggcttgagctatctggccgcttctgaagccccactgcctccagggggacctgccgaggccatcaaagagcatgagcgatggctggccatgtgcatacaggcgttgcagcgcgaagtcgcggaggaggatctggtgcaagtcgacagagcggtcgacgctcttgacagatgggagatgttcactggtcaactgcccgctaccagacaggacccaccctccagtcgggacagcgtcggcctcagaaaagtgctaggcgacaagttcagcagcctgcgcagaaaactcagtgccagaaaactcgcgcgtgcagagtcggctccccggccctgggatggcgaagaatcctag

SEQ ID NO: 44328 - DNA, 909 bp, Artificial Sequence
  Description of Artificial Sequence: Synthetic coding sequence
atgcagatcatccggcacagcgagcagaccctgaagaccgccctgatctcaaaaaatcctgtactggtttcccagtacgagaaacttaacgcaggtgagcagcgtttgatgaatgaggcctttcagccagcttctgacctgttcggtcctatcacactgcactctccatccgactggatcaccagccacccagaagccccgcaggatttcgagcagtttttttcggatccttatcgcaagactccaagtcccaataagcggagcatttacattcagagtatcggcgatatcctgaagttcttgaagaagaaaaagcccgaggatgccttttgtgtggtaggaattaccatgattgacttgtacccacgagatagctggaacttcgtatttggacaagcatcactcactgatggggtcggaatcttttccttcgcacgctacggctctgatttctactccatgcattataaagggaaggtgaagaagctgaagaaaacgtcctcgagtgattattcaatcttcgataactattatattcccgaaatcactagtgtgctcttactccggagctgtaaaacgctcactcacgaaatagggcatattttcggactgaggcactgccaatggctcgcatgcctaatgcagggatcaaatcacttggaggaggccgacaggagacccctcaacctttgccccatttgtctgcacaagctccaatgtgccgtcggattcagtatagttgaacgctacaaggccctggttaggtggatcgacgacgaaagctctgatacacccggcgccacaccggaacactcacatgaggataacggtaaccttcctaaacccgtggaagcttttaaggagtggaaggagtggatcataaagtgtttggccgttctgcaaaagtag

SEQ ID NO: 44329 - DNA, 1083 bp, Artificial Sequence
  Description of Artificial Sequence: Synthetic coding sequence
atgcagatcatccggcacagcgagcagaccctgaagaccgccctgatcagcaaaaaccccgtgctggtgtctcaatatgaaaaacttaacgccggtgagcagcggctgatgaatgaggccttccagccggcctctgacctcttcggaccaatcactttacactccccaagcgattggattactagtcatcctgaagcaccccaggatttcgaacagtttttctcagatccttataggaagacaccctctccaaataaacgaagcatatacatccagtctatagggagccttggcaatacaagaataatctcggaggagtatatcaagtggctgacaggttattgcaaagcgtatttctacggactgagggtcaagttactggagcctgtcccagtgtctgtaaccagatgctccttccgggtgaacgagaatacccataacctccaaatccacgctggagatatattaaagttcctgaaaaaaaaaaaaccagaggatgctttttgcgtagtggggattaccatgatagatctgtaccccagagattcttggaactttgtgtttggccaggcgtccctgactgacggcgtaggcatcttctcattcgcgcgctatggcagtgatttttactctatgcactacaaagggaaggtaaaaaaactcaaaaaaacttcaagctctgactacagcattttcgataattattacataccggagatcactagcgtgttgctgttgcgttcctgtaagaccctcacacacgagatagggcacatttttggccttagacactgccagtggctggcctgtctgatgcaggggtccaaccacctggaggaagcagaccgaaggccgctgaatctctgccccatctgtctacacaagctccagtgtgcagtgggattttcgattgtcgagcgctataaggctctggtgcgctggatcgacgacgaatcgtcagatacgcccggtgccaccccagaacattcccacgaagacaatggcaacctgcccaagccagttgaggcatttaaggagtggaaagagtggattatcaaatgcctggctgtcctgcagaaatag

SEQ ID NO: 44330 - DNA, 1083 bp, Artificial Sequence
  Description of Artificial Sequence: Synthetic coding sequence
atgcagatcatccggcacagcgagcagaccctgaagaccgccctgattagcaaaaatcccgtgctcgtgtcccaatacgagaaactgaatgcaggggagcaacgcctgatgaacgaagccttccagcccgcttctgatcttttcggccccattacgttacacagtccatccgactggatcacaagccatccagaggctccgcaggattttgagcaattttttagcgacccttaccgtaagacgccctcccccaataagcgatcgatttatatacaatcaatcggctcacttgggaatacgcgaatcataagtgaggagtacatcaaatggttgactggatactgcaaggcctatttctatggcctacgcgtcaaactgttggagcccgtgcccgtgtcggtgactagatgcagttttagagttaacgagaatacacataacctgcagatccacgccggggacatactgaaattcctgaagaagaaaaaacccgaagatgccttctgtgttgttggtatcacgatgatcgacctgtatcctagagacagttggaattttgtttttgggcaagcgagtctcacagatggcgtcggaatcttcagttttgcccgctacggtagcgacttctatagcatgcattataaggggaaagtaaaaaaactgaagaagaccagctctagcgattattccatcttcgataattattatataccagagatcacctccgtgctgttgttgcgtagttgtaagaccctgacgcacgagataggccacatcttcggactaaggcactgtcagtggttggcgtgcctgatgcagggttcgaatcacctggaagaggcggaccggcgtccgctcaatctctgccctatatgcctgcacaaacttcaatgcgccgttggatttagtattgtggagcgatataaagcactggtgcggtggatcgacgacgaaagcagtgacactccgggagcaacccccgaacattctcacgaggataatggaaacctgccaaagcccgtggaagctttcaaggagtggaaggagtggataatcaagtgcctcgctgtgctacagaaatag

SEQ ID NO: 44331 - DNA, 1083 bp, Artificial Sequence
  Description of Artificial Sequence: Synthetic coding sequence
atgcagatcatccggcacagcgagcagaccctgaagaccgccctgatctctaagaaccctgtgttagtgtcgcagtacgaaaagctgaatgccggcgaacagaggctgatgaatgaggcctttcagcccgcttccgacctgtttggtcctattaccctccactctcctagtgactggataacatcgcaccccgaagctcctcaggattttgagcagtttttcagtgacccctatcggaagactccatcgcctaacaaaaggtccatttacattcagtctatagggtctcttggcaataccagaattatctcggaggaatatatcaaatggcttacggggtattgtaaagcttacttctatgggctgcgggtcaagctgctggagcccgttccagtaagtgttacacgctgctcattcagagtgaatgagaatacacataatctgcagatccacgccggagacattctgaagtttctaaagaagaagaaacctgaagacgccttttgtgtagtggggatcacaatgatcgacttgtatccccgagacagttggaactttgtgttcgggcaggcaagcttgacggacggcgtaggaatcttctccttcgcaaggtacggctcggacttctactctatgcactacaaaggaaaagtgaagaagctcaagaaaactagtagctctgattacagcatattcgacaactactacattcccgaaattaccagcgtccttctcttgcggtcctgcaaaactttgactcacgagatcggtcacatattcgggctccggcactgccagtggctggcctgcctcatgcaaggaagcaaccacctcgaagaggcagacagacggccactgaacctgtgcccgatttgcctccataagctgcaatgcgctgtgggatttagcatagtggagcggtacaaagccctcgtgagatggattgatgacgagagctcagacacccccggggcgacacctgagcactctcatgaggataatggcaaccttcctaaacccgtggaagccttcaaggagtggaaggagtggatcattaagtgtttggcagtcctgcagaaatag

SEQ ID NO: 44332 - DNA, 1083 bp, Artificial Sequence
  Description of Artificial Sequence: Synthetic coding sequence
atgcagatcatccggcacagcgagcagaccctgaagaccgccctgatttccaagaatccagttcttgtctctcagtacgaaaaactgaacgcaggtgaacagcgcctcatgaacgaggcctttcaaccagcttcggatctcttcggaccgatcaccctacattcgccttcagactggattaccagccatcccgaagcaccccaggacttcgaacagttcttttcagacccgtatagaaaaacccctagccctaacaagcgcagcatctatattcagagtattggcagcctcggaaacacgcgaattatctctgaagagtatattaagtggttgacaggttactgcaaggcatacttctacgggttgagggtaaagctgctcgaacccgttcctgtctctgtgactagatgttcttttagagtgaatgaaaacacacataatttgcaaattcacgccggagacatactgaagttcctgaagaagaagaagccagaggatgccttttgtgtagttggaattaccatgattgacttatacccgagggactcgtggaatttcgtctttggccaggccagtctcacagatggggtaggaatcttctcattcgccagatatggaagcgacttttactccatgcattacaaggggaaggtaaagaagttgaagaaaaccagttcaagcgactatagcatcttcgacaactattacatccccgagattacctcagtcttgctccttcgtagttgcaaaacactgactcacgagattggtcatatttttgggttgcggcactgtcaatggctggcgtgtctgatgcaggggtcaaaccacctcgaggaagccgacagacgccctctgaatctttgcccaatctgccttcacaaattacaatgtgctgtgggcttttcaatcgtggagcggtacaaggccctggtgcggtggatcgacgacgagtcctcggatacgcctggagctactccagagcatagccacgaagacaacgggaacttaccaaaaccagtcgaggcttttaaagagtggaaggaatggataattaagtgcctggctgtgttacagaagtag

SEQ ID NO: 44333 - DNA, 1083 bp, Artificial Sequence
  Description of Artificial Sequence: Synthetic coding sequence
atgcagatcatccggcacagcgagcagaccctgaagaccgccctgatatctaaaaaccccgttttggtgagccagtatgagaaattgaacgccggtgagcaacggctgatgaacgaggccttccagccagcaagcgatcttttcggccctatcaccctccacagcccaagcgactggatcacttcacatcccgaggctccgcaagatttcgagcagttcttcagtgatccctataggaagaccccgagtccaaacaagagatccatttacatacaaagcattggctctctggggaacacaaggataataagtgaagaatacattaaatggcttacagggtactgtaaagcctatttttacggactccgtgtgaagctcttggagcccgtcccagtgtcagtcactcggtgttcgtttagagttaacgagaacacccataatctgcaaatccacgctggagatatactgaaattcctcaagaaaaagaagcccgaggacgcattttgcgtggtgggaattacgatgatcgatctgtatcctcgcgacagttggaactttgttttcggccaggcatccctgacggatggtgtaggaatttttagtttcgcaaggtacgggtcagatttctactcaatgcattataagggaaaggtgaagaagctcaaaaaaacatcttccagcgattatagcatttttgacaactactacattcccgagatcacctctgtgctgcttctgcggagttgcaaaacattgactcatgagataggacacatatttggactcaggcactgtcaatggctggcctgcttgatgcaaggtagcaatcatcttgaggaggctgaccggagacccctgaacctgtgcccaatctgtctgcacaaactgcagtgcgctgtgggtttctccatcgtggaaagatacaaggcgctggttcggtggatcgatgatgaatccagtgacaccccgggagccacccctgagcactcgcacgaggataacgggaacctgccgaaacctgtggaagcttttaaggaatggaaagagtggatcatcaagtgtctggccgtcctccaaaagtag

SEQ ID NO: 44334 - DNA, 2505 bp, Artificial Sequence
  Description of Artificial Sequence: Synthetic coding sequence
atgaccgtggagttcgaggagtgcgtgaaggacagcccccggttccgagcaactatcgatgaggtggagactgacgtggtcgaaatcgaggctaaactcgataagctcgtgaagctgtgcagtgggatggtcgaggcgggaaaggcctacgtcagtactagtagactgttcgttagtggggtgcgggacctgtcacagcagtgtcagggggatacagtgatctcggaatgtctgcagaggttcgccgacagtcttcaggaggttgtgaactatcatatgatccttttcgaccaggcacagaggagtgtgcgacaacagctccaatccttcgttaaggaagatgtgcggaaattcaaagaaaccaagaagcagtttgacaaggtccgggaagatctggagctgtctctcgttcggaatgctcaagcacctcgtcatcgtccacacgaagtcgaagaggccactggagccttaactctcaccagaaagtgtttccgacatttggccctggattacgtccttcaaattaacgtgcttcaggctaagaagaaattcgaaatactggacagcatgctgagtttcatgcacgcgcagtcaagcttcttccagcaggggtattccctgttgcatcagctcgacccttacatgaaaaagctggccgcagagctcgaccagctcgtgattgactcggccgttgaaaagagagaaatggagagaaagcatgcggccattcagcagcgaactctgctacaggatttcagttatgatgagtcaaaggttgagttcgatgtagatgccccttccggggtggtgatggagggctacctgtttaaaagagccagcaacgcatttaagacctggaatcgccgttggttttctattcagaactcccaattggtgtaccagaagaagctgaaggacgcactgaccgttgtggtcgatgacttacggctgtgctctgtgaagccatgcgaggatattgaaaggcgtttttgttttgaagtgttgagccccaccaagagctgtatgctgcaggcggactctgagaagttgagacaggcgtgggtccaggctgttcaagccagtattgcctccgcctatcgagagtcacctgactcctgctattctgaaaggctggatcgcaccgcctccccctccacatcctcgattgattctgccaccgatacaagggagaggggggtgaaaggcgagagcgtgctgcagcgggtacaatctgttgctggcaacagccagtgtggggattgtgggcaacctgacccccggtgggccagcataaatctgggcgtgcttctgtgcattgagtgctctgggatccatagaagcctgggagtgcactgcagcaaggttcggagcctgacattggattcatgggagcccgagctcttgaaactgatgtgcgaacttgggaactccgctgtgaatcaaatctatgaggcacagtgcgaaggcgctgggagccgtaagcccaccgcatcctcttcccgacaagataaagaagcatggattaaggataaatatgttgaaaaaaaattcctccgtaaggctcctatggcccccgctctcgaggccccccggaggtggcgtgtgcaaaagtgtctgcgtcctcactccagcccacgagctcctactgccaggcggaaggtccgtctggagcccgtgctcccatgcgtggccgctttgagcagtgtgggtacgctcgacagaaagtttcgccgggactcccttttctgtcccgacgagctcgactccttattcagctacttcgacgcaggtgccgctggggccggacctcgctctctctccagcgattctggcctcggcggctcatcggatggcagctccgatgtcctagcttttggaagcggttccgtggtggacagcgtaaccgaggaggagggggcagaatcagaagagtcctcaggcgaggccgacggggatacagaggccgaagcatggggacttgccgacgtgagagagctgcatcctggcttgctggctcaccgagccgcccgagctagggatctgccggcactggcggccgcgctcgctcatggggctgaggttaactgggccgatgcagaggacgagggaaaaactcccttggtgcaggcagtgctgggaggctctttaattgtgtgtgagttccttctccagaacggtgctgatgtgaatcagcgggacagtcgaggcagggccccactgcaccacgccacactgctagggcgcacaggtcaggtgtgcctgtttttaaagcggggagccgaccagcacgctctggatcaggaacagagggacccccttgctatagccgtacaggccgccaacgcggacatcgtcaccttactgagactggccagaatggccgaggagatgagggaagccgaagccgctccagggccccccggggccctggccggtagtcccaccgaattgcagtttcgcaggtgtatccaggagtttatcagtctgcacctggaggagtcgtag

SEQ ID NO: 44335 - DNA, 2280 bp, Artificial Sequence
  Description of Artificial Sequence: Synthetic coding sequence
atggtggaggccggcaaggcctacgtgagcaccagccggctgttcgtaagtggagttcgggatctgagccagcagtgccagggagatacggtgatcagcgagtgcttacagcgttttgcagactcattgcaggaggtggtcaattatcatatgattctatttgaccaggcgcagaggagcgtgcgccaacagctgcagagcttcgtcaaagaagacgtgcgcaaatttaaagagacgaaaaagcagtttgacaaggtccgagaagatctggaactatctctggtgagaaacgcgcaggcccctcgtcaccgtcctcatgaggtggaggaagctacgggcgccttgacattgaccagaaagtgctttaggcatctggctctggactatgttctccaaattaatgtgctgcaggccaaaaagaaatttgagatactcgactctatgctttcgttcatgcatgcccagtcctccttttttcagcaaggatattccctccttcatcaactggatccctatatgaagaagctggcggcagaactggaccagctggtcatcgattccgccgtggaaaagcgtgaaatggagcggaaacacgctgctatccaacagcgcacactcctgcaggacttttcctacgatgaaagtaaggtagaattcgatgtggacgcaccatctggtgttgtgatggaagggtacctgtttaagagggcatcaaatgcatttaaaacgtggaatagaagatggttcagtatacagaactcgcagttagtctatcagaagaaattgaaagatgccctgacggttgtggttgacgatttaagactgtgctctgtaaagccatgcgaagacatcgagaggcggttctgctttgaggttttaagtccaacgaaatcgtgcatgctgcaggccgatagcgagaaactgcggcaagcttgggtccaagctgtgcaggccagtatcgcgagcgcctaccgggagtcccctgattcttgttacagcgaacggctggaccgcactgcttctcccagtacctcgtctattgactccgctactgacacaagggaacggggagtgaaaggtgagtccgtattgcagagggtccagtcagtggccgggaattcccagtgcggcgattgcggccagcccgatccgagatgggccagcataaatctgggggttctcctgtgcatcgagtgctccggcatccatcggagtctgggggtgcactgtagtaaagtgcgatcactcactctggactcgtgggaacctgaactcttgaaactgatgtgtgaactgggcaactcagcagtgaaccagatctacgaggcacagtgtgaaggcgctggctccaggaaacctacagcctctagttccaggcaagataaggaagcgtggatcaaggacaaatatgttgagaaaaagtttttgcgcaaggccccaatggcgcccgctctggaagctcctcggaggtggcgagtccaaaagtgtctcaggccgcactcatcccctcgtgccccaacagctcgccggaaagtgagactggagcccgtgcttccatgcgtagccgccttatcctctgtaggtacgttggatagaaagttcaggcgcgattctctgttctgtcccgacgaattagacagtctcttctcctacttcgacgcaggggcagccggggccggccctcgtaaaggggcagagtcagaggagtcctctggcgaagctgatggcgatacagaggctgaggcctggggactggccgacgtgagagagcttcaccctggcctcctggcacacagggccgcgagagctcgggatctgcccgccctggccgcagctctggcacatggggcggaggtgaattgggcagacgctgaagacgaggggaaaaccccattggtacaagccgtcctcgggggctccctaatagtgtgcgaatttctcctgcagaacggcgccgatgtgaaccagagagattcacgcggcagggccccgctccatcacgctaccttgctcgggagaactggtcaggtgtgcctgttccttaagaggggagcagaccagcacgcgctcgatcaagagcagcgggaccccttggctatcgccgtacaagcagcgaacgctgatatcgtgacactgctgcgtctggcccgaatggccgaagagatgcgggaggctgaggctgctcccggcccccccggcgccttagctggcagtcccactgaactacagttcaggcgctgtattcaggaattcattagtttgcacctcgaggagtcttag

SEQ ID NO: 44336 - DNA, 468 bp, Artificial Sequence
  Description of Artificial Sequence: Synthetic coding sequence
atggtgatggccgccaagaagggccccggccccggcggcggcgtgtctggcggcaaggctgaggcggaggctgcctctgaagtatggtgccggcgcgttcgtgaactgggagggtgcagccaagccgggaaccggcattgcttcgagtgcgcacagcgtggtgtaacttatgtagatatcaccgttggatcctttgtgtgcactacctgtagcggcctcctccgcggcctcaaccccccccatcgagtcaaatccatatccatgacaacattcactgagcccgaggtggtattcctgcagtctagaggcaatgaggtctgcaggaagatttggttaggcctgttcgatgcccgtacctccctggtaccagactcacgcgaccctcagaaagtcaaagagtttttacaggaaaagtacgaaaaaaaacgctggcccgacaccttcccacgcagactgtgccagctgtag

SEQ ID NO: 44337 - DNA, 1446 bp, Artificial Sequence
  Description of Artificial Sequence: Synthetic coding sequence
atggtgatggccgccaagaagggccccggccccggcggcggcgtgagtgggggcaaagctgaggccgaggcggcatctgaggtctggtgcaggagagtgagggaactcggcgggtgctcccaagcagggaaccgacattgcttcgagtgcgcccagaggggagtgacatatgttgatatcactgtgggaagttttgtttgcacaacttgtagcggactcctccgtggtctgaatcctcctcaccgcgttaagagcatttcaatgaccactttcaccgaacctgaggtagtgttcctgcagagtaggggcaatgaagtgtgtcgcaagatttggcttggcctgttcgacgcgcgaacatccctggttccagactcccgggacccacagaaagtcaaagaattccttcaggaaaagtacgaaaagaagcgctggtacgtcccccccgaccaggtcaaagggcctacatacactaagggatctgcatcgactccagtgcagggtagcatacctgagggaaagcctctgcgaaccctgctgggagatccagcccccagtctgagtgtggccgcgtcaacgagctcacagccagtgtctcagtctcatgcacgcacatctcaagccaggtctacccagcctcccccccacagcagcgtgaaaaaagcctcaactgatctcctggccgacattggaggagatcctttcgcggctcctcagatggcacctgcctttgctgcatttcccgctttcgggggccagacgcctagccaagggggcttcgccaatttcgacgccttctctagtggcccatccagctcagtcttcggcagcttaccacctgccggccaagcatcttttcaggcacagcccacacccgccgggtctagtcagggcacaccatttggtgccactccactggccccagcttcacagcctaactcccttgcagacgtggggagtttcctgggacccggagtgcctgccgccggagtgccctcctcgcttttcggaatggctggccaggtccctccattacagtccgtgacaatgggaggcggaggtggctcatcaactggcctggcctttggcgcctttaccaacccattcaccgccccagctgctcagtccccccttccgtccaccaaccctttccaacccaacgggctggcccctggacctggattcggcatgtcaagcgccggtcccggattcccgcaagccgtgccacccacgggcgcattcgcctccagtttccctgcccccctgttccctccccagactcccctcgtgcagcagcagaacggttccagttttggcgacctaggttcagccaaattaggccaaaggcctctctcgcagccggccggcatcagtaccaatccctttatgacgggaccttctagttctcctttcgcttcaaagcctcccaccacgaacccctttctctag

SEQ ID NO: 44338 - DNA, 1992 bp, Artificial Sequence
  Description of Artificial Sequence: Synthetic coding sequence
gagctgctgcggatcagccccgacctgctggccgccgccgtgatctccgcccaggaagaaccactgaccaacattcagcgcgcttctgggccaaccggtctcctgtggtccgtgtccctagagttcgaccaacagcaaggttcggtctgtccttccgagtctgagatctacgaagccggagcagaggaccggatggcaggcgcacccatggcggcggccgttcaaccagctgaggtcacggtggaagtgggtgaggacctgcatatgcaccaagtgagagaccgagagatgccggaagccctagaatttaacctgtccgctaaccccgaggcttcaaccattttccagcgcaatagccaaacggacgctttggagttcaattcatccgctaacccagaggcttccacaatcttccagcgaaactcccagacagacgtggtggagattcgcaggtccaactgtactaaccacgttagcactgaaagattttcgcaacagtactcctcttgttccacgatcttccttgatgactcaactgctattcagcactacctgactatgacaatcatttccgtgactctcgagatcccgcaccatatcacacagcgggacgctgacaggtccctcagtattcccgacgagcagctccacagctttgctgtatccactgtgcacattatgaagaagcgtaatggcggtggtagcttgaataattactcctcatcaattccacctactccatcgacgtctcaggaggaccctcagtttagcgtaccccccaccgcaaacacgcccaccccggtctgcaagctgtcaatgcgttggtcaaacctctttacgtcggaaaaaggatcagaccctgacaaggagcggaaggcacccgagaaccacgcggacacaattgggtccggcagggccattcctatcaagcaaggtatgctcctgaagaggagtggtaaatggctgaaaacctggaagaagaagtacgtaaccctttgtagcaatggggtgcttacatattactcttctctgggagattacatgaaaaatatacacaagaaagagatcgatctgcgcacctccacaattaaagtgcccggaaaatggccgtcacttgccacaagcgcctgcgcacctataagtagcagcaaaagtaatggactgagcaaagacatggacaccggtctgggcgactctatatgtttctccccaggcattagttctactacctcgccaaagctgaaccccccacctagtccacacgcaaataagaagaaacatttgaagaagaagagcacgaacaattttatgatcgtgtccgccacggggcagacatggcacttcgaagcaactacctatgaggagcgggacgcatgggtgcaggccattcagtcacagagcgaagcaatggcactgcagtccatccaaaatatgaggggtaatgctcactgtgttgattgcgagacacagaaccccaaatgggcatcattgaacctcggagtgctgatgtgtatcgaatgttcaggaatacacaggtctttcgggacaaggttatcgagagtccgcagcctggaactggatgattggcccgtggaactccgaaaggtaatgagcagcattggaaatgaacttgcaaactccatttgggagggctcatcccagggtcagactaagccaagcattaaatccaccagggaggagaaggagtggtggatccggtctaagtacgaggaaaagctgtttctcgctcctctgccctgcaccgagctgtctttgggtcagcagcttctcagagccaccaccgacgaggacttacagaccgcaatcttgctgcttgcacacggctccagagaggaagtgaacgagacgtgtggagagggcgatggctgtacagctctgcacctggcttgccggaagggaaacgttgtcctcgagcagctgctgaccgggtggacttcctggccggaaatgccaacaggcacgcagcgctag
